United States Patent 9,328,346 (POLYCOMB-ASSOCIATED NON-CODING RNAS) - sequence listing, part 72

SEQ ID NO: 13435 - RNA, 87454 nt, Homo sapiens
cgucacuuccguucuccagcgcgcacgugggaggaagugcuggugcccucugccgcugcucccgucucuuugguuacgcucgucagccggucggccgccgccuccagccgugugccgcuaugggagucccggcguucuuccgcuggcucagccgcaaguacccguccaucauagucaacugcguggaagagaaggugaggaggcgccaggcggccgccacacucgagcccgggcccccggcacgucuaggccgcggcccaugggcuccgccgccugcccccggggagccuugccggagcucgcgcccugcugccagccucgcgagcagucgcagccccacacgcgaugggacgcgggcugugggauucagcaccccgggggcgaggaauucaggacccucggcggggcaagggccuauaggguuccgaacucgcaggagggucgcuccuccccuacucgcuuuuucccggcaccggaaggccccgcccacugcuuuguuuccucuccagaccgcgcauuuugggucucggaagagguucagaggcuguuguugagcaaugcaugccaggucagcugagcuagcggguuauggaugcacggauucggaggccagcuuuuugacaaccuuguaaaggaaucccuggcggcgaccuuuucguuguuuaccaauugugccggaaagguuuucuccuaguguucaggaccauuuguuguucugguuagauuggacgcugaaagcaguaugucagguccaggaugagcgcuauagaauucugagaaguuacccuucucugugugcccugacuacugaacggggugggugcuuguugaaaauuucaagauuacuggauguacuugagcaguacaauuuuuguuguuaguuaauacguaaguagauuuuuggccauuauugaguuuuguuuuuauuguuuucgucauuccaugcggauucgauuuugugcucuuaauuagaauuucuggauuggaaacguucagaggcacaucacgcguaccucacuccuuaguuuuugaaggcagugcuugccugucacugugaacuuauuucugcuuuuuuuuuuuuuuuuaacuuucuuggcuucuauccaaggaggaaccaaaagccuugucuuagugacauucccacuauuucuuguuuuuuucaaaaagcaacugcuaaauugaauacuuguuuccuuuguaaaauuuuaaucgaacuuuauugaacuuuacuugcacguggguuaaacaaaaagcaacaguucuugcucuaccccuucucaucccauuucuccaccuuuaacuguuuugguucugucucuaaguaucauacuuauacguuaucacuuuuagaucuguugaauucuagcuggaauaggagaggauuuagucaccuauucagcccucccucuauacucuuaauggaguaaaucacuagauauauauuuuuauugguaagcuuuauaacuaaguaauuugccuuuuucauuccaucgccuguguaacguaucccuugacucaaugcuuucuaaggucgaucuuagcuuuucuucccuuucaccucaaguuugucagcuguacuuuugcguugugggcauccaaaauuaaaugaucagggcuuugacuauacagauuuaaaaugcugaaaaaucagauaggauaguugacuauugacacuguguagauucagguuauguacugugauuuuguuuuuugugcugcuuuugucuuuuucccuggggcugucuuucuuuuuccacuuuacaucuugccgcgcccggacucuauuuuaccagguagucuaucaagagucaucuuucuucuugaauaguccuucuuggggucuuauuuauuuuuguugcugucacaccuggcuauucuguaggcuugcuggaaagcugcaucugggauuuuauuauuauuauugcuaucauaucuuucuucagugggagguacuguuuucuggaucaucaucuuacuucauuuguuuauuuauuuagagacggagucucgcuaugucucuuaggcuggaguacgguggcaugaucucggcucacuacaaccucuggccuccuggguucaagccauucuucugccacagcguccagagcagcuaggacuacaggugugcgccgccacgcccagcugauuuuuuuuuaguagagacggaguuuugccauguuggucaggcuggucucgaacuccugaccucaggugauccgccugccucagccuccacagugcugagacuacaggcaugagccaccauacguggccuuuuuuuuuuuuuuuuuuuuuuuggauuuuuaguagagacgggguuuugccauguuggcuaugcuggucucuguccugaccacacgugauccgccucccugggccucccuugugcuaggauuacaggugugagccacggcgcccggcccaucuuucuuccuuuaaaucguuuucuuaguuuuuauucuuaauucuuuuuuuuuuuuuuuugagacggagccucgcucugucucccaggcuggagugcaguggcucaaucaaucucggcucacugcaagcuccgccuucgggguucacgccauucuccugccucagccuccuaaguagcugggacuacaggcgcccgccaccacgccuggcuaauuuuuuuguacuuuuaguagagacgggguuucaccguguuagccaggauggucucgaucuccugaccuucugauccgccugccuuggccuccuuauucuuaauucuuaagaaaugcugugugggaugugagauuuccgagucauuguaggacccaaaauagcuccauucuacccuuauacacgugaaugaucauuagcuaggcauggaauucgagguguuuuuuuuuucuucuucuuugagacggagucuagcucugucacccaggcaggagugcaguggugugauaucggcucacugcagccuccacuucccggguucaagccguucuccugccucagccucccgaguagcugggacuacaggcgcgccaccacgcccggcuaauuuuuguaguuuuaguagagacggaguuucaccauguuggccaagcugaucuugaacuccugaccucaggugauccaccagccccugccucccaaagugcugggauuacaggcaugagccaccgcaccuggccaggaauuccaguuuuaauauuagguucccucagaacuuugaaagaaauuguucuuuuguacucucucaucuaguaguguugaugacaaguucgguguuaaugugauguauuuauuuaaccagcaguuauauagcauuuaccauuguuuuaagaacuuuauuauaacuuguuugauccucacaaccacaugacuucuacuguuguaauuauuuuuauuacauacaaauaauagaagcacguuauuuggagacaaccaauauuguuauuauguuauaauaauuacuauguuuauuggccgggugcgguggcucacgacuguaaucccagcacuuugggaggcugagguggguggaucacgaggucaagagauccagaccauccuggcuaacauggugaaaccccaucucuacuaaaaauacaaaaauuagcugcgcaugguggcgcgccuguagucccagcuacuugggaggcugaggcaggagaaucacuugcacccgggagacagacauugcagugagccgagaucccgccacugcacuccagccuggugacagagcgagacuccaucucagaaaaauaaugauuauuguuauguuuauuauuauuucagaugagaaaauggaaacacagcagggucgcguaucauacccaaggucacucagcugauaaaugucagagcuaguguggaaaccagaaggacuuaauuuuuaugcucauaugcuuucauucuuuugugaucaguuuuccuuccuagauuuuaaaaagaucuuuuucuugauaguguaaacuuucauuauuagguacccagguauagauguuauuuuaaauucagauucauuuugaucaguacguggcucacucuuugagucuggagucuuacguucuucgguuuuagggaaugcuguuugaugauuucuugaccuuuuuuucuucccuuuccagacucaggauacugguccucuuagacucauguauuuuuauuuuuauuuucucucucauucucuggcuuuccuugaaaccucccccaaccuuugguguuuuugcagcuuuguugagguauacuugacauagaauaaacugcagguaauuaaaguguacaauuuucuuuuaacuuuuuucgaguugaggucuugcucugucaccaggcuggaauguagugugcaaucauggcucacugcagccucaaaguccugggcuuaaaguauauaauuuaauacagugcauacaucugugaaaccagcacaaccaagacagugaacgugaccucuaaaacauuccuucugcccuuuuguaguuccuuucuacuaucccucccugccaccugucuuuugccaaccacugacugguuugcuuucugaccguaugauaaguuuucauuuucuauaauuuuuuauaaaugagauuauauaguauauacucauuuuuugccucaguuacuuucauucaguauacuuauuuugaaauucuuccguuguuguaugugucaguaguuuauuucuuuuuuguuuuuauuuuuuuuugagauggagucucgcucugucgcccaggcuggagugcaguggugcgaucucggcucacugcaaccuccaccuucuggguucaagcaauucuccugccucagccucccaagcagcugggauuacaggcacaugccaccacacccggcuaauuuuuguauuuuuaguagagauggaguuucaccauguuggccaggcuggucuugaacuccugaccucaaguaucugccugccucgucuuuuaauuuuuggauaguauucuguguguagauacaccacauuuuauuuauuuauucagaugauugaugaacauugggauuguuuccaguuuuuggcuuucugaaaaagaaaccuaugaacaucucuguacaagucauuguagggacguaugcuugcauuuguuugggggaaaaacauuaggagugaaaugguuggauuguauauuaggugugugauuacuuaaaaagaaaaaccugccagacuuuuuuuuucaaacugguugugccauuuuacauuggcaucagcagcauaucaggguuccaguugcucaacuuccucaccaacacuugauauaguuagcccuuuuaguuuuagguaguccaguguacuguuaccuuauugugguuuuaacuugcauuuccuucagaugcuuauuugcuuucuguauaucaucacgggcagggugaggcaucuguucagaucuuuugcucauuuuuaucuucgguugucuuacuuaaauguagaguuuguuacauauucuagauagaaauccuuaguuugauauaucuuuugcaaauauuuucucuugaucuguggcuugucuuuuuacuucuuaacagugucuugggagcaaacauuuaaaaauuuuaaugaagucugauuaauuuuuucccuuuauauuucugcuuuuuguauuuaaggaauccuuugucaaagccaaggucuccuguguuuucuuagagaaguuuuauaguuuuacuucauucugugguuuccauuuuuuggucuagucauauggugaauuaucggucuuuaaaugcuaaagccaccuugcauuccuuggauaaaccucacuugaucauguuguauuauuuuuauauacguugaauucaaguuugcuaaaguuugcuaaaguuuucuugagaauucuugagaauugugucucuguucacaaaagauauuuguagcauucuuguaauguguaguugagaugucagaauaauguugaccucaaauugaguuccuucaguuuuuuggaagaguuuguguagaguuaguauuguuucuuccuaaaauguuugauagaauuuaccagugaggccaucuggacuuggaguuuugugggaaggcuuuaagcugcaaauuaaguuucuuuaguugaucuagaacuauugagguuaccuauuuauuuauuuauuuauuuuuuggaugagcuuuuuuaguuuguaucuuucacagauuuugcccauuucaucuaagucaagcuuguccaaccuguggccugcaagcugcaugcaacccaggaugcuuugaaugcggcccagcacaaauucguaaacuuucuuaaaacaucaugagauuuaugcacagaccuuuucuuuuuuuuucagcucaucagcugucguuaguauuaguggcccaagacaauucuucuuccaaaguggcccagggaagccaaaagauuggacaccccugaucuaaguaguugaauuggcugacauaaaguuguucauaguauuuucuuacuauccuuuuuuuuuuguuauuaaaauguuuucacuccuguuuuuacuucucuuuuguuuucuuuuuucuuccuguuaacuuguuauuauccuuuuaauauuguuagaaucuguagugauguuaccucuuucauuccugauacuuguaauucuacuuucuuuguuuugucccauuaucagucuggcuacacuguucucagauaacuagcuuuugguuucauugauuuucuuuauuguuuuucuguuuucuauuucuuugauucugcucuuauauguauuuguuaugcuuacuuuggguuuaacuuguuuuuucucuuccuuguuuauuaagguagaagcugaggucauuguuuugagacauuucuuccucucugauauagaucuugagugccauaaauugccuucuagauauuguuuaaacagugugccacaaauauuaacauguuguauuuucauuuucauccacuuaaaaauauguucuaaaacucccuuuggcccgcugguuauuuaagagugugacuuaauuuucacacacaugggagauuuuccagguauuuuuuccuguucgugauuuuuaauuuaauucccuuaucagagaucauauuuaauuugaggucuguugaaguuuaucagacugguucagaauauggucucuauaaauguuuuauguguauuugaaaaggauacauuuucugcugcugugaaauuuugacuauaacuuuuggauuuuucuguuucuccuuucaguucuauugguuuuugguuguguauuuugaagcucuuuuauuaggugcauaaaugcuuaacauuguucuaguuuuuugguggauaauacacuuauuaugaaaugaccuucauuauucuugguuaauauuugcucagaaaucuauuuuauuugucauuaauacagccaguuauucugacuagugucagcaugguguguuuuuuucuauucuuuuauuuuagccuguuugcaucuuuauguuuaaaguggacguuuuuguagguaacauaacaauugggucuggcuuuuuuuuauuuuuauuuuuuauuuuuuauuuuuuuugagauggagucuugcugugucgcccaggcuggaguguaguggcgcgaucucggcucacugcaagcuccgccacccgguuucaugccauucuccugucucagccuuccgaguagcugggacuacaggcgcccgccaccacgcccggcaaauuuuuuuguuuuuuuuuaguagagaugggguuucauucacuguguuagccaggauggucuugaucuccugaccucgugaucugcccgccucugccucccagagugcugggauuacaggcgugagccacugcgccuguccgggucuggcuuuuuuauacaguuugagaaucucugcccccucuuuuuauugggauaaaacauacauaaaauuaccauuuugacuguuuuaaaguguacaauucaauggaaccaaguauguucaaauuguugugcaacugucaccaaugucuauuuccagaacaauuuuaucaucccaaacagaaacgcuaccuguuaaacaguaacuccuugucccccuccccacuuucuaucuuuauaaauuugccuauucuaguuaccuuauguaaaugaaaucauaauauuuuuccuuuugugucuggcuuauuucucuuaacauaguguuuucaagguuuguccauguuguugcaugucucagaauuucauuccuuuuuaaagcugaaugauacucccauuguauaugggaguauaugucacacucuggacacuuuggcugguucuaccuuuagucuauuaugaauaacacugcuaugcacauugguguacaaguaucuuuuuuagucccugcuuucaguucuuuugaguauguaccugugaguggaaucauuggaucauguaauucuguguuuagcauuuugaggaaccaccaaacuguuuuucuagucugcuuuguaauugggccauuuagaacauuuauauuuaaaaugauuauugauggccaggcauguuggcucacgccugcaaucccagcacuuugggaggccaaggaagauggaucauuugaggccaggaguucgagagcagccuggacaacauggugaaaccucgucucuacuaaaaaaguaacaaaaaaaaauuagcugggcauagugguacaacaccuauaaacccagcuacucaggaggcugaggcacaaaaucacuugauccugggauacugagauuguagugagcugagauuguuccacugcacuccagccugggcgacagagcgagccucugucucaaaagacaaaaaaagauuauugauaugguuagauuuaaaucugucaucuuacuauuuguuuucugucucaucuguucauuguuucaguuucuuaagucuuaugccuucuuuuagguuguguuuuuuuuugucuuuuugagaggaguuucacuguguugcccaggcuggagugcaguggcgcgaucucagcucacugcaagcucugccucccaggcucacgccauucuccugccucagccucccgaguagcugggacuacaggcgccugccaccaugcccagcuaaguuuuuguauuuauuuauuuuuuuuuaguagagacaggguuucaccguguuagccaggauggucucuaucuccugacuuccuggaauuacaggugugagccaccgugcccggccuuagguuguguuuuuaugauuucauuuuauucccuuugcucacuuauuaagaacucuuuacugauucagucaucagcuucuucacuucauauacuuuaacugcuuggcucaugcaguccuccauuuaucagcuuucugaccaucggaaaaugacuuaaaugccuaaacucuagagagccagagcuucuuguuaaaaccaaaccccaagauuuuuuuuuuuuuuuuuuuuuuuugaagacagagucuugcucuguugcccaggcuggagugcaguggugcaaucucugcucacugcaaccucugccuccuggguucaagccauucuuccucagccucccaaauaacugggacaaccagugugcaccaugacgccuggcuaauuuuuguauuuuuaguagagguuucaccacguuggcuaagcuggucuugaacuccugaccucaggcgauccgccugccucagccucccaaagugcugggauuagaggcgugagccaccaugccugggcccuagauaaauuaaauaacacaguucaauugagcaaugaacaguuugccaguugaguggcccucagaaccagaagagguuuggggagcucuugaaaacagaagugagguacagaaacagcuuaaucuuuuggcuuauuuaaacauggccagauaaguuggcaaccugugauugacugaagcucgacugcugcgauuggcggagacucugcuuuuuguuacagaaguaugcuccuaaguuaggcuuuuccuuaguggacuuuauguaaguaauauugcaguucuucaagugaagaaucaguaaggagccauccucaggccaaauuugguguaaguuaacacacuacgcuacacugugcugcucccuacaguuucccccucuggucaucucugugcaagggcugaaagcagaaggcugcguguccucauuuguugccagcugggaauguguauguugggugacucaauuuuucgcugcucugugcauguccacaaaugacugcgaaaguaccaugauuauuaauuuugggguuaaaaauaaauuucagugaguagacauauuugcaaauaugggauucaugaauaaugaagauuggcuauguauguaucacagagggugguuguguggauuagauguauuaauaccaguuacaauccuguuacagaagcauuugcuaaauggcaacuauuuggaaaaucugauuucagaauuuuauuugguaaauuaauguuuaguaguuuauguguccaaguaaaggcagagauguuuuugagucuaacucuugguaauacugcguuguaguguacaguguggucuuacuguucucauguaaugaaauccagguuuccuccacugccucuuuucucucuuccauuucauugaguacuacuuuugugauaggcaucacucugagggaagggagaaaaaucauaagguggacauuuauccuugacccuacauucuauuuucucuaauaugauuauuucuuuggagcugguuaccacauucuuuaaacagcuuuguugagauaugauuugcauacaauaaaauucacccauuuaaaguguacaacucagugauuuuuaguauuuucacaaaugugugcauccaucaccacagucaauuuuagaacauuuuaaucaccuugaaaagaaacuuguacccuuuagcuguugucccucuaacugcugucuccuuuucucccagccuuaagcaaccacuaaucuacuuuaugucuauauagauuuuuccuagucuggacuuucacaugagaggaaucuauagaauauggucguuucuggcuggcugcuuucacuuaauauuauguuuucaaaguucacccauguuguagcaugucgcaguacuuuauuauuugcuuauggccaaauacugugccauuguauggauauaccacauuuuguucauccauuugucuguugauaaacauuugaacaguuucuauguuuuggcuauuaugaauaaugcuguuuuaaacauucauguuauguuucuauguggauauguuuucguuuuucuuggguguauaccuaggcguagaguugcuggauuauaugguuuaaucauuugaagaacugccagccacuuucccagguucucgcucuguugcccaggcuggagugcaauggcaugaucauagcucacugcagccuugaacuccuggguucaagcgauucuccugccucagucuccugaauagcuaggacuauaggcaugugccacuaugcuuggcuaacuuuuuuuuuuuuuaagagaugggguuucucuguguugccuacuggucuugaacuccuagccccaagugauugcacuauuuuauauucccaccaguaguguaugaggguuccaauuuuuccacauuuuugcugugaagcagguuuacuguguguugcuuaccaacuugucugagucugaggagacaaggacauccauguacaauguuacaugaagaggguuuauuauuuacaaauagacaguaaaggacaacagaagccuaggauucauucugaaugggucccccauggcucaggaaacaugcccggggcagauagagucuugacugcaggggccacacuuacauggcgggagaggaacccugaaaggcagcccacucuggguuauacaccucaggguuuaugugacacacugagcuaaugcuuuaaaaaauguccugcuuccaggggugaaaggaacaaagcccaccuugucccgggcaguugcgcccucacucaagauguuaaauuccugggagggacaggagcaaggcuggacauuuucaggcaguucuucccuauuucaggauauugcauuaccaucacauucuacagucacuuuugagaacuaugagcaagaaaaggaacugaguuaguccaaggccagccaaagaacuaugccacacuugccaacacuuguuaucugacuuggcuuuagccauucuagugggugugugacgugguaucuccugugguuuugauuugcauuuucugaugacuagucguguugagcaucuuuucaugugcuuacuggccaucuguguaucuuuuggagaaaugucuauuuagguucuuugucuccucuucccccuuuuuuuugagacaggguuucacucuuguuacccgggcuggagggcaguggcacaaucucagcucacugcaaccuccaucucccagggucacguuauccucccaccucagccuccugaguagcugggacuacaggcaggcaccaccaugccuggcuaacuuuuuguauuuuggguugagacaggguuuugccauauugcccaggcuggucucgaaucaacuccugagcucagaugauccaccucccucagccucccaaaguguugggauuacaggcgugagccaucauacccggccucuuugcccuuuuaaaauuggguuguccuauugaaguguaagaguuuuaaagaauguauucugaauauaagucccuuauaagauaaaugauuugcaaauauuuucccacauucuguggauugucuuuccacuuucuugaugguguccuuugaagaauaaaaguuuaaaauuuuguccgguuguggugacucacgcuuguaaucgcagcacuuugggaggcugaggugggcagaucacuugaggacaggaguuugagaccagccuggccaacauggugaaaccccgucucuacugaaaauacagaaaauuagccgggugugguggugggcgccuguaaucccagcuacucaggaggcuggggcaggagaauggcuugaacccaggaggcggagguugcagugagccaagauugugccauugcacuccagccugggcaacaagagcaaaacucagucucaaaaaacaaacaaacaaaaaaguuuaaaauuuugaugaugaagugcaguucaucugcuuuuuucuuuuaucguuugugcuuuugauggcauaucuaagaauuccauugccaaauucaaggucacaaauauuuacaccuguuuuucggaagaguuuuauagcuuuagcucuuaaauguagguucaugauccauuuugaguuguuuggguugaguuaaggugugaaguaauaguccagcuucacuuucuugcauuggcuaucuaguuguccuacaccauuuguugaagacuguucuuuuccccauuaaaugaucuugacaccuuaucaaaaaucagcuaauaauagcugugugcauuuauuucuggacucaauuccauuccauugaucuaaauguuuauccuugucccaguaccgcacugucuugauuacuguugauuacagagcacguugaauuugucaaucaguuuggggaguauugucaucuuaauguugagucuuguguuccauaaauaugggauguuauuuguuuagaacuauuuugauuucugucaacaguguuuuguaguuuucaaaauauaaauuucguauuucuuuguuagauuuagcccuaguuuuuugauacuauugugagaauguuuuaacuuuauuuuuggaauacucauugcaaguguauagaaauguaauugauuuuuauauauugauuuuguauccuauaaccuugcugaagucauauaucguaauaauuuucuaguggaucccuuaggauuuucuauauacacaaucaugucaugugcaaauauaguuuaauuucuuuuuuuucuaauaucaauaccuuuuccuuuuccugccuaauugcccuggcuggaaccuccagaauagaaguggcaagagcaggcaucuuugucuuauuccucauuuuagagggaaagcauuuaggcuuugaccaccaaguaugauguuaacuguuagguuauuuuuuuguuuguuuguuuuuguuuuugcagaugcccuuuauguugagaauuucccuucuauuucuagaugaguauuuuuuuuuuuaaucaugaaaguguuggauuuuucgaacgcuuuuucuauaugaagaugaucgugucauuuugcuuugcaaucuguuaauaugauguguuuaauugauugguuuuuggauguucaacuaacuuugcauuucuaggauaaauccuacuuggucaugguguauaauauuuuaauauauugcuggcuucuguuugcuaguccagucgucuugcaguaucugugagggauugguuccaggaccuccuguggaugccgaaaucaacggaggcucaaaucucugauauauaaugguguaauauuugcauauaaucuaugcacaucuucucguauauuuuaaauagucucuggguuacuuaaauaccugguacaauguaaaugcugugugaauaguuguuauacuguaccauuuagggaauaaugacaagaaaaggucugcacauguugaguaccaacgcaacuguccauuuuuuuccugaauauuuuugauccaugauugaucuauuccacagauguagaauugacagauacggagggcugacuguauuuuguugaggauuuuugcauccaugcucauaagagaugcuggucugcaguuuuuucuuuuauguuuuuguguggucuugguauuggucauauuggcccaauaaaauguguucggaauuguugggaagaguucaugaagaauucguacaaauucuucuuuugaaugucugaugcaauucagcagugaagccauuuacacuugacuuuucuuuuggguaguuugcggauuacugauuuaauugcuuuaacuuguuauggguuuaugcaguuuaugucuuucuugaaucauuuuugguaguuugugucuuucuaguaauuuguccauuucaucuaaguuaucuaauuuguugguguaugacuauucaugguauuucuuuauaauccuuuuuguuuuuauaagguuagcaguaauguccugucucucgucucugauucuaguaacuugagucuucccucuuuuuucuuucaucagacuagcugaagguuugucauuuuuuguugaccuuuuuaaacaacuagcuuuguugguuucauugauuuuucucuauuuuuaaauuuucguuucauuaauuucugcucucaucuuuuauucuuucugcuugcuuuagguuuaguuuacucucuuuugguaucuuaagguggaaaguuagguaauugauuugagauuuuuuuuuuaauuaacuuuuucagagccaaauacuucugaagagauauuucuuaaucuaagcauuugcaacuauaaauuuccaugugaacacugcuuuauauguauuccauaacauuuuguauauugugucuucauuuguauugaucccaaaguaguuucugguuucccguuugauuucuuccuagaucccuugguuauuuuggacuguguuguuuaauuuccacauauuugugaauuugccaauuuuuuuuucucuuaaugguuucuaauuuuauuucauuguggucagaguguauacuuuguauuauuucuaugcuuuuacuuuuuuugagagcauauuucguguacaccugagaauguauauucuguuaaguguaaugugcuagaaauaucuguuaggucucuguugauaguguuguucaaauuaucuguuuucauguugaucuucuguuuuguucuauuauugaagggggaguauugaagucuccagcuaucauuguugaauugccauaugucuuguuuuguguauuuuggugcuguuauuaggugcaccuguauuuuuaauuguuauaucuuuuucuugauggauuuacuuuuuaucguuauaaaaugacccucuuuaccuccaguaacauuuuuuuauuuguuuuagucuguuuuaucugauaucaguauagccacuccaguuuucuugugguugcugucugcaugauuaucuuuucucauccauuuacuuuuacucuuuugggucuuugaaucucaaguguaucuccuguagauaacgcagaguuagaucauguuuuuaaaauccacuuugacaagcuaccuuuuuguuggauuguuugauccauucacauuuuaauguaauuauugauagaguuacauuuuacuuuuuguuuuuuguaugucucaugucauuuuucucuauuucuccuuugugcuuucuuuugcaaugagaggauauuuucuaauauagcauucaaauuuuuuucuuuucuuauucaguggccaguuacuagaaggauucuaaauucauuaguaauuuuuuccacuauauauuuuuucaaagucauuguucuagagcuuacccuauguaucuugcuagaaucaaauucagauuuauacuugcuuaguuucaguaauacaugcuaaaauuuauugaacuuuacugcuauauaguucaguucccauccccccuuuguauauuauuguuauauauauuacauauauugacauaauccaacaauacauuuuuuuaagaguuacuuuaccgucuguagccauuuccuuagcccacugcaacuuuguuuccauccaccccuuuuugcuauuagggcaaauauauuacacauauauuacauucugccuuauaagcucaacauuauacuauguaauauuuauacaauugcuuuuuaauucaauuaagagaagaaaggagggaaaauauacuugugcuuauuguuugcauggacuugaauuaccaucuagagucacuugcuuuaguaacuuuaguaaacuuuuuguaacuuuauagcuugaagaacuucguuuaguaguuuuugacaguguggucuguuagcaauaauucucucagcuuuuuauugaucugagucuuuaugucaccccaguuuugcacuauagcuuuucuggacugagaauucuugguugacaggguucuuuuguuguuguuuguuuguuuccacuucuuuacugcuuuuuauguuaucccacuaccuauuggcaucauuuauuuauuuauguauuuauuuauuuauguauuuauuuauuuauuuauuuugagacggagucuugcugugucacccaggcuggagugcaguggcacgaucucggcuuacugcaagcuccaccucccggguucacgccauucuccugccucagccuccugaguagcuggcacuacgggcgccugccaccacauccggcuaauuuuuuguauuuuuaguagagacaggguuucagcgugcuagccaggauggucucgaucuccugacaucgugaucggccugacuuggccucccaaagugcugggauuacaggcgugagccaccacgcccggccuuauuuauuuauuuuugagauggagucuugcugucacccagguuggagugcaguggcgugaucuuggcucacuguaaccuccaucucccggguucaagcgauucuccugccucagccucccgaguagcuggggcuacaggcaugcaccaccacaccuggcuaauuuuuuguauuuuuaguagagacgggguuucaccauguuggccaggcugaucucgaacuccuaaauuguagaucuuuccaggaauuaguuucugacgucaguguuugguauuugugcuaacaccaggagggcuccucccagccaucuuaaucccgaguuuucuucugcaaacuagccuguaguccaggccuguaucuucauuagaucuauuagucuccucccaguugcucuucaccauagcuugcacuguuuugguuuguuucuuuguauuugagacagggucucacucuguugcccaggcuggagugcaguagugcgaucuuggcccacugcauccucaacuuccggggcucaggugauucucccaccucagccuccugaguaagcugggauuacagguaugcuaucacaccuggcuaauuuuuuguagagaugagguuucaccauauugccuaggcugaucccaaacuccugggcucaagugcucugucucggugucccgaauugcucugauuauaguuaugagccacugugccuggcuguguguguguguguguguguguguguguguguguguguguguguguguagggucucauuuugucaccuaggcuauagugcaguaguggcacaaucagcucacuguaguuuccaacuccugggcucaugcagaccucugccuuaaucuccuagguagcugggacuacagguacaugccacuguaccuuccugauucuugauggggcuccaggacucuuauguuccccaggcuggccuugaacuccugggugcaagugauucucccgcuucagccucccaaaaugcugauuacaggcaugagccacugggccucauucuacuuucacuguucuugagaacagcuuuuuuuuguuuguuuuuuaaacuuuacugugcacuuuugcaaaugaauuuuguucuaaaauuuuuacagguuuucuugauuugcuugcuguuugcccucaggaucauuuccaaaggcuuuaaauguuuuuguuuuaaaaguaauauuuaccaguuucacuggggagcaggucguugaagcucuucaugcugucauguuagaauaaaaucuucugauaagacuuuauuuagcaaaugaugaucaaugucacacaccuugccuauuuuguauccucuguaguaccugauauagaccuugguacacaucacuuugaaucuagugaaauuacaauuaauuagucuaacauacugguuaagguaccaucucugagucaugguuuuaaauccuaguuccugaaucuauaguagugugacuuuggaaaagccacuuaaccucucuaagcauuuguguucuuaauuguaagugggauacuccagaccucacaagguuguugugaggauagaauggaauaauccaugaguaaaagcccuuguaacagugcuuaucacguuaagugcuccguaaaugcuagugguaauuauuaguccucauucacuaacgucguauaaaaaugaagaucuaacacacguacaacuugaaaaaauacuaaucacccauaaguguuaaaauugucuuauuauagguugaauuuuuaagccaaaauacuguaauuucaauuuuucauuagcccuuuggccauuucucucuaaaauaucacccaugguuugaauuucuuuucauaguuccaagcuucuuuaagggaaaucugaaacugaguuguaugguuuggcauaugacuuccaucagugggauacuccuguugcccuggaaccucagacaugauucaugguuuuucuaauguuccuguuaaauccuuuguagguuuaaacaaaaacaaugcaucuacugagcuauugguggugguuucuccucauaagguugacuggaacaguggguuggcaugaaauucauuuuagggauauacuucaaaaccuguguaauguauauuuauacaaacauuauuuguauauuuguauuaucuuuacuucuuuaaauaccuucuuuaucuugauuucuuggcauuuucaugcacaaauauaaugauaucccaacugccuauuuggaauaaauauauccccugcuuuauccaugaagucacgaaggagcaggcuuccuacuaggcagagcuaccuugacugccagccuucugguaggggugcucucuguuccuuccuaggcauuguuacucagccagggcacugcacugccuuucuaaccuaagccuucacauucucugggagcuucugucucaaguugccugguucacaugggaccugggugggugaagggagaggagagggcaggaguugacccaucuggcuguugcugugacuggcgcugaugaaucauccagaagcugucccuugagccuccucucugggccuagagcccucuuguguuagcccaccuuuggcagcauaucucuucucacauguuggagguacugcacuccaucuucaguuagggcuauugguugcccauauuuuagguaucacucaucauuucucagccacaaauucugguuuuccgccguaguuauacaguagauuuguuuguuuguuuguuuggucuuucauguggucuugggguagaaagggaagacugcaguguguguucagucugucaucuggggaauccaaaaaauaauuaaaagucauuacuugaaauacauugguuuuaggguucagaguggcucuccuuuuagcugcccuuugauuaaggaucucucuuuaacugaacaggaaacguguugguauagcauuggacaagguucuugaggagucaguucuuuguugagcaucagagucuucucuugaugaaaggaauucuaaaguuacauaauaaguguguuggacaugucuacaguacucuugaggggaaaauauauucaguuuucuuacugggaauaccuggagcucuuuucucaaaauuaggacccaccuacuccguacuuuauuuuuuuuccuagguaguagaaguagaaauucucauguagcuccacuccauaugaagagcugugccuuuucuugugcuaggcacuagggcagggauuagccugcuggugacguccuguuuuugugagucagguuuuauuggaauacagccauguccauucauguuguguuguuuaugguugcuuucacucuucaaaggcagauauuaguuguugcagcugagaucauauggccagcaggucugaaauauuuacugauuuuuuuccuggagggcacaaagaaugaguuuugauuuuccugaguguggugggccguuggacaggaugaagguggauguggacuuugggguguagagguuagaugaagaggcagagagccucuugccaucauagaguuuguuuuaauuuuggggucaucaaauuaucuuuuucuauagacuccacccacccccccaagaauugaccugcuuuuuucuuuaccacuuauuccacucacuguuccugaucaagccuuuuuuucuugauucacagcauguauguacagaagauugucuaguagcuucuucucuguucugccuuaaaucccuuuuguuauucuuucccuccaauucuaagugcaacuugaagcccaguugcauucccgugauuccuucucaaagacagucaauauccugaaguugguguuuaucauuccuuugcuuuucaccaugcuuucauugcauauguauucgucccugagcaauauugaaugcuguuuuauuuauucauaacuuucuguaagugguauacuguauauguucuuuuuuuuuuuuuggccuaguauguuugugaccaucuagcucuagcucuuccaaucucacuugcaucucacaaguauauggauguuauaugagcuuauucuuuuccugaugggcuuguuuccuuuccucuaaguugaucuguuuacuuguuuaagagaugagaucuuacucugucgcccaggcuggcauacaguggugugaucauagcucacggcagccuugaacuccuggccucaagcaauccucucaccucagcuuccgaaguagcugagacuacccgcacauaccaccauaccugauuuuaaauuucuauuucuaacagcuuuauugagauauaauuuguguaucaugaaauugaccugcugaaaguguaugauucagugguuuuuaguauauuuacagagcugugcaaucaucacuauuaucugauuuuagagggucuucauucucaaaaguaauuagcaguugcuacccaucucccuccccugucuccacccucaccugaagcaaccauuaaucuacuuuuuauauuugcaaacaugucuauuuuagacuuuucauauaaaugggauuguauaguacuugguacuucaugacuggcuucuuucacuuaaccuaauguuuuugagcuucauccaugauguaguauguacaugaugggcuuuuaaauugcuuacaguuuuugcuguuacaagugaugcuuuauaugugcuugaggaacuguuauuuuuuuaagugacuuuuauuguuaauaguaaaaauuagaucucauagucuuaaucucuugcugaggcucuggaagagaaaaacaaaggaaguaacauuuacaaaaacauaauugaguaucucuggcagugaguaagcccuuaucuuuugaggaacucaauguagcugggguagauugacuaacuguaaaacaguggaagugcuacaagugaauaagcaaaauuaugaggaaauucagaaggaacaauuucuugggagauauguacaagguguuauaaagugagugacauuugauuugaguguagacccuggaaauuaguaauuuuucaggaaguggguguugacaagggaggaagaagguguucugaaagaagcaucaugugacggcauugagagaucaaaaggcauuuuccaggaacuuacaagagagugagugggcuucaacaauaguauggcaggauaggagacuaggaaggcuccaggcucauugauaaacaccugcugugagaaucauuagaaaaauuagguaagauuaaggacguacacuuuuauguuuuagaaagagaacucugacaaugcagaaagugagcuggagaccagagagucuagaggugggguagacuagaugaagguuguugugcucuuuuagguuagagaugguaacuucuuguuguucaugguggugggaaugaaaggagaugaaguagguaagcauuuuuuacguuacuuugacaggacuuacugaugugaguggugagggaaaugaauuuuaagaugacucccaugauuucucacuugaacaaccugaaugauuugugaauuuucuaaacaucuacauugucaaaaauaacuuguguuagaagccauccacuuucuacagauaaaauaucugcuucaguuugcuuuaaggaauaaaauaacuuauuauaauuuaaagguuacuugaaguguuuuauuuccaguucagaaaugaaacacaaguucauauugagccuaggaucugucauuuuuagacuugaacaaucaaacuacuauuaauuaucacuuccucauagccaaaagaaugcaaugguguaaagauuccaguugaugccaguaaaccuaauccaaaugauguggaguuugauaaucuguauuuggauaugaauggaaucauccaucccuguacucauccugaagacaaguacguaacccauuuuugucacugauauagcaaaucacagaggaaacauuauauuauauuacauuguuugguugucauuauagaccagcaccaaaaaaugaagaugaaaugaugguugcaauuuuugaguacauugacagacuuuucaguauuguaagaccaagaagacuucucuacauggcaauagauggagugguaagugcuaaaauaauuagaagccuccauuuuguuuuuuuuugcuguguuaccagugucuagaaugaaagucagcuaaauaaugaaaaauguugacagugaugaacuugagaaagaaagccucauccuucagucauucauucagauguuuuuuuguguguguguuuugugcuuauuuugugcucaguacugugaaauacuggggauguuggcgacugcccuugcuuuugaacuuuuggcuuacugucaaagggaaggaggcauagauaaaugggugagcuuaauuauuuauaggcauuauaagcacuagauaauacaugcaggguguugagggaagaggaagucagugcuacuaaggaaguuaggauauagagaagaggugacuuuuguuccauuucuuuaacaaugaagaauaauugggagauuggugggugguggugggagauggaugggacaggguuuggggagggaggaccuuccagauuucucaaauguggcagguaaacacacuuuccgugccuuugaccacacugacauguuuuggcaacuacaggugguuugaauugagaagggaaguauagcaaaagcuugagaaagccuuaccgucuggaguuuggacuguauccuauaggcaaugaguagucaugaaaaugauuugagaggaguaaguuacugaccuaugauaauaauaccaaguagcuccuuuuauaaaugaccagcaaacucuauuagggggguaagguaagauauaacucuaaauuuauuuagcuaucugcaaguagauucuuuuaauuuuagugcauccuagcggcuaaugggaugauuuuggaaauucagagaacuuugaauccaagaagauuaacuuuucugugagauucgucuuacucagugaaaaaccuuagcuaccugauaacuugcuaaguugcaguuagaauggaguaaagaguaaaaagaaaaggaauaugucuuguuuagagcacauuucaguuuauauucagcuaauuuuuuuugaagaaaucuuuagcuuuacuccaguguguucuuucugcuacaucaaguauaaaauauguacacauuuauaugcauguguguguacauguuuauacacacauuuuuuuguuuauauauaaauguagauacagaacuuuguacuugagagggcuucauuagauggucucauucuacagaaaagggaauuguuuaaagagaauauuaaauaacuuacauuuagauguaaacaggauauuucacaguuucuucccaccccaaaacucaguucaguaacuucgaaaaucuuacaaucuaguucacuuuauuugggcuuuuccacugaaauugcauuugguuagagugauuuaaaaguacuucugguuaaggcauuauuucuuucuaacugcuaugccuuauugaaaagacagaaaaauuauaaaccuuauugugggaaauagaagugcaccgagauucuucacauaaagaaauaguuuucuguugcuuuuaugagacauuguggaucccauuuggacaccauucuuccuuuuagguguggacauagagaaugucuuccugaucuuaguucaguaguaacugcucaucagauguuggcugggucuuuugaguaaagugagcuuucuuucuugggugcccugaaucaagcacccuaaccgaggggaacugguguuagacugggagggcuugaaguauaagugcuagggcuucauaggauguuuguccauuugacguggcacucauucaccugauugagcucagcuuuuggguucucgguccaaauuuaaguucucagcaucugguaucugucaugaaaggauuauuagacacauuacuuaccuuucuuccauuuuaguguacugcuuuuauaagaacaacugauucaaaauaagguacagauuuauuugugaauauuuugaugaguguuauggaauaugaaauacauuuucaggcaccacgugcuaaaaugaaccagcagcguucaaggagguucagggcaucaaaagaaggaauggaagcagcagucgagaagcagcgagucagggaagaaauauuggcaaaagguaaagaauaugcaucuugaaguuggauuuuuucauaagauguaugcagaaugagggggugguggcaacuuuuucuuacaaagaggcaagcuuuuaauuuaauaaggaucccagaauauccaguguucacuguugaggaaaaguaguucaugaaaucuaccaauaggcuuaauaggcuuguuuauuuucaaacucuccaguaagagggagccuugggaauagggaauucugguggagauugcagauugucaacuccucucagggccagugcagcucuuuaacaaacuuuuaugucucuguagaauagaaauauaguaaguauuuuuuacuacuuuucucuguggcggcugucagaaagcuauagugcuguaaacauuuuccucaaaucagcuuugguuugcuugcuuuuugaaacucagaggucuaucugaggaagccggaggugauucgauccacauuuacaggcuguugccaagucauuugcauacuuucaauauagguugauggagcaggcacaguacuuaugguuccuucaaguuuggagggguuagggugggaugucuucauuuuugcaguuccccaaagccuuaaaauuccugguggcuacauggguaggaacugacuaagccucagagaaaaggaagaucagggaguguugaugccaguugggacugguucucuccuaccacaccugugugugagguaggguaugguuguagcagguuuguuugguguucugcuacuuaaggggguauaauagaccagaaaagccacagugucuuggcuccggauaauugcacucugcaguugaaaaaggaugccauaguauagccagcucaggccugcaauuacaauaaauuuuauauuacuugaauuuugcuggaaguguacaaguauauaguuccuuuagcugcaacuuguaauuaagacucuaaaaccuguuuguauuuauaacaauguuucugauuuuaagaaugucuuuuuuuugaagaugugaugaaauauacuuguuucuugagaagcagcuaauagugauagagaggaaaaaauaggauuuuuauauuccucuaccugauaauuguauuucuuauccuguaaagcugugaugaacucggcauuuuaaauuucauuuuucuuaggcaccuuuauuuuaggaacuguuaucaaaaaauauggccucuaacugguguguguguguguguguguguguguguguguguguguguguauucucuuacagagugaagaacuucauaauuuuuauguaacaauauaauaucuuuuguguaccauauauuguuuuacagucuuauuaaaacauaauuuaaaaggcugagcacgauggcucaccccuguaaucccagcauuuugggaggccgaggacggcagaugacuggaggucaggaguucaagaccagccuggccaacacaaugaaacugcgucucuacuaaaaauacaaaaauuagccaggcgugguggcaggcgccuguaaucccagcuucucaggaggcugagacaggagaaucgcuugaaccccggaaggcggagguugcagugagccgagauugcaccacugcacuccagccugggugacagaaugagacucugucucaaauaauaauaauaauaauaauuuaaauuugagagauggaaucuuauuuucuucccagugagggaacauuuuuccucggaugacgagacuucacuuucuuuuguaguggaacuuuuuguuuuuguuguucuggcuuaauguugaguaauuuaucucacuuuuuauggggagaacaaaacguugccucuuuucucuagguggcuuucuuccuccagaagaaauaaaagaaagauuugacagcaacuguauuacaccaguaaguagucucauacuuugcuagcuauugcuaacucuuaaaugauagguuaauuuauuucuuucuaucauuuuagggaacugaauucauggacaaucuugcuaaaugccuucgcuauuacauagcugaucguuuaaauaaugacccuggguggaaaaauuugacaguaaguuucacauuuugauacuucagaaagauuagggugaucauucgaggcuguacuuugauaugacugacauuauuuauccuucugcccugccccauaaaaugcuaguugacuguuggaagaaagaaaagcuuccaggguuuuuggagaugggguauccuugcaugguuagguuuuagauagcugaauuuucucuuaaagccaauuuuguccucuuaccaucacuaugaagcuauaaaaugggauucauaauuuaaaaaauauauauaggaaaguaauuuuuaaauggaaauuuccauuauuacauaucaauauacagcaaaauuaguaaguuguggggcugucuuaaauggcuguguucccaaauauuuaaauaauauguaaaugaacuuguuuguaauuuuagguucauaagcuggcuucccuauuaaugagaaaugguaaauuauauuuuauagauauguguuauugauuauucuuggggcauauaugguucagcacuauauccuugcauaguagugaaaauaggagcuugugaaugaucaguuuuucugauggcuaggucugacccagacauuucauuccuuuccauuacauguaguaagucaaucaaugaagugguuuuggugucucucacacacacacaccccuucuuuauucagaaaauuuucagugaaguaguuuugguguuuuucacacacacacacacacacacacacacacacacacacacccuuauucagaaaauuuucccguaacacuuaucucaguuuuucuugagacauauaauucuuuugauuuuugugccuauagaaaauuggggauaaucugaaaguguuaacaauuuuuuuauagguuauuuuaucugaugcuagugcuccuggugaaggagaacauaaaaucauggauuacauuagaaggcaaagagguaaagcuuacuuaccaauauuugauuauauguucuauuuuuaaaaagccauugcauagaaaauacuugguaugaagugauauucuugugguauauaauauauuaauauaaauacauguuucucucuuguuuagcccagccuaaccaugacccaaauacucaucauuguuuauguggagcagaugguaaguuucuucuuugggauuugcuucuuuuggauuaaaccauagcaaguugauggguuggugugcaguaauggauuauucaugguuaccuggaaguuccaaaaugccuugguuauuuuauguucgacagggaacuaguauugaguugcuguuuaaucuguggucaaugaucuuuaauuucuuuucuucuuucuuacauuuuucaaccuuuuaacuccccauaccuuuaaaauggagaauuucccaaguguuuaauccuuaguggcagucuauguuguagguccacguaucuagaggacuuccuguuaacugggaaaugccaggaagugucaagcuuuggggcuuugcugcucauuugggugcucauuugggcuuuucuuuguguuggcaucucauaguaguuuaugguaagacuucucucagaauacucacuguucgauguuuuucucauuguugauugauagcugaucucauuaugcuuggccuugccacacaugaaccgaacuuuaccauuauuagagaagaauucaaaccaaacaagcccaaaccauguggucuuuguaaucaguuuggacaugaggucaaagauugugaagguuugccaagagaaaagaagggaaagguaagaacuuugagaugguaguugccucauuaaaaaaaaaaaucuauugugguaaaauguauaugacauaaaauaucauuucaaccauuuuaaaguauacaauuaaauagcauuaaauauuugaguuaccuuguuuuuaaaauggaugaagagaagauugugguugauuaguucuuuaugugcuuguucuguuaccguuacccuucacagagauguaucuuuuuucuuuuuuuuuucuuuugagacagucucgacagagacgaaucuuuuaaaguacuuuaaaauaaaccugcauucaaaaacaugcacacacucauccuuucuacuuagcacuuuuucugauauugccuauaucuacacgaggcuuaguucccauagauaauaaugcccauagcuuguaauuuguuuguggaaguuauuuguuugaaauacucuucuuaaaaggaacuacaacuucuuaagacuuuuaaguuacucccacuuuuuauguauuuuagguucacuugguuauguccaguccccuuuaaaggggcuucuguuucaauaauauggugccucuugagucauaugcuuuuugaggggggaaaaagaauauggugccucuuucaaagacaucguuaagugaaaaaagagauaaauauaguguauuauuucagauauguaauacaauaaagacaguauacauguaucuaugcacaucuguucacaaggaagggguaaucauugguuggguauaggucaucaguuggcaaacuucaauccuccagguuuggccugugagcuauguuuuuuacauuuuuaaaguguuguuaaaaacaaaauaaaacaugaaagacuauuaaacagagaucauauaugucccccaguagccaaaauaauuuacugucuggcccuuugcagaaaauguuugcugaccccugaucuagacgugguugauuuuauggguaauuuuuauuuuaaaaugcauuggugagcuuuuaaaaauuaaauacuugugauauuaaaauggauugugcguuagaaaaagccuuaaaauuugcuugguuggaaaaaauuacuggacguagaguagacuuguuucaucuucauuccuguucuugcagcaugaugaacuugccgauagucuuccuugugcagaaggagaguuuaucuuccuucggcuuaauguucuucgugagguauguagcaauaaucauugaaaucagcacucuaaagcagggugccuuugauagcuguaauggcagcauuccuuuuugguuguaguauuuggaaagagaacucacaauggccagccuaccauucacauuugauguugagaggagcauugaugacuggguuuucaugugcuucuuugugggaaaugacuuccucccucauuugccaucguuagagauuagguaugugcauuuguguagcuuuucaaacgacuguuuuaggcuucuugacuuuacugugccuacugguccuaaugcauaauguuugucucuugcugacagggaaaaugcaauugaccguuugguuaacauauacaaaaaugugguacacaaaacugggguaaguucauucuugaaugauuucaaaacagaaguauuugcuuuuauaagaagaucauuuuacauauauuuuaucacuuacaggguuaccuuacagaaagugguuaugucaaucugcaaagaguacagaugaucauguuagcaguuggugaaguugaggauagcauuuuuaaaaagagaaaggaugaugagguaaaguguuucuauugcaguagcuaaaauugcuccugucucuaauaggcuaugaugauccugugauuacuuuuaaucucuuugaguguguuuuuauaucauuauggugugucaacacuaauguaaucaugaguggucagugcuuugauuauuuuauaaagguugugcugcuugcucuguggaacuauguauuguacccuguuugaguugcauuguaauguuuuuucugucuucauaaucugaauauaaauccaaacacauuucuaaucaauaggauuugaaaugcggguaccaaggcuggaagucuauugggauugaacuaguggcugucauguuuugaaggcaggaagacagguuaagaagaauugacaauguagggaguguggguuggauuauaucagccagggcagaggguugggagaauguaggaucuguggagagcugaaucucuuaaaaaauugaaacacaagaaggaaauaaaauagcaaagcauuugaaaauugauugcauauuauggaugagcgcuuacaugaaaaguccagguucuggcuugggcaguuaggaauuugcuggugccauuuacuaagauagcaagcacuagggguggaauggguugggguggggacaaaguaaaaacugaguuucauuuuggagauguuuaaugugagggggcuguaggacaccugagaggagaaaaguccauuaagcaguugaauguguauaaagcucagggcagaagucuuuugaagagauuugagaaccauuaacuaauggaagauacuugaaacuaugaguguacuaugagugugacccugggagcuuguguggaguaaaaguaccuuuaauagaagccuagggaaccacggacauuuaaagagaaagaggagccaguuauagagagguagaaggaaauuccugaagagaugggaagccaugcucaaggggucacagugagauggacaggcacuucguccguggacaggguuugggauccacuggugagcugauaggaguggaggagcagcagccuggaggcagagugauuggagggugauugcaggguguagcaagggaggccagcagugggcaaaauaagcagguaauagcuucuuagaaacagcaaggaaauccuuucagaaacugauuuuauaaaagucauguggcuauuuuaagcagauaacaacauauauuacugcuacauugcuucaugaucucccagcacauuaaaaugugucauugaaucuuauuuucuguuuucaucaacuuuguauacuguagcuagugaucucuuauuuuuaaaacuuugggugucauuuuauguaacauaguggguugacuguaagcauucuuuccaaaagccuucaguacuugguaauguuuuuaugugaugucaagaguuuuuugcauauagaauucaaauuacagaacuagcuuugucuggaagaucagaugucaauuggaacauuuuuaacuacuuuuucaacaauuaugguggcaucccuugaucugcugcuacauacuuuguaccacuugguuuaaaaaccuugaguuacaguagcuucuacugucucuuuagccgacucugcaccuugaguuggcauuagaggaggaaguaugggauuugguagacaccauaguguuacagauuuaauuaauacgauuuuucagcugaccuggcaggagagggcauuuuaaagcuuuggaucuuuguugguguuccugaagucaugccauguccuucagcaugauuggacaccaggggaaacccucaaaaacgcaauaggaaaguuuccagauauauguauuuuucugggaaguaugucccuggcauuugacagauuuccaaaggaguucauagcacaaaaaagggagagauccauaagguccacccagguggucuucuguuugugcgugacuaccacccuuagagauaggcauuuaacagaccagcagaacaaaugauagaaaaggaauacauuaauauuuguuauuggcuaagcgugguggcucaugccuuuaaucccagcacuuugggaggcuaaggugggcagaucaccugagguuaggagcuugagaccagccuggccaacuuggugaaaccccaucucuacuaaaaauacaaaaauuuaagcugggcgugguggugggcgccuauaaucccagccgcuugggaggcugaggcaggagaauugcuugaacccaagagguggaggcugcagugagcugggaucaugcuacugcacuccagccagggcgacagagcaagucucuugucuccaaagaaaaaaaaauuguuauugaaguugagcauuuaggcaagaaauguguugcuuuuuauuguaugagcuuucauguuuaccuuuuaacuugggaauguuguucauuuauuaagcaaauauuuaaguauuuaccaugugccagacaguguucugagugcuagugauacagcaaaaaacaaaaaaggagacagaaaucccugcccucauggaguuuacauucucuugggagagcuggaagauaaacacaguaacuaaguaaaccucauuaaguguuagagaauaagugccacaaagaaaacuaaagcaggugaggaggcaucugggaagggagagguugggcauuacaguucuagaaaaggugacgagagauggccucacugacagcugaccuugauuaaaguuguaaaggaugugagggagcacacugcagauguuuucaggaagcacauuacagacagagggaaucaccagugccaaggcccuggggcaggaacauacucaggauguucacagaacacaaaggagccaguguggaaggagcagaggaggcaaaggaagagcaguaggagaugaacucagaaagaagacggagggcccagucugguaggacccaacaggucaucauaggacuguuaacuuucauugugcaucaguguaagguuuugaguagaaaagugacaagauuugacacauacuguaaaaggaucacucuagcugccauguuggaaguacuguguggagggaaaggucaaagcagugagccccaggccagugaggagccuuuuuuacaguaauccaagggagccuggaugguagcaguggagaucaucagaggcaguuggauucugaacauguuuugaagguagaaccagugggauuggcaaauggauuaaacauagaguguaagagaaggaaaggugacacaagacugaaagauguuuugagcaacccucauggaaagacugggaggugcaaagguggguuggggauucuauuucagacaugugaaguuugagauagccaaauggagaugcuaaguauggagaggcucugguuggggagucaucagcauguagaugguguucaaagccaugagaccaggugaugacucccaugggaggagagaaguggagagauccaaguacugggcccaggggagcaccaacauuaacucauuucugcccaguguuccauuauuggaacgauaagcuugugggaguuauuuauauccuacugcuaaaggucaucaccaagguuugauuuuucacacaaaaaacuugcaaccuccagcauaaauggguuaagaggcuggggaguugaggaacaaagacacauagcaagagggaaggagaucaggugaguguagccuccuggaagccaagugaagacugauccaaggaggaaagaauccuggucagauaaggacugaaaucugacuaauggauuucauagucugcaggucauuggugaccuacacaagagacguuucauugaagaugggacagaagcuugauuaaauaaaucagugguuucuacaucagaggagguuuuaggguaguugaucaccugggcuccacuuuagagcaggagacuuauguauccggcauucagcuuuuugccuggcagaaagcaccaauuuccaauuuccuuaaggccuuauauugcaguugguaggacugacuuuggaaguguaccuacuaggaugaccaucaguauaggauccacuggccccuguuuuaggcuacaacaguagcuauggccacccuagcugucauuucaguuccuugauacucagggaaacuugggcaugguuaugggaggccugcgaauggcccagaguuaguagggaacaagaugaacacaaaauucugucuaguugaaaccauggcuacaauuuggaaaugaguagggggaaagaaucaacgugggcuggacccucuccugugaauuaaauuggcccagaguaguaagccgugcauacaccucaauuuccuuccuuuuuuuccaucggauugauauuuuuggaaucuggccagggugagggauaauguuugcguagagucccacuucucucuuuucuccauugugccaugcaugcuauagaauaagagcccuuuuuagauaacagagucuaauuaaauugucuugcugauuuuuuuaaaaauggauaccuuaguuauuaacuaccuucaacuaaaccuuaagaauuguugaguuguuuauuuuauuuuauuuuauuuuuuaacuuacuuguaucuucuccauauugacagccuguuugcuccaggauaaaaccaagggucuuuguaauggcuuugcauuuuccuaaaaugauucaaaagcuuucugaacagaauuaccaagaucaauugaauuguaucuaaauucagucuuccauuguuaaguucugauaagcagcauuuugaacauauagucuuauugccugguuuaaucauguaccuagauuucuggggucguccuuuaaaacuuaaguugucucccaaaucauuccugguaaugcuuaacucugacauuuuuguguaauuauuugacagaauauguggauuuuauacuuuuaggacaguuuuagaagacgacagaaagaaaaaagaaagagaaugaaggugaguuuuaauuaauuucaugagauuggcaauagcguaauuuuacaauuuaugaggaagauguucauuacaguagcuuuauuccuuguccaguaggacuuagucagggacguaaguguccacccaguuaccuuuuuaccuguagaaagaacacuggugucgauuuaaagaagguccucuaggcucugaugucugaagggauacacuugggaggugagagguggguggcaguuagcuauuugaaugguuuacagcaaucaaguauuguuuuuuaaguaaaaauggucaauauuuuguauccccuugaaaguuacuguacucuuauuucuaccucuuugucagauuaaucuuucuagaacacaacacucuaaacuuguuucucugcucuaaaagcaccacugacuccuuaauccccucagaauccaauucugucuuaguuugguguucagagcacacugucauccaguugaauuccagccguccagcacauccccuguugucuucuaaauacgccauaucccugcugauuaagaguguugccuucauuuguaaccucugaauggauuuuugacuuugcagcucacugacaucauaccuuuucuacaaggccucccuucuugguuaugcucauaguacagguugagcaauccuuucuuuuaacucuggugcuuccuaugucugauacauguuuucuuacuuaauugcauaaugcuuuauagucauuuaacuucuuuaguucuuguuuucuuaucuucccuacuagauuuucaagcuuguggaguuuagggacugccuuuuacuacguuuuguuagaauuaagcaauuucaggaaacaagaagggagaaaaguagaguuauuuauuguugcaguggguucaaaaucauuuagauugggaggggcauauuugguuucuacuuauauauuauuauuuuugucaguaucuuagucagccaagacuaucaccuauguuagcuauaaucauaucuaauuaauuggaaauaaagaguuaaauucuagcaaggcaaaggguaaauaaaaguuguauuuccacaaaaauuagccggguguggugacgugugccuguaaucccagcuacucgggaggcugaggugagaggaucgcuugaauucaggaagcagagguugcagugaguggagauugcaccacugcacccuagccugcacaacagagugagacucugucucaaaaauaaauaaauaaauuuaaaaaguuguauuuccuaaguauaacucaaacucaacuuuuuuuaaaccuaaauuauuuuguuuuuauuagccugaaauugugucucgaauguuuucuguaauuauaaaaagcaguggguuagcauaaugagacuugaaagauuuucucuauguuucaguauaauguauuauauguacuuuaggacugaguuauuaaguauuauaggcuauuguuuagaagguauaaguuaccaucaaaucaaaguguagacaaccuuguaauauuaacgaagaucauuugguuuuuuagugaguuuuguaaagugcuuacaguuuggacuuuauuccauugcccuucuuuccuuucugucaucuaacuguguugugauuuaauuuuaauuucuacauucauuccauuuauguuagagagaucaaccagcuuucacuccuaguggaauauuaacuccucaugccuuggguucaagaaauucaccagguucucaaguagccaguaauccgagacaagcagccuaugaaaugaggaugcagaauaacucuguaaguggcuuacuuuuaugugacauuuaagaguggugaauaucacauaccucuugcagggguggugugugugugaaauuuaucacagccuggaguuuuguuuuauaguuuuucuuaauugcuuugccuugagaaauguuuaguucuguuaaguccaucuuuaucaauaugaaaauauccaaaugaugugaaagaagagcacguaggauuguugauacaugcgaauauaaagagcugauuccaguuugggugacagcgugagacccugucucaaaaauaagcuaaguggcugcaguguuuuuguaaugcagaugaaccacacacugcuucucccuucuccaaagaauaggguggugaaugguucuagaagcuugucaagggacauccauaugucucaaagcugaggcaagaggaggaggauggguuuuauucccuuauuuccccuuuccuucagugggcaguugugagcauuuugcaaaauaguauuccuuagguguaaacucuggcucuccaauucagcauggaauagaucuaaauaaauaucuuaagguagcacuuacugguuacucccuguuugugaacucagcaacugcaugcauuuauuugccuugugguauucuuccauauuugaacuugguaauccaaacuccagaagcaaaucaaccuauccugcaaggcuguacuuuguccaccaccuuccuauuguaguggaaauagaccaugagcucucagaauacccagugggacagcaacagggcugagggaacagacccugaucuaacaguagaggaaggaacauacacuuuugcuaugauauauccaaggaaauugaauaagcuuggauauuuaauuucuguuauucuguuaguuauccuauugaugcucauauggaacagaaauagcugaugcccaucauucaagauuuuagugacuaccauccccgcagagcagaacugagagugacuggugguguuauaugcccuguugaugguagaguacuuuuuuuuuuaaaucuugggaggcaggcagguuuaaacuuugccagcugugguugcuucaggaagcauuccaguauuaucuucaggcccgguaguauuaggccacaggaccagacuguagaucgauaacaucugccauaggaguaguaauggggagacuggugaugagguugcuucuuugauucugucuuaauuaacuucccuugccacaauuauuucuauauagaggagguauggaauucgaaucuuugcagagugggauuuucaccuagaauguucuaaauuuaaggaaauuuugaagucaaauuaccaguuuauuuaaagggagccauuaaaguuacagauuucucguguuuuauuuuucugagcuguuggguuguagucucuaauacuuaucuacugaugauuaacauucuuaguguuuuauuaaauagcuuccauuuccuuauauuugugguuuuauauuuagcguucuucagugugguuucauuauaucuaauuugaugaaaaaaacagcuuaagaagaaauuugaauuuaauaugaaucugguauguucacaagggaauauuuuuguugguagagacagcagcggagauuuagcauuaaauggugaacagcauuuuuuucuagaaaguauauuauuauuuguuuucuaaagauagaguuuauaucuuguuaguaauuaauuuuguuaaaguuugcuuuuuacacaacuucucuguagacaguuaaugggaaugucacucucauaauuuaauacaaauggauuaguguaggguugaaaaaacaauagugauuacuuacugaaugguuaacuaccauguaccauguaggcagcaugccaguaaucuuucacauguauugaugcauuuaauccuugcaauaacuuguaaggaaacagaacguuaucauccccauuuuaagaugaggcucacagagguuaaguaauaaauuguucaaggccacacagccaguaaagguugaauuugguauuucagacucagaucuguaugacuaaaauacaacaauaccugccucguuuuccaaguacaacagugccuuccuguauuuauuuuuauuggguuuuuuuuugacaauauugucuguaccuuuucauuaauaacauugacauuauguuuuuaaaagagaugugcucuaaguucuaugugaaauaugauuucguauuauuuuaacuuuucuugaccugugguaugaacuguguuuaugcuguggauacucuaauuauuauaucauucaaauggccuucugugcucucaguuuaaaaaaaauucaguuuacuugaaauagcuaauauacugugaguaacagaagaaaaacuugacuguggaaauguuucugccccuuauguuuuuggugaugugguccuuuagcuugaguaacuaaaguugcagaacauuuucuuuuaauuuuuaaauauuaaaauauguuaggguuauauuaaaauauguuaauuaaaauuaacguauuauguuaauugaguuagguacaaagggaagauaauacugaauuuaaagugacagcuaagucuuugaaauaccaauaaaaucugcauuuuucuaagaugacuaauagauuuuuauuuguugauugauuuuuaaaacugaacauauaaaguaauuuaaguuaucuaacacagucuuauuaaacuugcuuuucagagugguuguacuagguugaagacuuaaccauuuagcugcauucucaccagcauugacuauuuuauauauuauuacaucuauauuauuauauauuauaugcuauauauguaaugcauuuuauauaucacauaauuuuuuccccucauagcuuugccauuugguagguggcaaaugauugugaauuccuaacaggaauuguuacaacugauugucacaaaugauugugaaccaccaaaggaaaauaaaauucaaguacuauaauuuuuaaaaaucuauaaaauuaaaacuuuuuuuuucuucagaaacuuuuuuuuuugcccuaauaauguuaauuguuuuuaguuuaagcauagaaaguuuggguauuacauuacuucuuuugaggggaagugaaauggagcaagaucagucucuguaccuucuaaauauguuuaccaucucuauguaguagcuuuaaaaauguuacugugaaacaugguaaguaguggugguuggauguaccuucuuauguaaaaugaauaaugaaauccuucuucuguaaugucaucauugucugcagaguccuucgauaucuccuaauacgaguuucacaucugauggcuccccgucuccauuaggaggaauuaagcgaaaagcagaagacagugacagugaaccugagccagaggauaaugucaggugaagccauuuuuugguagcacuuuguuagcaaauugcugaaauagaugcagucuaauuaaugcuauuuagcuuagagcagcagugccuucagaugcuugccugugaucuuuuuauccaucaguaauuaauguggaggguuagaauagucaguaaauuccagugagauguguaagcuguagcuguuaaaccuaagugucuagauuaguaugcgugcaggcuuucguccuccaauccacuuuucccucugagaccaggcacaagaucggcuagauaucauaucuagguguuuagcucugacuaugugaucugaauguugcuguuuggagacugauuaaauuuucaagcugcuuaaccuagaaaguucaguuauacuuagacacuuaauauaguuugccuuaaucuucucuauugaaagaguucuuccucaaaaugaaauaugcagaaaucauucuguuaagagaucaauauguauguuuuuuaaaaaccacagacuugcauaugcgcaauuauauuucaugacagaggaguuucccuuuaacuguauacuucaaauuuaaaauaggaagcugauucuuuaauucauccugaaguuugagaucauuauauaauaagauuaacaaccucucauguaauuaaauccagauuugaaccgugggcuccaagugcaaaaggccaacaaucucaauaauuguagcucauuaagaauuuaggaaaacgaucuauuucaaagguaaacaagacaguagucaccuacagcucaugcuucuuuuacaggacauggaaagugugugauuuguguuuaugauuagaaacuuugcaagggucacgugugguucugcacauuuuucuaacauucuuugauuucagauccaugucuacuugugauugaacauuuacucuguauaucuuuaguuucuauccucuacuuucuguacuuuggguuuuccucuuacagcaugucuuugguuuuguuuacuauguagccaucaugaucaauacuaguuuaauagguaacuugauuuguuuaguauuuuauuguuuaauccuagaggaaauuguuuaauccuagaggaaaucauuguuuaauccuagaggaaaugccucuaccaagaaaugcuuggggcuuuuagcauuuuuucauuaaccuuuucuguaaaauagugauaauccaccuuaugaaugggggauauuucuaauuguuauucugugacuccuuuguguugugggaggggcagauuaaaauugauaugguauauucugaaacaugacugcaauuaauaugugaaaucuggcacauggaaaagaggccuaaauggagaaucaucuugauguucuugaucuguucugauguuuguaaaguguuauuuggcuucuuuauguuccuuaaauguuaaaucuuagagaauaagaaauggauucuuaaaaaaaauaauacauuggaugaaaaugugguuggucacauuguauuuucagugaugaaugauaauuuaguggauucauugaccugcuucuagauuuuaccauaacauacauauguuuguguguguguauguauacauagauauauagagauauagaauguguaugucucucuauauauaucucuaucuccuuuccuuaagccaucaacaacucuuagcugaaagagggauaaggcccaagcaaggauagagagaguagguauacacauaauuucugccuaaugucuagauuauucuuuuauaaacuauuuuuuuacauuuaaaaaaguuaccugugugcgucuuaaguaauuuaguugacuuucuuuguaugguuuaaauauauuuuaacaaacuaaggaacuugaacuauuuaaaauaucuucaauauuugaaucuuaaaauguagcuuuagaauuguacaaagaaacauauaaaguaguauuaaaauuugagcaaauguguucuguaucuuuuucaauaacauuuuugaaaaugugguuuuauaauggucuuaccagaaucagugauugggguguguuuaacugucuuuaaguugauaauaaauccuaugaaauuagacuuuuuagaaauaguuaaaugaaucuguguuagcaugacuguuuaacucuuucacauuuccccuggguauuaaauauaaauugauuugggguauaaauuaguagacagccuguuacugaagguguguuaauucagcauaaaugagcugugccugguuuuagguuaugggaagcuggcuggaagcagcgguacuacaagaacaaauuugauguggaugcagcugaugagaaauuccgucggaaaguugugcagucguacguugaaggacuuugcuggguucuuagauauuauuaccagguacaaaaagaauauuuuccucugaauuuguaguuaaucauuuaagaaaaauaguaauuucuuuuuuuuuguuuguuuuuuguuuuugagacggagucuugcccugucaccugggcgggagggcaauggcgugaucucaacucacugcgaccucugccucccagguucaagcgauucuccugccucagccuccugaguagcuaggauuacagagcgcaccaccacacccggcuaauuuuuguauuuuuaguagagacgggguuucaccauguuggucaggcuggucucaaacuccugaccucgugauccgccugccucagccuccuaaaguagugggauuacaggcaugaaccacugcguccagcccaguaauuucuguaauaauaguauuauugagcuggaucuugaaaacaaacccaggcucauuuuuuaaagcucccuauucagaaguccguauuuguaaauauuuguuucugaagacguggaaguuucuuagauauuaauauagaaacaaagcuaauuuuuguuaaaaguauuuucaggaucaaguaaugugguugacugcacuuugucuuuaagaugacgaaagguuagugcuuuuuaaauuggaguuuaaaaauaacugaguaaugaauugacagucacugaaugacugaacagaggacaaacccuggaaaauacaaauaagaauucuaaaggaauuugaaugcuacgcuuuucauaauauagugaugauacaugaagcacauucuaauuggaauaaccuguauccuaccuuuugauaauugagaugucagauuggugagagauuagguagacauauugaggacuguaacacugauaguuaauaucugguuucgugcuuagagagcaaaccaaguuaaauuuggugugaccugggaauagaugaaguuuguugacaaguagaaaguaacacagugcacugaguauugaccguuaaguacucuguuugcguuuuacuccuacugucaagauuucaacucacuagacacugucuuaacacaucuuagauaucucuuuccuaugaguauaacuugcuuuuguuuucuuuuugcuguguuuacucacauguuuuuauagucaaaagaaacuugucaggugaaaauauaauggugaauuuuaaaaugaaacucauggcuguuuuacuuucaacugcuguuccaauaaugucucuaaccaccuuacaugcucaguaaaugucugcugugacugcuuuugguuuuacuugaugaugacagcucuagagauggaaagaaaugucaccaaauguauuuuaaggauaaaaaucuuaccaaauuguguuugugaauaugaaguuuggcaguaacuacugauuuuucaaagaugcuuuguagcauuuuuaaagucaaagagccauugauaugaauuagaaacuucaaacuuaaggaauuuuuaggagucauggaaaagaucaguauuuggaauauaugccagaagucauguguuuuauaaguagaauauuauagguuaacagucuaauuuuuguuuuuuuuaauuguguucaucauuaacauagguuuuugauuuuguuguuacuuuuuuaaugauucuagggcugugcuuccuggaagugguauuauccauuucauuaugcaccauuugcuucagacuuugaaggcauugcagacaugccaucugauuuugagaaggguacgaaaccgguaagcuuaauuacuuaaagucauaaaguuuauagaauucuggauuagauaauaaucuugggucuuuaauguuuuuucuuuuuucaguuuaaaccacuagaacaacuuauggggguauuuccagcugcaagugguaauuuucuaccuccaucauggcggaagcucaugagugauccugugagucucaguauuuugagugugugggugacaggauuuuugucacauuuuauucauaucaguuacaauugcuuuugcagcugauaguuaaaacagugaaguacagaaacaguauguuuuuuacuccaaacacacauauauuuccugcuuucuuuggcccugcacaguaaaucaguuuguuuuggggagaaauuuuuuuguuuaguuuuugauuuuuuuguuuguuuguuuguaagacggagucuugcacuguugcccaggcuggauugcaguggcaccaucggcucacuacaagcucugccucccggguucacgccauucuccugccucagccuccugaguagcugggacuauaggugcucgccaccacgcccagcuaauuuuuuguauuuuuaguagagaugggguuucaccuuguuagccaggauggucuugaucucgugaccucgugaucugcccaccucggccucccaaagugcugggauuacaggcgugagccaccgugccuggccggggaaaaauuuuuguucucuggcuaccuguaagucuuuaauuuuauuuguuccagccauauuugguagccaccagagaugaggaaacugccuuacccaaaaucaccugugaacuuguuuuguaugcuagcuagaaagagugagacccagccgggaaguaggaaauguuagaguacguaaacccuuuacuuucugccugucugaagcccauaguugucaauucuaaaauucuucuacaguaaugcuuuuucaucuuuuaaaauaacauuguucauuuuguuuuacuauacuugggauuaaugaccuaaugucucuuaacauuuuuuaaaaggaaugcacuuuauuuucucaucagaccuuauaacuugaaugaaagucauaucaaauucuuuauaacagagaugugugacuucuguuuugauucuuuacuuuucucccuaauauaggauucuaguauaauugacuucuauccugaagauuuugcuauugauuugaaugggaagaaauaugcauggcaagguaaaauuuagacguucuuuucugguaaaacugugaacaaacauaauuuuugaaaugaaauaauucuguaaaagauaaauauuuuagccugggcaacauggugaaaucucauuucuacaaaaaauacaaaaauuagccuggcgugguggcuugcaccuguagucccaucuacuuaggaggcugaggugggaggauugcuugagucugggaggucuugguuacagggagccacgauugcaccacugcauuccagccuggaagacagagugaggcccugucucauaaauaaauaaaugaauaaauaaauauuuuaaaagguaaauauuuugagaauuauaugugaaauguugauauuucuccauccaaccugggauuagcaaugauuaauaguaaauuuaauuauaacauucuuagaagcaguaaauuggguugaaauagguugauaauuacaucuuuuguuuccuuugugauuaauuaauggggcuuguuacauucagucaguagcucauuaacaccuuuugagguugcugagaaauacagaaacacaguaguauccauguggagauuuauguauacuccauggaaacuuuugaaaaauaugcuagaaacuuuuauguaguuuaaauacuugauguugaucauuacuuuuccuacuaguuuuucauuccauuaacagauuuuguaggaauggcuauauaaaauuuguacuaacuuuaagguguguuuaccacucaaccaauauguaaugaugauugaauguaaaauacaauaaagaaauaucuuggccgggcgcaguggcucgcgccuguaaucccagcaauuugggaggccaaggcgggcggaucacgaggucaggagaucgagaccauccuggcuaacacagugaaacaccgucucuacuagaaauacaaaaaauuagccuggugugguggcgggcgccuguagucccagcuacucgggaggcagaggcaggagaauggcgugaacccgggaggcagagcuugcagugagucgagauagcaccacugcacuccagccugggcgacagagcaagacuccgucucaaaaaaaaaaaaaaaaaaaaaaaaaaaagaaauaucucuuacacaguaaaccagcuguuguuucacacuaaagucauccugcagcaaauuauuuaaccuuuucuuccaccauacauuuuccuaggguaauaaacacauuugguaaaaucauauuuucauuuuuuacuuauuguucucugugguuggaauggccaauaaaaugacuuacggagaaucuugagacaaagggggaauaaauaauacaauuuacaaauugaaaaaucaggaggcuuuggaguugacuugauuuauuuaguagcagaaauaucauaucgcuucaguggaaugaucauggaagugcacccauugggguuauauaaggguugugugcuucaugaucauguauuauuacauguuaaauggauuggagauucggguuuuucaaggugcuuuguggaggaugucuugauuaaagcagagagagaagaugcaugggacagugagggauguaaaaauacuaaguaaauuaagaagcaaauauauuuuuguguuuguuaaauaaguaaauuauuaaaucguugucuggguuuauuaaguagauaauuaaauauauaaacaugcaggugacuugucaacucugucauugugguauacauuauuucuuucacugacaggauauuuucaauauaacuuaacucuaggggaaaagugagauaauguacaagaguucagauuucuucacauccucuccaacauuuguuauuuuguuuuuauuaguaauaaccaugcuaauggguaugaaugguauuucauugugguggcgauuugcauuuuccuaaugauuagugauacugaacaucguuucauguccuuuuuggccauuucuaaaucuuuggagaaaugucuguucaaauccuuugcucaauuuugaauuggguugauuuuguuguugcauuauagaaguuuuuuauauauucuagacauuaaucuuuuauuggauauaugauuugcauguauuuucucuuauucuguggauuaucuuuucacccugugaugauguccuuugaugcacacaaguuuuuaauuuugaugaaaucaaguuuaucuuuuuuguuguuuccugugcuuuuggugucauauccaagaaaucuuuaccaaauccgacaucaugaaucuuuuuuccuaugucugcuucuaaaaguuacacaguuuuaguucuuacauuuaaaucugauccauuuugaauuaauuuuuguauaugguguaaaguaaugguccaacuucauucuuuugcaugugcauaucaaauuuucccggcaccacuuguugaaaagaccauucuuccccccauugaauaaguuggcacucuuuguugaaaauauucugggcugucuauucuaguccauugagcuauguguuuuuccuuaugccaaugcuauacuguuguaauuacugucgcuuuguagugaguuuugaagucagaaauugugucuuccaacuuuauucauauucaagguccguugagauuucacaugaauuuuaggauggguuuaaauuuugaccucaaauauuuuuguauuuuauacaauguuuuauauaaauauuuuuacuuagcuuaguagcgagaacacacuuuucuugagguaaaauuuaguacuguugggaaauacaguuucuuccucauacauguuuuuaaaacuuacuuagugaaaguaaugauaauacuuaguuaagcucuuaccuggguugagcacaucuuaauagaagauaaacuauaucuggauacgucaacauuuuuaaaugugugcuuaucaacauuauauguaauuuuuuuuuuuuuaaagacagagucucacucuguugcccaggcuggagugcagugacgcgaucucggcucacuguaaccuccgucucacagguccaagcaauuucuccugccucagucuccugaguagcugggauuaccgccgugugccaccacaccugccuaauuuuuuuguauuuuuuguagaggugggauuucaccauguuggccaggcuggucucgaacuccugaccucaggugauccgcccaccucagccucccaaagugcugggauuauaggcgugagccaccgcacccggcccaacacacguaauuuaaaagcaguaucguuuuggucaauuugcuuaguacuauauagauauauagcauaguaguuuugaugcuguauauuuuauauaugaauagagaauuuaaguaauuccaucaagucacacaguggcagaguuaagaccugaacucagaaagucugauacuagagcucacauuugaagugacuguguaauaccuaaguuauuaccaguacuugggcucccucuggguauugaaagaauucagugagauaaugcauguaacauaagaaguguucagaaaacaguagcugcuauucucauguuuacuaucagcucacuguagcucugucauaucuggauguaaggcauuccuuucuaugcuggccaguagggguaauuuauugcuuagugauuuucuugcuguugaguagcacuucacauuguuaacugauuggauuuagcuucuggaauugauauuguagaaaagucuuauuuuauauauguauaauauuuaauauauaauauuuaauauuuaauauauaauauaauauauguuuauauauauuuuauauauauauaaauauaaauaaauguaguggguaggauauauauauauauauauauauauauauauauauauauauaucucuuaaauguaguggguagaaaacaagcuagaugaugcuguaguuuccccuugauauaguucucuuaaguguaugacuaaauaauguuuuagcaauuuccuggguuuuuuucauguguuuaucaguaauugaaauagccugacucacauguuagguauuaagagccuugaaaucacucuuuuaggccauucaaaauucauacuagaacuuaguuucuuuuuaacuuaaaaagaaaaaaaaaagaucaggugcaguggcucaugcuuguaaucucaggacuuugggaggccaaguuggaaggauugcuugaaacaaggaauuugagaccagccugcguaacacaaggagaccucaucucuacaaaaaauuuuaaaaauuagcuggguguggugguggcaugugccuguagucccagcuacucaggaggcugaagugggaggauugcuugagccugcaaguuugaggcugcagugagcaaugaucgugccacugcacuccagcuugggugacagagugagacccuaucuuaaaaaaaaaaaaaaaacaacuguuacuagguagugaaauugaacaugauuccuaaccuuggaauaauuaauuaagcuaaauaagacuuggaaaccuuuucauuucucauaauuuuaaagggaauaaucacaaauaacagugguuuugaguagcaguaguuucagaauuauuuaacacuauuuagcauuugucuuugcuguguauuguaaaauuuuuguuuagccaaaauacuacuuauacuguguagagcagaaaauauauacgcuucaauaacuuuguauauuuuucuuauagcauuguauuagugaugugcuucuuugaaaauuaugcuuuuggguccaaauaagugcccuuaauuucagcauacuccagaggaucauuuuaagucucaaaugaauagccucuguucuguccccugcccccuaaguuauuuaagcaagucuuuaaaauuuuuuuguauauaaauuaauuaguaggcuuuaaaauguaaaaagaauacuauggaauuuuagagcaggaggagaucuaugcauuuugguugaacagaauugaguauuuuaguugaaaugcucucauuuuacaaaagaugaaaccaaguacuagaaagaagaaaggacacacucaagcccuagggagaguaacuggcuugcuugggggcaucuuaguaacuaaagugagaauauauuacugguauccagguagccauuuguucauuuauuuaaaauuuuuaucaccauggaguuaagauucagaaaacaugauuuuccauauaagccauuuuaagaauggaaaauacguagaauuuuuucuucugcaacuacaggggaaauauuagcaucugaguuuuggcuuaaugagacaauaagaguucaguuccaaaauguuuuuguaucagcaaggaaacucuacuagaaacguucauuucgagcaaugauaaguuggaauuugggugauccugguagcaggggugguucauuugcacuuguuuuuucagguguugcucucuugccauucguggaugagcgaaggcuacgagcugcccuagaagagguauacccagaccucacuccagaagagaguaagaauuauacuucuuaguuaacauugaucuguguaauauacacuuuauauuucuguauaaaauuagaccuuccuucuccuguuugucagauuucccauaaaggggauauaaaucauugauuuuauuuucuuauuacagacguugacuuugcuucuuaauucauuaucuguaaguugaguaguaguuaaauaaaauguuuuaacuuacaaguauuucuuaaauuuuuuaaaaagcaauacuucaacaauauccuuugacauuuugauucuuauaugacaugcacacacgaaaguaucuuuugccuguugggaagauauuauucauuuucuccaucuaccuucuucccuacuccuccuuucuccccaguaauaacuacuuuguuuaaaagguuagggugaaacaaaagcauaugcucuuagagugcuaacuugaaauaugacauaaaaggaggcaauuuguaaucaauacugacaguaaaaaguauucauauucggaaauugcaaagcugggcucuauugaaaaauuuaauaccauuauaauaagccucuagaaacaauuucuguaucaaaaagauugucuuuuagaacaaucuuuucaucaaaugacacuguauauguuuccuuagggaaugauuauguauuucuuauacuaagaaaaugaguuuauuauaaaaagaaaauauugcccuuuaucuugcaguauauucauacguauuucaguggguuuuuuuuccugauaacuauugaucuuuuugaaacuuuuuuguuaaaauauuuuuuuccccauagaggcacaucacgcauuuagaucuaucacuauaauuaaaaaauuuuuuuuaaauugauauguaauaguuacacauguauuuuggguccaugugauauuuugauaccuauauacaauaugugaucaaaauaggguaauugggauauccaucaccucacauuuaucuuuucuuuguguugggaacauuacaguuucuuucuucuauuuugaaauauguaauaaauuacuaacuucuccacaguacuaucaaauacuagaacuuacucuugucuaaccuaucacuuuaaaauuauuuuucauaaauuuuauaauuaaguucuuaacacuuagaugcuuucccuuguuuuaugcucauaaaaauuggucuugcagguacaauuuuuuuauguguaggucuuauucuuuucuuucucccuagccagaagaaacagccuuggaggugaugucuuauuuguggggaaacaucacccacuccaugacuucauuuuagagcuguaccagacagguuccacagagguauguuacgcaauuugguuaauuagaaaugcacuuuuuaaaauuuugguaaaauaugcauaacauaaaauuuaccauuauaaccauuuuuaagugguuauucuguggcauuaaguauauuuccaguguuguauaaccauuagcacuuuuucagaacuuuuucaucuucccaaauagaauuucuguaccuuuuaaauaauguuaaauaauguaucagaauuucauaccuuuuuauggcugaauaauacucuauguguacuuuuuuauccacuuaucuauugguaaauauuuggguuuguuucugccuuuuggcucuuaugaaugaugcugcuaugaacacucaagaaucugcuugagucccaguuuuccauucuuugcauaugagaucaggaaugcauuuuuccacagccaguggagguacccccugaacuaugucaugggauucaaggaaaguuuucuuuggaugaagaagccauucuuccagaucaguaaguuucauuuuguauauaauugaggugacuggaaggaaguuuaguuaggauuuuuuuccuuguugucuaaauguuuauuuucuaauaauagugagaaaauuguauuuaaaauaagacaaaaccuugcugacugaaaaaugcuuggguucaaagccuagcucuucaaaguagcugugucaccuugugcagggagcucugggagucccuuucaggauauucugaagguuaaaacucuuuucauaaugauacuaagauguuacgguguuacuugcuuuucuuacacuuucucucuugagugcacaguggaguuuuccagaggccucucaagagauagaagcagaggagaguagcuauuaaauagauacuaaccagauauuaaugagauuuuugaaaguauacaacaaugacaucguuuugcuuuguaaaaaaauagcuuuuuauaagaauguuauuuauguuaacauguaggguaucuuuuaguauuuuaaaaauuucuuagucauaauuuuuaauggguaaauguucauaaauauaaccacuauaaacaaaagcccuuugagauuuaagaauguaaaaggguucugagaccagaguuugugaaccacaugucaaggguacauuuccaggaauggaacugcuggccauagaguauguguaucuucauuuuuuuucuagguaauauuucuaggagguuugucaaggugguuacacuguguuguaaucccaguggcaguuugugagagaucuuguugcucuacguuuuggcaaacccuugucacagcuuuaauuucugucagucugguggaugcucauugacaucuugugguuuauaguugcaguucuuugaguacuaaugagauugaaugccuuaugguuaauaguuaaccauuucauguaugugguacuuacucuuuuuuuuuaagauauaaaugguuuuuauuguuuuuguuagugcauucuaaugauuuaucuuuucuaaagacuaacaaacauagcaacaucuuauuuccacuuaccuaaaagguuacaguuuacagagagauguuucuucucuuguuuccuucuagaauaguauguucuccuguuccuauguuaagggaucugacacagaacacuguagucagguaaguuuuccaaaauucauggcauucacccagaacacagcucugaacuugcaaauccauuuuaaaagaccuuugauucacaaggaaauggcagcuguuaauccaccaaugcuucgagauuggagagucccuguguugcagaccuuacagcagagccucuuaacucuaaauuauguauauuguuaagguuacugauuuaacaugcuugcuuaucuguuuucugguuucccaugacaaccuguaauucuuccuggauuaggcaagugggagguaaagaguaggaguaucuagcaguuuguuauauaggaacaaacagaacucuacaccccagagguucacacagcuucccuguauuacaacagacuauuuuacuuauguuuauaaucauggcccugcagaguuugaacacaaaaauauucuguaguauguuuuaguuaagaugacauagaacagaauauauuugugaaaauuuuuauuagcaauuauaaacuuaaagggcuaauuucuucucucuggaaaacuaauuuauaucucaguucuuuggugcugacagcauuuucuauugaguaaaaauaauauaaaauguaauaugaccauuuggacuaaaauccaacaaauugacuacucauuuguauuuuauaaugacaaaucuugaugacagaauuuaguugucauuuucuccaaucuuuagguaagacuaaagcaaacacaucucagguauucaagaauuugauaaaagccugcuaauccugaauccuccuuuuccauccauuuuuguuucucucccccucaggaaauauuuuagauuuuuuuuuagauuucccuuugugaaauauaaacauguuuauuuccuaucuuaaauggauucagguaguaaaugauugccauucuagaaaggcuuuuauuuaaagaaaacuacugugaauucgaaaaaucuuucuggaugaguugcuuacguuuaucuuuacguauaauuuuuuguuuaucuuuacaccuaauuuguccugguucuuugucuuugugcucuuuuguuaaggguggaguacagaauugaaagccacgcuccuaaacccaucacaaacaaucuggcucugacagauucagugugaacacuguguauuaacccuuggagucucuggcuuucauuaaagcauuggcgcuucaggccaauuaauuccacgguucucucuuuggauugucacauguuugcuugugcuucucaauuuuucugcauauauucaagggccuuccugccuaacccucuagaaauaguuaauucuacuuaacuuucuaauuaggauagagaggcuugcccagaggagaguuacagaguuaauggaaacauuuuggauuuuuuguuuggaugaugaugauguugguugguuguuucugagccuaaaggggccuuugguauuuaguacauacuauguucacaagauuauuaaauuuauaaaacaggccgggcgcgguggcucacaccuguaaucccagcacuuugggaggccagggugguggguggaucaucugagaucaggaguucaagacuagccuggccaacauggugaaacccuaucucuacuaaaacugcaaaaaauuagcugggcaugguggugcaugccuauagucccagcuacucaggaggcugaggugagagaaccgcuugaacccaggaggccgaggccucagugagccaagaucacaccacuugggcaacagagcaagacuccaucucaaaaaaaaaaaaaauguauaaaacaaaucccagaucuaaaugcauauucagguguauauugaaaauaacuuuauaauaaaaucaacuaaauuagguuaauuugcugaagauuugugggagaccaaaguuaacuuuucccuuagguaaaaguaauuuucaguguuuucucugaagggcggcaacauugaggcagagauccaguuuuuacagcagguuuuugcauguuuguuuuagggcuuguuguacauuccaguguuaaauuugcuuuauaacuuuaacuuacaauuuucagauuuaaaaaaucucagaauauacucaccagucauuugccaguuauuucucuuuugacuccuggcauuuuuuuccucuuccuuauuuaaauacaucuaguaucccauuugauauuugagaaaucguuuccucaaguugaguuuagguaaguucuucccauuguauucauucuuaucuguagugcucagaaaguauguuauacaagcuguugaagucccuuaaauucguagacagacccuuagagaauauagucaacucuaaccuaggagaucauauuuuuuucccauuucuaauuccacaaauuauucaacauauuagcuucugcaugugaguuuuccucccagucugucaucuggaggguaagugcauaugugugcuuuuacuuuuucaaggccugaugcaccuuggcagggcccuggcccugugcuugaacccccagguccucaggaugcuuccuuccugcccaggcugaucccuucaauacccuuugaccuccgccucuuccuccuguuguuuggagugcucuuccuuucuuuucuccaccugccccauagccugccguuuauugcuuugcuuuucuucuaaagcauaauuuauacaguuuuuauauauguuguuuccagcaguaguguuguuagguuguuuuuuuuuuuuuucucauagcaccuagcagaguucuaaacccauauuuaaaaagcucaguuguucauaguguugcaaccaguguuugccaaagucuuugaagagcguaaacuuuuuucuucagaggaguguuucuuagacuuuuuguauucacuuuuggaugaaucagacaagauauagaauguuuuauuccuucaaggagauuuuuuguuuuaaugugaauguguauggagauggauuuuuuaaguaacuauuucugcagcauuugcaaggcuuaugcuuggcaagcagauaacucaagauccaaagccugaaggaaguggaauacaugcagucagcaguggauuugaugguggaaaacaguugggaggguuucacuuucgaugcuuaauugguuaaccucuucugauagaaugucacaauccuauaaacucuuuaaguguuuuaaaaugucaaguauaugaaucaugagauuuuccugcaagaacaguuugccuuuguaugccaauuuagcauuaauuauggaauguaucagggaaagguuguguaaaaaugaaacuugauauuuggaguuuucugcuuucuuucugaauuauguuaacacucucuaacaguaauacuuaaaauagcauuucuaaggauaauucuuaaagcgaaucagaaaaagguguucuauauuccauuccuuuucuauugagacuuugcuacaguauuuucuucuuaccagcagugcugaaagugcuacuugugguauaaauaaaagcacuguucaguuuccuuauuuucaaccaugcuuagguuuuaaauuuuuauuuacuuugcccuugauguguuuaugaagacaaucaagcauuuaaaauagugagguuaccuauuaaggaaaggaucuguuaugcuacuugggggaaagcuggucugguacauaaaagcuugaugagucaacaguguuucaccugcauuuggaaaaaguggaugaaaauacuguuguuuaaaaauacuucaguuuacagaauuagaugaagcaauacgaaucuaaacacaagucucuuaccucagcuggucagacuguugaguccguaggcuguauuaacucauuuccuuccucugcuucucagagcuugcuugagggugcuucucucuuuaccucaguguuacuuacuacuucccuagauaagccuuccacaaguaacccuuuugcuucugaugauggaauuuaaaugacauagacaugaaaaaaauaaaagaccuucaaauguuuggauccauauaaaaaguuaccuuuuugagucuuugccuaauggguuccugcuuagucuguguguuugacuuuuaggaaguuuguuugaaucugaguuauggcuguuaucacauuggaaaaauacauuucuaaaaacauaguagaucuuaguauacauuuuugggaacaaauuaagauacuaagaaucuuucaacccuuggaagcuuaauccauuuuaggagagagugugucuucaaauuguucucaaagauccaaggaaaaaugauauuaauacuuugguaucauaaauaguguccucaucuuugaauggaaacuuccaaacuuauuuuuagauacuccuuuucuaucuccuaaugguuuguauuguauuaaguguguagauccuuuuguugaaugugguucugaggggaaguagggaugaucuuggagacuguccuauugacuuggaaaguuuuucccuuucagagcaugagcaugaauaauggaauuuuaaaaacaauuuuauuaaggaauaauuggaaaacaaauggauuuguuuucucaaacuuuaguuucagcugucuuauuaaaucucuuguuauaaccauucuccugcagaagugguuaucucugugacgcugggauuuucucuucucccugggagcuuauuaccuuggcuauuuccuucauuuucuuaguuucaggucuuucugugcaugacuuggagaucuucaucugagcucgaucuccauucuaguuccagccuuaccauuucauuuacuuucccaacguucccauccaagaugugugucgaagacuguugcuuaggcucuguuggugaccucuuuaugggugucccucugcucucucgcacacugcugcuggguuguucuuucugaaauuaucuuugaucacuuucacguccucauugacuacuugcaaaggcaucacauuauacucacacaaacccuccaugaccauaacccacuucuguuaccuuucuuccugccccacuucugcucaaaugcguuuuuacucuaauuuagcccuucucaacuggaguuccaugggagaauucugccuugagaucuuaaagcaucuguuguauguaucagauuguagguagcaguuuguguccuguaucucuagaaugauacuagcuauguuuuuuccuugggagaauugagaauguacucacucaucauuuuuuguagggcuuaauucccucccacauccccauugagaagggcugcuccaguaaaacuguacuguuccuugguccugggacccuuuccauaucuuuguuccauuuguuuccucugccacccugugaccaauccugucucaucuuaaaccgcagccucuuggaugauguuuuccuugguccucaggugaaauaauucccuccccgcaguacacacauagcuuuagcccacacugacaaagauguuuauauggaagguguauacacacacaugcuuugacucagcaucuuuucugugccuguuguugcauuuuccacuuucuuccuuauuucccuuauuagaaggggaggcaggcuugaugccuggcggugugcauaaccucccucccaccgugaaccgugcaugcgauagguauucuaauaguuuggcaaagugcuaaaaacgcccugcugaaacacagauaccugcuucaaaacacuuuauuugcaagucuugcuuuguuacuugacuuuuuaucugcaaagcccuaaugagcacaaauacuuaacuaccauuuucucugucauccucuuaaaccuuuaucacugccuguccuaccuugcccugccccaugccaucuugccaguacagaaaaucugagcuaaagacaguugucagugaagagugaguuguaagaagaacuaguugaguaauaaguauuguucagcuguugagcuuaugguauauuuauuguaagugaauccauuuuuguguacuuaaaaugaaaauuucuguaaagcagauagacucuaguuaaaguggcaguauucagaaagaaaacugcugucuaaaaaugucaaccaggucaauaaaacuuuuuuuaaaaaccuuuuuaacugacuguaaguguaaucauuggaggaauuuugaaaaauauguuaaaggaaacaaguuacuaacuuauagagaaaaaucacugauaaucgauugaugaauaugucuagucuguuguauauauguuucccaugucauuaaggucauuaaguauucuguuacuaaauuuuuuuuuuugagacggagucucacucugucgcccaggcuggagugcagugguguggucuuggcucacugcgaccucugccucucagguucacaccauucuccugccucagccucccgaguagcugggacuacaggcgcccgccaccacgcccagcuaauuuuuuguauuuuuaguagagaugggguuucacuguguuagccaggauggucucgaucuccugaccuugugagccacugcacccaaccuucuauuacuaaauuuuuaaaaauauuaucugaguucuuccuuuuuaggaaggacuaguuuuuuuaaccaguccacuguuauucauacacuuggguuuuacagucuuugaaacauuaugaauaauaguguuauaaguauccuuaaguauaaaucugguguauaaccagaguccuggaagaagcauugcuaugucagaagacagacuuagguacuuaccaaccuuugggauagguaaacacacauacauaccacuaccacggcuaucacuaccagaaaagaaguucgacccagcuuauacucaaagccugaguguauagcuuuuaaaaauaguuauacuguccaggcgcgguggcucaugucuguaaucccaucacuuugggaagcugaggugggugggucuuaugaguccaggaguucaaggccauccugggccauguggggaaaccccaucucuacaaaaaauacaaaaauuagccgggcaugguguuguguaccuguagucucagcuaugagagaggcugaggugagaggaucucugagccugggagguugagacugcaaugagcugugagugugccacugcacuccagccugggcaacagggcgagaccugucucaaaaaaaaaaaaaaaagcauauuuguguaguuuucaaauggugaaaauuauuuuauuacuuaaaaauaacacauuaggagagaaggguacaaggguccaacugugaaguuuaauuuuuuuuguuaaguccaucccccccgcaccauagauuucuuagcuauuugugugcauuuuuugauuuugcaaauauuucuauugguauauccaucuuuucuuuauuaaaauaagagcuaaucugccucaagaugcuuugggguuuuugcaguggacugaacaaaauuaaagguuauuuuauuuuuauuuuuuguuguuguaaaccucuucgaccugucuacaauaucauuuugaaauuugaguuggggcaaugucuguuacuucucugucaucaccaauagucagcuagaacauaacuuuucccucagagaaaguuacaugaagguuauauguaccaggaauuagagacaguuuggugaggaagacauuuagccauuugucaaacccauuuauuaacuaaaauaauuuuuggagaggacuuaaacaugaaaaauaccucagucuacaugauaagacaggcugauauaaucagaucauugaauuguuucuuguucuuuuccaguauuaauuuuaaagacccacaguuugcugaagauuacauuuuuaaagcuguaaugcuuccaggagcaagguaacaacaguaaauuaccuagauuuauuuuguacaaaugguuuucaucccuauuacuaaguguugucuuuuuaaauggucagaaagccagcagcaguacugaaaccuagugacugggaaaaauccagcaauggacggcaguggaagccucagcuuggcuuuaaccgugaccggaggccugugcaccuggaucaggcagccuucaggacuuuggggugaguugucaguuuuuagcccuuguauauuuugcuuuuucugaaucaucccauaaaacaagucaguauuuaugccauauauauaaauuuaugccauauauauaauauaugauuauauauuauauauauuauauauaauauauaauuacauauauaauauauaauuauauauaauauuauauaauauauaauuauauauauaauauauauaauauaauauauauauaaaauuauaaauuuauauauauauaauuacaggagugagccaccgugcccggccgaaacccaguauuuucauaaaguuuauauauauaauauauauaaauauauauuauauuuauaguuuauauaauauauauaaauauauauuauauuuauaguuuauauauauaacauauauaaauauauauuauauuuauaguuuauauauauaacauauauaaauauauauuuauaguuuauauaauauauauaaauauauauuauauuuauaguuuauauauauaauauaguuuauauauauauauuauauauauaaacuuuaugaaaauacuggguuugggccgggcacgguggcucgcuccuguaaucccagcacuuugggaggcugaggcaggcagaucaugagaucaggagaucaagaccauccuggcuaacacagugaaaccccgucucuacuaaacaaaauacaaaaaguuaucugggcaugguggcaggcgccuggcgccuguagacccagcuaguuggcaggcugaggcaggggaauggcaugaaccugggaggcggagcuugcagugagcugagauugcgucacugcacuccagccugggcgacagagggagacuuccgucucaaccaaaaaaaaaaaaagggaaaaaaagaaaauacugaguuuguuucacacauauauuuuugucucaccaccauggcagaccaccacuacuacuauguccucucauaacauugcuuacauacuuaaaaccaagcaaagaguggagcuccaucuuuaaaaccuaaacaggcauuuuggacaacacauuauuguacaccacaaauaucuaacagaccauaaaauacaacuguuuuguaaguauuuuaauaacuuugauacugcucugcuuuucuucauuuuuaaaaauucacuucuccauuuauguauugcuauauguguugcaugagaauucuauuacuuucucuaagacguuuuacuguuuuucugacucuuacuucaagggaauaaaaccuccucuuuacccgcaagaaaguuuuagcugaauuaauuaauguaugauggagacucuuuuucaaguguuaaccaauauauugguguagaagccuccagucucuuaaauuuuuguuugcccagugcuugaacagugguaucucguaguugcuugaauuggcauuucccugccuacugaaauuaucuuuuaauauguuuauuaguaauuuguauuuccucuccuaugaauuuccaguuuuuauccuuugcccuuuuuaguuaacugaauugucuuuuuccuagcuguagaagauacuauagagagaggggacuuguaaacaauaacagguaaagcugguauagaaagagcaacaggcuugccauaauguuaaugaguuaggauucaugcauuaauaaugauaacuuauaaauagauguuuccaguuaguggggaaaccuuaagauucaaaaaauuauuuaggcagaaggucaccaucaacauguaauuuauacagcaaauauuaagagggauaguguggcagagugauuaagagcaugggcuuuagaucuuaaaugucuggauucagauaccuuuuuuuuuuuuuaaccacuuaauauacuugugaacuuuaccgaaccacucugugccuccauuuccuuaugucugagguggagacaguaauuauaccuacauauucuuaaaauuaugaaguuaugagaauuaagugagccuaaugucugucaagcgcuuaggguaguuccuaaacacuauguaaacauuaguuguuauugucauuguuuuggaaaaaucuucauucuuaguagcaguaaaagaaaugcagauuuaaaauagucuuaacuuuuuccauuauuucaacuguuuuggaaagcaacauaguauuuccucugaauagagcagugaguucagaagauacucuuaaccuuugguccaaauuccuaccucuuggauuugugaggaggaaauaauuuuagaugagcauaauuauaugcccaaauauuuauauuguauuguaaucuauacuacuaguacgaaaugagagaaaugguuuaguaaaguauaagacaucaacauaguaaaguauucuauagguuuauguguuggaauuacaaagaugaagaaaagauacaggcaaguauuugauauaguaaauuaaaaauagcaagauguagaguagucauguauacagugauagcaagaacauggauccuuaaggacaaaacugaaacauaaugcaaaaaaagaaaaauaugcaaauuauuuuucguaugauguaaguuguaaauauuuaaaugguuaucaauuaagagucuugguguggcagaugaacauuugcuaucacuauuaccauuauguaguuuugagcuuuaauuauaaaccaccuuuuuguuuguauuaucuuaaucagaucuguuagugaagacguggcuaugagcauuuguuuuauuugugucagcuguguuaugauggguauaucacuauacaauuuuuuuuucuuguguuggguccuuuuauagccaugugaugccaagaggcucaggaacuggcauuuacagcaaugcugcaccaccaccugugacuuaccagggaaacuuauacaggccgcuuuugagaggacaagcccagauuccaaaacuuaugucaaguaagcuuuuacaaaucgguuauuuuacauuauaaauuaaauaucacagcaaauguugguuucuaaucuucuuugcugaaaaagauuuguuguaucagugcagacagugaacuuuaaaaacauguaaguuagaagaguugugagagaauaccuuaugcaaaaucuuucauacauuuuuuaucuuuauuuuuguggguacauuguagcuguauauauuuauggggaacaugagauauuuugacacaggcauacaaugaguaauaaucacaucaggguagaugggguauccaucaccucuagcauuuaucuuuuguguuagaaauaauccaauuauauucuuaauuauuuugaaauguacaauuaaauuauugacuauggucauccugcugugcuaucaaauacuagaucuuauucauuguuucuaacuauuuuuucauagccauuaaccauccuccccuccccaacccuuccccuacuacccuucccagccucugguaaccguccuucuacucucugucuccacgaguucaguuguuuuaauuuguagcucccacaaauagugagaacaugcaaaguuugucuuuuugugccugacuuguuucauguaacauaacgaccuccguuuccauccacauuguuacaggugacaagaucucauucuuuuuuguggcugaacaguacuccauuguguauauguaccacauuuuauuuauccauucaucuguugaugcacacuuagguugcuuccaaaucuuggcuacugugaauagugcugcaguaaaugugggagugcagaugucuccuugacguacugauuucccuguuuugggguauauaccuagcauuagggauugcuggaucauaugguagcucuauacuaauuuacauucccaccagugguccaugagaguucccuuuucuccauauccucacuggcauuuguuauugccugucuuuuggauaaaagccauuuuaacuggggcaagaugauaccucauuguaguucugauuuucauuucucugaucaucagugauguugagcaacuuuuuauauaccuguuugccauuugugugucuuuugagaaaugucuauucagauauuuugcccacuuuaaaaucagauuauuagguuuuuuuccuauagaguuguuugagcuccuuacauauucugguuauuaaacucuugucaaauggauaguuugcagauauuuucucucauuccauggguugucucuucacuuugcugauuguuuccuuugcugugcagaagcuuuuuaacuugaugugauuacauuuguucauuuuugcuuugguugccugugcuugugggguauugcucaagaaauguuugcccaaaccaauauccuaaagauuuuccccaaaguuuuguuguagcaguuucauagauuuaagucuuuaaacuauuuuuauuugauuuuuuauaugaugagagauaaauuuaugguuuuauucuucugcauauggauauccaguuuucccagcaccauuuauugaagagacuguccuuuccucaguguauguucuugguuccuuugucgaaaaugaguucacuguagauguauggauuuauuucuggguucucuguuguauuccauuggucuguuaucuguuuugaugccgguaccauacuguugugguuacuauugcucuguaguauaauuugaagucagguaaugugauuauuccagcuuuguucuuuuugcucaggauaacuuugauuauucugggucuguuuuucaucuugacuauauauaguuaaaugaauaagguaauuuggauuucuuccuuaaucuucacuuaaaaucuguuucucaguuaacacaggcaaaaaaaaguaugaggaaaugauugcaauuuauuuaauuaauacaaguauaauuaaaucagauaugguagauauggaucgucaucacuuaguugccugaaagacaaaggugucccuuucuugauucaaauuguaucucaaugcuaccuacaauauagccagggacugcuuuagguagacuauaccuuuaacccuauauuucuggaagacauuagucuuuccuuaaccccucauaaucuguuuuguggacaggucagaaauguugaccacaaaaauaauuaacauggcauuuggauugcagugggaaagggaaaagauaguugaauguuagacuucauagauuuuacauugauuuuaaauuguguccccauuuaauguuauuuuugagcuccauuguuaugcccauuuaucaaagaauuguaagucaugugccaguguuuguuucucaaaaugaaugucuucaugaaggcuuuguuucuccauuccugguugucugguugccacaagggcagcaugggggagaagaaacaguguggcaagaugcucacguuuguuaaaucugagugucauaucauuaaaacauuuuuuucuaaauguuugaaauauuucauaaaaauuugauuuccaaaaaacagagugauacuuuguuauagauaccccucagagcuguuuuuaaaccgaagcuguacuuaugaaagaacgugccagguuaaaauggauaauugaugggaaauauuuguacuaugcaccuagcacuguuguaaugcuaguuaaguuacacaccagaaguccagauuuucuggauguaguacccaagaagaaauugguucuauaggucuuacucuuucagggcccucuguuuuuaguguauucacucucugucucuguuccucucucuggcaguguagcuuugcuguauagcuuaaugacauugaguggagcuuugugaggcucuaucaugcaaacuauggacuuguguucagugaagcacagaaggggcacagagguacagagucagugguccugugggaaucugcuuggugcaguggcuaacagcugcuucccguaagauuuagcaaauaacauuucuagguauuuccauguauucaguaucaagucauaccauguacaacaggagagucuaaucauuuugaaggagcuaucuuugcccuaagauuuuacuaauaaauggugaaagcauauccaacauauuuuuaaagccagcuguuacugacacauuccuuaucaguuucuuuuuucuugugacuuuuuaccauuuacauggauaccauggccuuuugcuucuagcagaaggaucauguuccaauaauaagggaaagaagccagaagguucuuuuauuuauuagcuuuacaccaaaggagagaauuucaugcccuuaggggccuacaguucuauaguucuucgucugccuucuuuggaaauagacaacucuuguuugcaucuguguauuuuauuucaaauaauggaguccccucucuacuuuuauuaauauuacuuugguuaaauaacuccuuauuugccauuguuguggcuguuauuagauuuaauguguacuuacaaaguacaaaauacuuacagacuuuaauuagaauguauuccaguuagaauaucuuuauuucaguuacgucaugaaaaaauugggagauauguuuuguaaaguagggauugauuuagagcaagaaacaaguacccucugccucgugacuuguaaacauugacucaacugaggauuagugcugggacucuaaugacauuuaacaucuuuucaaagggcacaggaaugggaggagugaaaaaguuuauggacaaaaaauuggcaaucaugugauauuuaaauugagccaacaaguggggaauuugggcuccucuaggcugagagaaaauuaugagcuuugaaguacauggcaaguaguugggugguguuaagcauagcauaacugguacaaaauuagacugggagcauacuuggaacagauuaugaggggaggagagcuaauuuuuaaaauauuuuuagugauuuuuaaauauauuuuuaaaaugcauuuuuaacuacaguacauguuaauugaauaaaauguggcauguagcaauaaaacauaaaaaacacccauaauuccacagucccgaaauaagcaguguuucuuuuuauuauuucaugugugcaaguuuugaaaauuagauuauuguacguguauuuuuacauauaguuuuuuauugaaauguaacauauguaaagugcuaaaucgaaccguacaguguaguuuuuaugaaauagauauauucauguauucaccauucagauucaguagaaaagugucaguccucagaagccccccauuguguccuuuccaggcacuacccccugcccauuaaagggaaccaguauccugacugcaguaucauaguaucauacauuaccuuuuuguuuuuuuaacauuaccuaauaguuuaaaaagcuauuacaugacuacccuuuuaaaagcuugccuuuuuuucagucuuuguuucugagauuuauauugcuuguagcaguaguucauccguuuucuuuuucuuuuuuuuuggucucccugagauggggucuugcucuguugcccaggcuggagugcaguggcacaaucuuggcucaccacaaccuccaccuuuuagguucaagcaguucugccucagccuccuguguagcugggauuacaggcaugugccaccacaccuggcuaauuuuuguauuuuuaguagagaugggguuucaccauguuggccaggcuggucuccaacuccugaccucgugaucugcccgccucguucucacaaagcgccgcgauuacaggcaugagccaccgcgcccagcaguucaucuguuuucauugcuuauaguguuaaaucauaggacuauaucaccauuuauuuacuuauccaguagcauuuggguugguuucugguuugagguugcuggauuggacugcugugaaacugugcguccuucaaugcacauauguaaacacucaugauggauauguacuccauaggaguggaauugcaagacuguaggauuguguguauguucagcuuuagugaaugaaagugccagacacauuuuccaaauuacauucaguuuguaugaauuuacacuccuccagcaguguaggagaguucugguugcuucauguuguugccaacccuugguguugucagucuuugcacuuuuagcuauuugacuaagcagggagugaauaucucaccgagcuuuuaguuggcaucuuccuggugacuaaguggagcauuuuuuaaaauguuuauugaccauuuggauauuuuuguuugugugaugguaguguucaagguuugugugguuuuuuuaaauuggguugucuaucuuuuuguuuuguaggcguucuuauauucugguuaugagaguaguuuuauauuggaaauaucuuuuuccacuuggcaauuugccuuuucgcuuuauuauugcugucauaugaugaacagagguuuaugccagcauuuagggaaugugggugaaggggaugugggaauucuuuguacucaucuuguaacuuuuaaguuugaaaucaucacaauaaaaaauucaggacaaaaagaauuaauacuauauaauugauguguuuugauguuuuaaguaacaguaucuuaaauaucacuuucuaauugcuuguuuauauguagaaauaaaguugauuuuuuugauauuuguaucugacauccuuacuagauucauuucuucuaauaguuuauauguucuuugaaaucuuuuuguguacacaauuaugucaucuccaaguagugaccauuuuauuuauuuauuuucuaaucuuaaugccuuuuuuguuuguuuuuuguuuugcuuuauugcacaagcuaggaccucucauaauuaauagaagugaugaugguagauauuucauucccaaucaguuuuaagggggagacuuuuacuguuucaucauuaaauaugagguuugcugcaguuuuuuucuguguagauaaccuuuaucacacugaggaaguucuucuauucuuuguuucuaguggguauugaauuuuaucagaugcuuuuuucucuaaaaccuggggguuuuguuuguuguuuuuucuuuguuguguuaauaugguaaauuacacugauugauuuugaaauauuaaaccaacauggcauuucuggaguaaaccuaauuucuggaauauaucaucuuuuuauaugucacuacauucuaugugucaguguauggugggauuuuuaaaaucuauguauuaugagagagauuaguuuuauuucccuuuuuuggacguucugggguaggguuuuucuggccuuauaaaacaaauuagaaaauauuuucuacauuuuuguucucuguauggguuaucguuagauugucgucauuucuuaauuuuuagaagaauucaguggccaagccaguugggcuuagagauuccuuuaugaaaagguuuucaauuauagauucaaauuuuuuaguucuggcuuuucagauuuuucgguaauucuuauguugguuuugguaaguucuuuuuuuuuuuuuuuuuuuuuuuuuggugggaaugugcccauucuaaaauuucaaauuuauugccagaaauuuuucauaagauuuuuaaugacuguaagacuucaaaauuaagugcugauacugguaauauauagucacucuucuuuucuugauuaguguugcuagaaucuauuuaauuuuuuuuuuuugagaaccuauuuaauuuuauuguuuuuuuuuccucccauugaacuaaccuuuagcuuuguugauauauagauauuuguucuuuucccuccauguacauuuguuuucuauugauuucugcuuuugucuucauuauucucuucuacuuuuuugggggauuaaauuggcauucuuuuuccaaguuuuugagauggagacuuagguaauuuauuuuuggucuuuuccaauauaugcacuucaguguuacagauuucucucuaaucacuuuagccuuaucccacaaaguuuggucucacauauuuauuaucauuuaguucaugguauuuucugauuuuuauuuuuuauuauguacccauggauuauuuagaaguauauugcuuaauuuuuuuuuuaauuuauagggcuuuuccaauaaucuuuuaaaaauauauuuauuucuuaacugcaggcuaaauuucuagaaaugguauugcuggaucagaagguauggugaauuucuagacuuuuggucaguaucaccacauuaaccucuaaauaagaguauaccaauuuguacuuccuacaauagcauaugagaaugucuaauaucccacucccaccaauaccagguguuuuuauuuauuuauuuauuuuuuauuuauuuauuuauuuauuuauuugagacggagucucucucugucgcccaggcuggagugcaguggcgcaaucucggcucacugcaagcuccgccucccggguucaugccauucuccugccucagccuccugaguagcucggacuacaggcgcccgccacuacacucggcuaauuuuuuguguuuuuaguagagacgggguuucaccgcguuagccaggauggucucgaucuccugaccucgugauccguccgccucggccucccaaagugcugggauuacaggcgugagccacugcccccagccaccagguguuauuuuuuaaaaguucuuggccgggugcaguggcucacaccuguaauccaagcacagauuuaaccaggcguggugguaugugccuguagucucagcuacucaggaggcuguggugagaggauugguugagccccgggaguuugaggcugcagugagcuaugauagcccacugcccuccagccuggguaacagcaagacccugucucuuuaacauaaaauaaauaaaguucuugcuaauuugauaaggaauaaugugucuuuguuuuaagauaugauuuuucaauuucugcuuuggucauauuuuuacugaccaguuuuucuuuuguaaguuggcuguucuugucccuugcugauuuaauuugggcacuagucuguuuguuuauaagguuuuaaaaacucuagaagaauuaaccagauaccucuccauuguagaaccacaacucuguggguuaaggagagaugaugagggucugaacuacacuggcagaguggauccaaaguccggaaggugggaggaagggaaggcugaaagucuggauaauugaauaugaagagugaggaggagagggagaagggaaugaagaguccugugcguucacugugaugccugggugcuuacugaggccuuucacagaguuuggaaacccaggagggugaaggaauaugaaagaaugugaugagugaguuugugggggucaaagugccugaaauacuuuagaggcaucugugcuagguagucauaggagucagguucuugcucaagagagagaggauguaguuggagagaaauuuggggauugucugcauauaaacuagaaacauaaaagcucaaaaaagaguugaauagauugauggauuucgauugcucuugguuauaaaaaaaaccuuggaaagcuuggguuaagaguuuggacuuccuagaaggcaaccaugucauuucacaaaucauucccugauacuuuuguaagaaauguauuggauaaauaauuagcuucaucuagaauggucauuaaaguaugauaaguucaggcaaaugcugcagacaaugaagaaaggaaaucugauauuuuccuaauauucuuuaagcauaguccaacauaugauuugucgguuuuuucuuuuuuuuuuuuuuggucagucuugcuuugccacccaggcuggagugcaguggcgcaaucucagcucgcuauaccucugccuuccagguucaagugauucuccugccuuagccucccagguagcugggauuacaaguaugcaccaccaugcccagcuacuuuuuguauuuuuaguagagucaggguuuugccauauuggccaggcuggucucaaauuuccuggccucaagugaucugccugccucagccucccaaaguguugggauuacaggcgugagccaccacguccggccuguguuuuuuuuuuucuuuuaguuuacugucauuaagacuucugacauauuuauuuugugaucuuguuacuucuagauucaauauuuguguagaaccagucuucaccuauguaucaaucuuucauccauucauccacaucuugcuauaagaggaagaaaaacacaaaaggaagagagauagagggcaaggaaaagcauccuuaagaugauuuggacuuggauggacgggauuguagagugaaucuaagcgccacaucucucuguugcuuccucuggcuaugagggcagagagguacuuuuuugucccuagggagauaggcuugaccaggaaggggaccugguucauuucacccaggcugucacggcuucgagagcaccucuccgcucuuuccgucccucgacagaccggcugaucucuuugaagugauguuggguuuugguuugugcuucaggaaccgcugauacugauuuuuaucugaucccuucucuuuacauuuuaagugccagauuuugagggguaguauuauccuuuuaaaaagagcagagauuccaguguuuuagccaagauguuuucuuauuuucuuccuauaaauccuguauuugccuagaugcuuacaacuaaaauguguguuauuuuucuuuccuauccuaauuggauaugaguaauaaugucgguuguaaaccuuuaagauguugagaguaguuguuaaaccccccauccagucuuguugaaacuguaaguuucugagccuccugauuaagcagcacaaaaucaugggugguucuccucugcgucuucugaaauaaauuaacaugaagugccaucucaaccgacagcauaaaugaaugugaaacuuugagauugcacaguguaguagagagugguuacggggacauagccccuggccucacucugugaccucugacagguuuggucauugccccaguuuccucaucucgaaaauaguacagaggauaagaauauuuaccugacaaaauaaccagacuaaaugaauuuaaguagcuaagcacuuaaaauaguacguuguacauaauaaguacugugaaaguauuaagugauaaaagaucaucuuuccuuuuauagaauuuugaacuuuaaaauuuagucaaauagcuuguuuuaguaagauugaguucuaagccauuuauucagucuaaaauauuuuuaguaucauaaucauuuucuucguguaguaugaaauugcacucaagaagggccauuuggucaaacugacaacugucaagugucugcuguagguauuucuuauuguugguguuugauuugucuuugaugugucaguuuuggcugaugaguaauugucugaguacugauaacuuguuggaaucgaguguagcccugaguacucagucugaauaaagcauuugguuucuguagcccagagaaccuuaaaugugacuucucuucauuuuagucuguaaacuugucaauuagccacguugaaaagugauuuuugacuagugcuaucaguaaacauggaaucuuuucugugauugccacgcugauuagguaaauugucacuugagaagcuauuggcgaagcuugguuuacauggccuuagagcucuagaaaagggauaaguuuuuaaagaccaaaggaaaaaauuuuccacucucgccuguaccuucugaagugcaauucacugucucagaauuuuuuuucuuccucucaaaugggucuucuguuagagccauacaaaugaaugauaauaaguuuguuuuaccaucuacuucauuacagaucagccaggaaauacuucugcuuuaugaauacuuccagguuauauauguuacuaagagccauaugaagaaauuugguuaaaaauagccuugaaauauuucuuugagccuuuuuucuuuuuggauugaaaacaaggaguguuuuaacaguugcaucagaguuuauugaaaguuuuggaaaauuugcuuagguuuuaacaaaaaacuguaauuuuuguaugugcugaguuuauauggaaaaagaaaauuguccuggaggugagagauagaaaauggaaaauagagaggcaccuggcacacuagaagugauauauuagaaauguuugcuguuuuuuaagacauuucuaguuguauagguuagacaacuaguuguauagguuagacaauuauuuccuccuccaaaaaaagcauuuacacuuaguaaacuuuacauuccaguucuacuuagaaauacugcugugcuuaaucuaagaauagcauguuugagucuaaugaauauauauuauggguggugauggcuucaucuccauuagcacaguuucuaggacaaaauauacaaguuuuuuucccaucuuuauuuuucuuaaaacauuagauuguuucugaagguuucucuuaauguagcuguaucuuuguauugucuucauucgauuuuaaauuuauuagggagccacuguggaagcuuucguaaguaccauggagaauguguauccugcgauuauaccauacauaaaaagacaccaggcaagcacaauauggaauuaaguccuaaugguaaaaagggguauguuuccaggguaaccgcagugauuccaggggaugugaaguagagggguccggaugaauauuugcuguauuucuuuugacuucuguuacauuugcaaauuuuguauauauaagggcacuaaaaugaaauacuucugggaacauuuuaacugauucucacuaaacuaauuuuguacaugagcugaaaaaguggcucaaacauugauuuuacuuucaguagauuacuuucucacaaaugguaacucauugaaauucauauauguaaauguaucuuaaguuuucccauagaaauaaaccauacaaaugaaaugauugcuauuauuguaagaacuucuuacuuuuaucucuucagaaaauugauuuucugauaguguauagucuguaguaaugacucagaacuuacucugggcguaggguggggaacugucuuccucuguuuucuguggaguguguaguagucagcauccuccacauuguuacucgguuugacugcuaguaguuugguuuuuaagaaauaaaaaaggaacuuaauuccaauugacuaaagauaccaccuuuuaauucacaaugggaaucugccuggaagugacagcuggugaagggcuuccugcaccuuucugagagguggguuuggcacccauggguauggcugcagaaacuuuuccagcuggccauggacugaugugggagugggcuguggcagcugcagauggcugcccuccuucagguaguuuguccacauaaggaaaacuuucuucagucuggccuucucagcaugucgagaugggaaggaagccagggcugaggcugccaguuaugagcuagaaucauugugagcagcuagauauuuuauugauuccguguucuuugucauggggcuuuuaaagcaugauucuacuuuuuucuuucucucucuuucuuaaguaaaaaccauauauauuuuugguuucuaaccagagauaagcuuucaacucuucuuuucuuuaaguaauuuugaaaagcauuuuucuaguuuguguuucuauuaaaaugugagccugaauacauuaugguaagcguuguccuuggucucgggagucuagaggagguuacuguccucacauggugaacucauuagacaacuucuggaaccagcaguuuuaauuaggucacagcagaccccgcugaaggugaagugacugcaagcugugguucgcugauauagacaggcccagauguuucuuucauccuauauccgucaguuuauguagaagagcaggagccauuuaauuguuucuucuaguuagaugauguugcuaguucagcuuugcguuacaagaaaacuaucagaaaagauggagaaguggguggucccuucauuaauguguuuucuugguuuguguuggagagauugugugugcucugcuuaauguuaaugaaagcaauuuaugccuucagaaggaaaauuucaggauuucuguuguagauacuauucauucaguuuguauuaauucuauuuauggaaaagaacuaaaccuuuccuuuuccacagcauuuaaaauauaaauguaaaaacuguguguaauguauguaucuuuacuuacacacacauacacacacacacacacacacacacacacaggauuaugugaguuuagugaccagggguuacuaaaccuauuuuguuaucaaaggaaaaauaauaaaaaauuugcugaccuuguuaguuacuuaccuuuuuacauuugugguguguguuauuaugauacuaguuuauuugguuuacagucuuucucagauuuuuuucaagaacuuuuaauuauaaaauauuggguaguugaauauugguuacuuuuaaaaaucuucuuaacccuuuccuguuucuuuuucagauaugaggccccaggauuccuggcgagguccuccuccccuuuuccagcagcaaagguuugacagguaauauuaaaaguagacaugacuuuuaaauacuuucugacaccaacauuugggguuuaugguuuuuauggaagcuaaaaccucugugguuugaaauguacuuuuucccaccaaaaacaauuucccuugugccuauccuuuaagaaaauauauagcuaauacuuugaauuaaaagacucauguuuaauauacuuucuuacuuuucuugguucuuggccuuuauuuuauugaugcuuuugagaugcccugaaaaaugcaacacagcuuaaaacuguauuagguuuuggucaggcuaaacaaauuucuuuuuagaaggguugugcagcuuaaugaggcauaacuaaugguguuccacuuuuaucauuucugugcgggcaaugcagcguuaguacagaccaaccauugauucuugcuacaaaccucuugaaguccuaaucagcuucuuugguacaacuuuuucagggcugacaagccuauuguagggcagugucacuguaggucaguaguuauuaguugccacugaaaacaguuucuuuaacuacuuaagacugaacugaauuaaacgcagaagggacucagaagaggauuaugggaucugcagucuaauaaguaccauggacuaggaagaaugugacaugguuuaauaacaagggauguuuaacauguauuccuucauugauaaguugugugcuccuaaguccgauggacucuguacgacaagacaacuaggcacauuaugaauaauuaacaucuguagaauaauuuuuaaaggccagcuuuaagauguaucauuucaugaugguuuugccaacaucaguaaaugcaaaaacaaauuaagccccaucauaauaaggcuuucuuuuuugccuucccaguuuuaaucuguuuuauucucuucuccucugccauguuuacagucucuaaucuguucacaucugaaaugaauaguguuuuuauaaaugggauucuaaaugcagcuucccuuuuaagaaaacuuuauaacucuuuagagacuccagaacuuuauuucauuguuaucuucaagaggauaaaaggaaucauguuauucgauguuuacuaauagugucaacuuagugcaagucucauuaaaugcaauacgacuagcaauguguguauuaauguuuugauuuuaguauauguucugaaagcacacaguaugugcuguuucauuuuccucaguaccacaaauuuuaagcagaaauuaaguaaguaagggguaaauuuuuccuaaauuauauacuugguuucucuaucuuauugcucacuuuccauacuaauaauaauggcaaauguuugucugcuuacaaaguguuaacacuguguuaacauccuuuaauaagaaugauuucauuuauuccuccuagcagugcauugaaauagaugcuguuauguuuacauuuuugcaaaugaagaaagugaggcacagagaaguucagcagcuuaccuaaggucacucuuuugugccauucuuuaccaagaaacuuuucacuggaacaaaacuuaccagaauauuuacucugagcguaauauaaagacguagggacuucaaaggaaguaaaggaucuguuuccacuucuaaggccccaacagcuuuccuccccucuguucacauuaaaaguuuuccuaagaucaucaucauugucccuucccuuacccugcuguccaucagguuuuguucuuauucuacccuagccaaguacuaguauuauucugacuuugugaacccagcagguuagugacaaguuuugugggaauguuuuuugguuuaguuuuagucagauacuuaaaauuaugccugaaagcaaaagguaaaugugagcauaauagaguucuaucauaaaagucuuacaucacagacauuuaagaaagauaccauuuuguuccagaaccagguuuuaccaguucuuaguucaguauguuuccacgacgcuacuguuuguugagaauccuauuaagagaauuuugagugucuuuuuuuuauuacauugcauuucuugaauaauuuccuacuuuaagaugguauguauaauccauauauccaguagauuuaaaaauacaacaggaacauccucccaacacagacacagccuagaguuaauagauacccagcauuggaguucccuuugucacuugaguuuugccacauuguuuggguucuucuugucaauggaggccucuuuuucagucauuugcaaggcagccauuuaguuuuuuaccuaugaguguuaagcucaaucaugaaaaaucuuuuaaauaaaacuccgauuuuaccauaugcauacauuuaaaauauucaaauugguaguaguucacaucuccaguaacuuuccaaaacaauuuggaaacuuaaaaaaauuguugcuaucuacgaugccaaauggcucaaauaaguugccuuauuuauuaacuucuuuuauugauuuauugauugagacaaggucucacucugucacccaggcuggaguguaaugucaugaucuuggcucacugcagcuucugccauccagguucaagugauucugaugcuucagccuuccaaguagcugggacuacaggcucccacaccaccaugccuggcugauuuuuguauuuuuaguagagacgggguuuucccauguugccuaggcuggucucaaacuccugggcugaagugaucugccugccucggccuccuggagugccgggauuacaggcugaguuacugugccuggccuaauugcuaauuuuuagaauuuaggauaugucaguuucugugcuucuaucccagauuuuaaaacauaauuuccuaggcaaauuuuuaguuuuguaaguauuugcaaaauauauaauuagucuagacaugugauaaacuuguugaaaauaaaggccuuucugucauaaaagucagaagaagguaguacaugacauccuugcuuuguucuucuguuuaauuuuaauuauugaugauuuuuuucauaaaaauuauauuugucaaaaacauuauaaguaaucaauucaaacaaaaagaacuuugcguuuuuaaacuguggcuuuguucuuaaccuguuuuuggaacauaaaauaguuuugaauugcauuuauaauguauauuauuuaugccagcagaucuuccuaaaacucaauugaauuuuauuauuguaagacucaaaagaaaaacugaucacaguuaagaugugaauuguguuuuuagcccguggguuuugcauuaauuggcccaguuuugaugagacuuugguuacagcacaaaccuuaguuuagcccuucacuccugcagagacuggaagagaccauuccuaucucugcacacggagcucuucuugcuaaaacagauggaggcauucuugcuaaaauauauuugugcuaguaauuguccugaaaaauaauuaaaagcccuagccauaugcauuuucuuucugagauaaaaacuuauuuuuaauuguauucugaauuacuuauaacacauuguuauuagagcucugguuucagcuaccaacuguaaagaaaaacuuuagccuuucuagaguucuuuagagagcaguucauuucuucgaaucaucacacaaaaauaauuaucucugguguuguuuuaauaaaaagaaggcaagcuccaagugaagggaggagaguggggguagagaggauggauucaggcuugaauagcugugagaagaaugcuuuacccaaugagcccagcgccgggcuuuuuuccccuaagaccucggaagugaaauucuuaugcugauaugguuauaacugauuaccagcuagucagcacuucagugaauuuaaaguuuuauugaauuccuccuaacauggucaguggccccaaagcuucugauguucaaguauacuggagcauuugccucuguuuauucuuuguagugccuuccauaaaauagaaguuauggaaagugccuuaaggagaaaguaaagucuuaaauggugauugccuuuagaagguauauccuugcuacauuguuuaugugacaguuuuuaauuaaguuaugauuuaguacauuauaccuguugcuuugcaucugcaaaguuaaaauagucacuugaagacaauuaaaacauuucuuucgacuaguaaucugcgacagcaaacuggguuauaauagccguugaaucuguguucccauguaaacuguacaccaaaugccagucagcccaugccaauuagugcucauguugcuaggucaccguggucaauugaaagcugcaucaauagaacuugaaaagguuuccucccaaucagaccuucugacauauugaacagaauaauggaugggaaaaaacagccaagucuccuacccuggauucaaaauacucagcaguaagaauucauuugcaaccugcaauuaaguagaaagaauggauccaagaacgagucuggacauuuuugaaaauaaagccucauucuccugucuuguacauguuuacucuuuggauagcaucuuaaauguagccaucuuggugaucuugggucuacaucuuuaagugacuaaaaaggaaauuucccaauugaaaaugaacaaaauaacuuuuaaaagucagaacuucucaguugaguuuaaacauccauuguaauaaaugcugaugcuucaugaaacauguuagauuauacuggauauaagggacacaaaggccauucugauacucuguaucccauaugauaaauccagguaaauuggauuguacuaaaauuuggagaugauaccugccgauuuuaggcuuugugcuguauaauagguguggcuucugauguaaaacugguacuuuccuacagaggcguuggggcugaaccucugcucccauggaaccggaugcugcaaacccagaaugcagccuuccagccaaaccaguaccagaugcuagcugggccugguggguauccacccagacgagaugaucguggagggagacagguaaaugguugugggaugaaaaguauacugcucacuuuauauuucaacaagccucacaggacuccguauuuucuuaccaacauuucuggagaagacacugauagaguagcuuagaguagcuuggcugaacuugggucugucauuaaaaauguauauggguugaguaccugcuucacuaaauagguuauauaccuugaagaugccaaagaauuucuaacccaaaagcccuuuaaaucauagcagucagugauaauuaguccaaguauagucagucaccaaaacacauuguuuuuccuuuaaggauauuguucuucaauagaaccuagaucccucuuaaugggugaugauuuucuggaagcuggaaaguaagucugcuuuuucagcuguugucuuuuagaagucauuuuacaauguugucauuuuagaagucuccugccuugauucaucugauaucccuccucauaaaagaaauuucugcuugauaaucuuccacauauuuuucuucucaauguaagcagcuguaucacugaaugacuaucauaauuccuagacaaauuuaguauauguaagcuucauguccuucucuuuacagcauccaguuuuagcagcauuuaagacugaggucuauuugacauaauuuccuccagcaauuugacacccuggccaguauuuacaugcucuuaauggaauccuuacuagagaacaagauuagaaugcugugauucagaguaauguguauggaguuuggcaccugcagugaugugaagugguuuuuaaauugcuuaccugguguugccuccaggccuuuugcagugcuucacauauuaauuaguaagaccucucuucucacagcuaaggaacauauuuuguauguuuuuugauguauucuuacaaguaucuccaccuuacaagaagauaaucaccuuaauugcaaauaauuucuucugagauuuuguuacaguuuauuugaaucaguuuaucgaauuuugcuuugaauucuuucagcccaggaccucuaaaaaucgugucagugaacuaaggcucuuuauguuacuaugguuagauggcacuaggccguuucagugaugagcauuuuugaagugaggacuauuuguaacuggaagaaaccuuggagaauguguagucuagucaccucauuuuccaagucaggaacugaaacccugaaaaccccacacgguucagcaggagaacugguagcuggcugccuagacugcugaccccaguucauccauuuuccucucuccuuuggagaucuuccuuuuaaaggaacucugugcuguuacaggagguaaaauucuuauuuacuuagaagauauaaaccaauugguaaauuuauuauucuuuuaggacuuuuugaaaauaacauuucuucuuucucagucccuuugccagggagauacuuuuuauuaaaucacaauuguugaagcacuauuaaauugcagaaguuuguuguuaaaaacauagaaucauuacuucauuguauuuuuaguaaaguuuuauaugaccaaacaaggccuuagccugcauucuggccuugagucugcacauguucauguuuaaaguacugaagugcucucuggguggcaaaaugaggugggaggggguuccauuucaaaacccuagaggccuaggaaaggacuuauaaugaagaggugucagguuuaucuuuuguuauacagaaauguuauuugcaaacauacuaggauauguuauaaaggucacggcuaauggauuguguaauaaccuuaauaugucauuuaaagcccuacuauuuguugcuaaauaaaaaaucccuaaaaucaauugcucauuuggccuuaacugacuuagcaagcucuugccuugguuaaagcaaaguuacuuuccuuguguaauaagucuaaauugauguggguaucuuaccacaaagugacuugaauuacuacugcuaggacagugagaaaauugagaaccacugucuguacauguuguuuacacagaacacuuuaguuauuugugugcauuugugauuguuaagguuuuuuguuuuauuuuucaguaauagcauuugugcuagccuccaacuuugcaacaagucuguauuaaagcucuggaucaaagcaccuuuuauggggccuuuccaugugcuguaccuuuaacacauacucaguuuccuuaugauguguuuuuccauagagguuuaaaguuaacugacuugcaggaguaucgguccagaaaauaaacucuuucuuuuguuuauuuucagggauaucccagagaaggaaggaaauacccuuugccaccacccucaggaagauacaauuggaauuaagcuuuuguaaagcuuucccaaauccuuucaucauucuacaguuuuaugcuauuuguggaaagauuucuuucucaaguaguaguuuuuaauaaaacuacaguacuuuguguauuucuuuuaacuguguauauuucuacugaucugaucucacuguuuauguugcuuuccaaagauguauguugcauaauacaguggaucugaauuuauuauugcuuauaaaacacauuugauggaauaggaguacugguuuuucauaaugguuaaaaaugaaaccagcuguggauuucaaaacacaguguauucuagaucaucuaagauccaugcugauuuuuauugcacaagaauuagguuugaacucgagcuggaaccucagcaaacuagaguauauauuguucaguauuucuuuggaaacauuucauuaauguacuugucuuacagaaauuucugaacuuuaguaaaaaaaaauaaaguuaaacuuuuaaaacucuguuuuguguuguuauuuugcaguauuucaacuuugaaaaucuugaccaagcgugguuuuuuaaaauuaacuuuugcagaaaacuauuucuguaaucagauguccaaaccaaaggacaaagaagucaaugaagaaguagauuuuaaaagauagggucagcaagacauaacaaaagcuuuaacuuuguuguauuaugucagugacugaucuggcuaacucagaaaucuuugugagauaaauuacauuuuuacaaauuuaauguagacuucuccaguuuuaaggacuuguuuuaaaucuucaaguugacaauuuuaauuaauggccaaauagucuaugcuccuuagcauauuuuuguaugucauuagauugcaauuuguacucauguuuuuccuugcuacuaaguacacuauaaauugcuuaaauguguguuuggaguucacauacagcacuuacauaugcauuuucauuugauugccaaaacauauuuagacacacauacagagacuauugcuuuguuucaguuuuucccuccuagcccaagauugugagguaaagcuucucuuugaccuccugacuuaggauauuuuugcuuuaauauucaacugaagcacgcuuguuaaacuuagucugugggaaaaaaaaaaaucucaccucaaccuugaauaggaagguauuuuguagcuauugaguucauugcuaaugaugggugaccagagcaggauccuuuauuguugagacaaagagucucuccaucaggaauuaccaacccaacccuuacauaauugccuucgcucaacauucaagugauaaugccuucuauuaaauuucucuguaaguuuaucucccaaauauuaaaaauguagacagccaucucaguaaagcauugcauauucuaaaggagcuuauaa

SEQ ID NO: 13436 - RNA, 4203 nt, Homo sapiens
auaaaaccggguauaacacuuuaauauagauuuguggaacucuggcccuugcagccagaauacacauuuauaagccauaaauaaagcacgcagaaaccauaaauuaaucggacccgagaccuggauuucaccgugucaagauugggaaugcuuuuuuuuucuuuuucuuggucauuuacaacagacccuuacauuauuuuuuuuccuguuuuuaaacaauaguacaacccucugguucuguuaaaacuacaugguuuuacaccgagucacucacaaaauuuuuuuuuuuuuuuaaguaagacuucccugcaacaacagcaauggaggagaacaacaacaacaaaaaaaucagaaucugcaggugcuugaagaagcaggagucuacacaguaguggaaaccggaggcuuuuuuuuaacuuuauauucuuucccguuuuccuccuuauauagaacgugggguaucuguguggcccucuguuugggacggaacggcugcagcgggugaagaagacugcugucuuggggguguugggguggggguguuauggauuucuucucccuugcgucucugcaacaccgucuccccaaagucucgacccccacuugcucucucacuuguccucgauccggggugccagaguuagccgggccugaagccgucgucuucuuaagaggaguucauaaugggccgggaguacacccccugguaguaggagguaucugcggccaggggcgaggcguccaggcccguuuuguucgugaccgggcccauggccaagcugccaggcaugggggaaccguagccgggguagugcaucaccuguucguaggccuugagguccauuuugugggguuggugguggugguggcugugguggugcugcugcuccgaggacaugagguuguugauggagaacgggugguugaaggcguagugguguuccggcuucaggugggccucaggcggcaggcccgggugguggggcgggcccagcaggugggccgcggccugcugcugcugcccgggagagggcgccggcucuggggggcucagcgccgcagccggcguccccuucagcucucccaggcccccucgcuugugcuccuggcacggggaggcgcucgagugaggcgacucggugcccgccggagucucggaggccggcccggcggccuccccgaguugagccugugaggccugggcuccggcggccgccuucuugccgcugccggcggcgccugcggccuccuucagcgccagcugcuucucgcacuugaagcgcuucuggcggcgcagguagcagccguucucgaacauguugcccgagucagggugcaggguccagaaggagcccuugccgggcuugucgggcgagcggggcaccuucaggaaacagucguugaaggagagcgaguggcggauggaguucugccagcgcugcugguucugccgguagaaggggaagagguccaugauccacugguagaucucgcucagcgucagcaucuuguuggggcucugcuggauggccauggugaugagcgagauguacgaguagggcggcuuugcgugcguguagcugcgccuguaggucuuggggucgcgggcgcggcucaggcccgccugcccguacauggggcucauggaguucauguuggcguagggggccaggccgcccauggccccggccgccugccccccgagcgggcucaggcugggacucaagugcggccccaugcccgccacgccggccgccccggccgagccgcccaugcccgccauggcgcccgcgccgggggacauccccgccagggacgggcucaugccagcgcccacguacgacgacauguucauggagcccgcgcucauguugcccgagccgcugcccauggcggccgccgacaugcucauguacguguucaugccguucauccccaggccggcguucauguugcucacggaggaguagcccugcggacagagccccgggagggaggcgacagcguuagcaccgcggcuggagggugcccagaccucccacccaccgcccaggccuccgcguccggggaggccuccggggagcccuuucguccccgauggcccagucuccggacuccgagucuguuucauucagggagagucaugaucgaucgcccuugggaagguggcgagcggauugcugcuugggcauguggcccguuccuagcccuucuccaccucgcccagauucuagaacaggggucccauggaguacucccaagccagcaccccaaauacauuccccuaccccagagucuccccaaacucucccaccagcauacugagcuggcgccgaggcccgaaguccccggacgccaccuccggucgcagcaagcaaccugcgggacaacgcgcggggcgccucgggcugccuccagcgaagacugucccgggcccccucuguccggucucccuccagggacccccucccuugucccagggaaacugcaaggcagugccugugcggagugcgggggcggcuggaggcacugaacggggcaauagggaaagaaccgagaccugaaccacacgcggcugagcuuugcaggcaaaaacuuucuuucucuuuguccacuagucuuugacucugccuccacuucagcccccaacuccuacccaucuucuccuccucagcuccccacccccucgccggccgaccucccaccccuccccagccgcgcgcugccaaacauaacucuguuaggauagugcguggcucggccacgaagaggauuuggaggcgccgcaagucaauauuugaucacaaaguuaauauuaucucaaggcuaacagugugucguauaaaaaagagacccauuugauuccaaggagggcggaaaaggcggcugcccagaaaggcugggguuguggggcggggugggggggugccagcgagggaagcgguccugagguuggggaaggagcgagcgccgccgcuccacuucccccuggaaaagacgagcgcuuaccucgggcucugcauaguagcugcuccagucggacggcucgugcccuuccaucuucaccgcucccagcauacuggaagccgagugcauggcaguuuaaaauuuaacagccacaacaaacgaccagcaaucaccccccacccccacccucuuuuaaaaaaaagucagccaaagcaccguccccuccucccucccucucucgcgcucccucucccugggcuccacucccucucucucccugggcaggccggaggcgguaguuggaagugggcgggaggugggggggggcgaggagcggaggaggcccaggccagcgccccgcgguagggagcacccgccgccgccgcgcucacgggcugccggguggcggcugagguuggcagugccgagcugccccgaggcggcgggaagcgcgcggcgcgggggcuaguggggggguggggaggaggaggaggaaggaggaggaggaggcggugguggugguggaggaggaggaggaggaggaggaggaggaggaggaggaggagguguggaccgcggagcggacaagugccgcagugacgugggaggcuggugauauagcgcggcgcgcuggcgcgggccuccaauccccagacccggggcagcccauuugaauaaucagcucacaccuaggugagagguagccgcagccggcgcuccgcaccugccccucagcgccugccguccgccccaccgccgcggcgccccgcacuccugggcgggccaggggagcgggcugggcgggcgaucgggcacgcgggaucccuggucgagcccccuuuccucccggguccacagcgaguccccugaggaaggagggaccugggaggaaaccacccucuggggcggcuccggccuccagcccccgccccgucucaucgcgccgggcgcccggugcgccugucggagggcgcguccagccucagugcccggcagaucccuaugaaagccggauuuauuuaugccggguuucuucgcucucagugcucauucucugucaaaacagcaaguccaugacagccaauuugcaaagcgcuguccuauuuagaaaaacuacguacacaccuuuaacucgcccgcugcugcuccugcgaggccccucccuguuacaguucagacccggaacggccucgggagaagcgcggggcgcacggucuggccgccucggcucuccga

SEQ ID NO: 13437 - RNA, 1605 nt, Homo sapiens
ugccccguucagugccuccagccgcccccgcacuccgcacaggcacugccuugcaguuucccugggacaagggagggggucccuggagggagaccggacagagggggcccgggacagucuucgcuggaggcagcccgaggcgccccgcgcguugucccgcagguugcuugcugcgaccggagguggcguccggggacuucgggccucggcgccagcucaguaugcuggugggagaguuuggggagacucugggguaggggaauguauuuggggugcuggcuugggaguacuccaugggaccccuguucuagaaucugggcgagguggagaagggcuaggaacgggccacaugcccaagcagcaauccgcucgccaccuucccaagggcgaucgaucaugacucucccugaaugaaacagacucggaguccggagacugggccaucggggacgaaagggcuccccggaggccuccccggacgcggaggccugggcggugggugggaggucugggcacccuccagccgcggugcuaacgcugucgccucccucccggggcucuguccgcagggcuacuccuccgugagcaacaugaacgccggccuggggaugaacggcaugaacacguacaugagcaugucggcggccgccaugggcagcggcucgggcaacaugagcgcgggcuccaugaacaugucgucguacgugggcgcuggcaugagcccgucccuggcggggaugucccccggcgcgggcgccauggcgggcaugggcggcucggccggggcggccggcguggcgggcauggggccgcacuugagucccagccugagcccgcucggggggcaggcggccggggccaugggcggccuggcccccuacgccaacaugaacuccaugagccccauguacgggcaggcgggccugagccgcgcccgcgaccccaagaccuacaggcgcagcuacacgcacgcaaagccgcccuacucguacaucucgcucaucaccauggccauccagcagagccccaacaagaugcugacgcugagcgagaucuaccaguggaucauggaccucuuccccuucuaccggcagaaccagcagcgcuggcagaacuccauccgccacucgcucuccuucaacgacuguuuccugaaggugccccgcucgcccgacaagcccggcaagggcuccuucuggacccugcacccugacucgggcaacauguucgagaacggcugcuaccugcgccgccagaagcgcuucaagugcgagaagcagcuggcgcugaaggaggccgcaggcgccgccggcagcggcaagaaggcggccgccggagcccaggccucacaggcucaacucggggaggccgccgggccggccuccgagacuccggcgggcaccgagucgccucacucgagcgccuccccgugccaggagcacaagcgagggggccugggagagcugaaggggacgccggcugcggcgcugagccccccagagccggcgcccucucccgggcagcagcagcaggccgcggcccaccugcugggcccgccccaccacccgggccugccgccugaggcccaccugaagccggaacacc

SEQ ID NO: 13438 - RNA, 3762 nt, Homo sapiens
acccgagagcacauuguuauuuguuuauuuuguacaagugaugucauaagcaaggauuuugccuguguucuagauuaucuccaauaaauaaauaacuauguacaaauauuuugaguuuacaaaauagaagaggaaaaccuuugucuuacaaaaguuacauuucuaugauacauuuauuuccauacacugaagcaggauuucauuccuagcuuagcugaaccaaagaccuugcagacccuguguggcagugucuagagcuguguaccuagccuuuucuaccaaagagcaaagcuacacaaagaaaauuccucaguuucuugaaaauaagggccugacuuggccugcuacuuauaacugaucuauauuucauguauuccagaaaauuggaagcagucuggaaugguuguccucaaauuacugagcagacacacccccugcagaucuuguuaaauauagauucucaugaacuggaugggguggagccuaggauucugcauuucuaaccagcucccaugggcagggcagcuuccaauucuuguucaggggccacauuccaaaaggccucucugaaaugguagaaauucucugaggaccugauuaaggcuaggcccuaauugggcauccuccaggauccauucccaagcucccaauuccacaagaccaguagagcugguuuuauuuuggucuaccagugacaaggaacagugacagucaauugcuaauuggcaugaaucaugcaguuugaagcuuucuugaacugucuccugggagguguuugucucuucucucaaucuagagcaaccuucugaacauuuucaacacugucaaaaauaaguaauaauaacaaaaaaggaaauugcauaagaagauuagcaacaauuaccauuuuucaguacaaaucaaaacagcaacaaaauucaggcucacuguuuaaaaguaaagauaaauaccucuuuggguguaauuucuaugacaguccagcaacaucaauuuaauaccuuuuacaucucaaccuuuguuuaaaauuauuuugcucugggaaucugaaauuucaggauaaauuagcaaaucuggugaaaaagcaaauggccauuuuuauuuuuaguguuuuuguuucuguuucauguagggguucugucugagcagacagcuaagagcaaaagaaguagggucaggcacagguagggugacucaggugaguuggcccaguuccugggaggagaaaacuaggaagaauggggaauaaguggggcuugcuucauaaaugugagagggcuaggaaaaaaaaauucaccaagauaguuuaccugucacaugacaagugggaguuuguagagagagagagaccggagagcugugcaaaguggauacuggagacauacagguaagaacaaaggaaacaaacaaaaaccuaaauacuuaaaaaaaauaaauauuuuagucaucccuagcccacgaggucaaggucugcccagaaggcugccgaccaauaacgcucacccuccugcgcccgguagugaggaccugggacaaaucgcagucugugucuucguuacaaaauugccaucauugcccagugguccagugacgucacggaagaggccgaggcucauucuccucccucuaaucacccccucgccaguuagccauggaauagaagaaaacagcuuggggggugcggggagggucuucuccagcuguaaugccagcuaaggugcuuugguagcaaagcugggggugaggaggcacaggcuccuggacggagccaggcuccuggacggaggccgcucagagucucugcggcguccgcucgguccgcacgugcugcagcacuaccuccuuggaaggggccgcgcacuuguacuccaucuuggcccuggcggcgcccugcuucuugcgcagguggcagaggagcgccaaaagcgccaccaccaggcacaggcucgcgauggagaugccuaugagcaagcccgaaugcacgagccccacggccggaggagucaagguggagccgggcgucgggcugggcgggggcucgccagagccgcugucgccaccguccaccuugccggagucacagucggugccaauguggcgggcaagggccgagucgggcccgcagaugcacucgaagguaccggggagguuguggcacaccccggagcagaagccgccguuuucgcacucgucgauguccgugcagaugaaaccgucguccaggauguagccuucagggcacucacagcuagccuggguguuggggucgcagucggcuggacaggcagucugguugcaaaacaucuggcaccugugcggcucguggggaaugggcgcgaagcccucggcgcagacgcagagguagcuaguuugguucaggggcuggcacugguacucgcaguuggcucugaagcacggguccacgggcuccacacacucgccguccaccaggucguaguuaggguagcaguggcacucgaagccacccuguguguugacacagcgcugcggacacggacugggcuccaguaugcagucauccacguccucgcaccgguguuggucggccgccagccgguagccggucucgcacaugcacgaguaggagcccggcuggucgggguugggaacgcagaagugcucgcagaggucguugcaggacugcgucgcggaugcggugcaggagcgcccgucugccugcagggcggcgccggcugggcacuggcagcggggagccccagggaucgcauugcacgcgugcucgcagccgccguucuccacgcugcagucccaagcgcccggcgccucccuggcccagugccccuggaccgcuccgggcggcgcggugcacauuagcuguaagccgaggggagccaccgcggcggagcugcccaccggcagcgccuggaaguccgcuccgcgggccgcgaacggggugccguaggugaucgagacggcggcagccgcggcgccgggcuccacagccaguggccugcagguggcugggaaguggaacucgcagaggaagccaucggccuucacuucgcacugcugcuccucccagaucggcucgcugggcacaguggccucagcagcggagacagcgacgcacaacgggccgcagaggggagccccauugaggucgagccgugcccaccugcuauagcugguguuguugucucccguaacccacuggaagccgcgcaggggcccgaggcgcuuggggucgccgcagccggguggcagcugcaggccgauccagaggcgccggcggccaacgccgccgucgccguucaguagcaaggaaaugacaucggcagccaccgaggagcgcacugucauuagguggccccgcaguccgucgcagaucugacuggcauugaggaaggucgcggggcccggguagagcgcgaagcagucgugcucgacgcacuggcugccacccggcugcggcucugcgggugcggggaaccccaggccggccagggccagcgcgccaaggaccaggaccccaagcauguuacccaggcgcgccgcgugcaggcgccggggaaagcgcgggcacugcgacagggccgugccggagcagaggggcacaggacgccgauggcgacagccucuccuguccgucccagcccagacacuucuugccgcugcgcgcagccccugcgaggcagccucugacaugcggaucggccagggcucgaguuuauaagugcccggcccucccucccuggacguucgggaaaaggaaggaagugccug

SEQ ID NO: 13439 - RNA, 3762 nt, Homo sapiens
caggcacuuccuuccuuuucccgaacguccagggagggagggccgggcacuuauaaacucgagcccuggccgauccgcaugucagaggcugccucgcaggggcugcgcgcagcggcaagaagugucugggcugggacggacaggagaggcugucgccaucggcguccugugccccucugcuccggcacggcccugucgcagugcccgcgcuuuccccggcgccugcacgcggcgcgccuggguaacaugcuugggguccugguccuuggcgcgcuggcccuggccggccugggguuccccgcacccgcagagccgcagccggguggcagccagugcgucgagcacgacugcuucgcgcucuacccgggccccgcgaccuuccucaaugccagucagaucugcgacggacugcggggccaccuaaugacagugcgcuccucgguggcugccgaugucauuuccuugcuacugaacggcgacggcggcguuggccgccggcgccucuggaucggccugcagcugccacccggcugcggcgaccccaagcgccucgggccccugcgcggcuuccaguggguuacgggagacaacaacaccagcuauagcaggugggcacggcucgaccucaauggggcuccccucugcggcccguugugcgucgcugucuccgcugcugaggccacugugcccagcgagccgaucugggaggagcagcagugcgaagugaaggccgauggcuuccucugcgaguuccacuucccagccaccugcaggccacuggcuguggagcccggcgccgcggcugccgccgucucgaucaccuacggcaccccguucgcggcccgcggagcggacuuccaggcgcugccggugggcagcuccgccgcgguggcuccccucggcuuacagcuaaugugcaccgcgccgcccggagcgguccaggggcacugggccagggaggcgccgggcgcuugggacugcagcguggagaacggcggcugcgagcacgcgugcaaugcgaucccuggggcuccccgcugccagugcccagccggcgccgcccugcaggcagacgggcgcuccugcaccgcauccgcgacgcaguccugcaacgaccucugcgagcacuucugcguucccaaccccgaccagccgggcuccuacucgugcaugugcgagaccggcuaccggcuggcggccgaccaacaccggugcgaggacguggaugacugcauacuggagcccaguccguguccgcagcgcugugucaacacacaggguggcuucgagugccacugcuacccuaacuacgaccugguggacggcgaguguguggagcccguggacccgugcuucagagccaacugcgaguaccagugccagccccugaaccaaacuagcuaccucugcgucugcgccgagggcuucgcgcccauuccccacgagccgcacaggugccagauguuuugcaaccagacugccuguccagccgacugcgaccccaacacccaggcuagcugugagugcccugaaggcuacauccuggacgacgguuucaucugcacggacaucgacgagugcgaaaacggcggcuucugcuccggggugugccacaaccuccccgguaccuucgagugcaucugcgggcccgacucggcccuugcccgccacauuggcaccgacugugacuccggcaagguggacgguggcgacagcggcucuggcgagcccccgcccagcccgacgcccggcuccaccuugacuccuccggccguggggcucgugcauucgggcuugcucauaggcaucuccaucgcgagccugugccuggugguggcgcuuuuggcgcuccucugccaccugcgcaagaagcagggcgccgccagggccaagauggaguacaagugcgcggccccuuccaaggagguagugcugcagcacgugcggaccgagcggacgccgcagagacucugagcggccuccguccaggagccuggcuccguccaggagccugugccuccucacccccagcuuugcuaccaaagcaccuuagcuggcauuacagcuggagaagacccuccccgcaccccccaagcuguuuucuucuauuccauggcuaacuggcgagggggugauuagagggaggagaaugagccucggccucuuccgugacgucacuggaccacugggcaaugauggcaauuuuguaacgaagacacagacugcgauuugucccagguccucacuaccgggcgcaggagggugagcguuauuggucggcagccuucugggcagaccuugaccucgugggcuagggaugacuaaaauauuuauuuuuuuuaaguauuuagguuuuuguuuguuuccuuuguucuuaccuguaugucuccaguauccacuuugcacagcucuccggucucucucucucuacaaacucccacuugucaugugacagguaaacuaucuuggugaauuuuuuuuuccuagcccucucacauuuaugaagcaagccccacuuauuccccauucuuccuaguuuucuccucccaggaacugggccaacucaccugagucacccuaccugugccugacccuacuucuuuugcucuuagcugucugcucagacagaaccccuacaugaaacagaaacaaaaacacuaaaaauaaaaauggccauuugcuuuuucaccagauuugcuaauuuauccugaaauuucagauucccagagcaaaauaauuuuaaacaaagguugagauguaaaagguauuaaauugauguugcuggacugucauagaaauuacacccaaagagguauuuaucuuuacuuuuaaacagugagccugaauuuuguugcuguuuugauuuguacugaaaaaugguaauuguugcuaaucuucuuaugcaauuuccuuuuuuguuauuauuacuuauuuuugacaguguugaaaauguucagaagguugcucuagauugagagaagagacaaacaccucccaggagacaguucaagaaagcuucaaacugcaugauucaugccaauuagcaauugacugucacuguuccuugucacugguagaccaaaauaaaaccagcucuacuggucuuguggaauugggagcuugggaauggauccuggaggaugcccaauuagggccuagccuuaaucagguccucagagaauuucuaccauuucagagaggccuuuuggaauguggccccugaacaagaauuggaagcugcccugcccaugggagcugguuagaaaugcagaauccuaggcuccaccccauccaguucaugagaaucuauauuuaacaagaucugcagggggugugucugcucaguaauuugaggacaaccauuccagacugcuuccaauuuucuggaauacaugaaauauagaucaguuauaaguagcaggccaagucaggcccuuauuuucaagaaacugaggaauuuucuuuguguagcuuugcucuuugguagaaaaggcuagguacacagcucuagacacugccacacagggucugcaaggucuuugguucagcuaagcuaggaaugaaauccugcuucaguguauggaaauaaauguaucauagaaauguaacuuuuguaagacaaagguuuuccucuucuauuuuguaaacucaaaauauuuguacauaguuauuuauuuauuggagauaaucuagaacacaggcaaaauccuugcuuaugacaucacuuguacaaaauaaacaaauaacaaugugcucucgggu

SEQ ID NO: 13440 - RNA, 7033 nt, Homo sapiens
uacaacaguacaggaugcgccuugggucagggggacguggaaagcccucagccuuuguguccuucucugcgccggaguggcugcagcucaccccucagcuccccuuggggcccagcugggagccgagauagaagcuccugucgccgcugggcuucucgccucccgcagagggccacacagagaccgggauggccaccuccaugggccugcugcugcugcugcugcugcuccugacccagcccggggcggggacgggagcugacacggaggcgguggucugcguggggaccgccugcuacacggcccacucgggcaagcugagcgcugccgaggcccagaaccacugcaaccagaacgggggcaaccuggccacugugaagagcaaggaggaggcccagcacguccagcgaguacuggcccagcuccugaggcgggaggcagcccugacggcgaggaugagcaaguucuggauugggcuccagcgagagaagggcaagugccuggacccuagucugccgcugaagggcuucagcugggugggcgggggggaggacacgccuuacucuaacuggcacaaggagcuccggaacucgugcaucuccaagcgcugugugucucugcugcuggaccugucccagccgcuccuucccagccgccuccccaaguggucugagggccccugugggagcccaggcucccccggaaguaacauugagggcuucgugugcaaguucagcuucaaaggcaugugccggccucuggcccuggggggcccaggucaggugaccuacaccacccccuuccagaccaccaguuccuccuuggaggcugugcccuuugccucugcggccaauguagccuguggggaaggugacaaggacgagacucagagucauuauuuccugugcaaggagaaggcccccgauguguucgacuggggcagcucgggcccccucugugucagccccaaguauggcugcaacuucaacaaugggggcugccaccaggacugcuuugaagggggggauggcuccuuccucugcggcugccgaccaggauuccggcugcuggaugaccuggugaccugugccucucgaaacccuugcagcuccagcccaugucgugggggggccacgugcguccugggaccccaugggaaaaacuacacgugccgcugcccccaaggguaccagcuggacucgagucagcuggacuguguggacguggaugaaugccaggacucccccugugcccaggagugugucaacaccccugggggcuuccgcugcgaaugcuggguuggcuaugagccgggcgguccuggagagggggccugucaggauguggaugagugugcucugggucgcucgccuugcgcccagggcugcaccaacacagauggcucauuucacugcuccugugaggagggcuacguccuggccggggaggacgggacucagugccaggacguggaugagugugugggcccggggggcccccucugcgacagcuugugcuucaacacacaaggguccuuccacuguggcugccugccaggcugggugcuggccccaaauggggucucuugcaccauggggccugugucucugggaccaccaucugggccccccgaugaggaggacaaaggagagaaagaagggagcaccgugccccgugcugcaacagccagucccacaaggggccccgagggcacccccaaggcuacacccaccacaaguagaccuucgcugucaucugacgcccccaucacaucugccccacucaagaugcuggcccccaguggguccccaggcgucuggagggagcccagcauccaucacgccacagcugccucuggcccccaggagccugcagguggggacuccuccguggccacacaaaacaacgauggcacugacgggcaaaagcugcuuuuauucuacauccuaggcaccgugguggccauccuacuccugcuggcccuggcucuggggcuacuggucuaucgcaagcggagagcgaagagggaggagaagaaggagaagaagccccagaaugcggcagacaguuacuccuggguuccagagcgagcugagagcagggccauggagaaccaguacagguaaagggggcccugagugaccgggggaggggaugggcaggcaugggggcacugacuacaguacaaagagguggcagcaagagcaggcccagguuuccugugggcagacacacccugguccuugcagcugaccccucaaccuccccccacgccaggcacucgggcccccuuagagcauacugcccaucugcagcacggccgcacguggggcucucucccaagguggggacgugcaggcacagaggcgccauggcuuccaacgcugucuguuuuguuucccauaguccgacaccugggacagacugcugaaagugagguggcccuagagacacuagagucaccagccaccauccucagagcuuugaacuccccauuccaaaggggcacccacauuuuuuugaaagacuggacuggaaucuuagcaaacaauuguaagucuccuccuuaaaggccccuuggaacaugcagguauuuucuacggguguuugauguuccugaaguggaagcuguguguuggcgugccacgguggggauuucgugacucuauaaugauuguuacucccccucccuuuucaaauuccaaugugaccaauuccggaucagggugugaggaggccggggcuaaggggcuccccugaauaucuucucugcucacuuccaccaucuaagaggaaaaggugaguugcucaugcugauuaggauugaaaugauuuguuucucuuccuaggaugaaaacuaaaucaauuaauuauucaauuagguaagaagaucugguuuuuuggucaaagggaacauguucggacuggaaacauuucuuuacauuugcauuccuccauuucgccagcacaagucuugcuaaaugugauacuguugacauccuccagaauggccagaagugcaauuaaccucuuagguggcaaggaggcaggaagugccucuuuaguucuuacauuucuaauagccuuggguuuauuugcaaaggaagcuugaaaaauaugagaaaaguugcuugaagugcauuacagguguuugugaagucacauaaucuacggggcuagggcgagagaggccagggauuuguucacagauacuugaauuaauucauccaaauguacugagguuaccacacacuugacuacggaugugaucaacacuaacaaggaaacaaauucaaggacaaccugucuuugagccagggcaggccucagacacccugccuguggccccgccuccacuucauccugcccggaaugccagugcuccgagcucagacagaggaagcccugcagaaaguuccaucaggcuguuuccuaaaggaugugugaacgggagaugaugcacuguguuuugaaaguugucauuuuaaagcauuuuagcacaguucauaguccacaguugaugcagcauccugagauuuuaaauccugaaguguggguggcgcacacaccaaguagggagcuagucaggcaguuugcuuaaggaacuuuuguucucugucucuuuuccuuaaaauuggggguaaggagggaaggaagagggaaagagaugacuaacuaaaaucauuuuuacagcaaaaacugcucaaagccauuuaaauuauauccucauuuuaaaaguuacauuugcaaauauuucucccuaugauaauguagucgauagugugcacucuuucucucucucucucucucucacacacacacacacacacacacacacacacacagagacacggcaccauucugccuggggcacuggaacacauuccugggggucaccgauggucagagucacuagaaguuaccugaguaucucugggaggccucaugucuccugugggcuuuuuaccaccacugugcaggagaacagacagaggaaaugugucucccuccaaggccccaaagccucagagaaaggguguuucugguuuugccuuagcaaugcaucggucucugaggugacacucuggagugguugaagggccacaaggugcaggguuaauacucuugccaguuuugaaauauagaugcuaugguucagauuguuuuuaauagaaaacuaaaggggcaggggaagugaaaggaaagauggagguuuugugcggcucgauggggcauuuggaacuucuuuuuaaagucaucucauggucuccaguuuucaguuggaacucugguguuuaacacuuaagggagacaaaggcuguguccauuuggcaaaacuuccuuggccacgagacucuaggugaugugugaagcugggcagucugugguguggagagcagccaucugucuggccauucagaggauucuaaagacauggcuggaugcgcugcugaccaacaucagcacuuaaauaaaugcaaaugcaacauuucucccucugggccuugaaaauccuugcccuuaucauuuggggugaaggagacauuucuguccuuggcuucccacagccccaacgcagucuguguaugauuccugggauccaacgagcccuccuauuuucacaguguucugauugcucucacagcccaggcccaucgucuguucucugaaugcagcccuguucucaacaacagggaggucauggaaccccucuguggaacccacaaggggagaaaugggugauaaagaauccaguuccucaaaaccuucccuggcaggcugggucccucuccugcuggguggugcuuucucuugcacaccacucccaccacggggggagagccagcaacccaaccagacagcucagguugugcaucugauggaaaccacugggcucaaacacgugcuuuauucuccuguuuauuuuugcuguuacuuugaagcauggaaauucuuguuugggggaucuuggggcuacaguaguggguaaacaaaugcccaccggccaagaggccauuaacaaaucguccuuguccugaggggccccagcuugcucgggcguggcacaguggggaauccaagggucacaguauggggagaggugcacccugccaccugcuaacuucucgcuagacacaguguuucugcccaggugaccuguucagcagcagaacaagccagggccauggggacgggggaaguuuucacuuggagauggacaccaagacaaugaagauuuguuguccaaauaggucaauaauucugggagacucuuggaaaaaacugaauauauucaggaccaacucucucccuccccucaucccacaucucaaagcagacaauguaaagagagaacaucucacacacccagcucgccaugccuacucauuccugaauuucaggugccaucacugcucuuucuuucuucuuugucauuugagaaaggaugcaggaggacaauucccacagauaaucugaggaaugcagaaaaaccagggcaggacaguuaucgacaaugcauuagaacuuggugagcauccucuguagagggacuccaccccugcucaacagcuuggcuuccaggcaagaccaaccacaucuggucucugccuucgguggcccacacaccuaagcgucaucgucauugccauagcaucaugaugcaacacaucuacguguagcacuacgacguuauguuuggguaauguggggaugaacugcaugaggcucugauuaaggauguggggaagugggcugcggucacugucggccuugcaaggccaccuggaggccugucuguuagccagugguggaggagcaaggcuucaggaagggccagccacaugccaucuucccugcgaucaggcaaaaaaguggaauuaaaaagucaaaccuuuauaugcauguguuauguccauuuugcaggaugaacugaguuuaaaagaauuuuuuuuucucuucaaguugcuuugucuuuuccauccucaucacaagcccuuguuugagugucuuaucccugagcaaucuuucgauggauggagaugaucauuagguacuuuuguuucaaccuuuauuccuguaaauauuucugugaaaacuaggagaacagagaugagauuugacaaaaaaaaauugaauuaaaaauaacacagucuuuuuaaaacuaacauaggaaagccuuuccuauuauuucucuucuuagcuucuccauugucuaaaucaggaaaacaggaaaacacagcuuucuagcagcugcaaaaugguuuaaugcccccuacauauuuccaucaccuugaacaauagcuuuagcuugggaaucugagauaugaucccagaaaacaucugucucuacuucggcugcaaaacccaugguuuaaaucuauaugguuugugcauuuucucaacuaaaaauagagaugauaauccgaauucuccauauauucacuaaucaaagacacuauuuucauacuagauuccugagacaaauacucacugaagggcuuguuuaaaaauaaauuguguuuuggucuguucuuguagauaaugcccuucuauuuuagguagaagcucuggaaucccuuuauugugcuguugcucuuaucugcaagguggcaagcaguucuuuucagcagauuuugcccacuauuccucugagcugaaguucuuugcauagauuuggcuuaagcuugaauuagaucccugcaaaggcuugcucugugaugucagauguaauuguaaaugucaguaaucacuucaugaaugcuaaaugagaauguaaguauuuuuaaauguguguauuucaaauuuguuugacuaauucuggaauuacaagauuucuaugcaggauuuaccuucauccugugcauguuucccaaacugugaggagggaaggcucagagaucgagcuucuccucugaguucuaacaaaauggugcuuugagggucagccuuuaggaaggugcagcuuuguuguccuuugagcuuucuguuaugugccuauccuaauaaacucuuaaacacauugauugugaac

SEQ ID NO: 13441 - RNA, 10219 nt, Homo sapiens
cggccagaucagguaacugcccgaaccgcuccgccgcccgacguguggcucagccccuuccucagccccgccaggggcggggccggccgcgggaggggaggggccugcagcgaccaaucggcggugcccgcgcagggugcuacgccacgcccagccgggccggccguuccuaccggccugguccagcggacagcggcugcagcgggggcgccggcugggaggugagugcgcggcccguaggccuggcuccggccccucgccgcccgccgccgccucuuuguccgcgcgccccggcugcucuguggaccugcgcgucucggggaugcgggagcgggggcagggggcggcccgagggccugauccacgcggccccggaugcccgcgucgggaggcggcgcgucgggccgaggaggggcuucucuguggcugcaguaguuuguucucugggucgucuuuggaguggccgagcggcguccgggcgcuggggcggccaaguggcgcgggaagggugggaggugccgugagggcggcgaggacagcggcggauuuaagccccacuggaaaccccggcccuuguggccguggacugggcugcggguagcagcgucuccuggaagggcucuggccccgugagccucggggauucaggggccgccgacguuggugcagaugccgggcgcacugggaggcggccggaaugccaaugagauucggcggauacgcagcugucaccggccgcagacugcccugucgccaccuccagugccugcacuccaguagccaagcaacauaggaaaucgcgcucagaacccacuuuguugauugagaaaucaggucuccucgagggcccuguuggcagaggucuggggaagucagggcaucaggcugagagagcccucugcagucuuguuuccccaggcuggggcugggaccacugaaaccccaguggcucuauaagagccccacucuuauagaucccuuccuuaggcuuugucaguguucucacaguuuuacuggggcgucuccuucaggcgacauugaucaagccucauagguaccuguuuacagcggaacucccagagggcagucuuuuccauguuugagggacugcuaguuguggggagcggucucauugaugagacuggagaaggggagaggggugggacuaguuuaucagggaagaugaugacaacuuuuuuucuagacacguugaauccgaggugacaucuguggucuggccgaaggaggcuagaaggaaggcaugugcuuuggauggauggaaacaggaaucaaagaggaagguagauucaggagcugaagggcagggagaaaacacauucagggaguuuguggcaaagcagcagaaaugacgauggggugacgguaucuggaggccuuaggugggguuggugaaauuugcaugcccgcugcaguggaaagauuuaggggcuaaagauagcccuuugccuuuggcaaggcugaggggaagaguguguugaguagucugaguugaauccgggcaccaggcccuggcucaugucccaaccagccauugacuguuaccuugauagguccucaucuaugaaauggggaucacuguagcaccuuggccuaugugugggaaaccaauaaacuagccaacaaguuucaggcucauggaacccugguaacagccggucagccuucuucagaggaggaaauggguucagagaaguugcuugcucaaaguagcacagcuuguaaaagcuguggaacuuaacauuauuucaguagaguaacaauaauucaaauucugaggaguuuaggauguugggaaugggcgaugaauugugaacuacuuuuccaagaaguuuuccucauggaaaguaguuauuuaguugguucuuuucaaaggcagaaaugauucccugagguuuuggauuugcucccagauggugguggcuauguguuuuaauuaucugguuuccugaucagagaacuagacauuauuguugccaugaauucuuuuacaguuuuggggacuauguaagcaaauuagacagugaccuuggugagcaaauuacuguguuaauguauuucacuaaucacaacuuccaucauuuguuuaucacuggaggaaaccuuagaauacacuauuuuucaugccaauuuauuaccuuaggaaaaugcaugaggaaccucacuuuagaaaacugcuaagaaguaaaaugucauucgaaucuuuaccugaguaaagcuagguuguuaaugagucuauauccucucaaguacugaaggaauccucauaaauuuuaguccuuuugcaucagugguugcucaugcauaauucuuguuucuuuuucaaagcuguuuuuggaaggaagaaagauggaaagcggugcaguucugcuggaauccaaauccuccccauuuaaccuacugcaugagaugcaugagcuucgccuccugggucaccugugugacgugacagucagcguggaguaucaggguguccgcaaagacuucauggcccacaaggcagugcuggcugccaccagcaaguuuuuuaaggaaguguuccuuaaugagaagaguguggaugguacuaggacuaaugucuacuuaaaugaagugcagguugcugacuuugcuucauuucuugaguuugucuacacugcaaagguacagguggaagaagaucgggugcagcgaaugcuggaaguggcugaaaagcugaaauguuuggauuuaucagaaacuuguuuucaauuaaagaaacagauguuagagucaguacuuuuggaguugcaaaauuucucagagucucaggagguggaggugagcaguggcucccaaguuagugcugcuccugcccccagggcaaguguggccaccgauggcccucaccccaguggucucacggauuccuuggacuacccaggagagagagccagcaauggcaugucuucagauuugccaccgaagaaguccaaggacaaacuagacaagaagaaagagguaguuaaaccucccuacccuaaaaucaggagagcuaguggaaggcuggcugggaggaaggucuuuguggagaucccuaaaaagaaauauacgagaagacuccgagagcagcagaaaacugcugagggugaugugggggacuacagguguccccaggaccaaagcccggacagggugggcacggagauggagcagguuuccaaaaaugaggguugccaggcaggugcugaguuggaggaauugucaaagaaagcagggccggaggaggaagaggaggaggaggaggaggacgaagaaggggagaagaagaagagcaacuuuaagugcagcauuugcgagaaggcguuucuguaugagaagagcuuccugaagcacagcaagcaccgccacggcguggccaccgaggugguguaccgcugcgacaccugcggccagaccuucgccaaccgcugcaaccugaagagccaccagcgccacgugcacagcagcgagcgccauuucccaugcgagcugugcgggaagaaguucaagcgcaagaaggacgugaagcggcacgugcugcaggugcaugagggcggcggcgagcggcaccgcugcggccagugcggcaagggccugaguuccaagacagcgcugcggcugcacgagcgcacacacacgggagaccggcccuacggcugcaccgagugcggcgccagguucucgcagccguccgcgcucaagacgcacaugagguacgcggggagccguccggaggggucccugcgcacuggaagggugugucaagcacugaggucguccugggauuugaugucucacugcuuaauuucuccgcuccaaaccugggggcuuauuucgagacagcguuuaguucucugucaagguacaggggcugcgagugauggcucugcucccuuguucugagaccccuggggcgccccugcuggccgggacgucccucuggugggaccgcgacagcggccgcgggcucgccccaccgugcuggaggaagaguugggccucguuaccuuuauuucuccuuuccugacucuucguuuagaucuugggguucugugaccauccgggucccacagucucaguagagaccucagugagaugccauuucaggcuuuaggacucgucucuggucuuuugguucucaggcuuggaaggagugccaucuaggcagucugcacuccagaaucaggacagacagugcuuucuguuucuuaauauguuucugagcugcagguguguggugauguuuuuaaauaaguuuucuuauaguucuuaguauauuuauucuugaaaucccaacaagcaguuguuuucucuucucuucuagaucugcccucaaaccuaggucagucuuggguuagcagcaugguguucauuuuuuacucuauauaauaaguuaaaaauacuugguuuaggaagugcucaguaaauuauguuugauugcuacuucauacuaguugugacauuaaaaugcuuaugcauuuuaaaaaugccaccuucggcaauuugagaacaguucuccuuucucuacuggugaugucauauuaggaaaugagaguaacauuuuugaucaugugacacuuaaucagcaguaguuccuaagguguuuguggcugauuauucuguaugagacagcuuuacaaauaucagauuguggucuuuaguguuuaaaaaaaucugcaaaggccuggucucuaccugcacaugccuuauagcaucagcaguagggcuugugaucagguguagaugaacauuccagucagugauuuauggaaaauguguggauccauugaccuugugcagaaacucaguuuauuuugggauggagauuaugggcucuugaccugucacuacagucauucucauuaggucucuuggaguaaacgauuuuugcaggauagaguggaaauuguauugcaaagugagcuuugaaauacauccuaaguuaucaucugaauguuguacuuucagaauucauacaggggaaaaaccuuuugucugugaugaauguggugcaagauucacucagaaccacaugcugauuuaucauaaaaggugucacacagguaaauacucaugcuguugugauugaaugucuuuccuagaucuagaaggaaaugcaauugauuaauuuugaaguuggcaucuaccaagguggugcagguuaaagccaugauauagcuuuuccaucuaguaagugagcaaaaugaauaaacauacacccauugccuuguugcuagugugcacauggcuguggcuuuuauaccaccaggccauaggaucuggcaugcaggucuuagguaucaagagauauaaaauaguucuuuuguaaccgaaauuuuuuuuucuaagacucuguccuaaagaaauuguccaacauaugggaagagcuguaugcuauuaucccccuucuugcuauuuuuaacuaagaaugggaaacagccugauuguccaacuacaaggaagugcucuagucaacucugguaaaucuauacccuggcuuaugacccggcuauucagaguaagggcucugaaugacaugaaaaagucugugcuuggauguucaacuuuaaaaugcacaauuaagcauacaguuaaccucaauuguauugaaaaccugcacauaaaagaccagaagaaaauaaguuguuauaugauacauuaagguaguaggauuaucucauuucuguuuuccaaagucuuuaugauuuauuaauuaugugacagauaaaacuuaaguuggcuuuauucugcuucagcacaguaacccugagguuuagaaucuuguggaagauacagaagcauacagcacugaaguguuccaauucuucucaguuucuucuuugcuugcauuuuuuauucuuaccuguaaacacuggcuuacaagccucaaguucaaaugcaugugagacagagaugacaugucucugacucauuagacaccacaucugugugauuagacaccaguucugcucauucugaagucauaauucaugucauugaaugaaaaucucauuuaaugucaugaaauuagcauuuaaugacaugcauuaugacuacagaaugaguagaauuguuuaaagaaagcuugggauuggggacaaggucagguuauaaugaaggauuaaguuagaauugguccuuugauaauauuaacaugguaagauuuuauuaaagucacuauuuuuauuuugaugucugugaaaucgggcacagcuaauaauuugguaagucugauuugugggauuaaacuacaaaaagugagauauuuaaaacucuuguccuacaauucaaucaaguugauuggaguugcuacucuagaauagugauauauauccauugucaacuuccccuuuauucugauaaagauccauagaaguguuccuuugaaaauaauccagcaguuccuccaaacagaaguugugaaauuauuuucuuguuuggaaugaguaaauuucuaaaaugugagccagcugaacaaacaauaccucuuugauucuagucaaauggaauuuuucuugcaauuuccaaggauauuuuacaccaacuuucaguaaguagcaagcaucuuacaugaauauauauuuuaugauaguuuuuacuggaaaauguaacaugcugccuaccaaggcacuuuugaguucacguggguuuuaacaguggagaccuacuguuccauguguuuuuaaugccuguauuguuuaugacuuuauuucauuuucucauguaggugaaagaccuuuuaugugugaaacauguggcaagaguuuugcuucuaaggaguacuuaaaacaccacaauagaauccauacuggauccaaacccuuuaaaugugaaguauguuucaggacuuuugcccagcggaauucacuguaccagcauauuaaaguccacacagguaugguuggaaugucccagggaagggaguuuaguuuggccaaaaaaaaaauucuaaagcuuguagauuuaccaguaaauuacuuggaacuaagcuuuugaagaaaacuggccaaacuuuguaugucauaauagcauuucuuuagagauuguuucuaacucugagaaacugaaaagugggagcacuuauguguguaaacgggagaagacuaagucccuuugcuacauggaguuuuuacugaaaaggacagacagcuuagucauggugugaauguaggaaguggauguggauguguggacauagggauaaugaucuguacauguuaguaaaugcacaugcacacaugcauauucaguuguuaggggucuuguaauuuuauacuccauuaccauggaaaacaggugucauuccuauaguuauaauaccugcugcaggcacauguccuggccccuuuuugguguaggccauaaauucuugguauuauagagauaguggauuuguagcccuuaaguuguucccaacauaaccuuccuuauguuggaugcugaggcuucccagugguuugcaacagcaucauucacucaaguguguauucagaauuaagcacaguaggccaaagggacccaccagcagucuccucucucccugccucaggggagcgucccuacugcugugaccagugcggcaagcaguucacccagcucaacgcccuccagcgccaccgccgcauccacacaggggagaggccauucaugugcaaugcgugcggacggacauucaccgacaaguccacucuucggcggcacaccucaguaagcaguggguuggcuuauuugagaaacaagcugcugcccuuagaugcacggaaagagaaauaccuaccaccauucuccaaggugguuagaggucgagacaacagguacuuucuccuuggguugucucugcaguggaacgcucacggaaugaaugaaguggaacaccaagccccaaggcccagggaaagcaccauccacgaugacuacucuguaacagugagggugguggcaggcggguacuuauuagugaaaguugaaaauugaaguuguagagggacuauuguuuuaaaagaugcacuuguccagagacacauucagugaccuuuguuuuguguuuaacuuauagauacacgauaagaauacuccauggaagucuuuccuugucauuguagauggcucgcccaagaacgaugacggacacaagacugaacagccugacgaagaguaugugucauccaagcuuucggauaaauugcugucuuuugcagaaaauggccauuuccacaaccuggcugcaguccaagacacuguaccuaccaugcaggagaacaguucugcugacacagccugcaaggcagaugacuccguggugucccaggacacccuccuggccaccaccaucagugagcuuagcgagcugaccccacagacagacucgaugcccacacagcuucacucuuugagcaacauggaauaagagcuucaagcaguucccauccuguuagucugcgugugugguagcugaacucaagaugauguggggcuaagaaaaauaauuguccaugugcaaagaugugggcaagaauggccucugcagauuuuccugaacuucugcuaacuugcacggcuuuaucacagcauuuuuaaagcuuucccucaaaaauccugaucugcaugaucucagcuacuuuauugacaaaaaggcagugaacauaaccucacuuaauucugguguaggguguaugugcuaaucguucuaauucuugauuaccuaguuuauagauaacugcuggucuuaauugcagaguacagagaacugaaccagcuccugauauuguaguuagcagucuuccuggcuucucacucugccuuauauuuccauguggguuuacuucucucauaacuacuuucaagguauuuuucuuccaagcugaaauaaaacuggggccacauauuuucagucauuucuucccuguugaauugaagcaaaucagauuuucuguggggacccucaaaugcaacugaagaaauagauuguugcauucauuccuccccaccccccauuuguaggcaguaaacaaaguaugacugacagauugaacaccugcaaaacugcuagcguaaucucagcacauacgcagcuaggaaguuugucauaaaaucaacuuagaaaugagaugaggcuguucaguuugucuuaaaaaaaucagauuagguaaaagcuguccuaccaaagagucuagcaaaacaauauaguauuuuuuugcagaggcaugaaaaauuaagacgcuuuagaguacuugaaaguuguguagucauuuuauuugcaaaaugaggugacuguggcaaauuauagaacacagaguauuauuacuuuugccagguuuuucugacuugauuucuguaauuuccagaaacccagacuucucauuuccacaccuagagauggaaacaggcaaguaacugacaugucuauuuccuugggagcaugugagaacauagcaguagggaccaaaagucucagcacacuuaccuccgauuaugccuuaaagaguugauugugaagaaccaguaacuuugucccaaaugcuucuuuggcuguuucaugcaggacuuaauuauugcuuuuaaaaauucacaaugaaaagacgauucugcuguauuuguuaaacguugacauuugguucuagggccuugaguaugugccacgugcuugugaaaugcuaugauucacauguaacauuuaaacauuaauuuaaaaagggaaccuuggagaauucuuuuguucacuaguuccuuuuuucucuacauuuuuaauuuauuaaacuugcugugaaaacacuuugauuuucuaagaggaagguacuuuaaguuccagaaugaacauguagcugcacuaugccagaaauuaaugagggaagacuuucuuccuaagugcuuauguuuuaacuuauguuagugaaaccacuacaagguguuucaggcgcugauaacaugcuucacaccugcccuuggaggucacaguacuaauuuacuucaaauuuaguuaugacagugucacuguauccuaguuauguuuacagcacaaauaaauaaugacugucauacauccagaggagaccgaaccugcccagcugauguacuguuuuauggaauaaagucacuugaucagaaggaauugaaacaauagaucauuuuguuaccuacuggagggauuuuugucuugaauuuguuuccuuagaaauucuacaaaaaaauguuguuaauaaau

SEQ ID NO: 13442 - RNA, 47045 nt, Homo sapiens
cgaaaggccucgcgcgucgcgccugcgccugcgucccugcggccgccagagggaggguuaaggcgccugggcgcacagcgagccggcugagggggcuguggcggccgcggcgggcgacauggacaacgcggggaaggagcgugaggcaguacagcugauggcggaggccgagaagcgagucaaggccucccacuccuuccuccgagggcuguuugggugagcgccagaccgugcgugcccuggggggggggggucuccguacuuggcccccuuccuuucaggcugaccccccgagucccccacgcaaccucuggggcccucagaccacgucuaggggcccucagccugcaggcgcccuccagaaauccuguagggucccccagcgcccccuggagcccccaggacgcccaggggcccucaguccgcacgcgcccuccagagaccccacaggcccccccagggucccuggaaaccccgcauccucccaggggcucucagcccccacgcgcacuuuagagacccccuagggccggcagaacuccccaggguuccucagcccccacacgcucuccggauccccuaacacgcccccuuagaauccccagagucucacagggacccucagcccccacgcgccuuucagagaaccccuaggacccccagagcuccccaagcgccccacgaagccccuagaacacucuggggggggggcugucagccucacgcgcccucuggagaccccagaucgccccccucgcccuggcccggguuggugcgggggucccacgaccuagaaggucagcggcucccugaggcccgcgggcgcgguagcucggggcgcgcguggggcccccuucucagugcguagcgagucguauuggugcauuucgccacgcugaagcccguaucgcuccugagaccgguccgggugaggcgcgccgggguggagccggaggggugggugcgggggccgcccccggcgccuggaacgcgcaccugggggcgucccgccugcaggugggccccgccggggagggggcgguccggcgagggauccagagcuggugugcuuguuggccucucuccaggggccuugcgccgaguacaccuuuaguaaauacuugacuaaugaacgaauauauuuucucagcauaguauuuuuccuucuccggagauugauugauagccagagccuccuguuugauuaacgguaacgcugcugcuguuuaagucaggcguccuuugggaaucccuuuaauuuccuguaauucuuccgugcucuccuaaggaggauuuuaaauuccaaccucucaaaaagcagagcccgcacugacagcccggaagaauucugggcuguugaauaugugaaugauucagcuguuuaggaugagaaaggcagaaauuuugugugugccuguuucguuguuuucuuuugaaagugaaagauccuuugcuguuaccaagagcagauacuuaacccauugcaugacuagacacgauuuuauuucuguacacauucaguucagacucuauuucagaagacagacauaaugggcucuuagcuuguuuugccaacuucauucuuuuggcuauaaauuauaauacuuuaccgcuauugauacgucuuuaggaaaugcuuaaggacaaguugcaugcaguacgcauaacugcagaaaugcauaaaggcugcaaaaaugcaagaagauaagggucccuguccucaggaaccucucagaggacguuuaucacagcugguuucuaaauuucucaugugauguguaggagauauagcuaugaauuauguuuuguuuugcauuuaaaaguuaugacaguaccaucaagugcuagcgccacacuaacuccuuuuaaauguuuugauucacaaaacauuuaaaauucacucuaauaaaauuuaaugucauaguaccucaugccaggagguuauuuuaauguuacaacauuauuucaagucaggaagugcuucccugugggagagucuguaacuggcagaggaaaaagcuugacagcacuuggugcuugucucaggagaacacuccuuuugggaaagagguuuucgauguuuuuaggaaacuaggccaaaucuugagcuuauaauccuuaaaggauuuugaaaagccuuuguuuuuaaagaaacaucucccuuuuaaauguugcuaccuauguuauugacaggacauauaagaagacgaaucuucaccauucacacucaguuacacaaaaguuaaugcaucuuaguucuuaccuggguacaacagguugguuuauuaucuagcuuugggaccuagggcaaguuacuuagccucucugugcuucaguuuccaguguauaaaacggagacaauaauaguauaucucaaaauuuaugggaguucagugagguuauguuuauaaaacauuuggaaccauggauguuggagacagugaccaugagauauuaauuagcauauucaucaaaauuaucagcuccaguuauuuaucaaagaagcaguaggccaaacagauaacuuuuccagaauuucagagccguagacugcaucauugauuuuuuuuuuuugagacggagucucacacugucacccgggcuggauugcaguggcgggaugucaacuaacugcaaccuccgccucccagguucaagcgauucuccugccucagucuccugaguagcugggauuacagccacccgccaccacgcccggcuaauuuuuuuuuuuuuuuuguauuuuuaguagagacgggguuucacuguguuggccaggcuggucucgaaugccugaccucgugauccaccugccuuggccucccaaagugcugggauuacagacgugagccagcacgcccagccucauugaucuuuuaaugaaauaaaauaucugaaagagcuuuaaccauuaauguaccaugcaagugugauuuauacuuugaagacuguuauuuccaguaauacuugcuccaggaaagcuugcaggaagaagaguacuuagaauuuuaggaguuuaguaauauuguauaauuacugaagccagaaaacagacguaguguuccugugucaguaggacaauuaagauucuguaucaauuuuagauguuuagaauccuaccuuauagauggcauguaucaucaccuuucuagacuggaauacauguuauuccacccugccccugccuucuuagcuauagaaugucaccauuuucauuccuaaaggucugcauguaauccuuuauuuaaaacgcagaguaauccaucucuaugucagacuccagaauuaauguaauacaaaauuaauaaaacacacauacugacuugaauaucaucagagcucauauauuuaagagcugacuagcuggugcuuuaaagaggauaagccaucuguuuucagguuguggcagucauuaaaagcugcuuggcauauugcagauauuucacaucacagacauucugaaugcucuaucugcagauuaaagccugucaugaguucucuaguguuuaccacucacagugguuuuguggcaauacuguauucuuaguaguauucuauagcuuuuguuucuugcuuucaguaaaauuagaugaaaauaugcauauguauuuaugagaacaugucagucaaauauuucuucucuguguaaggcacaaauccucugccuuaucugcuugauagguaagguaucaauauuccuuucccauccccaccuuccuccccaggaaaagagcugacaagggaugcaaacauugcaggaaaccacuguuguggugguuuguguuucugcuuaauugcccguuaagcaguaaugugcuuuuguaguuguggaauuaaaacuuuuucucaaguuuguaguauaguacguuuaguaaaacuacuuccaaaggaguugucuuguccuuuaguuuguugccagggaugagcuauggaauuuuguaguuaauuucaaauuccaguuuauaauguuaaugaacuacugguaugauuuuaaaucggccugagucugacauuaagauaguuuugaauuggaaaagccucuuauaauacuauccccuccaucuuguugcuaugagacccgguugggaauaaccugcacaaugcacauagaagaaagugcuuaagacugacaguggaggccaggugcaguggcucacgccuguaaucccagcacucugggaggccgaggcggguggaucacuugaggucaggaguuugagaccagccuagccaacaugaugaaaccccgucucuacuaaaaauacaaaaauuagccuggcgugguggcgggcgccuguaauaccagcuacuugguaggcugaggcaggagaaucacuugaaccuuggagguggagguuguagugagcugagauugugccacugcacuccagccugggcccccgagcgagacuccgucucaaaaaaaaaaaaaaaaaagaaugccaguggaaagauguucuuuaugguuaaugcugucuuccuuugccuuucaguguuuagucugaguuuacacaagagcuacaaauuuggcaaugucaauguaaauuuaaugaaaggccccauuggguuaucuugaaauaauuaugaaucuauaauuuguugguuguuugugaaaauugugaauauuucuuaagcauuguagacuguaaauuaucaguauucuucacuuguguuuauuucaacaaagauugcuuuuaaguuuggccaaaauaugguggggccaugugauaacauaggugaagcauuuagguuuuccucaguuacaauucuuguucaaaugcagauugaacuuuuaaaaaaauuauuaggcucagguuuacugacagagacaggugauacaguauaagaaauauauacguauauuuguguaucuuucucaaaagaaaucgauuauaaauugaacaauuauuuuuauaaauuauauaauauacguaagaaauauaauuauauuauuauucauggggagaccagguagaggcucaaguucucucauuuacuauuuuggugacuauagucaaguaaaucauacucagaacuuguuuuuuuuaguuuucagaugggcagagagacagaaucuguuuuucacgauuguuaaggauugaaugaggucagaaugcuuauucaguugcacagagcuauauaacuuuauuauaauuguuugguuuucugauuuuagguuguuacagcuugguaucaaaugauaaacuguuaccagacuggccuuuuucuuguugcauuuuugcaguuuucuccacauauucuuucauucuugugagcucugugaggugcaguuacucuggagagagggagggccaguaaucauauguggcuccuuggaagucugccuguuuuguugcuguggcuaacaccucacccagccugaggcaugcguuaggcacgugguaaauauugguggagagaaugaauguauuaaugcuaauacaaaugcugauguuuuuucuuuuauucuuaccuaguuuucaagagcaaagcuauaccaaguaaaggagaguuuaagucgcuuucuuccguuuuauuuauguauuuauuuuuuugagacgagcucucacucuguugccuaggcuggaaggcaguggcgagauaucugcucacuucaaccuugaccuccugagcucaagagauccucccaccucagccucccaaguagcuaggacuacaggcaugcacuaccaugccugacuaauuuuguauuuuuuguagagacagggucuugcuauguugcccaggcuugucuccaacuccgggacucaagcgaucugcucugcugaccucagccucccaaagugcugcgauuacagguguuagccacuguacuaggcauuuuauuuaaauauuugcuuauuaugaacauuguagcuguacacgguagaaaaguacaaggaguacagagaguuuucuuuuuuuuugaaauggagucuugcucuguugcccaggcuggagugcaguggcaugaucuuggcucacugcaaccucugccuccuggguucaagugauucugcugccucagucuccugaguagcuuggauuacagaugggugccaccacacccagcuaauuuuuguauuuuuaguagagacaggguuucaccauguuggccaggcuggucuugaacuucugaccucaugauccguccaccucggccucccaaagugcuggaauuacaggcaugagccaccgugcccagcgcagagaguuuucaguugaaaaguaaaguucucugagucuucuuuuuacguaaucucacucccaagaagcaaccauuuuuaacuuucucauuaguuuuucugaugguuaccaccauauuucuaaauaauuuuagagcacuucuacuuccugauaucuugauuuucagacaguaucuguugauuuugcuaaaaaugaugaaaaauuuauuauaacuuacauggucuuacauuuuccccuuuaccuccucauuuuacuuaguuaugucucaaucucuauuaccuuuuauauauaaacagcauauuuaaaucuuaauucauguaugaauuaaugcugaauaauuaagcuaaucaaaauauuauacuuaaaauuuuuuuaauauauuuuucuauuuuugugaguuauggagucaaagagaauauauuguccaaauugugauauuuuugagauacuaauaaaauggguacaagucaagcauaucuaugcaaugaggacacagaaucacccuaguuacagacuucauauacucuucuuagauuuucacauuguguuuaucugauugguuauaaaaucaguaaagcuuuuguaccuucaaagaauuuucagugacuaauaaaguucacaguaaggaaacuuggaaguagaguuucagaauguuaacuauuucuguauuuaaguggaacuuauaaguaauaacaaaaucuaauaagucaauacuuccuugaauuaagguauauuuuuucauggugaggacuugucugucaauuccaguuuuaguccguguauucauuagggauuaguguuguauuuugaaggccuuuuugaauaucugcggagauaaacauuuuucuccuuaagaguuauuauauguuaauuaguaaauaugaggccucguauuguacuguccucgcacuccuggaguaaaccucucaggauuauaauauauuuuuaaauguagauuccauuuuuauuuuuauuuauuuguuuauuuuuuugcgacagggucucacuuuguugaccaggcuggagugcagugaugugcucauuacucacugcaaccuccgccucccaggcuuaagugauccucccaccucagccuccucagcagcugggauuacaggcacaggccaccaugcccagcuaauuuuuguauuuuuauuagauaugggguuucaccauauuggcuaggcugguuucaaacuccugggcucaaaugaucugccugguuggucucccacagggcugggauuacaggcaugagccacugugccuggccuagauucuguuuuuacauacaugauuuaggauuguuuuaucuacaauucauuuguauauagcuuuacuuuaucagcuugaaguauugcuguuacaggugccuccuaaaaauaauguggauguuuuucuuuuuuuuuuuuuggacucuggucuuugaagauuuaagaauauaccacagugaaaccauuggggcuuuugauggguauuucuuugauaacuuucuuguuuuugucucuggaguuuguaauguuuaaauuuucuaucucuacugaggucaauuuugguaaauuguguuuuccuaggaaauaauucauuuuaucuaaguuuuaaaaaauguauuugcauugugcauaguagucuuuucugacuuuuaaaaauguucuguuuuaguaauuuucuucugucacuuuauuuuuguguuuguguuuuuccccuuuuuuccuugauucuuuuucucuaaacaaccaauauuuugauugauuuguucuacugguuuuguguuuucugucuuacugacuuauacuuuuaucuuuauugcuuucuuuggcuucuuuuguuuuucccucugguucauuuuucuagggagguguuuauucacuguuuucauugcuuuauuuguauggauuaaaauauucauggcuauacauuuuuuucuuaaaacugcuucaguuguauuuuauagauccuguuacauaauguuuuuaucuuaguuuguuuccccuuuguugcaagaggcuuuuauuguaaggguuuuauuccagguagaaagaauggccuuucuuuguauauuauuacuuaaacuuuuuuuuuuucauuaugaucagagaacuuacugagauuuucguugccacuuaauauauuguugguguucaugaaugguccagguacacuuuacuuaaaauuuuuuuuucgacacggaaucuugcuguguuucccaggauggucucgaacuccuggccuaagcaauccuccugcuuuggccucccaaagagugcugggaucauaggcaugagccaccugcacccagcacccauguacacuuuauuuuuuuggagacagagucucacgcuguugcccaggcuggaguacaguggugcggcucacugcaaccuccaccucccagguucaagcgauucuccugccucagccuccccaguagcuaggaauacaggcacacgccaccacaccuggcuaauuuuuguauauuuaguagagacacgguuucaccguguuggccaggcuggucucaaacuccugaccucaaacgauccaauugccuuggccucccaaagugcugggauuguaaucucccauguauacuuuagaagguggauauuuucuuaucaaauuuugauagagaucccucuugucuaguuauugauuauauugucucugucuuucaugucuguauuuucuguucacuugaucuguuuuggggggcauauuaauaucugcuuucuuauaaguguauuucuaucuuuuuuaacguuugcaauuucugcuuuauaaagggggcuacuguguuuuugguacauagauuuucacaacuaauauuauuaugaauuauauuuuuagcauuaugaagugaacuucuuuauuucauuuaaagccuuugagcccaaauucuacuuuguuucauugcaggguagcaaucucuguuuucuuacugcuuguguuugcauuccuuaggacuguauuauguaagaggaucauacaugcugucuguuaccuugugcccucugcugccaguuguggccaugugacugacuuugacugaugaaguaugaguggaaggcacuucugccauggcuuuuacccuucuguaagaaauuaagaagaguauauauaccggauaagugcuacauuccagaguagagaaugaugacacuuggagaaagaggcagcagucacagccagucugcaguaaacaagucaagugacugagagaagccuuugggagaugucaggguuauuugcuguuaugacaguucuaaugagagcugcuugauuuguuugguauacuuuugaccaucucuuuauuuuaagccuuucggaauagguauuuuaguuguguuucuuguacugagcacaaaguuggguuuuguuuuuugagcagaucugaaaaugacgaguauaugauugguucuuaacugucauacuacuauauuuacuguauauuauauuuucauugcuauuugucuucaugucucuuuuuuuauuuaggaagguuuguaauuuuguucuacugguuaccuuuaugcuauaaauguuuuuaaauauccuuagcuccuuuuccuuacuuaggcgccuauuauuuuguucacuccagaaaacuccuguuaccuaugugcuucucagugagcacguucuacaucucuuguucucuaauaucccuuuuuuuuuaagcuguuuguacuuugucagacauagaaguguuucccuauuauuuuucuacccuuguccuuacauuuugucuuagaucuacaauacaacauaugcagugacaccaccagucauuucagcuauguuuccuagucaucucuuaguuaucccuuggguccuggcuuacacuggggguugcaugcuggauggccugguuguauaauccuuggcucacacuuuuuucccccuugaguuucugguaaagcauuguuccacuguuguuuugcuccguauauugcuguugaagucuuagccugauuuucuuaguuuuauaaguaacuuugaguuuuuauguggaagcccagaaauguucuucauuuauaaaaucuagucaucuuacuaggauauguuucacaguagacuauucugggucaguuuuccaaguacauguaggccuguucaguauuucgauucaugccuuuuguuuccagaaaauuuucucagauugugaaaauggguuuuuucuuccccucuuuagggacucucauuacauggauauuggcucuuugcccauccuguauuacuuuuacuuagauccuuuucucuucauuuuuguucucuuggcuguuuucauaguuuuccuuauugucaguagaaucugcuuuccccuuagguaugcuauaacagagauuuuauuucugagaucauuuugucuuuuuauuucuauccuucuagaauuugaaacaagaguucaucaucuuauuuuuuuguguauuuccaugaugaguuuuuaaauuucuagcuuaugauguacuuucauaucuguuuaauaauauuucagucauauggaauuguuuuccugugccuugugauuguuuuagggaacguauuuuaauucuuguuucuuuuuuguuuuggggcuuuuuugguauggcucauuuuuauuuuaauauuuguuccuuuuuuacaacuuuuauuuuagagucaggggguacauaugcagguuuguuaacuggguauauugugugauacugagguuuaggguacagaugauccugucacccagauacugagcauaguacccaauaguuuuucaacuguuucucuccccauaccccgcuaguguccccagugucuacgguugccauuuuuaugcccauggguauccaguguuuagcuaccacuuauaagugaaaacaugcgguauuugguuuucuguuccugcauuaauucacuuaggaucuucuuucuuauguaguagcuucauauggaugcuguuucuccuuucuguuuaguguagagagucacagaguuucuuggacacacaauagcauguguuucugugauaggagaugagcgguuugugugacuucauggguuucuuaguuuaaaugcugcguuguguagguacaguuaagugcgguuucuuuaaugaauggugcuguggagggguagguuugugugacuucuaauucugugauacucuuuuguuucaagaacguauuuccaucacuugccuucuuuccuuucacugccaaaccuccauagagcugcccccaccuucuaaguugccuucucccagaagcagugucuucuggaaacugcagccuguggcaaagcccuucuauucaguucccaacugcagugcucuaaccugccaggucuuccaccuggucugggguguuugcccacccugguagggcacuuccuugcugagaguucuucccuggacaaugauugccagguuaaacuccccucuccugucgacagacgccccucugacuggcagcagaggcaguguugcuagcucugguaguuuuggauuuuuuauuuccuaaauuauauuuaauggaggcuugcugaauacugccuccuuuugcuguaggcacggauuaugggugguuguguaugcuuuuuguugaucuauaagguuuuuggaggauguguggauauauuuaucuaagcagccaccaugauuuuuugggaaucacaugucucaucaguauuuucugaagacugaaauucagcuuaaauuuuuauaaagacugaaauucaauuuaaaaacugcucuugguaaaucagguuguauguaacagucauuucugaauuaaucuagcaguuaccauuaucuuucuuaaguauuuaaauauguuuguuuuguuuuauaaauagguccaguguauaccuauuucuucucuauaaagaugacuacuccccauauaaaguugaggcauuagaaaacuauugucaaaauaaagucuaacuaguuuucuuuguuauacuuguucucauaagcuuuauuucaggaaauugugcuuaaacacaaauacuuuggucacaggccuuaaaugucucugauuauuuucucuguuugagaaucuaugauuuuuguccuuaauuaagcagaaguaaacugaaaaguucuuagaaaauugauuccaaaagcucaaggccacugagacagcgcuccccuuacugguacagugcuagcuggcuugguggaauuuuucuuucucuccaaggccaagacaggccuggcugcuccagggaacuggaggcugguaaauaaaugauacuguucauuuguagguggucugacucaagcccaugcccugggccuuuccaccauaccuugggcuucugcauuaccgauuuauaaaagaacagugaaacauuuaaaugcugccuuuugcuguaagaauucaaauuagcauucuggagaguaucucccuccuaccuuuuuaaaaaaauaguuuuuaauugacacauuguauugcauauauugaugggguacaguuugauuuuuugauauacgucuguguuguauaaugaucaaaucaggauaguuagcauacucaucaccucauacauuuaucauuucuuuguguugagaacauguaaaaauaucucuuccaguuguuuuguguccuucuggggccucugcaucuccuccacggaagaaaucucuacuuuugcaucacauaaaagauuuguacuguuuuaaaauauauuaagcacugaaauaaaguaaucuuggaaggguuaaguuuaccuaggaaagccccaaguuuuuagaaucuguggaguuuccagaagugaagcaucagguggaaauaaauuguuuauagagccuauaauaucacagaguaguuguguauggcagaggcacguucagacagauuuugaauuuuccucucuucuggauucuuucuacauuugcuuauuauuuugaggcauacaugggaaaccuuaaaaaaugaauguggacaguuuguuccauccagacacuaagcaucagccuuguuauuguggccugugugcuaggcccugugcugcuuccucuuccccagagcaucagucuaguggcuaaggagauacugcugguaaauaaugagaagaaggagguaccaugcuuuguggggauccccccaggcuccccacacugggcaagucccuuuucagucuuuugggguggcuugacacaccccuucauggcauccugauguuagagcugaauuuugccucugguucuacaugcuuaucuucauaguacugucacugucacuuuuugugguauuucuacucuaauaucuugugauuuuagaggcaacuuuauuucuaucucaggaguugucagccuuuuucuuugagguacaucucaugaugugugugucauuaguucucacaauucuacgaugucuccuuccucccacccacaguuuuaaaauaguacggacuauaguugucauaguuuuacaaugcucugcaauaguuauuauucaggaugggggaaaucaagauuuuagauuauuugaagaugaauugguuuucacagcucugcuguucacuggcuccuggugggacauuuguggcuuugacaauguuuccucaggggaacauggggaauugauaggcuuuuucucagacccuucuggccgugaagcuugauauucuuuccucagugucgugaccuccuugugggcaagaaguuuauuuccuuaguguuuucuggcacauauggaucucaguaaauauuuccugaauaaguacggucaagaagaagagagucugccuugccucuggaaugcaagggugguucaccugggccagccagguggcagugguuuuugugcuagcugggcaguguuuucuuucacgguggggaaaauguuuucuucuuccaagucagauuccuguaauacaaaaaaauaguuaauuuagcucaguuuagcuucuuaaugucaauugagugcuaaguguuuaacuuauguugcugcguaauauggauuccccacagaauauuuuuuccaaggaucuucugccucacugugagaccucuggauaacaguuguuacuuugaaugcaaauucugaauacuuguccauaaaauuuacaaaaaauuaacuuucacauaaaacaaaauaagcauccgguguaauuucaaaaguaccuuuuuucaggaaguuuuaaaguuauggucaguuuaugacaaauggguuuuuaaagugaggcuaccucuggcaauucuguuucaggagacaugaggaucucaugguuuagcaaaguucaaaggucacugaacuugaagucaagugucagguacacuacugaccuuggcuggguagccuuggauaagccauuguccucuagaugccauuuucucuucaguaaaauagagauagugucuuucaugguuguaauaaugaaaaugacauaacauauauggaaauaucuagcauaaaaccuggaauaauguaggaacucuguuaauucuagcuguauccugucucugaaaauaaguggauaaaguacauuuuaauuaagcuaguuuuauuuagaaaccuuuaauaagaaugauugaacuauaauuacaguucaagauucccaguacucuuuagaaaaacaagacccaagaaaguagcaagacuuuacgccaagggagguauggcuaagguugagaauguuuucaugugaggaauuuuccauuuaggaaacuuauuagcuguuuuucuuuuuuuuuaauguguagauuugaaguggagggaaagggacaugaaggugugagagaaagcuguagcuuauucugacacuucauuuuugguauggcuuguugccauucuaucuuucacuguguaacauaguccccaaagguuuuuguuuguuuuuuugauuuuuuuuguguguguuggggaggagguuuuauugagauuuaauacacauaccguacaauucacugauuuaaaauguacaauucagagguuuuuagccuauucacagggcuaugcaaccacagcaguuuuagaacaucuucaucaccccagaaagaaacccuguaccauuuagcugucauuuucccucaccucccugcuuuuccccaacacucccaccucuagaugucuuugccugcuuugcgcugcuguaacacaauaaccuuagccuggguaauguauaagaacagaaauguauuucucacaguuuuugggggcuggaaagucugagaucaaggcaccagcgucugguaucuggugagggccuucuugcuuugucuucacaugguagaagagaaccagagaaaauggaaccucccuuucacaagcucuuuuauuaguggccuuaauacauucaugagagcagagggcucaugaccuaaacaccucccaguaggcccuaccucccaacacuguugcauuggggauuaaauuuuaauuuaguuuuggaggggacaaaaacauucaaaccauagcacuaccaaccacuaaccuguuuucugucucuaaaaauuugccuacuguagaccugucauauaaauggaaucucacugugacugcucauauugcgcauuaauauuccauuguauguguauaccacauauuauuuaucuguuaaucgguugauggacuuuuggguuguuuccacuccuuagcuuuuuuuuuguuuugagacggagucucugugucacccaggcugaagugcagugacacuaucucggcucagugcauccuccgccucccagguucaagugauucuccugccucagccuccuguguagcugggacugcaggcacccgccaccaugcccagcuaauuuuuguauuuuuacuagagauggagguuucaccaaguuggccaggcuggucucaaacuccuggcccugaagugauccacccaccucagccucccaaagcgcugggauuacaggcgugagccacugugccuggccacuuuuuagcuauuaugauuaaugcugcugugaacaguugcauacaaguuuuuguguggauaugcguuuucucucuuucuuuaucucucucuuucauucucuuucuuucuuucucucucucucucuuucucugucucucucucuuucuuucuuuucuucuugacaaagucucgcucugucaccuagacuggugggcuggagugcaguggugugaucucggauuacuguaaccucagucccucaaguagcugggacuacaggcaugugccaccacacuggcuaauuguuuuuguauuuuuaguggagaugggguuucgccauguuguccaggcuggucuugaacuccugaccucaggugauccuccagccucggccucccaaagugcugggauuacaggcgugagccuccucgccccgccgggauguguuuuaauuucucuuggguguguaccuaggaauggaauugcuggguuauaugguaacauuuuccaaaguggcugcacccuuuuauauuccucccagucguauauaagguuucuccacauauauaagguuucuccacgucuucccugacucuuguuauuuuuugucuuuugacagacaguagcccauccuagccauccuagcaggagccaugugguaucacaugugugguuucgauuugcauuuauucuagauacauguuccucaugagacauacaauguaauauucccaaagguuuuuaugccuuccauacauggaucuagauaugauaaccauucugauugaguaccugcucugggugaagcucugcaguggcagcuguauguggauuauuucuuuugauccucauaauaacuccuagguauacauuaucuucaguuuacgcaugccaaaacugaggugugaaggaguuaaagaacugguccagggccauacuguuaguaguuauugccuaaggucugagucacaccugagccuugcuguaugcccagccucugcucugcacuaggacuuguguugacagggagcugcaagcuccucugcuggagcuuggaguuuaauggaguuccuaacacgugugugcacucuuucauguacauguguucauaccaggcccagcauccagugucagccuugaccuguccugucucugaguccuuauguccauaccccaccgaguuccuuguuauguauacuguacagagucugcugcaucucaguuuuccacuguuuauuuuaugauuauaaauagacaagauagauaaacgucuuucauggaggggccuuagcauaguaaaagcaaaguuaacucugggaggauuacggaggauaauuuuggcuuuuaugugagaagaaauuuccaaguagcuuaaagcugucccucaguggaaucagcugcuugguaaagaacuuugcagaacuguauauguccaagcaacaguggagguacccuucucucaggguguuguaaaaugcauuucucaggguguugcaaaaugcauuucuaaacugggccggacccugaggcuuccuccagguuggagaaggacuugcccuuaccagaguugacaucauacagcuguagaaugucgugccacuuucucauaagacguggcuucugaauaaacauagugcugaacucuugggagauaacaggguaaagaugucuuuauccuucaaaauuuaaucuccuuugaaaaacguacuuuuaacuacucagacugauauaaaacuuccagcuuuuauagaugggaaggacucugauuaaagauguaaucagaauaacaucuucaguuuguaacaccucugguucuggggucagccagaucuguguuugagucuuuuuuuuuuuugagacauaguuuugcucuuguugcccaggcuggagugcaauggcacgaucucagcucacuacaaccucugccucccagguucaagcaauucuccuaccucagccuccugaguagcugguacuacaggcacaugccaccacacccagcuaauuuuuguauuuucaguagggaugggguuucaccauguuggccaggcuggucucgaacaccugaccucaggugauccgcccgccuuggccucccaaaguucugggauuacaggcaugagccaucaugcccugcccuguguuugagucuuaauucugagcuauccuuucugugucaccucgggcuaguuacuuuaccacuuaacaccccaguuuccucaucuggaaaacagguauaguaagaguaucuccuuuaaauagagguuaagauucuguaaugcuugucuggcacauagcaaguauauacuaaauguuaaucauuugagggagggagaauuagagauguggaugguuguuaaaaaucuaauuuuuaacuuuuucucagaggaaacacaagaauagaagaggcuugugaaauguauaccagagcugcaaauauguucaagauggcuaaaaauuggagugguauguacaaaguuuuuguuugcuuuuuaggcaaaugguuuaaaaucacuuugaagggagaaaugacuguuuuccccuugaagagcaagacuauuggccccagagacagaugucagugcugaauaacugauguggcugcuacugacauauggagacuaaaggggugugcucuaagugaaugaagcuggaaagccuggcuuaaguuuaagcacagggacagugucugucuuaguuucuauaaacuucuuaauacaguaggcaugugguaacuuaaaauaguuaaaauuacuuggaauuagaguaaucuuugcuucuuacuaauauguucaaauaaacacagugccauaaggaaugaaaguuggaauaaaagucauuaaaacuagugggauaaagagaauuuucuuuaccugaacauugguugagaaugaccauucccugcuacgcaauaacugauugugauuccacugagaacugaaagugggguuuggggggagggggauggauuuacauuaaccucaauagacucuugguuauuuuuuaaaguaaugcuuucuacccagugagaccgggcauaacaaaauucacaggauuauuauuuucauuggucugagaugggauggcucuuugagagaaauucaucccucucccuucagcgaaagagaucuuucaugccuuagugaugggauauuucuguagugaaaauggagaccaccguugaccagagcaggggacguggguguugugcucuggcucacagcugcugugggauuggaagugggacucgcccucuacaagcuguuucaaggcagacacuuuaaaaucauuucaaaggagaaaaugcuuuugagcuagaugauucuaaaaggucucuucuggcuuuaaagaucuuuguaagaaguuuaguuuuagcuaaggcuuuagauaugcuauuuuucaaaacacaccuacgccugaauuauauuguauuuuuaaaaugguggagaaaacaguuuguuucacauucccucuuuuauuuuguucaggucuuauaaguaaaaagugaucuuaccugaagagaucacuuacuuacuuauuuauuuacuuacuuaauuuguuuauuuauuuauuuauucgagacagagucucacucugcagcccaagcuagagugcagugguacaaucuugacugacugcaaucucugccucuggggcucaagcgauucuuaugccucagccucccucguagcugggacuacaggcacgcgccaccacgcccagcuaauuguuuguauuuuaguagagacgggguuucaccauguugcccaggguggucuggaacuccugagcucaggcgauccacccaccucggccucccaaagugcugggauuauaggcaugaaccacugugcccggcugagaccacuuauuacuuauuguaucuggugaugagguauucuaaccuuuggaaauuccauuucagagaggccacugaucauguauguaacuaaggaggcuuuguaugugcaccccgcgucaucuguugccuggggugaugcucuagccuccugacauugucauacugcugcacuuuuccagucuguuuccauuuaugucugagguugcaauuuuuugaauuuuggaaaucagaccuuggcgaugaccuugagcaguaggauaggauauaaauaacucccacgugccuagcguuccagugaaggaacacuaggcauaaauguguuaaugaaguaacguaacacaaguuaaguaaggucauaucauuccaaauaagagcugacgucucuguaguggcccucaaagacuauccccuuccuugugcacccagcucccacuucagagccuuugcauguacuguucccucugucucccuacucuuuccccaaacagaauguugcugggucccugcuuccuucagcucccucuucacaugucaacuuauuggugaggucuucucuggccaccccuuuuaaaaauaacaaucuuguccuuccuggaaacuuuuuuuuuuuucuuucuccaacacuguuaucaccaucuagcaaaaauaaauuacauaauguuuuauucauuuauauuuacauguuuuuauuauauggugauucucauuagaaaguaaaccuuggaaggccauguuuguguguuuuuaucucugcuguaucuccaggcccuggauuauuaccugcaaagucauaggugcucaguauauuuguugaguggaugaauauuagacuccuugaaguucuauccauguugcauuggugaugaucauaacagcauugcaucucuuuauaguuuuaaaaguucuuucauaaugacuaagcuaauuuguuugauacucagcuuuugagagaucauccucacagguauuauaccaguuuugcgggugaggaaauuuagccuaaguuguguggcuucccagagaccauuuaauuuaauauaugauccuuuaaagacaguuccaaguucccccuccaccuccgagaauggagucuugcucuguuguccaggcuagaaugcaguggugcgaucucagcucacugcaaccuccgccucccgaguuuaagcgauucuccugccucagccuccggaguagcugggauuacaggcaugugccaccacgcccagcuaauuuuguauuuuuaguagagaugggguuucuccauguuggccaggcuggucuugaacuccugaccacgaggagugccugauccacccuaagugcugggauuacaggcaugagccacugugcccggcccaacacuuccaaguuuagauagaccgagcuagcauuugcugucagugauuggaaugaauagucagagugaaaaaguaagccagcaacucguuuuggaaugugggaaugugaaaauguaaaauuaaagcgcuuacuguugucuggagaaauggagguagcccagaagagccuggguguugugguauuacugagcaagaaaaggauggcccaugacugauucugagacaggaaacauagauaaguuaucaaaaaugaaaugccagcaggagagcaaggauguagauuguaaaaaaaagauggcauuucaauaugccaaaccacagauaugaucuaaggcuagauuugcauguaauaaugaaaguggccaccguguguaaugugagucaggcccuucuaagcacuuuacuugcgaaguccaagcuauuacuacguucuucugaggcagagcccauuaaagcucccacuuagccagauauguuccugaguugccacuucaugguuaagugcugccccaaguaccccaggugccuggccacuguccuggcaguggccuuugccccuucuggauacccaccagccucucaugauucacaaggggccagcagggcuucuucaguuccagcucuagcccugaggcuggcauguacucugauuguucagugccuugguuucuuccugcggcuauaacaaaauaccuuaguguaauuuauaaagaaaaugaacguauuguucagaguucuggaggcugggucguuuaagaucaaggugccagcagaucccguauuuggugaggacuguucucaccuuccacgauggcgccuucuugcuauguccucacgugguggaaggaacaaggcaguucucuucaaccucuuuuauaagggcacucaucccauuuaugaggguggugcucucaugacuuuaucacucccccaaaggccccaccucuuaauacugucaaauuggauaucaggcuccaguaauacaaauuuuggggggauacugccauucagaucauagcacuacccaugucaugcuggugguuacauauuuuucaaagaugccuggguacucuuuuuaaucagaaacugugguacagagcaagaauugaaccugggcaggugggcuccagaguuuguacugucccuuugcccucagguucagaaacccacaugagaacugugcauuuccucuggggagagggaguuggaacaagagaugcagcugaagcuuuagcagaauuggauguuuacggccagguauaaucaucuguaaucccagcacuuugggaggccgaggcuggaggauugcuugagcccagaaguucaaaaccagccugggcaacauagcaccugucucuacaaaaaaaaaaaaaaaaaaaaaaaauuuuuuuuuugagacaagagucuugcucugucacccaggcuggagugcagugacacagucucggcucacugcaaccuccgccucccggauucaagcaauuguccuaccucagccucccaaguagcugggauuauaggcaccugccacaaugcccagcuaauuuuuuguauuuuuaguagagacaggguuucgcuauguucaggccaggcuggucucgaacuccugaccucagguaauccaccugccuuggccucccaaagugcugggauuauaggcuugagccaccaaacccagccaaaaaaauuuuuuaaagaauuaaaaauaaaaaauagccaggugugguggcacaugcagcuacucaggaggcugaggcaggaggaucucuugauccugggagguggagguugcagugagcugugaucacgccacugcacugcagccugggugacagauugagacccugucuugaaaaaaagaaaagaauuggauuuuuuuuccucacaaaaaaaauuuauagcaaauguuuaauaucagcagugaguacugcuuuaugauaauuuuuuuagaaaccuaaaggcuuugugauauucuuaaccaugcuuuuccugguagaucagauucuuuccucuccauuucugcuguacugacuuccccaaugugacucauuuuucagaggcacucugcuguguugcuuucucugaacucaggaaguuucgcauguugauguuuaaacccucugggaaguggccugaugcagccucagccuugauuuccacuggccuccuccagucagggcaggcuugucacuggccuccacuuccagcccuuucuuaccuucaagcauuucuucuguguuccugugacuccucugcuagcgauuccuucccucuuucuuuuccagcacuccagaauccauggucccugauccaaaaccuuuucugaaaaagauuaguucauguaccuuauauguuguacugugucccaguuggagaccugggugguaccccacaaccagauccaucagugauucugcagggaaauuuguaaauucucacacuaaaugggguaaaauagauuaaaccucauauaaauuucagucagauuuugcuauaaaguaaagaaaaaaauuuggauuuuuagacuuuucuggauuucaaaauugugggccugauuuucacuuuuuaggaaacuuacuuuauccaugaagccuucauuagcaguuucuuccacaccgacagcuaaguguaggagacacuaagauagaaaagugagcaaauaucuuugcgcucaguguuuuaccuuucuuuaaucauuuguggcuugaagcccuuagcugauguuuauuauauguuaguggaauugaauugaguagcccaagacuuggcuacugguauugaauggacagaucagggaauaguggcuuagugcccagggacacuuggaaagucugcuggagcugagguggagaagcuuucaucgcuguuugacuugauucugguuauuuuuauauuugcccgaggugcacuggaccacauggauuuuugcuucugacuagaaugcuucuuuucaguggaauauaauuuuucuagggagguccagugcuuacagcaugggcugcucugggggggacuuguuccucuguguuuaauuguagugucuucuucagcugcaggaaacgcauuuugucaggcagccaagcuccacaugcagcuucagagcaaacaugacucugcuaccagcuuuguggaugcuggaaaugcuuacaaaaaggcagauccccaagguaagacagccaggcauguagcaugcuaucucuguguguaacuaaccagucaguacuucccucaacguuaaggucaguguuggugugcuuucaaguccugguaaaaaggaauuuuuguauuuuggaauaauagagaauuuugauaaccuuagggauuuuucuuuuuuaaucauuugggggcuuuuaugaggagaaauuauguuaaauuuauacuggcuguuuacuuuauagcaucauuuaauuaaacucuuauuuauauugcauuuuagagaauuuuuuggaaauuaccuuuaauuuuaucuaagacuucuuauaucuuaauuuugugaaaauguauauuguucauaaaaggaaacucuuauguucccuuacuccuaaauaccuaaggaguuuucagauccaguuaaugggagauuguaauauucaaucguuaaaaagucugauucauacaguauucauuugguuuuuuaaaaaguuuuucaaaguauuuguuuugaggaaagaaugcaauuggauauuuaaugugguaaaauuuugcaaagauuauuucuuuuuaguuagaagaguguaauuaaaaguauuaauuucuuaccuuccacacgcgugcacagcggaaauuuuguguuuuuccuuuuucuuuuagcaguccauuuuguuuaacacacagaucccaaauuuugagaauaaauaugucauaaagaaauaggguaucuucaauaccuuugguauaaggguuaaucacaguuuauuucccaaagugacaaacuggacacagguuaaauaagcuguuagagugguaacauuguaaugcaucaguacuuuagaauauggugcaggcauuaaaaucccugguuucagagaaucuucagugaccugguaaauguuuacaugucaauuaaagaagcacaugagacugaauguuguauaaucucauuuucagaaaaaaguuugugcauauagaaaugugucuaauaaacgcaaaaggaaaguacaucugaguacuaacaacggauuugagcgggauuauugauagauuauuuuucucuuuauauucuguauuuuaaaagguguaacagggauccacauuuuuuauguaguuuagagggaaauuguuuuaauuuuuguucaucugcuuaccuuucuaauuuuguagucaggccuuucuacuuugcugccucuuuaaaccaaacguaauaaacuuggagcugucacuguaugccagcaucauaaacaccaucauuuuaugauagggaaaauuuuuuggcucacuuguuuagaaaauuaguaaaauuuauuagcauuauuauuuauuagauuuguuucuucauuuuguuaguaugcuacaauuuagcaucuuugaacauuauacagaauguugacuuugcuuaaggguuguuugaauaggcauuucaaagugcuuuugcuuuuggcugcauggagaguagaaucuauugaggugauuguucuugugauguggugccauguuccaaaauuaauauauaugcaugguauuaaugaggaauauguuugcauucauauuuuagcagauacaauuuaucaguguuggugacaaccucuaugguuuuauuuucuuuauaauacagucuuuugccuggauggaguccucacuuuaagguuaagaguaacuaagccaauguuacuccagcuacaguucccuaaauuauacuauagcugcugggaacaaagccaugcugaugaaucuggacuugugcaugauuuuuguuugcuucucauuaaccugcccacccuccacuccaaaauuauaccucauuaacguucugauaacagccaggaagacagccucaccugaacccucuuugacugaauggauuuuucauuguuuuucuuaaaugccuacgcuucagaggcuaucaacugcuuaaaugcagccaucgacauuuacacagacaugguaagacauugcauugcuugaguggcugugggguggagucuugagauggcuuagaguucuaucuuucuuuuuuauguucccaaacuggcauucagauagguaaaaucggugugugacuguuucuuguuuuuuccccuagggaagguuuacaauugcagccaagcaccacauuacuauugcagagaucuaugagacugaacuuguagacauugagaagguaagcagugggcacacuuccucagaugugaagcaggcagauaagcugacucaaagaacucuccucuccucagucugagagugaucguagguguagaguggucauagauggccuugccuggagacuuucuggcaaagucuacuagcuggcuaaguagaugggcuguuuuccuggaguggacaucuaagacaugagagcugauuaagauuuacagagaucaccuguuguuuccacucucucugauucaugucagaacauuagcauugccaaaagaaccuucagcuguauugcuuaguacucuaaggcccagugaagaaaguguaagaggucaccucuguacacucagucagcaucacagcuuuaaguaucugugugccagugacucagaaaucugacugcagccuagaccucucuccaaaugcuagauuacuguauccaccugccugcugaccucuccacuuuguccagcagucaucucuaacccaacaugucugggacuggauucucagauguccccaacccaguguuccccgcuaaacuacaggcuuccuugccuuuucucuuucucuacaaccugugagcaauuuuugugagcgguguccuuccugcucccaagucuuggcacaacucacuaccuugucucucagcucacacuugaucgcugcaggauccuucaaaccggucucccugcuuuugcucucccuaccuugccaaccccacauccccaugccacagaguagccagagugagccuucuaagcauugcaucauacucuguuucucuacugcugacagucauuagaccccuuucacuaagaggaacagcuggagcugugcagagccuucauggguccacugaauugcuuccucccagccccacacuccccaugcaucuguguggccuggccucuccucuuuucuguuauucuccuccucuugcauacccugcauggccauccuggccuccuugcuguuccgcacacaugccagaugagcgcuccugccucaggaccuuuguauccacgauuuccucugucugcaaagcucuuccccagauguccacguggcugacuccucacaucuuucaaguccacauggcuaacuuccccgugcccuuccauuuuugcucauuuauuaccuauuuccaugauuaacuauuaugacccccuaguuaauuuagccccccaggaagacauaguagauccccacacaccucacuuaacuucuuguauugcugagcagaugucuccuuacaauaugcccucucauaugcuugcucaucauucucauuuugguugucucucucccuccgccagauugggcacacgugucagcagagagcuuugucucugcuuugcugaugugucccaagagcccagaacucugggaccuaguggggucuaaauauuugcuaaauaaacaaaugcuaccccuaccuccaccauaccaaauggagucuuccuggucuggggaaggaucugcuaggcguuacugaaauuggacuggcauuguuaacguucacucuuuugacugugugaccuccaccuguugguuauucagcacaaaauuugcucauauuuguuacauaaaauuuauuauuugaccuuuuuuuuuuauaauugccauacuuuucugaggauacucccugaucuugaucaagucagggccacccugugcauugacgugugugugagccuucucuuuggaagguuaucuguggauccuggaggcaggugauggagcuggaucugaaccuccuuuguucccugguguggaauugaugauggaaugggagggagauggaucugguguggcugggguauuuauuuggucagggugucugggauggccacaguaucuuuauuuagguuugagugagucuugcggggaugagcacugugcgcagagcaucuuugccagcagaggcuccuguuccagcuuccucuuucacaguggucagaagggcacucuggggcaggagccugcagugcugugucauuucugcugcccaggcauggucuccaacacaugggucuccauaaacuugagagcagauaaaaugaaaugugacauacucuuuuuuucucuugaaaaaaaaaaggccagguacaguggcugaugccuauaauccuaccacuuugggaggccaaggcaggaggaucacuugagcccaggaguucaagaccagccugggcaacaugagaaauccccaucucuacuaaaaauauaaaaaaaaaaacuauccaggaaugguggcgugugccucauucuguuccacaggcuggacagguuggaguggcaugaacacagcucacuguagccucagccuccugggcucaagcgauccucccaccucagccuuccaaguagcugagacuacaggcaugugccaccaugcccggcuaauuuuuuaauuuuucauacaaaugaggucuuuucauguugcccaggcuggucucaaacuccuggacucaagcaguccucccaucuuggccucccaaaugcugagauuacagucauggaccaucaugccugaccuucacggaauacugaauuuuaaaaugcagcuauaaaagaacagguguacuaugguucucuuuuugcaaauacuuagucacacacagaaauagucuggaagaaaauauuucucuggaagaaaauauuucuuuggaacaccugucagagcugucauguacacacaugugagauuaccugaugaagguacaucuccucccucuaaaaugugggcucugugagggcagggcccaugacuguuccgcucaccaucacagcccugagccuagcaugaugccuauuuacaaagugggugcucaguaacagaugcuaagugaaugaagacaaagugcaucacaaaugaaagcugccuauaguuccauggccuguuuuguuuuauuuguuuucuugucccugcaaaucucuucuaacucacuaggagcugccuugaagccacuuaacuaaugggcuugggcagaaaggcagcaccuuuaaucugauuuucagagacugcuagcucccucauuugcauuugcugugaaaccuuugucauucaagcauccugcaaacccaccaccugcuucuguauguuugcaugcuaaaaaugguuuuuacgguuuuuaauccuugagagaaaaaagcauuuugcgacguguaaaaauuauaugaaauuagaaauuucauuguucauaaauauaguuuuauuggaacacaaccacacuuauucauuuauaucuuguguauggcugcuuuuaugcuaccacaagagagcugaguaguugcaacaaagaugcacaaaaccuaaaauauuucuugucugaccuguuagagaaaaacuuuggcuagagcccugguuuaaagagcugcucauacuuaucucuuguuauuugggguauagaagguuuuuucaaucuuaugagagcuuuauuucuaaggcugucuaccaccgucuacaaaccagcugauucuuugcagaguucagcucuuacaaaacugugcuaaaaacagcagcacacacuaucaucugacucuucucagccauuuugcuuaguuuuggacuccgguagacacuuauuuuuuuguuuguuuguuuguuugagacagaguuucacucuugucacccaggcuggagugcaauggcgcgaucucagcucacugcaaccucugccuccccgguucaagcaguucuccugucucagccucccaaguagcugggauuacgggugcccacaccacgcccggcuaauuuuuguaucuuuuuaguagagacaggguuucaccauguuggccaggcuaguccugaacuccucagguauuccacccuccucggccuccaaaagugcugggauuacaggcaugagccaccgcaccuggccgacaccaguucuuuuuucugaguugucacgugcuugauuucacuaacuucuaccacagcaugacaaggacuucuagcuuucuggccugugaucucuguuucuucuccacuugaugccauauauuuuagauugacggcaacacccuuauucuaggugacacuuaagguauuaguguguguagucugugcugcaagucauagacguaagguguaauuagggcuucauagcucucuaacaauccaguguggcugcuaaggguuugacagugguagagacacugggguuggagguaccuuguguccuuuguaauuacuuaggaaccugccugacaguucugccauuuuggugucuagcuuacagugucacucuggacuuggucauagcccuccuagcucaugggaaguggaaggccuggaggaggaugcaaagugagauauauggcccaagccugggaguggcccccaacaugucuguuuacauuccacuggagagaacuagucauaggcugccccucacuauggaggaagcugaggaagugguguagcugggcauaugccauguggggagggggaaacagauuuugauggucagcaagcauucugcuuccagaggugcaugcuuucuuguauuuccuaaagaaaguaggccgaguugugaaaaguuugcugguagaguagguuuauuuauggaaaaauaccuaugcaaauguaguuuuaaaaugcagcucuccaaauaaauugugugugaauaaaauauguauguuuucaggcuauugcacauuaugaacaaucugcugauuauuacaaaggagaagaauccaacaggcaaguauuacuuuucuuaauaugauuuaauggguuuuauuaugugugauaaaaaaauacuucuuuauacuuugugaguguauuugacuauaccaaaugaagauguacugaggcccagugcacaucuuuuauuuuuccauugacuuguuacucacucugcuuugguucuugauuucagcucagcaaacaagugucugcugaagguggcagcauaugcugcccagcuugagcaguaccagaaagccauugagaucuaugagcaggugaggauacuguuguuuccuuggagagaaguugucugaauaauuuuucaaaauuaaacuuuuuauuuuucuguuuauugagauauaauccacacaucacguaaugaguacaguucagcgguuuuuagucuguucacaaaguuguauaacuaucaccacuacuuaauuccagaacauuuuaaucauccccaaaagaagcccagcagucuauucuuuccuccuagucccuggaagacacaaucuacucucugucuauauggauuuuucuauucugaaccuugaauauauaugaaaucacauaccauguggccuuuugugacugccaucuuucacuuaguguauuguuuucaggguucauccaugucauagcaaaugucaguaugucauuguuuuucguggcuaauaccucaugguuuauuuaucaauuuauggauguuugggguuuuuccacuuuggggcuauuaucaauaaugcugcugugaacauuuguguuaaaguuuuuguggugguguuuuuaguucucuuaguuacauaccugggaauagaauugcaguugcuggaccaugugguaaguccauguuuaacuuuuugaggaacugccagacauuuucacaguggcuacaccauuauaccuucccacuagcaaugcacaguguuccaguuucuccacauccucaccaauacuuguuuugguuuuuuuuuuuuuuuuuuuuuaaauaauagucacccuaaugagugugaaauguugucucauucuguuuuugauuguuauuucccuaaugacuagugauguugagcaucuuuuuauuugcuuauuggcuauuuguauaucuuuggagaaaugucuauuccaguacuuucuccggauuuuaauuuggcuguuuguuuuuugguggugaguuuuagguguucuuuauauauucuggauauuaauccccuauuagauaugugauuugcaaguauuuacucucauucuguggguugucucuggacucuguuauuaauguccuuugauucacugaagucuuucauauuuuugaaguccaguuugucuauuuuuucuuugucuggcuuuuguuguuauauagaagaaaucaucgcuaaaucugauaugaggcuuuuccuuucuguuuuguuauaggaauuguauaguuuuggcuguuagguuuaggucuuuuauccauuuugaguuaauuuuuguauauaguaugagguaaggguccaacuuuauucuuuuauauguggauauccaguuuuucuagcacuaauuguugaauagaacuauauuuuaacuauugaaugguauuaagacccuuauugaaaauuauuucaccauaugaaauaugagggcuuacuucugggcucucuauuccauugaucuauuuauccaucuuugugccaguauuacacuguuuauaucuguaacuuugcaguaaguuuugaagucaguaagugugaguccuccagcuuuuuguucuuuuucagaauuguuuuggcuauuccagaucccuugcauuuucauccgaauauuaggaucagcuugucaaucucugcaaaguagccagcuuggauuuugauagggauuguauggaaugugcauaccaauuuggagugguuuuaggguuuucuagagaaacagaaccaauaagagguguagggguguauguguguguguuugugugugugugaguguguauguguguuuagagagagaaauuacuggagggaauugauucgcuugauuauauaggcugagaaggccuaagaucugcauucugaagacccaggagagccaaugguauagcuccaguccaaauccaaaggccucagaaccaggagaguugaugauguaauuucuaaucugaguccaagucugaaucaggagaauaccaguguccuggcucuaagacaggcauugagaaugaauucuuccuuuuaaccuuuuauuuuauucagguuuucaguagauuggaugaggcccacccacauuggggagggcaaucugcuuauucauccuacugaugcaaacguuaaucucauucagaaacaccccacagacacacucagaauaacaccaaauaucugggcacccuguagcccacucaaggugacacauaaaaucagucaucacagagaguauugccaucuuaacaauacuaagucugacagucgaugaauacagguuccuuuuauauuuauuuggaucuucuuucauuuugcucaacaauguuuuguaguuuuugguguguaaguuuuguauuucuugggugaaauauacuccaaaguauuuuauuuuuuuuuugacgcuacuacaaauugaauuauuuucuuaauuuccuuuuaagauuguuaacugcuaguguauagaaauacaguugaauuuugcauaucaauuuuuuguccugcaaccaugccaaacuuauuagcucuaauagguuuuuuuguguggauuucuuagguuuucuauauccaaaaucauguuaucugcaaauaacaauaguuuuacuucuuccucugcaauaugaauguguuuuacuucauuuucucgguugcccuggcuagaaucuccagugcaguguugaauagaagugacaagagcagacauccuugucuuguuccugaucuuguaaggaaaacuuucggucuuucauauuaagugugauagcgguagauaucaguagugggguuuugguaaaugcuuuuaucaguuugaggcaguuccccucucuuccuaguuuguugaguguuuuuaucaucaaaggguauuggauuuugucaggcauuuuccugugucuauugagauaaacauaugauuuuuguccuuuauuugucagacuuuuuucugcaucuauugagauaaacaugguuuuuguccuuugucaaacuuuuuucugcaucuauugagauaagcguaugguuuuuguccuaaucagcuuaauauuguagauuacauugauugauuuucauauguugaaccaaccuuacauuccuggaauaaauucuacuuggucauugcaaacuuugagggguuucccaagaacacccucaaguuuauuaauaauuuguuagacaaacuuacagaacccacugaaagcuguuauacucacaauuaugguuuauuacagcaaacggguacagauuaaacucaaaggagagacucauaggucaaggucuaggagacuuccaggaagagcuuucaguugucggcucucaguggaguuauguaaacagcacuuacuuccccccacaguaauaagugaaaauaagcguagacugcugccaaccaaggaagcuccccugaacgugguguucugaguuuuuauugggguccagugacauagauguugaccacccuuguggcugacuuuacuuuuuguaagugccagaauugguuugcuaacauuuuguugaggauuuuaugucuauguucauaaaggauauugaucguuaguuuucuuguggugucuuugucugguuuuggaaucaagguaauucuggucucagaaugcauuaggaugucuucuuccucuucuguguuuuggaagaguuuguaaaggauuggugugaauuccucuuuaaauguuugguagaauucaauuauuucucuuuuuuuguuuuuauuuucacugauuucuguuuuuauuguuauuuccuccauuuuguuuucuuuggauuuguuuugcucuuuuucugggugcuugacauggaaguuuagcuugcugauuuucaucuuuguuguguaugcauuuuuaguguuaucaguuacccuuucauacauuuggcuacuucccaauuuuauuauaucauuauacuuuuauuuuuauucaguuaguuggauuuauugauuucccuugagacuucagugacccauggauuauuuaguaguguuuuauuuaauuuccaagugucuagcagagauuuuucuguaaucuuucuauuguugacuuauuuuuaauuccuuugugguuagauaacauauuuuugcgugauuucaauucuuauaaauuuguuuuguuuuauggccuagauauggucuaucuuggcauauguuuuaugauuaugcuguuauugggugauguuuauaaauguugauuagcuccuguuggaugauggcauugucgaguucuuuaauauacuugcugaucuuucuuucuuucucuuucucucucucucucucucucuuucucucuuucucucucucucuuucucuucuuucucuucuuucucuucuuucagacagagucuugcucugucacccaggcuggagugcagugacuugaucucagcucacugcaacccuccaccucccagguucaaacuauuuucgugccucagccucccgaguagcugggauuacaggugugugccauguuggcuaggcuggucucgaauuccuggccucaaaugaucugccugccuuguccucccaaagugccaggauuacaggugugagccacugcgauuggccuuugauuuucuuucuaauucuauccauuguugagaguuggguguuaaaaucuccaacuuuaguuguggauuugucugacucuucuuucauugugucagucuuugcgucacauacuuugcagcucuggauugcuauucuugcuggagagacccuuuuaucauuacauaauguccuucucugucucugguaauuuucuuggcucaagucuacuuuauccacuuuauagcccugccugguuucuuuugauuaauguuuauaugauauguuuguccauucuuuuucuuucagccugucuauaucauuauaacugaagugaguuucuuguaguuggaucuuguuuuuuuuuguuuguuuguuuugagacagagucuugcucugucuccuacacuggagcgcaguggagugauuuuggcucacugcaaccucuaccucuuggauucaaguaauucuccugccucagccucccgaguagcugagauuacaggugcgugccagcaugcccggcuaauuuuuguauuuuuaguagagacaggauuucaccauguuggccaggcugguuucauacuccugaccucggugauacacccgccuuggccucccaaagugcugggauugcaggcaugauccaccacagccagccuggauccuguuuuuuaauccacugugccaaucuuuguuuuucaauugguguauuuaggucauucacauuuaaugcaguuauuuauauguuagggcuuaauucugcuuucugccauuuuaguuuuugcuuucuauucuuugcuuuuuguuucucuguuuucuuuuuccaaccuuuuuauggguugcuuuucuuuuuuuucuuucuuucuuuuuuuuugagacugggucucacucugucacccaggcuggagggaaauggugcgacccuggcucacugcagccuccaccucccaaccucaagcaguccucccaccucagccuuagccuccagaauagcugagacuacagacaugcaccaccacaccuggcuauuuuuuguagcgaugggguuuugccauguuguccaggcuggucuugaacuccugagcucaagucuuuuuguagcgaugggguuuugccauguugcccaggcuggucuugagcuccugagcucaagucaucugcccaccucggucccccaaagugccaggauuauaggugugagccaccacacccagccuacuugauuuuccaguguuucuaaguacaguuauuccucagugucuacaggggauuaguuccaggaccucucucauauaucaaaaucugugcauagucaagucccacagucggcccuguggaacucacauauaaaaaagucugccuuucauuuauauggguguugaauuccuaagaauacuguauuuucaauccacauuugguugaaaaaaauccguauauaaguggauucacacaguuuaaaccaguguuguuggagaaucaaugguauauaucuuuguguagcuuuugugguuaaaugcuguagguuggugucaucauuuuauaaguucuggugaaauauagaaaucuuaccucccuuucuguucuuuuacucccccuauucaauauauaguugucuuaauguuuccucugcauacauuuagaaccacaugagucaauguuagaauuuuuguuucagccaucaaacauaauuuagaaaacucaagaaagaaagccuguuauauuuacccauauuuuugcuuaccauguucuuucuucuggauguuccaagauuauuguuuccuuucuauuuagagaaccuccuuuugucauuuuuuuaggguaggucugcugacaacaaauuuucuuaguuuuccccuaucuggaaacguuuugauuuugccuucauuucugaaacauaguuuuccugggaguauaauucuaaguugauuguucuuuuccuuuaguuucaaaaaugugcacuuuauggcuuccaugguuuuacaaacuucugacaucaagugauccacccaccucagccucccaaagugcugggauuacaggcaugagccacaacgccuagucggccuccauuguuuuugauaagaagucugcugucauucaacuuguuuuccccuauaaaaaagguguuauucucuagacacuuucauaauuuuuuucuuuuaguuucaaaaguuuaauuauaauguggcuuggauagauauauuugguuuuaagcuauuugaguuucccuaaacuuacagaaucuguagguuuauguuucuugucaaauuugagaaucauuuagcaguuauuucuucaaguacuuuuucagcuuccuuuuuuuuuuuuuuuuuuuuuuugagaccgagucuugcucugucgcccaggcgugccaguuuaauggcgcaaucuugucucacugcaaccuuugccucccagguucaagcaauucuccugucucagccucccaaguagcugggacuacaggugcuugccaccacaccuggcuaauuuuuguauuuuuaguacagacaagguuucgccauguugaccaggcuggucuugaacucuugaccucaagugguucgccugccuuggccucccacagugcugggauuacaggcgugagccaccaugcccagccagcccuuuucucuuucuccuccccuucuagaacacagaugccacaaaagugagacuguuuuauuaucccauggguccuugaugcucuguuccuuuuugucaguuugucuucucucuguuguuccuguuguugucuuccauuuagugcuucuuuccucugucccuuucauccugcuguugagcccacccacuuuuuauguaugguacuguuuuuuuuuuucaguucugaaauuuuuauuuguuuuuacuuuauaucuuuuuuccuguggcuuccuuuuucuuuguggaugcuuuccauuuuuccauuagcuucagguguuauuguacuugcuuuuuggagcauuuuuaugagggcuucuuuaaaaucuucgugggauauuuuggacauuuccgucaucuggaaccaucaucuguuaauggucuuuuuucauuuagcuugagaucuuccuguguuuuugguauuacaagucauuucugauugaaaacagggcauuugcacauuagguuaugagacugggucuuguuuaaacguucucuuuucaguuggccuucuuugacauuccucuggcuggggaagguggggauguuaccucauuacugccagguggagguagaagugucagcuuuccaccaggucucuguugacaccugaggggccuagucagcccugggcagaaguggcauccccucuccuuaucuguuucugccagcacagugcugguuuguucuugguauggugagagucuucacccuccacuagaccucuucugacagcacaccagcuggagaaagaaggggaaccucuuuccugcuugacagagacaggaugcaggcucccaguguggucugcacugccuuagugucaggggguuggguggggaucaagccucagcucccuauuuggccuucucugaagcuccuaagcagagguauuggggugcuucuuacagucuuucaagaauggacuuuaggacuccuucuucagccuuugaugauguaaauggaguuagggccucaguuuuucugugauauuuggcuggaguagagcaguuauugucuaaguguuuucucucuugcugggcugccccuuuucuaguccuuuggccagagagagcaggcuuuugucucuucucuuuuuaucugugcauacuggcauuucuggguugcugguucuucaguuucaugccauggauauaggaagggaaaagaaaacugagggaacccacuaccacguuuucccuugggaaacguuuguuuuuuagaaaaugaccugggcuuuuaguagugcuuagugggaggauuaggggaaaggauguuuacuccaucuuauuggaagcagaauucuucugagcuauuuuuaacugguuaagacuucauguauuuaauggucuugucuaguaaaauuucuacuauaugguauucggauaaaauaauauauuucauagcuaaacaaacauaagauacauaauuauuuucuaaaggacaacagaugagaaugacuuugccugauauaagaggguaaaucuuuuaaauuuaacucugcguucugugccuagguuggggcaaacacaauggauaauccuuuguugaaauacagugcaaaggauuacuucuucaaagcugcccucugccacuucauaguagacgaguugaaugccaagguaaggaguucuucagcauugauugacugauuucacccauaagaauacguacacauucucucuuguucuugguaucauuucauuuugauguuaguaccaagaauaaacggguacauuaaaaauaaguauuauucugugguaugugucccaguuguaaucuuuuaacagcugucaaagcuguucucaaaaguuaccugauaguuuauagccauaccacccugaacacacccaaucucgucugaucucagaagcuaagcaguguagagccugguacuugaauggggggcacugccugggaauauuuagugcuauaggcuuaaauauauguauauguucacugguagccaccauuuuuuuuucaguaguuuugcuuuaaagaaauuaagggggccaggcgugguggcucacaucuguaaacccagcauuuugggaggccaagugggguggagcaccugaggucaggaguuugagaccagccuggucaaaauggugaaaccccguuucuacuaaaaauauaaaaaaauuagcugggugugguggcgggugccuguaaguccagcuacuugagaggcugaggcaggagaaucacuugaaccugugaggcagagguugcagugagcugagaucgcaccacugcacuccagccugggugacagaguaagaguccgucucaaaaaaaaaaaagaaagaaauuaaggaacuaagggaggagacaauaagaguaggauaauauccauuuaaaaaacaaccaaaacaacaggcaagcucagaaaugguguuggagugaggacugggaagaaguugaaaagcacagugagcacugggagccaagaggcaaaaagacaggcagccuuggcauggccagugucuggaguuggaagagcagaacuaaagccaguaagagaaacuguucuuucugucagcuucgagcaggaagcuaaauguaauuuauuuggaaucuggacuguauuaagaacgucuccauuuaauggauggauacagauaccuggucugugaguguuuaagaauucauuuucauuuacaaugucuucucagcagcagccuaacucagaaaaaaguaguuuagaaauuauucuuuauugaaauggaaaauucagaauagaaagauuuucuauguugauucugcuuuugaguuuaacuacauacuuuuucaacacuuaauaggauauagguagaucuuauuugaagcugauagaauguugaaagcuuuguuuguuuaguaagucugaaauugaugagugguuuuucucucucagcuugcucuugagaaauaugaggaaauguuuccagcauuuacugauucaagagaauguaaauuauugaaaguaaguaauauuagaacuuugaagaaaaaugcuuuuguucuguuaggugacaacaccuaagugggauuggguaugaagugaaguuuuaaucuauaaagucugcuaacugaggggcccugguacuuuccugcuuucguauuauagguguucaaaugcaauuaaggucagaaacauguaguuguguucugaaauaggcaccugagaaauguuacuacagaagcuagaucccuaacuuggcucuugacuuguauaugaguauuuccucaguuuugugcaauauuuggcaacauugguauuauacuuaaaguauauauuuagaaaugggacuucaucuuacagaacuguuuuuuaaaauauuuuuaugcuaccagaaacuccuagaagcucaugaagaacagaacagugaagcuuacacugaagcaguaaguuaugcuuuugggacaugguacauuauuugaagauuuaaguuaaagaaacuucuuuuccuuuucauuaugugaauucuaaacauuuauuugaacaugacuccagcauaccuuaaguuguauuuuccaaacgucaccuuuuauauaucacacaaauuaaacaguuccauuagccaugcugagauucgacuuacacucaaaacuaauuuagcugugagacuaguucaggagcaaauauuccauuuauauucuuauaauuugcuguuuuaauuuuuucuuuugaaaauaaucugacccauaaauaaguauaaaguaaaauuaguuaaggccaggcacggcgucucacaccuguaauccuggcacuuucggaggccgaggcaggcagaucaugagucaggaaauugagaccauccucgccaacauggugaaaccccgucucuacuaaaaauauaaaaauuagccaggcaugcuggcacacgccuguagucccagcuacucgggaggcugaggcaggagaaucgcuugaacccgggaggcagagguugcagugagcugagauugcaccacugcacuccagccuggugacagagcgagacucugucucaaaaaaaaaaagaaaaaaaaaauuaaauauaauuuaaaauauaaaaacuaaguagugagaauuugcuguauuuguggcaugaaauaaauggaagguggccaggcacgguggcucacaccuauaauccuagcacuuugggaggccaaggcggguggaucaccugagaucaggaguuugagaccagcuuggccaacauggcaaaacaccaucuuuacuaaaaauacaaaaauuagccaggcaugguggagugugccuguaauaccagcuacucgggaggcugaggcaggagaaucucuugaacccaggagguggagguugcagugagccaagaucacgccauugcauuccagccugggcaacaagagugaaacuccaucucaaaaauaaauaaauaaauaauaaauauauauauauauuaaaaauaugaggguuuuuuucuuuauacuuuuuguuuuuccaucuuuugccaucucauguuuagaaucaagcaaaaaaaaauguuuuuauauauuuugaaacagauccucacucugucacucaggcuggagugcuguggugugaucacggcucacugcacccucaaccuccuggguucaggugauccucccaccugagacuccuaaguaccugggacuacaggugcacaccaccacccccagcuaauuuuuuuuuuuuuuuuugcauuuuuuguugagacaagguuucaccauguugcccaggcuggucucuuaacuccugggcuuaagcuauccaccugccuuggccucccagacuucaaggauuacaggcaugagccacuacauccagccucaagcaaauuucucaguagccuccuguaacauguucaucacagcucaggagugauagaggaaaggaauguuuuccugucugacuuuugccuaccacaucauuuucauccuauuguaauuuuauuuuuggguaaugcauugaaauguguuaauuccgcuuccauacauauucuaacucuguaauuaauguuuucccauguucagugaguauuaauuuuccauauuccuuucaaauuuuuauacaauauccaguuacuuuugccacaauaauuaugacuguuaaugaauuuuuuucuuacacguuugaaaacagagaaaugucaagcccaggaacuugucacuaguaucaaaauaguaacaggauaaugaaaaaauaaacaauuuuuuaaugaagaaaguuauaaacuggaaugauuaauuucaaaugaugaagaaaguuaguagauuauggcuguaaagguauaaacagcuugggguacuauuauuuuguguuuuuaauguauuuacaugggguaauuccuguuccucuuuccuuauacuaggugaaggaauuugacucaauaucucgcuuggaucaguggcugaccaccauguugcuucgcaucaaaaaguccauccaaggggauggagaaggagauggagaccuaaaaugaaauguuuuugucuuuguggcaugcagcuaacuccucuuuaguuuugucuuagggucaagugaucuuuaugggaugccuauuuaauggcuuaauuuuguugcauaugagccagacggccuguguauuguuuaagcucgccaagucuguguugcugugaaaugaaugaaggagaggcuccuguucaucuugugguaaugauggguuguuucaugcuuaucagaacccccagcguuuucugagaaguacuucagaaucucauuccucauauuucauugguauuuguggagccuauguuuaauguugccacguguuuuuauguccuuuuuguuggacuugaguacucagcccaguuguucucauagaugcuuugcauuuucucugugcuuuggcaucugaauauguucuuuaaauguguguuuaguuuaggacaguuacuaggaaugaguuuauaacuucauuagaaaucauuucuauuuuuguuauccugugauuauuuugauggugcuagugacuaguuucuuugcuuuuuguguuguuccguaugcuaacaugugcauggcaaaaauuuagaauagccagggucuguaggcaucacauugugaggaagggagcuuucuggaaguacuugcuucauguauggaugagugucaaagugaauuugauuuguacuuagacacacgcguuuacacacacacacauaucacaagaucuguuagaaauggaauuuuucucuuuuucuggagauaguuuucacuuuuaguuggaguggaaaucccuuuauauuuacauugaaguauuuuaauuggcauagccugcucauuauuuucauguuuauacacuuucccacguugaggugguguguucugugcugugacuauagaaaucuuggucagggcuggauagauuaucuaagucaagcuugagaaugaauguauguaauuuuccuguuuauuguacaugauggguuagguggggugaaugugguacaggaauguccuguaugcccaagugggcaagaaccccaacuuguuucucaggggacuugauuguucucuuagcugguggaauauguuggcuuauguguuugaacucugucguguuuaauugguuuauauaauauauguaugcuaucuugauucaugaacuugauccuauuaauuuauaugcugauauuguacuuuagacauacgcuugucuccugaauguccucugaauauuuauaguuaaaugauuuauauuugaaauguguugccagacuuaacccagcagacacucugacaucacggagcuucacugaugacagguaacgaaacuuccuauguuaugucagguaguaguaaguaguauuggaaugauguuuucauuuuugguggcucucaacuggaauugguaguguuuccaggccaagggucgacugcagguuguuugagaaaugaugaguaggucagucuaggaagaaagagaaaguagcaggaaaggaagugggaagggccagccaaggacagacuguagaggauccacaucagguggccacgaggacuugcaggcuauaguuaugguggugacaugcaugaggugggcugguagagcaggaagcucugugaugucagagcaucuacugggacuacaggugcacuguaguccccacuacuggggguggcaaugaagacacucugucuguugggcccuagaauuuaauguggauuuccuccuuccuuccaaguucugagauucuuaaaugagagcuggcugucuucuagagguaagaccuggaauggaguccaguugguacuuuuucacucccucuuagaaucucuuaugaaaaaaugaucagagagaaaagugggguuuuguuuccccaccuaauaauauauccuacaaccagccaaaugcacuuuugugaaaauggggugugaggagugguucugcagcuugaguccucugguuuuaaguaguuuguuucuacuuguuuaaagaaucuucuggucugaccacuuaaaguaaaaacuacaugauuuauuuucgggcaauuauguuuagcuuucaucauuauacuccaacagacccgucugaagggguauuuuuuuuuaacaauaauguuuguaacauuuuguugugucaauuagagggucacuuguuuguauugcaauaaacacugggaccaguuccgggguuaagaauuaauuuuuguuuuuaauauuucacaugaaaagaaucaaaguaauuguaauggcuagaagagaccugccagaagauuaaaaaaaagaaugagagaaaagcccaguuaguggugugcaaacuuacuuccuuuaaaugucccauggauguaggacagugccauguuucaagaugccugugagcuaggucuucaagauuuauagaauguuacuuaugaacaaaauauaauuauuuaugguacaauucuuguacuuuagcaaaucuggaguuaguucauagucaaagucaguuaauauuucuuagaggaaaguuuugcuuuuuguggcaacauuuuuauagcuugugugaguucuuuuuuauuuaaugauuugaaagcaguauuuuugcacagucgugaccgugugugguggcgucacuguaaccaaaguauaugcaccagcccuugugcauuuauuguuucuccugauuuuguggauuuaaauguccaaaugcaaaccuuugugacuuccuuuggaggacuuggcagcacagcaugcccccgugaccugccugcugugguaugagcuaugaccaagagcaggcuuccugcuccauggaguccugaguugcucuggggcaggggauuacguuaugaaaacuaaccauguguaacaauaaaucuaccuuagcagaaaaaguaugcuuguuuuauuuuaaccuauaaaguggaaauuaucaguaau

SEQ ID NO: 13443 - RNA, 20167 nt, Homo sapiens
auagcugcugggaacaaagccaugcugaugaaucuggacuugugcaugauuuuuguuugcuucucauuaaccugcccacccuccacuccaaaauuauaccucauuaacguucugauaacagccaggaagacagccucaccugaacccucuuugacugaauggauuuuucauuguuuuucuuaaaugccuacgcuucagaggcuaucaacugcuuaaaugcagccaucgacauuuacacagacaugguaagacauugcauugcuugaguggcugugggguggagucuugagauggcuuagaguucuaucuuucuuuuuuauguucccaaacuggcauucagauagguaaaaucggugugugacuguuucuuguuuuuuccccuagggaagguuuacaauugcagccaagcaccacauuacuauugcagagaucuaugagacugaacuuguagacauugagaagguaagcagugggcacacuuccucagaugugaagcaggcagauaagcugacucaaagaacucuccucuccucagucugagagugaucguagguguagaguggucauagauggccuugccuggagacuuucuggcaaagucuacuagcuggcuaaguagaugggcuguuuuccuggaguggacaucuaagacaugagagcugauuaagauuuacagagaucaccuguuguuuccacucucucugauucaugucagaacauuagcauugccaaaagaaccuucagcuguauugcuuaguacucuaaggcccagugaagaaaguguaagaggucaccucuguacacucagucagcaucacagcuuuaaguaucugugugccagugacucagaaaucugacugcagccuagaccucucuccaaaugcuagauuacuguauccaccugccugcugaccucuccacuuuguccagcagucaucucuaacccaacaugucugggacuggauucucagauguccccaacccaguguuccccgcuaaacuacaggcuuccuugccuuuucucuuucucuacaaccugugagcaauuuuugugagcgguguccuuccugcucccaagucuuggcacaacucacuaccuugucucucagcucacacuugaucgcugcaggauccuucaaaccggucucccugcuuuugcucucccuaccuugccaaccccacauccccaugccacagaguagccagagugagccuucuaagcauugcaucauacucuguuucucuacugcugacagucauuagaccccuuucacuaagaggaacagcuggagcugugcagagccuucauggguccacugaauugcuuccucccagccccacacuccccaugcaucuguguggccuggccucuccucuuuucuguuauucuccuccucuugcauacccugcauggccauccuggccuccuugcuguuccgcacacaugccagaugagcgcuccugccucaggaccuuuguauccacgauuuccucugucugcaaagcucuuccccagauguccacguggcugacuccucacaucuuucaaguccacauggcuaacuuccccgugcccuuccauuuuugcucauuuauuaccuauuuccaugauuaacuauuaugacccccuaguuaauuuagccccccaggaagacauaguagauccccacacaccucacuuaacuucuuguauugcugagcagaugucuccuuacaauaugcccucucauaugcuugcucaucauucucauuuugguugucucucucccuccgccagauugggcacacgugucagcagagagcuuugucucugcuuugcugaugugucccaagagcccagaacucugggaccuaguggggucuaaauauuugcuaaauaaacaaaugcuaccccuaccuccaccauaccaaauggagucuuccuggucuggggaaggaucugcuaggcguuacugaaauuggacuggcauuguuaacguucacucuuuugacugugugaccuccaccuguugguuauucagcacaaaauuugcucauauuuguuacauaaaauuuauuauuugaccuuuuuuuuuuauaauugccauacuuuucugaggauacucccugaucuugaucaagucagggccacccugugcauugacgugugugugagccuucucuuuggaagguuaucuguggauccuggaggcaggugauggagcuggaucugaaccuccuuuguucccugguguggaauugaugauggaaugggagggagauggaucugguguggcugggguauuuauuuggucagggugucugggauggccacaguaucuuuauuuagguuugagugagucuugcggggaugagcacugugcgcagagcaucuuugccagcagaggcuccuguuccagcuuccucuuucacaguggucagaagggcacucuggggcaggagccugcagugcugugucauuucugcugcccaggcauggucuccaacacaugggucuccauaaacuugagagcagauaaaaugaaaugugacauacucuuuuuuucucuugaaaaaaaaaaggccagguacaguggcugaugccuauaauccuaccacuuugggaggccaaggcaggaggaucacuugagcccaggaguucaagaccagccugggcaacaugagaaauccccaucucuacuaaaaauauaaaaaaaaaaacuauccaggaaugguggcgugugccucauucuguuccacaggcuggacagguuggaguggcaugaacacagcucacuguagccucagccuccugggcucaagcgauccucccaccucagccuuccaaguagcugagacuacaggcaugugccaccaugcccggcuaauuuuuuaauuuuucauacaaaugaggucuuuucauguugcccaggcuggucucaaacuccuggacucaagcaguccucccaucuuggccucccaaaugcugagauuacagucauggaccaucaugccugaccuucacggaauacugaauuuuaaaaugcagcuauaaaagaacagguguacuaugguucucuuuuugcaaauacuuagucacacacagaaauagucuggaagaaaauauuucucuggaagaaaauauuucuuuggaacaccugucagagcugucauguacacacaugugagauuaccugaugaagguacaucuccucccucuaaaaugugggcucugugagggcagggcccaugacuguuccgcucaccaucacagcccugagccuagcaugaugccuauuuacaaagugggugcucaguaacagaugcuaagugaaugaagacaaagugcaucacaaaugaaagcugccuauaguuccauggccuguuuuguuuuauuuguuuucuugucccugcaaaucucuucuaacucacuaggagcugccuugaagccacuuaacuaaugggcuugggcagaaaggcagcaccuuuaaucugauuuucagagacugcuagcucccucauuugcauuugcugugaaaccuuugucauucaagcauccugcaaacccaccaccugcuucuguauguuugcaugcuaaaaaugguuuuuacgguuuuuaauccuugagagaaaaaagcauuuugcgacguguaaaaauuauaugaaauuagaaauuucauuguucauaaauauaguuuuauuggaacacaaccacacuuauucauuuauaucuuguguauggcugcuuuuaugcuaccacaagagagcugaguaguugcaacaaagaugcacaaaaccuaaaauauuucuugucugaccuguuagagaaaaacuuuggcuagagcccugguuuaaagagcugcucauacuuaucucuuguuauuugggguauagaagguuuuuucaaucuuaugagagcuuuauuucuaaggcugucuaccaccgucuacaaaccagcugauucuuugcagaguucagcucuuacaaaacugugcuaaaaacagcagcacacacuaucaucugacucuucucagccauuuugcuuaguuuuggacuccgguagacacuuauuuuuuuguuuguuuguuuguuugagacagaguuucacucuugucacccaggcuggagugcaauggcgcgaucucagcucacugcaaccucugccuccccgguucaagcaguucuccugucucagccucccaaguagcugggauuacgggugcccacaccacgcccggcuaauuuuuguaucuuuuuaguagagacaggguuucaccauguuggccaggcuaguccugaacuccucagguauuccacccuccucggccuccaaaagugcugggauuacaggcaugagccaccgcaccuggccgacaccaguucuuuuuucugaguugucacgugcuugauuucacuaacuucuaccacagcaugacaaggacuucuagcuuucuggccugugaucucuguuucuucuccacuugaugccauauauuuuagauugacggcaacacccuuauucuaggugacacuuaagguauuaguguguguagucugugcugcaagucauagacguaagguguaauuagggcuucauagcucucuaacaauccaguguggcugcuaaggguuugacagugguagagacacugggguuggagguaccuuguguccuuuguaauuacuuaggaaccugccugacaguucugccauuuuggugucuagcuuacagugucacucuggacuuggucauagcccuccuagcucaugggaaguggaaggccuggaggaggaugcaaagugagauauauggcccaagccugggaguggcccccaacaugucuguuuacauuccacuggagagaacuagucauaggcugccccucacuauggaggaagcugaggaagugguguagcugggcauaugccauguggggagggggaaacagauuuugauggucagcaagcauucugcuuccagaggugcaugcuuucuuguauuuccuaaagaaaguaggccgaguugugaaaaguuugcugguagaguagguuuauuuauggaaaaauaccuaugcaaauguaguuuuaaaaugcagcucuccaaauaaauugugugugaauaaaauauguauguuuucaggcuauugcacauuaugaacaaucugcugauuauuacaaaggagaagaauccaacaggcaaguauuacuuuucuuaauaugauuuaauggguuuuauuaugugugauaaaaaaauacuucuuuauacuuugugaguguauuugacuauaccaaaugaagauguacugaggcccagugcacaucuuuuauuuuuccauugacuuguuacucacucugcuuugguucuugauuucagcucagcaaacaagugucugcugaagguggcagcauaugcugcccagcuugagcaguaccagaaagccauugagaucuaugagcaggugaggauacuguuguuuccuuggagagaaguugucugaauaauuuuucaaaauuaaacuuuuuauuuuucuguuuauugagauauaauccacacaucacguaaugaguacaguucagcgguuuuuagucuguucacaaaguuguauaacuaucaccacuacuuaauuccagaacauuuuaaucauccccaaaagaagcccagcagucuauucuuuccuccuagucccuggaagacacaaucuacucucugucuauauggauuuuucuauucugaaccuugaauauauaugaaaucacauaccauguggccuuuugugacugccaucuuucacuuaguguauuguuuucaggguucauccaugucauagcaaaugucaguaugucauuguuuuucguggcuaauaccucaugguuuauuuaucaauuuauggauguuugggguuuuuccacuuuggggcuauuaucaauaaugcugcugugaacauuuguguuaaaguuuuuguggugguguuuuuaguucucuuaguuacauaccugggaauagaauugcaguugcuggaccaugugguaaguccauguuuaacuuuuugaggaacugccagacauuuucacaguggcuacaccauuauaccuucccacuagcaaugcacaguguuccaguuucuccacauccucaccaauacuuguuuugguuuuuuuuuuuuuuuuuuuuuaaauaauagucacccuaaugagugugaaauguugucucauucuguuuuugauuguuauuucccuaaugacuagugauguugagcaucuuuuuauuugcuuauuggcuauuuguauaucuuuggagaaaugucuauuccaguacuuucuccggauuuuaauuuggcuguuuguuuuuugguggugaguuuuagguguucuuuauauauucuggauauuaauccccuauuagauaugugauuugcaaguauuuacucucauucuguggguugucucuggacucuguuauuaauguccuuugauucacugaagucuuucauauuuuugaaguccaguuugucuauuuuuucuuugucuggcuuuuguuguuauauagaagaaaucaucgcuaaaucugauaugaggcuuuuccuuucuguuuuguuauaggaauuguauaguuuuggcuguuagguuuaggucuuuuauccauuuugaguuaauuuuuguauauaguaugagguaaggguccaacuuuauucuuuuauauguggauauccaguuuuucuagcacuaauuguugaauagaacuauauuuuaacuauugaaugguauuaagacccuuauugaaaauuauuucaccauaugaaauaugagggcuuacuucugggcucucuauuccauugaucuauuuauccaucuuugugccaguauuacacuguuuauaucuguaacuuugcaguaaguuuugaagucaguaagugugaguccuccagcuuuuuguucuuuuucagaauuguuuuggcuauuccagaucccuugcauuuucauccgaauauuaggaucagcuugucaaucucugcaaaguagccagcuuggauuuugauagggauuguauggaaugugcauaccaauuuggagugguuuuaggguuuucuagagaaacagaaccaauaagagguguagggguguauguguguguguuugugugugugugaguguguauguguguuuagagagagaaauuacuggagggaauugauucgcuugauuauauaggcugagaaggccuaagaucugcauucugaagacccaggagagccaaugguauagcuccaguccaaauccaaaggccucagaaccaggagaguugaugauguaauuucuaaucugaguccaagucugaaucaggagaauaccaguguccuggcucuaagacaggcauugagaaugaauucuuccuuuuaaccuuuuauuuuauucagguuuucaguagauuggaugaggcccacccacauuggggagggcaaucugcuuauucauccuacugaugcaaacguuaaucucauucagaaacaccccacagacacacucagaauaacaccaaauaucugggcacccuguagcccacucaaggugacacauaaaaucagucaucacagagaguauugccaucuuaacaauacuaagucugacagucgaugaauacagguuccuuuuauauuuauuuggaucuucuuucauuuugcucaacaauguuuuguaguuuuugguguguaaguuuuguauuucuugggugaaauauacuccaaaguauuuuauuuuuuuuuugacgcuacuacaaauugaauuauuuucuuaauuuccuuuuaagauuguuaacugcuaguguauagaaauacaguugaauuuugcauaucaauuuuuuguccugcaaccaugccaaacuuauuagcucuaauagguuuuuuuguguggauuucuuagguuuucuauauccaaaaucauguuaucugcaaauaacaauaguuuuacuucuuccucugcaauaugaauguguuuuacuucauuuucucgguugcccuggcuagaaucuccagugcaguguugaauagaagugacaagagcagacauccuugucuuguuccugaucuuguaaggaaaacuuucggucuuucauauuaagugugauagcgguagauaucaguagugggguuuugguaaaugcuuuuaucaguuugaggcaguuccccucucuuccuaguuuguugaguguuuuuaucaucaaaggguauuggauuuugucaggcauuuuccugugucuauugagauaaacauaugauuuuuguccuuuauuugucagacuuuuuucugcaucuauugagauaaacaugguuuuuguccuuugucaaacuuuuuucugcaucuauugagauaagcguaugguuuuuguccuaaucagcuuaauauuguagauuacauugauugauuuucauauguugaaccaaccuuacauuccuggaauaaauucuacuuggucauugcaaacuuugagggguuucccaagaacacccucaaguuuauuaauaauuuguuagacaaacuuacagaacccacugaaagcuguuauacucacaauuaugguuuauuacagcaaacggguacagauuaaacucaaaggagagacucauaggucaaggucuaggagacuuccaggaagagcuuucaguugucggcucucaguggaguuauguaaacagcacuuacuuccccccacaguaauaagugaaaauaagcguagacugcugccaaccaaggaagcuccccugaacgugguguucugaguuuuuauugggguccagugacauagauguugaccacccuuguggcugacuuuacuuuuuguaagugccagaauugguuugcuaacauuuuguugaggauuuuaugucuauguucauaaaggauauugaucguuaguuuucuuguggugucuuugucugguuuuggaaucaagguaauucuggucucagaaugcauuaggaugucuucuuccucuucuguguuuuggaagaguuuguaaaggauuggugugaauuccucuuuaaauguuugguagaauucaauuauuucucuuuuuuuguuuuuauuuucacugauuucuguuuuuauuguuauuuccuccauuuuguuuucuuuggauuuguuuugcucuuuuucugggugcuugacauggaaguuuagcuugcugauuuucaucuuuguuguguaugcauuuuuaguguuaucaguuacccuuucauacauuuggcuacuucccaauuuuauuauaucauuauacuuuuauuuuuauucaguuaguuggauuuauugauuucccuugagacuucagugacccauggauuauuuaguaguguuuuauuuaauuuccaagugucuagcagagauuuuucuguaaucuuucuauuguugacuuauuuuuaauuccuuugugguuagauaacauauuuuugcgugauuucaauucuuauaaauuuguuuuguuuuauggccuagauauggucuaucuuggcauauguuuuaugauuaugcuguuauugggugauguuuauaaauguugauuagcuccuguuggaugauggcauugucgaguucuuuaauauacuugcugaucuuucuuucuuucucuuucucucucucucucucucucuuucucucuuucucucucucucuuucucuucuuucucuucuuucucuucuuucagacagagucuugcucugucacccaggcuggagugcagugacuugaucucagcucacugcaacccuccaccucccagguucaaacuauuuucgugccucagccucccgaguagcugggauuacaggugugugccauguuggcuaggcuggucucgaauuccuggccucaaaugaucugccugccuuguccucccaaagugccaggauuacaggugugagccacugcgauuggccuuugauuuucuuucuaauucuauccauuguugagaguuggguguuaaaaucuccaacuuuaguuguggauuugucugacucuucuuucauugugucagucuuugcgucacauacuuugcagcucuggauugcuauucuugcuggagagacccuuuuaucauuacauaauguccuucucugucucugguaauuuucuuggcucaagucuacuuuauccacuuuauagcccugccugguuucuuuugauuaauguuuauaugauauguuuguccauucuuuuucuuucagccugucuauaucauuauaacugaagugaguuucuuguaguuggaucuuguuuuuuuuuguuuguuuguuuugagacagagucuugcucugucuccuacacuggagcgcaguggagugauuuuggcucacugcaaccucuaccucuuggauucaaguaauucuccugccucagccucccgaguagcugagauuacaggugcgugccagcaugcccggcuaauuuuuguauuuuuaguagagacaggauuucaccauguuggccaggcugguuucauacuccugaccucggugauacacccgccuuggccucccaaagugcugggauugcaggcaugauccaccacagccagccuggauccuguuuuuuaauccacugugccaaucuuuguuuuucaauugguguauuuaggucauucacauuuaaugcaguuauuuauauguuagggcuuaauucugcuuucugccauuuuaguuuuugcuuucuauucuuugcuuuuuguuucucuguuuucuuuuuccaaccuuuuuauggguugcuuuucuuuuuuuucuuucuuucuuuuuuuuugagacugggucucacucugucacccaggcuggagggaaauggugcgacccuggcucacugcagccuccaccucccaaccucaagcaguccucccaccucagccuuagccuccagaauagcugagacuacagacaugcaccaccacaccuggcuauuuuuuguagcgaugggguuuugccauguuguccaggcuggucuugaacuccugagcucaagucuuuuuguagcgaugggguuuugccauguugcccaggcuggucuugagcuccugagcucaagucaucugcccaccucggucccccaaagugccaggauuauaggugugagccaccacacccagccuacuugauuuuccaguguuucuaaguacaguuauuccucagugucuacaggggauuaguuccaggaccucucucauauaucaaaaucugugcauagucaagucccacagucggcccuguggaacucacauauaaaaaagucugccuuucauuuauauggguguugaauuccuaagaauacuguauuuucaauccacauuugguugaaaaaaauccguauauaaguggauucacacaguuuaaaccaguguuguuggagaaucaaugguauauaucuuuguguagcuuuugugguuaaaugcuguagguuggugucaucauuuuauaaguucuggugaaauauagaaaucuuaccucccuuucuguucuuuuacucccccuauucaauauauaguugucuuaauguuuccucugcauacauuuagaaccacaugagucaauguuagaauuuuuguuucagccaucaaacauaauuuagaaaacucaagaaagaaagccuguuauauuuacccauauuuuugcuuaccauguucuuucuucuggauguuccaagauuauuguuuccuuucuauuuagagaaccuccuuuugucauuuuuuuaggguaggucugcugacaacaaauuuucuuaguuuuccccuaucuggaaacguuuugauuuugccuucauuucugaaacauaguuuuccugggaguauaauucuaaguugauuguucuuuuccuuuaguuucaaaaaugugcacuuuauggcuuccaugguuuuacaaacuucugacaucaagugauccacccaccucagccucccaaagugcugggauuacaggcaugagccacaacgccuagucggccuccauuguuuuugauaagaagucugcugucauucaacuuguuuuccccuauaaaaaagguguuauucucuagacacuuucauaauuuuuuucuuuuaguuucaaaaguuuaauuauaauguggcuuggauagauauauuugguuuuaagcuauuugaguuucccuaaacuuacagaaucuguagguuuauguuucuugucaaauuugagaaucauuuagcaguuauuucuucaaguacuuuuucagcuuccuuuuuuuuuuuuuuuuuuuuuuugagaccgagucuugcucugucgcccaggcgugccaguuuaauggcgcaaucuugucucacugcaaccuuugccucccagguucaagcaauucuccugucucagccucccaaguagcugggacuacaggugcuugccaccacaccuggcuaauuuuuguauuuuuaguacagacaagguuucgccauguugaccaggcuggucuugaacucuugaccucaagugguucgccugccuuggccucccacagugcugggauuacaggcgugagccaccaugcccagccagcccuuuucucuuucuccuccccuucuagaacacagaugccacaaaagugagacuguuuuauuaucccauggguccuugaugcucuguuccuuuuugucaguuugucuucucucuguuguuccuguuguugucuuccauuuagugcuucuuuccucugucccuuucauccugcuguugagcccacccacuuuuuauguaugguacuguuuuuuuuuuucaguucugaaauuuuuauuuguuuuuacuuuauaucuuuuuuccuguggcuuccuuuuucuuuguggaugcuuuccauuuuuccauuagcuucagguguuauuguacuugcuuuuuggagcauuuuuaugagggcuucuuuaaaaucuucgugggauauuuuggacauuuccgucaucuggaaccaucaucuguuaauggucuuuuuucauuuagcuugagaucuuccuguguuuuugguauuacaagucauuucugauugaaaacagggcauuugcacauuagguuaugagacugggucuuguuuaaacguucucuuuucaguuggccuucuuugacauuccucuggcuggggaagguggggauguuaccucauuacugccagguggagguagaagugucagcuuuccaccaggucucuguugacaccugaggggccuagucagcccugggcagaaguggcauccccucuccuuaucuguuucugccagcacagugcugguuuguucuugguauggugagagucuucacccuccacuagaccucuucugacagcacaccagcuggagaaagaaggggaaccucuuuccugcuugacagagacaggaugcaggcucccaguguggucugcacugccuuagugucaggggguuggguggggaucaagccucagcucccuauuuggccuucucugaagcuccuaagcagagguauuggggugcuucuuacagucuuucaagaauggacuuuaggacuccuucuucagccuuugaugauguaaauggaguuagggccucaguuuuucugugauauuuggcuggaguagagcaguuauugucuaaguguuuucucucuugcugggcugccccuuuucuaguccuuuggccagagagagcaggcuuuugucucuucucuuuuuaucugugcauacuggcauuucuggguugcugguucuucaguuucaugccauggauauaggaagggaaaagaaaacugagggaacccacuaccacguuuucccuugggaaacguuuguuuuuuagaaaaugaccugggcuuuuaguagugcuuagugggaggauuaggggaaaggauguuuacuccaucuuauuggaagcagaauucuucugagcuauuuuuaacugguuaagacuucauguauuuaauggucuugucuaguaaaauuucuacuauaugguauucggauaaaauaauauauuucauagcuaaacaaacauaagauacauaauuauuuucuaaaggacaacagaugagaaugacuuugccugauauaagaggguaaaucuuuuaaauuuaacucugcguucugugccuagguuggggcaaacacaauggauaauccuuuguugaaauacagugcaaaggauuacuucuucaaagcugcccucugccacuucauaguagacgaguugaaugccaagguaaggaguucuucagcauugauugacugauuucacccauaagaauacguacacauucucucuuguucuugguaucauuucauuuugauguuaguaccaagaauaaacggguacauuaaaaauaaguauuauucugugguaugugucccaguuguaaucuuuuaacagcugucaaagcuguucucaaaaguuaccugauaguuuauagccauaccacccugaacacacccaaucucgucugaucucagaagcuaagcaguguagagccugguacuugaauggggggcacugccugggaauauuuagugcuauaggcuuaaauauauguauauguucacugguagccaccauuuuuuuuucaguaguuuugcuuuaaagaaauuaagggggccaggcgugguggcucacaucuguaaacccagcauuuugggaggccaagugggguggagcaccugaggucaggaguuugagaccagccuggucaaaauggugaaaccccguuucuacuaaaaauauaaaaaaauuagcugggugugguggcgggugccuguaaguccagcuacuugagaggcugaggcaggagaaucacuugaaccugugaggcagagguugcagugagcugagaucgcaccacugcacuccagccugggugacagaguaagaguccgucucaaaaaaaaaaaagaaagaaauuaaggaacuaagggaggagacaauaagaguaggauaauauccauuuaaaaaacaaccaaaacaacaggcaagcucagaaaugguguuggagugaggacugggaagaaguugaaaagcacagugagcacugggagccaagaggcaaaaagacaggcagccuuggcauggccagugucuggaguuggaagagcagaacuaaagccaguaagagaaacuguucuuucugucagcuucgagcaggaagcuaaauguaauuuauuuggaaucuggacuguauuaagaacgucuccauuuaauggauggauacagauaccuggucugugaguguuuaagaauucauuuucauuuacaaugucuucucagcagcagccuaacucagaaaaaaguaguuuagaaauuauucuuuauugaaauggaaaauucagaauagaaagauuuucuauguugauucugcuuuugaguuuaacuacauacuuuuucaacacuuaauaggauauagguagaucuuauuugaagcugauagaauguugaaagcuuuguuuguuuaguaagucugaaauugaugagugguuuuucucucucagcuugcucuugagaaauaugaggaaauguuuccagcauuuacugauucaagagaauguaaauuauugaaaguaaguaauauuagaacuuugaagaaaaaugcuuuuguucuguuaggugacaacaccuaagugggauuggguaugaagugaaguuuuaaucuauaaagucugcuaacugaggggcccugguacuuuccugcuuucguauuauagguguucaaaugcaauuaaggucagaaacauguaguuguguucugaaauaggcaccugagaaauguuacuacagaagcuagaucccuaacuuggcucuugacuuguauaugaguauuuccucaguuuugugcaauauuuggcaacauugguauuauacuuaaaguauauauuuagaaaugggacuucaucuuacagaacuguuuuuuaaaauauuuuuaugcuaccagaaacuccuagaagcucaugaagaacagaacagugaagcuuacacugaagcaguaaguuaugcuuuugggacaugguacauuauuugaagauuuaaguuaaagaaacuucuuuuccuuuucauuaugugaauucuaaacauuuauuugaacaugacuccagcauaccuuaaguuguauuuuccaaacgucaccuuuuauauaucacacaaauuaaacaguuccauuagccaugcugagauucgacuuacacucaaaacuaauuuagcugugagacuaguucaggagcaaauauuccauuuauauucuuauaauuugcuguuuuaauuuuuucuuuugaaaauaaucugacccauaaauaaguauaaaguaaaauuaguuaaggccaggcacggcgucucacaccuguaauccuggcacuuucggaggccgaggcaggcagaucaugagucaggaaauugagaccauccucgccaacauggugaaaccccgucucuacuaaaaauauaaaaauuagccaggcaugcuggcacacgccuguagucccagcuacucgggaggcugaggcaggagaaucgcuugaacccgggaggcagagguugcagugagcugagauugcaccacugcacuccagccuggugacagagcgagacucugucucaaaaaaaaaaagaaaaaaaaaauuaaauauaauuuaaaauauaaaaacuaaguagugagaauuugcuguauuuguggcaugaaauaaauggaagguggccaggcacgguggcucacaccuauaauccuagcacuuugggaggccaaggcggguggaucaccugagaucaggaguuugagaccagcuuggccaacauggcaaaacaccaucuuuacuaaaaauacaaaaauuagccaggcaugguggagugugccuguaauaccagcuacucgggaggcugaggcaggagaaucucuugaacccaggagguggagguugcagugagccaagaucacgccauugcauuccagccugggcaacaagagugaaacuccaucucaaaaauaaauaaauaaauaauaaauauauauauauauuaaaaauaugaggguuuuuuucuuuauacuuuuuguuuuuccaucuuuugccaucucauguuuagaaucaagcaaaaaaaaauguuuuuauauauuuugaaacagauccucacucugucacucaggcuggagugcuguggugugaucacggcucacugcacccucaaccuccuggguucaggugauccucccaccugagacuccuaaguaccugggacuacaggugcacaccaccacccccagcuaauuuuuuuuuuuuuuuuugcauuuuuuguugagacaagguuucaccauguugcccaggcuggucucuuaacuccugggcuuaagcuauccaccugccuuggccucccagacuucaaggauuacaggcaugagccacuacauccagccucaagcaaauuucucaguagccuccuguaacauguucaucacagcucaggagugauagaggaaaggaauguuuuccugucugacuuuugccuaccacaucauuuucauccuauuguaauuuuauuuuuggguaaugcauugaaauguguuaauuccgcuuccauacauauucuaacucuguaauuaauguuuucccauguucagugaguauuaauuuuccauauuccuuucaaauuuuuauacaauauccaguuacuuuugccacaauaauuaugacuguuaaugaauuuuuuucuuacacguuugaaaacagagaaaugucaagcccaggaacuugucacuaguaucaaaauaguaacaggauaaugaaaaaauaaacaauuuuuuaaugaagaaaguuauaaacuggaaugauuaauuucaaaugaugaagaaaguuaguagauuauggcuguaaagguauaaacagcuugggguacuauuauuuuguguuuuuaauguauuuacaugggguaauuccuguuccucuuuccuuauacuaggugaaggaauuugacucaauaucucgcuuggaucaguggcugaccaccauguugcuucgcaucaaaaaguccauccaaggggauggagaaggagauggagaccuaaaaugaaauguuuuugucuuuguggcaugcagcuaacuccucuuuaguuuugucuuagggucaagugaucuuuaugggaugccuauuuaauggcuuaauuuuguugcauaugagccagacggccuguguauuguuuaagcucgccaagucuguguugcugugaaaugaaugaaggagaggcuccuguucaucuugugguaaugauggguuguuucaugcuuaucagaacccccagcguuuucugagaaguacuucagaaucucauuccucauauuucauugguauuuguggagccuauguuuaauguugccacguguuuuuauguccuuuuuguuggacuugaguacucagcccaguuguucucauagaugcuuugcauuuucucugugcuuuggcaucugaauauguucuuuaaauguguguuuaguuuaggacaguuacuaggaaugaguuuauaacuucauuagaaaucauuucuauuuuuguuauccugugauuauuuugauggugcuagugacuaguuucuuugcuuuuuguguuguuccguaugcuaacaugugcauggcaaaaauuuagaauagccagggucuguaggcaucacauugugaggaagggagcuuucuggaaguacuugcuucauguauggaugagugucaaagugaauuugauuuguacuuagacacacgcguuuacacacacacacauaucacaagaucuguuagaaauggaauuuuucucuuuuucuggagauaguuuucacuuuuaguuggaguggaaaucccuuuauauuuacauugaaguauuuuaauuggcauagccugcucauuauuuucauguuuauacacuuucccacguugaggugguguguucugugcugugacuauagaaaucuuggucagggcuggauagauuaucuaagucaagcuugagaaugaauguauguaauuuuccuguuuauuguacaugauggguuagguggggugaaugugguacaggaauguccuguaugcccaagugggcaagaaccccaacuuguuucucaggggacuugauuguucucuuagcugguggaauauguuggcuuauguguuugaacucugucguguuuaauugguuuauauaauauauguaugcuaucuugauucaugaacuugauccuauuaauuuauaugcugauauuguacuuuagacauacgcuugucuccugaauguccucugaauauuuauaguuaaaugauuuauauuugaaauguguugccagacuuaacccagcagacacucugacaucacggagcuucacugaugacagguaacgaaacuuccuauguuaugucagguaguaguaaguaguauuggaaugauguuuucauuuuugguggcucucaacuggaauugguaguguuuccaggccaagggucgacugcagguuguuugagaaaugaugaguaggucagucuaggaagaaagagaaaguagcaggaaaggaagugggaagggccagccaaggacagacuguagaggauccacaucagguggccacgaggacuugcaggcuauaguuaugguggugacaugcaugaggugggcugguagagcaggaagcucugugaugucagagcaucuacugggacuacaggugcacuguaguccccacuacuggggguggcaaugaagacacucugucuguugggcccuagaauuuaauguggauuuccuccuuccuuccaaguucugagauucuuaaaugagagcuggcugucuucuagagguaagaccuggaauggaguccaguugguacuuuuucacucccucuuagaaucucuuaugaaaaaaugaucagagagaaaagugggguuuuguuuccccaccuaauaauauauccuacaaccagccaaaugcacuuuugugaaaauggggugugaggagugguucugcagcuugaguccucugguuuuaaguaguuuguuucuacuuguuuaaagaaucuucuggucugaccacuuaaaguaaaaacuacaugauuuauuuucgggcaauuauguuuagcuuucaucauuauacuccaacagacccgucugaagggguauuuuuuuuuaacaauaauguuuguaacauuuuguugugucaauuagagggucacuuguuuguauugcaauaaacacugg

SEQ ID NO: 13444 - RNA, 4481 nt, Homo sapiens
gcaagaaggaaggagggagggcagagccccuugcugagcaacaaaggccgccugcugccuucucugucugucuccuggugcaggcacauggggagaccuuccccaaggcaggggccaccaguccaggggugggaauacagggggugggaggugugcauaagaggugauaggcacaggccagcccgguacagaccccuaggcguccugacagguggauuucgacaaggucauugugcccugccaaggcacagcguagaucuggaaagagcagaaugcuuucugugaaaggaaacagaggggacaaucaguguggguuacaguucaaagcagaagaugcccaggcacgggacaucagagugggagugaagaaggauggaggugaaacacugggcccuuaucuaccccuccacccacccccgcugaucccagagcaccgcuggacugggcagugacugcuccaucccucucccagggcuccaacucuaccugguggcacugggcccccaccccagccugcaggauuccugccccagcacagcccugugaggagcagccugugcaaggccucgggagcccuaaggguacagggcagggggaggcagcucacugcccccagcuccuuccaccuccagcccucaggccagcacuaugaagggcgagagggaagaacccagggaacuggaaauuccaagucauagcacaugggguggugaggagaugacaaggagaguguggcucuccccugagcagagacgucacaagaaauccuggguccuuggagaagcugguguugggugagcuggggcaggucugaggguuuggcugcuaacaggccucuacuacccucuaaucugcucagcauggccguggcugugggcaggugccuaaggcugggauuagacagagcccuuucucccugcccagcacccagcccugcagcugcuuccugcaguccaguaggcaacacuccaaagcacauaggguggagcucccaguaccccaaucccaagcuaaagcccucuuagcaaaucaaauucaucacuccucuccacaccaccccgucuacaugcacacacauaggcaucuacaugaacucacccuaaccuucacccauacggaucuaugcaugaauccacauacucccucauacaucuaucuacccacaugcacacacacacacagggcagguaauuccucauaauacagcauguauguucacagaaacccccauguaugugaauguaugugcacagacacccccacacauaugugcacacacauauacucacacacccacaccuauccaugcauaaacccccacacuuccccaacacauccacacacccacuugcacacacucacgugcacuuccccacacaaaccuauacuuggaaacacauaugcaucuccacguguacacacacucaggcacaugcacacguacccugcagaacaugugcaucacacacacacacacacacacacaccccucugcaguguaugacuggcccuggacccauauaaggcacauacccuuuucagauguggcuggucauggaaggggcaguuguccaaguugggcugggucuugguacacgugguucggcccagcuccacguccaagaaguaguucaccccagcuacgaucuacacaugugaaagagcaggaggcagggacagcacguucugucaguuucuuacacacacaggcacuucacugugaccgggucacugggcuugccuggggcuucaagccuaccuucaugagcugcccacauugucaccugcaaggcacacaagccaccuccuccugccagcuggcagggaugccaugccccaggccuccccgguaacuuguuucucuaugccaaugccaaggauuaacugaauuccgcuaccuaugacccagggggcagggacacuggaucuauucuaggaagguucucaugugaugaugaaauuucggcaaacuuccaguuccuggcauucaguccacagagcaucucauuccugccauuuaacccagagguauuuuuccucauuucucacuaggagaugagaugcucacauacauugauguuuuaggccaauaaacauugcuucccacgugcuuccauuccaggugugauuuucaaggcaauauuucuaaagugagucacacaccugcaugucuuaggguugcaacuucagaagagaacugaaugcuuucccugcacagugccgccccaaaacaugacuugucagaacuguggagaagcaugggaugagggacccugggaccagggugcuagaccuugcccuguggaaccacacacaaguccuguagaagcacaagcaaggccugugaucccucuggugucagucugcuccucuguaaaauaggcuccagggcccaacgaucuacaaugccccaugcuucacucccagugagagagaggugcaggccagcggggacccuacaccagggaauggcccuccugugcagggagagggccccagcugacggcugcgggagaaacgcggcuggucuggacuccucugaauuuccaagagaagguggaggagcucuaaagucugugucacuguucgcugcucugccaugggaugcaggucaagcugggccugguagcccuacugaagcucccucccgauccgacccccuacuccggucugcugggugucuucaucuggcugaggucuaacucugcaucagcugauagaggcagggucaggcaugcuccaccccagcagggacucagcugcccugggauguaggggguggucagccggccugagggugaaggccgcuaguccuaggggacugugcccaggggugugacuuggggagggaagcagggcucugcaggacaaggugccaggcucacguguggccccugcggagaguauucugggaggaggaugagccgcauggccuagaucucaucuugagcagcaucaagcccacccagagucagcauagucuccauccacaccugcuagacccugggaaauggcacggucguggcacagacccagcugcugcugcagguuaaaagaggccgaggggacaggacagggcugaacucaugcacucauggcccaggagcguccuagggcacgaaggccgucaacagacagggaaagcugaaugagucugagcauuagaucaugaaugugucagugcugauuuucaaaauggaauagugauuaugugcgauauugcccuuguuuuuaggaaaaacacacugaaguguuuacuuucaaaagauucaggcaaaaaaugcauauacaguacauauacacacacccauauucacauucggaaagugagcuggggggaacaaacagggcaaaauguuaacaucugugcuaacaucugagggaucugggugaaagaucuacagggaugcccugugcuauuuugcagcugcucuguaagucugaaauuacgggagaauaaaaaguuaaaagaaacaaaagugcuuaaaaauuauuugguggaagaacaaggaggcagccagaugaggggcucuguuuuuccuucuccugcguauucagcagcgcacccggagcccagcgucccaggaggucgggacagagcugugugggacguccugugccugcccccgcgcugcggcgcagcucgagcuggcuccuggaagcugaucuuaggcgccgggcgcggaccugacguguccgugcgguuccaggccaggccagacucagggcauucccggacacgcccgccaagggcucgggggugacagcgaagaccgggaacaggguccgggugagaagcccaggcgccggagaggagcagcacgggguccgggagcagcgcggggggaggcugggacggcggggccggggcuucggacccugcggggggcggcacgcaccugcuugcgggcgcgcaccaccugcagcgcgcggcugugguacaugucguugcuggcuuuguuguacucgccgacggcaaaguccagugcacgccgcacacccuccuccuccacgcuggcguccauggggccucccacuaggcgcggcggcuugccgggacuggagccggccgcggggcucacggccagggccacggccaggauggccagcaggagcagcggggcgcgcaggggcccggccauggucggcuaggacgcgggacgcggggaguggggcgcaggcgagaggcuggagcuagauagagaggacccgcugcgauaccgaggcgaggccgugagccccgcgaggccggcgacugcgguuuuaucccuuccggccuucgccgccccaccccaccgcggccugcacucccuuuuccggaacgccucgucccucccaccucccuucucccuccccgccuccccugccucuccccgccuccccugccucuccccgccuccaggucccucccuaucagucuccucccaucccagccuccccugccccuccaggcuucccuguccuuccccauccauccccuu

SEQ ID NO: 13445 - RNA, 4481 nt, Homo sapiens
aaggggauggauggggaaggacagggaagccuggaggggcaggggaggcugggaugggaggagacugauagggagggaccuggaggcggggagaggcaggggaggcggggagaggcaggggaggcggggagggagaagggaggugggagggacgaggcguuccggaaaagggagugcaggccgcggugggguggggcggcgaaggccggaagggauaaaaccgcagucgccggccucgcggggcucacggccucgccucgguaucgcagcggguccucucuaucuagcuccagccucucgccugcgccccacuccccgcgucccgcguccuagccgaccauggccgggccccugcgcgccccgcugcuccugcuggccauccuggccguggcccuggccgugagccccgcggccggcuccagucccggcaagccgccgcgccuagugggaggccccauggacgccagcguggaggaggagggugugcggcgugcacuggacuuugccgucggcgaguacaacaaagccagcaacgacauguaccacagccgcgcgcugcagguggugcgcgcccgcaagcaggugcgugccgccccccgcaggguccgaagccccggccccgccgucccagccuccccccgcgcugcucccggaccccgugcugcuccucuccggcgccugggcuucucacccggacccuguucccggucuucgcugucacccccgagcccuuggcgggcguguccgggaaugcccugagucuggccuggccuggaaccgcacggacacgucagguccgcgcccggcgccuaagaucagcuuccaggagccagcucgagcugcgccgcagcgcgggggcaggcacaggacgucccacacagcucugucccgaccuccugggacgcugggcuccgggugcgcugcugaauacgcaggagaaggaaaaacagagccccucaucuggcugccuccuuguucuuccaccaaauaauuuuuaagcacuuuuguuucuuuuaacuuuuuauucucccguaauuucagacuuacagagcagcugcaaaauagcacagggcaucccuguagaucuuucacccagaucccucagauguuagcacagauguuaacauuuugcccuguuuguuccccccagcucacuuuccgaaugugaauauggguguguguauauguacuguauaugcauuuuuugccugaaucuuuugaaaguaaacacuucaguguguuuuuccuaaaaacaagggcaauaucgcacauaaucacuauuccauuuugaaaaucagcacugacacauucaugaucuaaugcucagacucauucagcuuucccugucuguugacggccuucgugcccuaggacgcuccugggccaugagugcaugaguucagcccuguccuguccccucggccucuuuuaaccugcagcagcagcugggucugugccacgaccgugccauuucccagggucuagcagguguggauggagacuaugcugacucugggugggcuugaugcugcucaagaugagaucuaggccaugcggcucauccuccucccagaauacucuccgcaggggccacacgugagccuggcaccuuguccugcagagcccugcuucccuccccaagucacaccccugggcacaguccccuaggacuagcggccuucacccucaggccggcugaccacccccuacaucccagggcagcugagucccugcugggguggagcaugccugacccugccucuaucagcugaugcagaguuagaccucagccagaugaagacacccagcagaccggaguagggggucggaucgggagggagcuucaguagggcuaccaggcccagcuugaccugcaucccauggcagagcagcgaacagugacacagacuuuagagcuccuccaccuucucuuggaaauucagaggaguccagaccagccgcguuucucccgcagccgucagcuggggcccucucccugcacaggagggccauucccugguguaggguccccgcuggccugcaccucucucucacugggagugaagcauggggcauuguagaucguugggcccuggagccuauuuuacagaggagcagacugacaccagagggaucacaggccuugcuugugcuucuacaggacuugugugugguuccacagggcaaggucuagcacccuggucccagggucccucaucccaugcuucuccacaguucugacaagucauguuuuggggcggcacugugcagggaaagcauucaguucucuucugaaguugcaacccuaagacaugcaggugugugacucacuuuagaaauauugccuugaaaaucacaccuggaauggaagcacgugggaagcaauguuuauuggccuaaaacaucaauguaugugagcaucucaucuccuagugagaaaugaggaaaaauaccucuggguuaaauggcaggaaugagaugcucuguggacugaaugccaggaacuggaaguuugccgaaauuucaucaucacaugagaaccuuccuagaauagauccagugucccugcccccugggucauagguagcggaauucaguuaauccuuggcauuggcauagagaaacaaguuaccggggaggccuggggcauggcaucccugccagcuggcaggaggagguggcuugugugccuugcaggugacaaugugggcagcucaugaagguaggcuugaagccccaggcaagcccagugacccggucacagugaagugccuguguguguaagaaacugacagaacgugcugucccugccuccugcucuuucacauguguagaucguagcuggggugaacuacuucuuggacguggagcugggccgaaccacguguaccaagacccagcccaacuuggacaacugccccuuccaugaccagccacaucugaaaaggguaugugccuuauauggguccagggccagucauacacugcagaggggugugugugugugugugugugugugaugcacauguucugcaggguacgugugcaugugccugaguguguguacacguggagaugcauauguguuuccaaguauagguuuguguggggaagugcacgugagugugugcaaguggguguguggauguguuggggaaguguggggguuuaugcauggauaggugugggugugugaguauaugugugugcacauaugugugggggugucugugcacauacauucacauacauggggguuucugugaacauacaugcuguauuaugaggaauuaccugcccugugugugugugugcauguggguagauagauguaugagggaguauguggauucaugcauagauccguaugggugaagguuagggugaguucauguagaugccuaugugugugcauguagacggggugguguggagaggagugaugaauuugauuugcuaagagggcuuuagcuugggauugggguacugggagcuccacccuaugugcuuuggaguguugccuacuggacugcaggaagcagcugcagggcugggugcugggcagggagaaagggcucugucuaaucccagccuuaggcaccugcccacagccacggccaugcugagcagauuagaggguaguagaggccuguuagcagccaaacccucagaccugccccagcucacccaacaccagcuucuccaaggacccaggauuucuugugacgucucugcucaggggagagccacacucuccuugucaucuccucaccaccccaugugcuaugacuuggaauuuccaguucccuggguucuucccucucgcccuucauagugcuggccugagggcuggagguggaaggagcugggggcagugagcugccucccccugcccuguacccuuagggcucccgaggccuugcacaggcugcuccucacagggcugugcuggggcaggaauccugcaggcuggggugggggcccagugccaccagguagaguuggagcccugggagagggauggagcagucacugcccaguccagcggugcucugggaucagcggggguggguggagggguagauaagggcccaguguuucaccuccauccuucuucacucccacucugaugucccgugccugggcaucuucugcuuugaacuguaacccacacugauuguccccucuguuuccuuucacagaaagcauucugcucuuuccagaucuacgcugugccuuggcagggcacaaugaccuugucgaaauccaccugucaggacgccuaggggucuguaccgggcuggccugugccuaucaccucuuaugcacaccucccacccccuguauucccaccccuggacugguggccccugccuuggggaaggucuccccaugugccugcaccaggagacagacagagaaggcagcaggcggccuuuguugcucagcaaggggcucugcccucccuccuuccuucuugc

SEQ ID NO: 13446 - RNA, 1644 nt, Homo sapiens
gcaagaaggaaggagggagggcagagccccuugcugagcaacaaaggccgccugcugccuucucugucugucuccuggugcaggcacauggggagaccuuccccaaggcaggggccaccaguccaggggugggaauacagggggugggaggugugcauaagaggugauaggcacaggccagcccgguacagaccccuaggcguccugacagguggauuucgacaaggucauugugcccugccaaggcacagcguagaucuggaaagagcagaaugcuuucugugaaaggaaacagaggggacaaucaguguggguuacaguucaaagcagaagaugcccaggcacgggacaucagagugggagugaagaaggauggaggugaaacacugggcccuuaucuaccccuccacccacccccgcugaucccagagcaccgcuggacugggcagugacugcuccaucccucucccagggcuccaacucuaccugguggcacugggcccccaccccagccugcaggauuccugccccagcacagcccugugaggagcagccugugcaaggccucgggagcccuaaggguacagggcagggggaggcagcucacugcccccagcuccuuccaccuccagcccucaggccagcacuaugaagggcgagagggaagaacccagggaacuggaaauuccaagucauagcacaugggguggugaggagaugacaaggagaguguggcucuccccugagcagagacgucacaagaaauccuggguccuuggagaagcugguguugggugagcuggggcaggucugaggguuuggcugcuaacaggccucuacuacccucuaaucugcucagcauggccguggcugugggcaggugccuaaggcugggauuagacagagcccuuucucccugcccagcacccagcccugcagcugcuuccugcaguccaguaggcaacacuccaaagcacauaggguggagcucccaguaccccaaucccaagcuaaagcccucuuagcaaaucaaauucaucacuccucuccacaccaccccgucuacaugcacacacauaggcaucuacaugaacucacccuaaccuucacccauacggaucuaugcaugaauccacauacucccucauacaucuaucuacccacaugcacacacacacacagggcagguaauuccucauaauacagcauguauguucacagaaacccccauguaugugaauguaugugcacagacacccccacacauaugugcacacacauauacucacacacccacaccuauccaugcauaaacccccacacuuccccaacacauccacacacccacuugcacacacucacgugcacuuccccacacaaaccuauacuuggaaacacauaugcaucuccacguguacacacacucaggcacaugcacacguacccugcagaacaugugcaucacacacacacacacacacacacaccccucugcaguguaugacuggcccuggacccauauaaggcacauacccuuuucagauguggcuggucauggaaggggcaguuguccaaguugggcugggucuugguacacgugguucggcccagcuccacguccaagaaguaguucaccccagcuac

SEQ ID NO: 13447 - RNA, 1644 nt, Homo sapiens
guagcuggggugaacuacuucuuggacguggagcugggccgaaccacguguaccaagacccagcccaacuuggacaacugccccuuccaugaccagccacaucugaaaaggguaugugccuuauauggguccagggccagucauacacugcagaggggugugugugugugugugugugugugaugcacauguucugcaggguacgugugcaugugccugaguguguguacacguggagaugcauauguguuuccaaguauagguuuguguggggaagugcacgugagugugugcaaguggguguguggauguguuggggaaguguggggguuuaugcauggauaggugugggugugugaguauaugugugugcacauaugugugggggugucugugcacauacauucacauacauggggguuucugugaacauacaugcuguauuaugaggaauuaccugcccugugugugugugugcauguggguagauagauguaugagggaguauguggauucaugcauagauccguaugggugaagguuagggugaguucauguagaugccuaugugugugcauguagacggggugguguggagaggagugaugaauuugauuugcuaagagggcuuuagcuugggauugggguacugggagcuccacccuaugugcuuuggaguguugccuacuggacugcaggaagcagcugcagggcugggugcugggcagggagaaagggcucugucuaaucccagccuuaggcaccugcccacagccacggccaugcugagcagauuagaggguaguagaggccuguuagcagccaaacccucagaccugccccagcucacccaacaccagcuucuccaaggacccaggauuucuugugacgucucugcucaggggagagccacacucuccuugucaucuccucaccaccccaugugcuaugacuuggaauuuccaguucccuggguucuucccucucgcccuucauagugcuggccugagggcuggagguggaaggagcugggggcagugagcugccucccccugcccuguacccuuagggcucccgaggccuugcacaggcugcuccucacagggcugugcuggggcaggaauccugcaggcuggggugggggcccagugccaccagguagaguuggagcccugggagagggauggagcagucacugcccaguccagcggugcucugggaucagcggggguggguggagggguagauaagggcccaguguuucaccuccauccuucuucacucccacucugaugucccgugccugggcaucuucugcuuugaacuguaacccacacugauuguccccucuguuuccuuucacagaaagcauucugcucuuuccagaucuacgcugugccuuggcagggcacaaugaccuugucgaaauccaccugucaggacgccuaggggucuguaccgggcuggccugugccuaucaccucuuaugcacaccucccacccccuguauucccaccccuggacugguggccccugccuuggggaaggucuccccaugugccugcaccaggagacagacagagaaggcagcaggcggccuuuguugcucagcaaggggcucugcccucccuccuuccuucuugc

SEQ ID NO: 13448 - RNA, 15801 nt, Homo sapiens
aaaacauggcugcggccgguuuggcccuucuuuguaggagaguuucauccgcccugaaaucuucccgaucguuaauaacuccucaggucccugccugcacaggguaagugauguauaaaguagguuugcccaccucuccaacuuuggaucuuguuugguugccgagaugccgagaugccgagaacaacucaagaauggaacggccgccuggauggcagagccggagcccacuuuggugaggagugagugaccuuggagaagucgcucaccuccgacauuucuauuccuuccucauuuuguugcugccugcuguggacaagacaguauaugggguuuguagauguccagcauuuguugaaguaaauacaucuauaaguacagaagcauccucuugggcugggugaggugcgaaaaacuuuaccgaagauguuuuuguugugauacucaagucugugucaaguuuggauggauuaaaaaagaagagauauuuguauuuacaggauguguuacaaugaaaguaacugguaacuuaguaacuucuuuuauuuauuuauuuuucuugguccuggauccagugaaguauccauuuauuacauugguugccaugacucuuuagucucuauccggaacaauuucuuuuuuuuuuuuuucuuaauguuguugacauuuugaugagauuagcuuuuuaagaaucuuauucauuuggauuugucugauuguuuccucauuauaagauuuaggcuaaauauuuuugguagggauacaacacuugugauaaacuucauuauuuaguuucaaaucaucucaggucguuaacuauuuuuuaaaaacaggauuuuugaauuacugcauaauaauuuaucauccagaugcacaguaauuuuuaaaccauucuuagcugcguauuuacauaauuaaaaacuugacauccuauauagugcuuuaauaaacaucuuaauuuauaaauucccaucuauaauaauuuuuucaguugaaacuucuagaugcagaauuacugaauuaaaggaggaaguauuugaggcuccugauacauguugcaaaauugugagguuuuuuuguuuuuguuuuuugagacagggacugacucugucgcccaggcuggagugcaauggugugaucucagcucacugaaaccucugccucccaggcucaaagcguccucccaccucagccucccgaguaguugggacuauaaggcacgugcuacuaugccuggcuaauuuuuguauuuuuguuaaagaugagguuuugccaucuugcccaggcuggucuugagcuccugggcucaaagugauccucccaccucggccuuccaaauuucugggauaacaggugugagccaccgugcccagcccacauguugcaaaauugacugcucuuuuuaccugcgcuugcacccauuagcaauguaagaaggacccaaaaauguuaccuuaaaauauaauuguguaacuauguuaccucugaaauuauaagguagcagcuucuauaaugcaguauuaacaauacuuucuaaagcauuuucaaaauuuauuguggccaagcaugguggcucaucccuguaauuccagcacuuugggaggccaaggugggaggaucacuugagcccaggaguucgagaccagccuggacaacauagugagacccagucucuaaauaagaaaaaaaaauuaauucuugugcagaaacccugaguagcuuuuuaaaauguuaucgaugacaaaaugauuauguuuauuaugauaauguuuauugcuuauaaaauccagauauuauaaaacuuuuacuuguuuauguguguucaauugcagguuuuuucuuaguuuguugccuaagaguacaccaaaugugacauccuuucaccaauauagauuacuucauaccacauugucaaggaaaggacuagaagaauuuuuugaugacccaaaaaacugggggcaagaaaaaguaaaaucuggugagauacuuggauuugucaacauuagauauauuuauggaacccccccccccgccccgcccaaccaucguucuaggauuauauauccaguuuaggaauuauuuagauguuuccuuuuucaguuuucuuugagacugucuacuagagaaaauuaaagggacaauauaauaguagaguuaauuguuccuuggcagauuggcaagaugguuagauaaggaauaggcugaaauuauuaacuaaaguaagguuuagggcuuauuuuagauuuuauuuuuuaaugauaauuuaaaguuuguuuauuuauuuagagauggaguuuugcucuuguugcccagacuggggugcaguggcacaaucucagcucaccgcagccucugccucucggauuccagugauucuccugccucagccuccugaguagcugggauuacaggcacgugccaccacgcccggcuaauuuuguauuuuaaguagagacaggauuucgccaucuugguuaggcuggucuugaacucccaaacucaggugaugcccgccgucuuggccucccaaagcguugggaauacaggugugaaccaccgccccaguuaauuuauaaugacaaaguauuuugucauuagggugugaaaauacguucuguacuaaugcuaacauuuuuugaaugcuauugccagucauguuaauaguauuuucguauguuaccuaauuuaucucuaauuacacauuguuauauacuauaaaaaagcuguuauauauuuuacagauaaagaaacagguuuagacagguuuagagagcuuaaauaauuugccaaagggcacauggcuagaaauguuauuucauguuauguauuauuuuaauaggagcagcauggaccugucagcaacuaaggaacaaaaguaaugaagauuuacacaaacuuugguaaguauacuaaguacauuaacaucuagacguuugaagccguuauaguguaacaaugaggugaaaacaaucuaucugauauaagaaauugaguaaagcgauuucuuuuguaguacuauggaugauaaaucugauguuuaagaucaugaaagauuuuauaugacagagguuagauuaugacaaaugucacaauucucaaguaguugggaauucagaaauuuuacuguaauuuacauugguccuacuaacauguuuauacuagcaauuucaguuaauuaauaaaaugaaacagagaauaguugguggcuuuuguuuuuuucuuugagacaaggucucgcucuguugcccaggcuggagugcagugguacaguaacggcuuacugcagccuugaccuccugggcucaagugaucccccaccucagccuccugaguaucugggaccacagguaugcaccaccacacccagcuaauuuuuuugcguuuuauggagagggagucucccuauguuacccaggcugcucucacuggggcucaagugauccuccuaccucagccucccaacauccugggauuacaggcaugagccacugugcccagccauugguuauauuuaaaauucucuccuuuuuauuacauuuucaugaucuguaaucuuuaguguauuugcuuuggaaagguguguuggaggaugcauuuaauugagaauuuagguagauuuuucuggcaggcucugaugaauuaggguugagaggauuuaagacaggguugcauuuuuaauguacuauauguagcccaaagauauguuuuguuuggacuguaauuguuuuuuaaauugggaaguuucacacagaaaauauuauuuuugucggcucuugaauaaugagaccugugauuuggcaacaccggcccugcauuccuacauggcaacaacuuggcugguguguggagcaacugccccuucuagauggagcagggacacaccacuucucggccacccugugguucuuucacuaugucuacuuccuucauaauuguuaucugccuagggacucuaguagacauuugcuuuuuuuuauuuuaucuuuuugagacacagucucacucugucacccaggcugcaauucaguggcgugaucuuggcucacugcaaccuccaccucccagguucaagcaauucucaugccucagccucucaaguagcugggauuauaggcucaugcugccaugcccagcuaaauuuuuguauuuuuaguagagaugggguuucaccacauuggccaggcuagucuugaauuccugaccucaagugauccgccugccuuggccucgcaaagugcugggauuauaggcaugagccaccgugcccagccaacauuuauguuuguugauguaaagcauuguuuaucuuucaugacaaauuaaagaauugugaaguguuuaugaaaaccacugauacuauguuuauucauuauagaaaaauaaguuguauuaaagcacuauuaguuacuguggguuaucagugaaaggauaguuaaggcuauuucaacauucaucauggcugcaaccaacuaaaguuaugccauuucucuuuuuuguuuuuuuuuuuuugagacaaagucucgcuuugucgcccaggccggagugcaauggcacgaucucagcccacugcaaccuccgccuuccauuccagguucuccugccucagccuccugaguagcugggauuacaggcacgcaccaccaugcccagcuaauuuuuguauuuuaguagagacgggguuucaccauguuggccaggcuggucucgaacuccugaccucaagugauccaccugccucggccucugaaagugcugggauuacaggugugagccacugcacuuggccccaacucguauucccaaauagauguauucagaaaaucugccuucacuuuagcucugcugcuucaguaccuuugauuauguuugcucugcucucccuucuaucauaaauuccaucucuaugacucuuucccuggucaucuuagcuagaagagauguuucucaucucccccacuuaauucuucugguacuuauugccugucccacuuauuaucccacaucacauuacaguuucagaagcagcgugguggaguuaaaauagaauggauuuuauacacagagaucagggauuugaaucuugaauuaccuguaugacccagaauaccuuacuucucucagccuuagcuucuucguuaaguaaguggaaauaauaccaaccucagaaggugguugugaaaacuagaugaaauaaguguauauaaaauguuuaacacauugucuggcauauaauagguacucaguaaauguuauuuaucuuccaucugccuucucuacucuccacucagaauguaaggacuauguuuuaugccucuuuguagcucucuuagcacuuaauacauguggcaaauggaagguuuauugaacacauggauaagcaaagauaguuuauguauaauggauuauucuuuguaaucauauucuauauauugagauuucuaauaugucuuuuuuuuuuuuuugaagcaagaucucacuuuauccccaggcuggaguauaguagugugaucuuagcccacuauagccucaaauuccuaggcucaagcaauccuccugccuuagucucccaaacagccggggcuacaggugugugcugccaugcccggcuaauuauauuuuuuauuuuuuguagugauguuuauuuuuucuagcuguguugcccaggcugguauugaacucccaaggucaagcgauccuccuaccucagccucccaaagugcugggauuacaggugugagccacagcaccucgccucuaagugacuuucaaguacagauaauuaauuuugaugucagaaaucacaacuuuauuaacauaaccacagaauagcaucacaagguuuguguucuuuuguauagguaugucuuacugaaagaaagaaacaugcuucuaacccuagagcaggaggccaagcggcagagauugccaaugccaaguccagagcgguuagauaagguaaggauugggagaggcuggagacugguauacaugauuacagcuaaaaggagugaguaugugguuccuguauuucuugucaaauagauuuuuuuuucuuauucguuugauuuuuaguaaauuugaguagugcaaccaucauagcuccuuuggaaacauuuccaucgccccuaaaagaaaucucauacucaccugcagucauuccucauuucuaccugcaacguguuuuuuguuuuuuuuuuuuuguuugugugugugugugugugugugugugugucagugugucaggugggucucacucugucgcccccaggcuggagugcaguggugugauaucuuggcucacugcaaccuccaccucccaggaucaagcaauucuccugccucagccucccaaguugcugggauuacaggcacauaccaccaugccaaguuaauuuuuguaucuuugguauaaaugugguuucaccauguuggccaugcuggucucaaacucuuaaccucaagugaccuacucaccuuggcuucccaaaccuaccugcaacuucuaacauacauguggacaaauguuuuugaguagauaccuaggagugaaauugcuggcuuauaugauaaaucuauauuuagcauuuuaagaaaccgccaaacuguauucuaaaguagcuauaccacuuuacauuuguaguucugguuuaaccauuuccuuaguaacuagaucaguuuuuuacugcuuuuuaaaauaacugugguaaaaaucacauaacauaaaauuuacugucuugaccauuuuuaaguguaauagucaguaguguuuaguauauuuacaauauugugagaaguugguuacuuuuuuauuuuauuuuuuugagacggaguuuugcucuuguuguccaggcuggagugcaauagcacagucucggcuugcugcaaccuccaccucccggguucaaacgauucuccugccucagccucccaaguagcugagaccacaggcacacaccaccacuacuggcuaauuuuuuguauuuuuaauagagacgggguuuuaccauguuggccaggcuggucuugaacuccugaccucgugaucugcccgccucagccucccaaagugcugggauuacaggugugagucaucgugccuggccgaagacuuagguuuuuauuuagauguauguuuuuacucgaugcuuucaagaucaacccuuuauugauuuuuuucuguggcauaguaaguagugagaacagaacucaguuuuuauaauagcauuaguccugcuaccuaaccuuagcuacuuuaguuuccuuuccucacaccagucgcagccauuuuuaccacacugccuuuaagauggaaggacauaacgaucccuggagaaaaucaaagaagguauaaaaugaaaccucauugauuuacccuaauuauggagaagguuauucugauguagugaaaguugaguuauauaacauuuuuuucuuuuaucuuuauuuugacauaauauuagacucacagaaaaauuacaagaauaguagaaggaauucucauauacccuccagauugcucuguuuuacugcauuuaccuuauccuucuaugcaucuaucaguccuccauacacaguauuuuuucucaaauguuugagaguaaguuguacacaugacaucccuuuaucuauaaaaacuucagaaaaaccaggauauucccuuauauaaccacuauguaaauuucaaaaucaggaaauuaacauugauacaguucuguuagcuguaaucuacagaucuuauucagaguuugucaguuaucccaaguguccuuuauggcaaaagaaaauucugcaucaugaauuuucaugugucucuucagucuccuuuaaucuggagacucagucuuuguguuuccugacauugaacuuuuuuaaaaguauagggccugggagguugaggcugcagugagccacgauugcaccaccaaacucuaggcugggugaccgagcaagacccugucucaauaaauaaaaaauaaaaagugcauugacaaguaaggaugcuuuauaaagaacacguuauuugaugaaaaagcuuuugcuauaauggugcuguuacagaacuuuugaacuucaaccguggauuaucugcuuuaaauauguauuucagaggugaacuucagcccaguagguuauauguacugcacuuucucaaucaguagaacccaaaauaauaaaaguuuacuccagagaagcugaaagugaccauaauuuuuucaaacuucauauacaucugguguuuccaguguuuugugacauacuacuaaggaaacuuuauuaagcaaaaauguaaaaaaaauucucaauauaagauagaaaccgaagauuuggaacuguuuaaggaagaguaaaagagaaaagaauuauaauugggauauaauucuuaucacugaugugaguugauauccaguugaagcauauuacagacaaauuuuacuuagagaauaauauaaaaauuaagggagaaauuauauaauucuggcacaauaguuagcuaugauuguaacuaaaguauuaacuauccauuugagauaaaugacccucacuauaugugcuucucuucagaguauuaguaucuauuuaucacacaaauaaaugacauguuaguccccuuguguuugaaauacagaaacaaggcaaauguugaaagauugauuauaauuuugcaaguguaucuuuuugucucuuuuaaaaacauguguuucaagggcuacucuguaauguuaauucuuggcuguaaagagaaguguauacucuuacccuggaacacaguccuauuuuauauucucucaacugacgcuccuggcacugagaaacuuauagaaaagaaggcucuuugagguugacuuguuuucaauaagguauaucuaaauaauacuuuugauuuuccuucacauuucuuggcaugaacuucugaauguuaauucuguggacuugguagccauuuacuuucuaucuuugugagcuaacacuggauuucagcuggaagccucaagucuuacccuugcuuaggcaaacucuuuaaugcaguuagugaacaaccagcuuuacuaaaaauuucuaaagauuagagaguuuuauauaaagcccuuaucaauguggucccuuuacucuccuaaguuugcuugucuucaaaauagaauuugucuuagucaucauuucuuuuucagggauuuuguagaaaauaaaauaguuaagaggaaggcaugugaauucagcuacuguaaggcauuuagugaaguugaggauagcagaagugcugagugugaacugagcagguuaugggccaggugcaauggcucacgucuguaaucccagcacuuugggaggccaaggcaaauagaucacuugagcccaaggaguuugagaccagccugggcuacauggcaaaacccugucucuaccaaaaaaauacaaaaauuagucgggugugguggugcaugccuguagucccagcuacuugggaggcugaggugggaggauugcuugagccugggaggcagagguugcagugagccaagaucgugccacugcacuccagccuggcugacagagcuagacccugucucaaaaaacaaaaacaaaacugauuaugaaguaauuuaucuaaauuuguggcuuucauaucuuuuucagaucucauagcuaccugggggauuauaaucugugcuuuuuuugaggauucuuaugagaaacaaaugugcuuaugcaguauuugauaucuguugugaugcuuaagggacauacacauaaaauggcucucaguauguauuuaggacuaugaaaaaguuuggcccaucucacauuacaauccccaacauaugaauauuuauauguaaacaaauagaaggccgggugcgguugcucaugccuguaaucccagcacuuugggaggccaaggugggcagaucaccuggggccaggaguuugagaccagccuggccaacauggugaaaccccaucucuaauaaaaauacaaaaaauuagccgggugugguggcaggugccuguaaucccagcugcucaggaggcugaggcaggagaauugcuugaaccuggaagguggagguugcaaugagccaagaucacgccacugcgcucuagccugagugacagagcaagacucugucuaaaaaauauauauauguauaaaacccugccaauauauacauuauaaaacaauagaaaucuuaaagagguaaaaauaaauagaaguuuaauaguaucaucuugcaucuugauaaaucuuuggagauucauaucuggauggacugcuauuccuuucccuguaguagcaacagcuaccaagcaggccacaauaucugugucugcaugucaaggacacagugauuaguugagaccagaacaugucuuuuuuaauauaaugaaaauagcaaauuauuaucacuucuuauuagcucauugaguuuugaaauaacaugaaucaaauugggucuccaaaaggaaucuauguaaguguaucucacuccaaacaaaacuaauggaaauauauuuguaguuaaaacuguaagcuuuuuaaaaaauacagaaagugguaaucuagacacccauguagacauacuugugccaaaaagauuuuuaggaaauacuuaacagagugguucuuuggcauaaauauucauaaguuuucuguagcagaaguguuuauacauucucuuuuuugggaauuuuguaguagaugauuguugaaauuguaucuuucuauucucuuuucagguaguagauuccauggaugcauuagauaaaguuguccaggaaagagaagaugcccuaaggcuucuucagacuggucaagaaagagcuagaccuggugcuuggagaagagacaucuuuggaagaaucaucugguauguaguuaacacuguggcucuucuaagaugagaguggaaauccaugccucauuccccugcccaauaucuuuuaaaaaaaaauuuguaccauaugagauaauauuagagauaugucuaauaaaagaagaggccccacaccccuuuggacuuuaaugaaggaggauaugaaugaagguagcuuuaucugguaaaaccagcccagacaucccauuccuaugauucaguuaccuauaagucuuuauuguagugguucuuagucuuauaugaaucacaaggccuuuugagaauuugaugaaaguuagggaucguuuccucagaaaaauguacauguacacauaucacuucagaagguauaaaauccaugaagcuaacuucaggacacacaccugcccucuuugcacauugagaaccuggaacuauuuuuuuuaaagucucagggaaugucacaugaaccaguuucaguuugcucccacugccaucaggauaagcccuagggcaaauuaugaaguaguuuauuuuuuauaccuccuuguuucuccuacauucaaaucccagagucuugucagccuuugggaaaggaucugguaaucagccuucaugcugagguguaaauaacugagaagaccugguguaaauaaaccuccuucgguggggaggcuguucaacccaaagguaaauaaaccuccccucagaaagagguuuauuuaccuuugggcugaacaaccaagaugaaauaucauuagacuuuuaaacguaggcagaauggggaaggcauuuugguuagagaccuucccuguacucuugacauuauaccacuuaacucauaacucauucgguagguucuuuuaaugggguuuaaguccaacacagaaaagagaaauugccaaagcaucucacuaaaaauguuuauguuuuauuuucuacuaauuuuuauuuggacuaacccuuuugagguaaauuaggaaagugaaaauguauuaaauguuuucuuuaaggcaaauaacuuuuugcuuuauuggcaggcacaaguucaagcaguggguuauaccuuggcaccuaaauaaaagauacaauaggaaacgauucuuugccuugccuuauguggaccauuuucucaggugagcacaagcaccuuuaauaaaacauauuaucuuuauaccagaugacauauggucauauaucauaccagaugacauaaagaaagcuuaagcugucuuuaaauuuuaauuucuguuauuacauaaguauuauaaaaaauaggaaagucaggcugggugcgguggcucacaccuguaaucccagcacuuugggaggccgagguggguggaucacgaggucaggcgaucgagaccaucccggcuaacauggugaaaccccgucucuacuaaauauacaaaaaauuagacggacaugguggugggcaccuguagucccagcuacuugggaggcugaggcaggagaauggcgugaacccgggaggcagagcuugcagugagcagagaucgcgccacugcacucuagccugggugacagagugagacuccgucucaaaaacaaacaaacaaacaaaauagguaaaaaagaaaauugaagucauauauaagcucaccuucagaaauagccacagucagccaagcguguuggcucaugccuguaaucccagcacuuugggaggccaaggcaggcagauuacuugaggucaggaguuugagaacagcccggccaaagugacaaaaccccaucucuacuaaaaauacaaaaauuagccggccaugguagcaugugccuguaaucucaacuacuuaggaggcugagguacgagaauugauggaaccugggagguggagguugcagugagcugagauugcaccacugcacuccagccugggcgacagagugagacuucaucucaaaaaacagaaaaaaaaaagaaauagccacuguuaacauuguaguauguauccuuucaaaaguuuuauugccuuucuauucuuguaucuauauguaaauggaaaaauuucuacuguuauguuaaaaugaagguccaaauaauucaguugcauacaaugugaguucauguuauugcaaggcuguugaaaagaaauggcgcuaggaagagaagucuguuauauuauaucuaaacucauguuguccugcagaauguugaucuccaaauauuuccuuuagcacauuuuuccugcauuagguuuaucauugaacagggagaacauagggcuucuguuaugauagaggagugcaguguucccaugaaccacucacugguaacuauacaaacuuaagauuuuuuuuuaaagagcuauuuuaaaacacuugggccauauccaaaaggagacaaagccagaggauauaguuuaauccccaaaacugcaauuagaagggaaaaguauugcuaguuuaugguuuccugggccaagggugcuauccaacucccauugcuguggcuccagagagagacagggcagaggaaccgaagggcuccuggcuaaaggugcuagaaaucagaauucaaggcugggaaggcagcuggaaaauuaaaggggaaaucauagcagcacgauagcagcacaagaaccacagcuuuuaacaacucuugaauaauacguucuacuuuuagcaaguuccucagaaaccgauuuucccgccccgauuuucauaccaaaacaaauuuuuaaaaacaauuuaaauaggaauggaauguaucuuuaaccuuggcuuuaaaguguuuaguguacuuuagaaucacauuuaaaauuacucaucucccuacugaaccagcuaccucucauuuuaucuguaguacauccagucuacauuagcccuaaaccgucagucaucuuuuucaucaccauugcuauauauuuaaucaguccuugauuuaauucuugcugcagaaugucuccaggaucugucuuuucuucucccauugucuuugcccuagugcagucugugucuucaucaaauugaauuaccgaacuucuugacuccaguccaaucaaguauugcuuccuggcuaauuuuccucaagacuuuuuuuuuuuuuuuuuaaucacaucaggccuuuucagaaacauacaacagcuucuugucuacaggacaaaaucuuaaacucuuuuccucccaguauuccugcaagucuuagcuaccuaccuuucaucgaagucagaacucuugccuuguuuccuaaguguuccuugcuuauuuuccacuguugcuucuucuguugcuacagcuuuuaaaucuuugcuauucacauuuaagaccuaguugagaugcuaagcaacugaagaaaucugaccacuuuuucucugagauugcuccaagcccaggguugugcuguuugauccuuuugucccuuagucauacagggugaaguuauaaaucacuuuuuuucuuuuuuuuuuuugagauggagucuugcucuguugccaggcuagagugcaguggugcgaucucggcucacugcaaccuccaccucccggguucuagcgauucuccugccucagccuccugaguagcugggacuacaggcaugugccaccacgccuggcuaauuuuuguauucuuagcagagacaggguuucaccauguuggccaggauggucuugaucucuugaccucgugauccucucaccucggccucccuaaguugggauuacaggcgugagccacugcaccuguccaugacauaacuuuuaaaauaauguaugagaauguaucaauccaguaucacuuuuacagguuuuauacauauucuaaugauuuuguuuuugaaacuaccuuuuuaagccucaccuucagaauguagcaucaucaucuuaauauuaagaauagcaaaccuuuauucuuucagaugggucuuuguuuuuguaaauggucaaaauuuaguuggagcaaagacugaugaauagaauggguaaucucauuuugacuuuguucagccuuuauacuuuuuuuccuauauaugugcauauuuuuuacuucauccagcuguaauacguguuaucucaauuuucuaugaccucucccauagcacuggcauauuguauugucuuuuuuccccccaaaaccucauuuguaauaacuucagcaguacaucuuuauugcuguauuuuauauaaacuuauuucuauugaccaauauccuguaagauaucaauucaaauagagcuugguaugcaaggauuuuuuucauuuucaauuuuuacaacucccaaguugacccuacaggucaaguaauuuauguuguaauuuaugcagcaaaugugucauacccugggauacugaugugugggaacaaacucauuuaaagaauaguaagucuagccagagccuaagaauuuauuuuuggcaucaugagagauauccugagacuuaugggaauucccuacuuucaaauaguacucacucuagcuuaucauuuccccuauacacagaauaacacucugcuaagagaugaugcuuagucauaugaggauugaacuuaaggcccaauuuguuacagguucauaauaucuggacauucuuucuagucaggaaauagggauaguugguauaggguuucagaugcucuugacuuguguagguuuacagugauuacuauucaaguuuaauaauauauauaacacaccaaauacagggacuggcauguuugaagcuuugauguaauugauuuaugcauauuuugauaguauugaauaacaaggaaauauuuuuguauaaauugcuguuacgcuuuuuuuauucuagacuggaacgugagaaacgagcccgcaucaaagcacggaaggaaaauuuagagagaaagaaagcaaaaauucuuuuaaaaaaguuuccacaucuugcugaagcccaaaagucaagucuugucuaagaugucugaacuauuaaauuuaccauuuuguuuuucuugaaua

SEQ ID NO: 13449 - RNA, 11990 nt, Homo sapiens
cauuuaauaagucugaauucauuuucaccacacgguauuguacacggucaucuguugaaacagauuucuuuuuuaacagaucuuaguuuaaaaaagucauagguacugugaguucuguauaaacugguggacaguaaguuaguuccuuuguuuuaacuuauaagccucaacuucaccgcagaauaaagaauguaggccaaagaaagcauaaucggucacucguauagaacaguauuguuucuauaauuugaagcuuucugaauggacggguucaggccugaugcaacuguaaaaagauuacuuaaugaauagacuauauggaaauuguauaaaauguuauuaccuuuuaucguuaguagcuuaaacagcacuauaucacuaauugcuauucaaaaucaaaaaccuguuuuugaauccccaagaaggcagcauguguauacaaccauaccaccuuguacuuaggggugugucaaaacauaauucaacagaaacuuuggcuuuaggaaagagucacaaauauuuaaaagaauggcuuugucauuuuaaguauacggucggggaaaagugugcuuuaauuaaauauacaucauaccagugaugcuggcaagguugaaaguuacuccuaauguugauagcuauaaaaacuaguuuguacauaacaagacaaugagaggaaaaagcaaucccuuugaaacaaaauucucaaauaaaaaauguucacagugguuuguaucaacaguaugcauuuuaugacaagaacauguacagauucagagcacccuagggcucucuuuauguccuaaagaaaaugagcauuuacaugauuauggguuguacugaauuaaaaaagaucaauuguacacuuacuccucagacaggauaaacuguccugggguguacagcuuuaacaccaucauuaaaauuguuugcaaaaggaacagagaauuaaaaaacaaaacacuuuucuuuuuggagugaagagucuuucauuugcuguuauaaccagcaaaugccauucacuaaaucaaaaauggaaggaagggcccccacaaacacagaucuaucugagcaagcugaccaguacacauuacagucuuaaaaaugaagguuauauacucuauguuacaagucccgacuaggcagugucaaaacgacaucuauuucuuugcuugcuuugugaucauaccccuuggaggcguuacaggucucguggcauuuggcuucuuuuucucugcaggcuuuaaaaucuggagauucaaaagacaguuaauuuaggaaauauacucaaccccaaaucuuaagaguccuuaaauuucauucagaucuucuguucagaugguguucacaacugccccaacaacuguaaaagccccccuagcauauuaacacaagcuauguugaauguaaacauuugguaauuaacgcuaugacgaacagauaaaaucuauuaucuggacaaauuauuuugccucugaguauaaugacaaucuucugaagucuacaccugguaguaucuuuagcuacuccuucugauacaggggaaaaaguucuuuacaaaaguguuucuccaaccuguaggggauccuugcacaaucuuuggaauuuugaaagcugcaaguucucucugauaauugguaaaaaacuauuuuaauucauuuaacugaugagugccacaugauuugguggcuguauuuauguuuaugacuaggcuggcuugaaguuguacaaguaucauaauaagcaaaugagaaaaaggcugaggcagauucuaaauaaugcuuuugugccaacugaaggccaaaugaugucaugguacauuaacagaaguuuuguggaaguuagacuagagggcagaacuaaguaaacacauagcacaaggcacucaguacuuuucacauucaaguggugauuuaauuuuagcugaacauuacauugucauuaagguuuuagauuuacaguaaaagagccauaagcauuaaggagccaauaugcaaugcaaaaauuuauaauucaacacugggaaaaggugccauaauuaauuuuuucuuuuacaagggauccacacauuauucaacuauaauacacacugguuaagggaaaauaaaaacuuagccuacucagcauaagugaacacuaggcaaaaaguagcaauuauauuuuucaaucagcaaaguguaaacauauuaaaaggaaaucauguugaaagcaugcucuaccugaaaagaacacauuaguguuucauccacacucaucauggcaccugcauugucaaacucuccgcaauaauugggcgcagaaaacagagugaccaacugccucuuugcaaaaaauucauauccaucuucaaccaccuugaagagaaaauuuuuucaauauaaauaggugcaaauauuaggugaguaaaaccauguuucaguuucccauugagccugauaucuuguguuccagaaacacuuuguauaaauaagcaauaccuacccaccaaaaucaacaaggagaaucugugcucacacacaugcucuuaaguguacauguaaaauucaaaaucaauaccugaugggcucuacauauaagauccaaaucaugcuuauggagaaauuuugcaaccacuucugcaccaaaugugaaggacacuccucugucauuuucaccccagccuaagacaucuuuaucggggucagaccacaaaagaucacaaagaagaccuugaucugguacaucaguuggucgcauaauucgccgaaucugcuccauagauugaagaucuggugauaaaccuauucaaugaggaaaaaaaaaaaaugaagaaagcagaacuuuuaaaaggauacuaccccuucaaaaguuccauuugucuacagagaaauucaauaauccugacauaaaaacugaaaucuaugauuauauuuuauuuacuuuugguuaaaagaaaaaaacacagaaaaaggacaacuggauacacacuagaauuacaugcaguaaugcauggggugcaguagguuuaaacaguacauggaaacaauuauauuauacagaacacuguaaaauaaaauccagugauuuaaaaaacucuucuaugggcuucccccaguugaugacaauaaugagcgauguuaugauugauggcuuauaaugacugagcugagaagauaaggaugcucagugugagguaguucucuaggaaaccugcacuguucacagaccauuaaaaucuacaagagcuuauuguaucgaguuacaauaugggaugcauauuguaagaguuaaaaaccauguauccaacucuaccaaaaccuaaguacagaagcacagagauaaaagacauuaugcaggcuuuuugauggcuaaaaucuacaagagcuuauuguaucgaguuacaauaugggaugcauauuguaagaguuaaaaaccauguauccaacucuaccaaaaccuaaguacagaagcacagagauaaaagacauuaugcaggcuuuuugauggcugauuaauuucagaccauacaggaaaagaaauucucuuugcaauuacuauuuuaauuacauuauagaaagcacaaccacugagcaaagcaaaacagcuuauaacauauauauguauauauuuucagagauagggucuugcucuguugccuaggcuggagugcaguggugcgaucauagcucacugcagccuuaaaccccuggguucaagcgauccucccgccucagccucccaaauagcuacggcuacaggugugcaccauuacaccuggcuaacuuuuacaacuuuuucuaaugacaggggucucgauauguuauaggcuguucucauauucauggcaucaagcaauccuccuggcuuggccucuccaaagugcuggaauuacagaugcgagccacuaugccuggccaaaauaacuuuuaaaauccaagucagagaaaguucugagaggauaaaaaacaaucaagggaaaaucuacucacaucuugaguguucuagaggaucucuggcacaacaaauuacacauuguucauuuuauaguuaaaaacacucuucugccgggcgugguggcucaagucuguaaucccagcacuuugggaggccgaggcgggcagaucacgaggucaggagauugagaccauccuggcuaacacggugaagccccgucucuacuaaaaauacaaaaaauuagccaagcgugguggcggguggcugcagucccagcuacucaggaggcugaggcaggagaauggcgugaaccugggaggcagagcuugcagugagccgagauggugccacugcgcuccagccugggugagagagcgagacucugucucaaaaaacaaaaacaaaaacaaaaaaaaccaaaaacuuuucuaagccgggcacaguggcuuacaccuguaacccagcacuuuggaaguccgaggcaggaggacugcuugagcccaggaauuugugaccagacugggcaacguggugagaacucauccuuacaaaaaauaaaauaaaaauaaaaauuuucugcucuauuuucaaaccuagcuuacagagucuagaauucccuguaauaaaucaauuccuuaagauuuuuauccaaaugauccuggcuguaucagagugaaagugcaaugcaacacaucaacaaaggagaguguucugucagagaaagucaucccaaugauaacucacaaauguuaaaguguucacccuuuggaagggaucaaaaccuauuuggaacaaaaaucagcccaccuaccuccaugacagcagaauaucuucucauccacgauggcugcuaucgguaaacaguuaaaacagucugugaaaguuuuccauaguuuaauguuguaucuucuuuuaccugugauuaaaaagagaguauuacauuaaaaagagaguauuacuguuccguaggcucauucucucaggauuaacuucccccaaagcaagauucugggugccuuuuaagcaaaugaaacuauguuuuuauuaagaaucuuaauaaaaccaucuuauuuuaaggcucuuuuaaaauaagagcugggcguggugggucagaccuguaaucccagcacuucgggaggcugagguaggaggauggcuugagcccaggaguucaagaccaucuugggcaacauagugagaccccaucucuuuaaagaaagacucuccuagagggaagggguuuaggagagacacauaucugaucuaaaagcaaugacuuacauuuucacaugaaaucuuuuuaaauuccacagaagcaugaaaccagaauuccagauuugauaaugauuaaggacugccaucaaaucccaggaauuaucugggagcaucaauucuguuugaaauugucugcucuguccaaucucaccgcagcuaguccccuacuucugaauucaauuacgaacuuacacauguggcguuaugaccuuccuucugaggaaaccugagaguuagcacccaucccccauauaugccccucaauaaccuacugacaccagaggauccccagcccucaguacucuagcaggaggcacaaugaucacacggcaguggcugccucucacaggcacuacagggcauuuguuuccaacacugcacagacuccacaugcucccacaggccugaugucacaggauggucauguucccucaacagcacaggcauccacacauucuggagucagagugcaguucugacagaaauaugccucuaugcacuguuucuacaggaaacugauguucugaguuuaaaaccuagucacauaccuugcaagaacaaauuucucuggauugguugaggauuguccaauuguccagaugccuuuguuuccuguacuuacuauacuaagcacaaucuuuaaaaaccaggaguuuggccaggcgcgguggcucacaccuguaaucccagcacuuugggaggccgaggcgggcagaccaucugagguugggaguuugagaccagccugaccaacaugaagaaaucccgucucuacuaaaaauauaaaaauuagcugggcgugguggcgcaugccuguaaucccagcuacuugggaggcuaaggcagaagagucacuugaaccugggaggcggagguugcggugagccuugauugugccauugcacuccggcuugggcaacaagagcgaaacuccgucucaaaaaacaaaacaaaacaaacaaaacaaaccaagaguuuguccuuagucucuuuuccuggggaauacagggacaucuaaagguuuaaaccuauaccucuccuuugagaguuagagccagcccaagcaacugaccugaaccacaccucccacccuguaaugcaaaucaagcagcuuagggaguuuaccacagggcuugaaaugaaauguaaauucaacaaauguuugccuucucucugcagaggaguguuaucuuuucuccuaauaauuucugguuucucaaugacugggucuaacacugacuaugguucacccuguugcauauuucuuuagagguccuucacuaggggguucggaaaguuuaacaaacuucucccgccaggcugaggaaggaaaauugcuugaaccugggaggcagagguugcaguaagccaagaucgcaccauugcacuccagcaugggcaacaagagugaaacuccgucucaaaaaaaagcaaacuccuucuuacgaaaggcugaagggcaaucuccaaaaaccaccaacucccauuuccaacagcaauacuacuacuacuaccaccacaggaugaguauccuuaauccaagaugcuccaaaauuuggaacuuuuugagcacucacaugaugcucaaaggaaaugcucacuggagcauucuggauuucagauuuuuggauuagggauguuuaaccaguaauuauaacacaaauauuccaaaauuaaaaacaaaaacaaaaaaccugcaacacuucuagugccaagcauucccgguaaggaauacuuaaccuguauuauaaaaacagagcugcugucuuagcuccccagugacagugacuuccucuuuccccaaggucagcuucacuucuggauacuuuuuuugagguggggucucacugcaucaccuagggggaaugaagcgacgcaaucuuggcucacugcaaccauggucucccagguuccagugauuuuccugccucaaucuccugaguguccgcgacuacaggugugcaccaccacagcuaauuuuuguauuuuuaauagagauggguuuuccccauguuggucagaccuccugaccucuugugaucagguugaacuccugaccucaagugauccacccaccuuggccucccaaagugcugggauuacaggcgugagcuaccacgccccggcuuugauucuuuaguuaugccacauacuccagcuucuccugcugauuccugcuggcuucuccaucaaaaaucaguuuguuuccuccuuuucccucucagcacuuuaagcgugggccugccucuuucuauucucucuucauuuccucccuaaggcuaccucagaccacuaggaacaucuggcuccugaaagguuuagccaggguaaucgccuagcuuccaaauccuaagauucugagccauaaccuguaaugcgguuucgcauuacuguacaucagacagcuacggcagcagaaacagaucaacaaacacucauguuuuacccaacaacauauaccucagccuuuccaucacauuuacaaaguuaaaaaaaaaaaaaaaagaaaugguaguauaaaguacuuauguaccuggaaaacaggcagugguuuuuaaauugucccaugaaaaucaacauuugaauacaacuuuucauuuuaauaaaauuaguuaaguauuuuauauauauauuaaaugucugcaagccuucaaccaaaagccaccuaugucaagggcacuuucaugcccacaaguagacuggauggcaaauuauaucugccugaugagagagaggaagcuugagcauaagaucuacaaauuguguugaugaccaaacaggagucgaaacugauaccaaccaacacugaucuucuaagucauuuuuuaaaggccucugcauuaaguagaaaccgaaacugaugcagccaguaucauuacauuaggauacacgucacaaaaaugaggucaacuggauuugaauucaucagugcaaacaugaaaaguauuugcugggcuaacagcuauguaaaaggaauccuuuaacucaagagcaggccaggcacgguggcucacgccuguaaucccagcacuuugggaagcagaggcgggcggaucaugaggucaggagaucgagaccauccuggcuaacacagugaaaccccgccucuacuaaaaauacaaaaaauuagccgggcguaguggcgggcgccuguagucccagcuacucgggaggcugaggcaggagaauggcgugaacccaggaggcggagcuugcagugaggcgagaucgcgcccugcacuccagccugggcgacagagcgagacuccgucucaaaaaaaaaaaaaaaaacaaaaaacaaaaaacucaagaguaacacuuggaauaaguauccaaaacacaguguuggcugggugugguggcucaugacuguaaucccagcacuuagggaggcugaggugaaaggauugcuuaaacccagaaauuacaggugguaguaagcuaugaucccaccucugcacuccagccuaaggcucugucucaaaaacaaacaaaaaaaacccaucacaccugccuugcauuucacuaccuaaggaguaguaacuggcuuacugguacuucucugacacagaaucacuguuaauauugaauaccuuucauguacaaguucaaugcuaucagucaguccagaacccauagaauuuuugucccugaugauuccugccaccccaucuuaucagcuggaucucaaggucacagaccaagcaaacauccaguugugggaaagggugguaguagaagggcucaguuugugaauauaaucuuucuaggaugcacuucuaacaaaugugcuagcucaacauaucuaugugaauugagauggaaaaacacugcaucuggagacucuagguuacgauguggucuaggggagggccacagggacaacccuuugcugauaucccuauaaucauauuagcaaaugccaaguaccugaaguuccuuaaccaccucuucacuccaaaccugaaacccguccuggcagcaaugaugagcacaaaaggaaggugaagguaaagauucaaaaccuuuucugacuugaaacccuuuacugaacugauauuuucaaagcuuuuuuuuuuuuuuuuuuuugagacggagucucacucugccacccaggcuggacuacuguggugugauuuuggcucacugcaaccuccgacuccuggguucaagugauucuccugccugagccuccugaguagcugggacuacaggcaucugccaccacgccuggcuaauuuuuguauuuuuaguagagaugagguuuccucauguuggccaggacggucuugaucucuugaccuugugauccacccgcuguggccucccaaagugcugggauuacaggcgugagccacugugcccagccuauuuucaaagcuuuaagaacuguguuuugucaauagucaaaucgaaguauaccuuuaauuaaacaauccaaaaugggucacaaaauguguaaaauacuguaaaaauaaucuuuguucagcacauuuuaguuuuaggaaaguuauugccauucuuccuggguguggauaugccagaaggagaaaaacuauaauaauuucaaaaacuaauuauuuacguauugcaagauuccauuugcaugcaauauucucuagaaaagacaaaaaguagauuagugguugccuggggacuauggugauggucgcauaacucuauaaauuuacuacaaaucgcugaauuguacacuuuuaacagaauaauuuuauggaaugaaauuacauaauaaaguugcuuaaaaaaacuauuuggaaugguucucagauuucuacuaagaauuaaguuaucugugaauacaacaauuuaaaucuuaaagcaaccauuaccaugaucauuacuuccuaaucugaucaucacaucauaaaagaauccaagaccuuauuuuauuacagcggcaguguuauuuuucuacccaagagagaaaaaacuggcugggcaucauggcucacgccaguaaucccaguacuuugaguggccuaggcgggcagauuccuugagccaggaguuucagaucagcuugggcaacaaggugaaaccccaucucuucaaaaaaauacacaaauuagccaagcguggugaugcaugucugcaguccuagcuaccugggaggcugaggcaggaggauugcuugagccugggaggcagagguugcaaugagguaagauggugcuacugcacuccagccugggcaacagagugagacuccguucccccaccccccuaaaaaagcuaagcuaaaaacaaguugaugaaauagaaaacaugagagaugauaccacugcaucuaaacucucacaauuccuaacagaaguaugugauaauuguuuaugauaaauaucuuaauuucaauaacucuuccuuagauauagaaaaguacuuacauucaucauaaaauccauaaauucuguugaugcuggcacauucaugguucccucugagaagaaaaaaauucucaggauauuuuauuuuguaggccaguaagaggcagaucgucuccaaugacugcuuuccccuguccacauaguccccaagaaacagguaguugcuuucuggugggaaaccaccguacucaaaaagucgcagcaaaucauaguauuguccauggaugucaccuggaagcaagaauuuuguuacacaguguucccauacuuaaagcucaauccacuaacaaagcuuuggaaagacauucuuuaaauauucauuguacaauggcauugaccucuaguaaugagaguuuaacugggcagccaacacuaaguaauuuccaaucuuauaucauauuuaguucaacugagcuuaacaaaaauuuuaaguauauguguauguccagaaccucacauaaaauucaacuauuaagaauuuauucuguggaaaggguuauuauguccaagcaugcauucuugccaaguaacaugguaucccuuucaggcugacugaucaauaucagaucucugacagcucagucucuggguacugugucagcagaacugcugcacuucuagugagucuuggccccaucugaacaaaagcacauacacacauacacaccacccccaccccccacccaucaaugcauuuagcuuucaauuucucccugcuagauaaugccaaagaacauuuuacuuuuaaaaacaugaacacaaaguuuuaucaaugcaaauaugcuauaagaauauauuacucaaacgaauaaaguuugguuuuacauugaguuaaaacacagauuauuugcuucuauuaugcagaaaacagaaccacaaaaucaguaucaaggaaguucuauuuuuagcuauaaccaguguugcuuuaaacuuaaacauauuccuauacauccauguaguucagaccuuuccucagcucuccauucuuaguuucauuuuuuucuuuugcaauguuuauuccuucagcaaaauauuuuuuuuaaaaaucugaaguacaucuaaguaaacuaaguccauuagagguauuuauucuaaagcuacuauuuaacuuacuuuuaaguaguuccaagcuauucgcaaacaggauaaucauucugcuagcuaauacaaggucaucaacauauccuugacucaguuaaucaaucauguaacaaaagauaaccugugugccccaaacuuaccacauauuuugaguggugcuucaaguucuaguaggauaggcugacugagaaagauuucacgagacuuuaagcacaguccucugauuucauucuccugaagcuggacauucuuaccaggcuuggacccucucacugcaag

SEQ ID NO: 13450 - RNA, 6888 nt, Homo sapiens
uuuaauuuuuguuucauaugaguuuaaguguugucuaggugacaucaaaaucuaaggcaaacagacuugaccaucuucagacccacugcauucucaagcugaaguggucugcucauaguuugugugccagguugcucaucaguauugauacugucccagaacagguuguagguauaauucagagacuguccuuugcaaaggaaaugaccagcauuucaacuguaugucuuccuggaaggguagauucugcuauaucuucuuugucugcaucaaaagacucaagaggaauguggacacauuucauaucccauuuguagaguaaagcuucaagugaccagucagcacuuaaaaaaaaaaaguuguucuuuuaaagucaugccuuuucuguuuugcuucagauguauucuauucuuaaauuauguaucgcauggguaggguagaguaaggcuuaaguuacauauaaaaaguaagggucauccauacuugccuccuaacuugauaaguagaccacaauuggaccuugggauucuugugcaucaaaaaauauauuguagccaaaaugucuucaaaaucugaggagaaaggauuuaugaauagauuuucauauagcaucacuggccaaauguacuauugagccaaaaaagcuuaccuucugguucaaagaacacaucagaugcaaggauaauaucuuguggugguagagccagaagaucccaagauauaugaccccauguuaguccuaccaccugcagauguggcagguuauucauuuggcagcuuugccgacagacuuccagacagugaggcaguucugagcugucugacaguauuacuucugcaccacauuuggcagccaaaauuccuggaaggcucacuccagcuccaaucuaauaaguuaugaaagauggcauuucacaauuauacuuggaacugcaaauaauugggaaucuuaguacuuuuucauuauauucuugcauuuuuaaauaagcauagagucagucuuucuggguuuguauaaaauguaccguaacugaacauuacuauaaacaugacaaaaguacauuccuuaugaaucuacucugcuaaaagguaaaagcuuaaccuucaauuucaauauuaaagggccauguaucguaacuggcaguuaauugcuaugcacacagaaguaguuuuggggcacuugauuccucugccaugauuuucaguuuuguuuuauuuuuuugagacggagucuugcucuguucuccaggcuggagugcaguggugcaauaucggcucacugcaaccucugcuucccggguuccagugauucuccugccucagccuccugaguaacuggccaccaagcccagcuaauuuuuuuuuuuugagagcguuuggcucuuguugcucaggcuggaguacaauggugcaaucuuggcucacugcaacccccgccucccggguucaagcaauucugccucagccucccaaguagcugggauuacaggcgugcaccaccaagcccagcuaauuuuguauuucuuuaguagagacaggguuucucccuguuggucaggcuggucuugaacucccgacaggugauccaccugucucggccucccaaagugcuaggauuacaggcaugagccaccgugcccagccacucggcuaguauuuuguauuuuuuaguagggacuggguuucaccauguuggccaggcuggucuugaacuccugaccucaagugauccaccagccucagucucccaaagugcugggauuacaggcaugagccacagcacucagccuaauuuucacuucuguuagcauguucuauaguugauugcuuuucuguagcuaaaaccuaacaggucugcaacauggcuuucuaguaaagauuuuccaguugggccuucaaagcggcaagaugcuuugcagacacuaagaaauaauaccagggaaugccuucauaaguauuagcauaaacacaagcuucccauuuuccaguucaaggaaggacacagagauagaauuauugugagugcccagcaauuacaacuaggaccagaggugugugccaaauccuaccccuaauuucauuuacuugguguaguaaaaguuaagagugggauguuaauauuaagcuucugguuugucuauuuagccuuuggucuuaaguauggugugaaagucuauuucugcaaaugugauaaaauugguuuuuccaagccuucaccagucugaggccagguagugagguuagaaagagaaugggauacauuuuuacacuaaucucaacauuuccaaaaacagaaagggcuacacuacggucugaauguguucacccaaaauucauauguucaaauccuaauuacccaucugaugugggccuugggaggcaauuacauaaaggcagaguucucaugauuagugcccuuauaaaaugcccuggagaguugcuuugcuucuuaagguacaagacacuuaagaacacagaggacacugucugaaccagaauucuggcccucaccagacacugaaccuguaaggacuuucauccugggacuucacugccuccagaacugauacccaaauuucuuuauucuuuugagaugcagucucgcucuguugcccaggcuggagugcaguggcacaaucucagcugacugcagccuccaccuccuggguucaggcgauucuccuaccucagccuccugaguagcugggacuacaggcaugugccaccaggccuggcuaauuuuaucuuuuuuuuuuuugagauggagucucgcucugucgcccaggcuggagugcaguggugcgaucucggcucacugcaagcuccgccucccggguucacccaccauucuccugccucagccucccgaguagcugggacuacaggcgcccgccaccaggcccggcuaauuuuuuuuguauuuuuaguagagacgggguuucaccguguuagccaggauggucucgaucuccugaccucgugauccgcccgccucagccucccaaagugcugggauuacaggcaugagccaccacgcccagccaauuuuuucuauuuauaguagagacgggguuucaccauguuggccaggcuggucuugaacuccugaccucaggcaauccgcccgccuuggccucccaaagugcugggauuacaggcaugggccacagcgcccggcaagagacauaaauuucuguuauuuguaagccacccaguuuaugguauuuuguuacagcaaccugaauauaaaaaggcugcaugacacugcugggacaccuaaaacaauggccuuaaagacugccacggccguggaaggcaguucaggggcuucaucuagaauagcggucagcaaacuaaagggcuagagagucaauauuuuaggcuuugugguccaccuaucaucucugucacacuuuucuuuuuucuuagagacagcgucucacuauguugaccaggcugguaucaaacuccugggcucaagucaucuucccaccucgaccuuccaaaguacugggauuacaggugugagccaucacacccaguaucuucuuuaaaaaaccacuuuuuuuuuuuuuugagauggagucucgcucuguugcccaggcuggagggcaauggugcgaucuuugcucacuguaaccuccgccuccaggguucaagcaauucuguuucagccucccgaguagcugggauuacaggcgugcaccaccaggcccggcuacuuuuuguauuuuuaguagagaugggguuucaccacauuggccaggcuggucucgaacuccugaccucaaaugaugcacccgccucagccucccaaaaugcugggauuacaggcgugagccaccaugcccagccgaaaaaccacuuuuuaaaugaaaaaaaguuccaggauaaucucuguaccuuaagacaaaaacaaaacaacauucuuagcucacagaccuuacaaacuagcuaaauuacccgauuuaaaaauauuuaacaaaagcuaaaaacaagcaauauacacaugucaacuuaacacaucugaacauaaccuagaacucuggaaacuucaggggcauuuguaccucuaagauggccuugccuggcagagaucuucugugaaaccaaagguacugggccaggaccacagcacagggccaaacauacauuccauacuggagaugcaggaccugaaaagaauguuuuugugugccauaaauaauuuagcugcuggaaguuggaaucauucauacagcaauuucugucaggcauuggcauccauuacaaaaauggcagcccuguucaccaauccacgaccuuuggggauauaaaacugcaaugcaaugugauagaaacucuugauagcacuguuuauucaacaagugcuucuagugucacaguaucagggaucauucucagacuggggauauagcucucccugagcacauauccuacuguagagaggcaacgagcaagcaaauaagauauuucuagucaggggccgggcacggugacucaggccugucaucccagcacuuugggaggaugaggcgggcggaucaccugaggucaggaguuugagaccagccuggcuaacauggugaaaccccugucucuacuaaaaauacaaaaaauuagccgggcaugguggcacgugccuguaaucccagcugaggcgggaaaaucgcuugaacacgggaggcggagguugcagugagccgagacugcgccacugcacuccagccugggcaacauagugagacuacguuucaaaaaaaaauggccgggcguggugggucacgccuguaaucccagcacuuugggaggccgagguggguggaucaucaggucaggagaucgagaccauccuggcuaacgcggugaaaccccgucucuacuccacuaaaaauacaaaaaaauuagccggacaugguggugggcaccuguagucccagcuacuccggaggcugagacaggaaaauggcgugaacccgggaggcagagcuugcagugagcagagaucucgcgacugcacuccagccugggcgacagagcaagacuccaacuccaaaaaaaaaaaaaaaaaaggaaagaggcuucuauucucacaggcaauaucaucacccccuacauuuaggaagaaaugcaaguguauuuaaacgugaagccagccgggagcgguggcuuacaccuguaaucccagcacuuugguaggccgaggcaggugcaucaccugaggucaggaguucaagaucagcuuggccaacauggcaaaaccccgucucuacuaaaaauacaaaaauuagccaggcaugguggugggcgccuauaaucccagcuacuugggaggcugaggcaggagaaucacuugaacccacgaggcggagguugcagugagcugagauugugccacugcacucgucugggugacagagcgagacuccaucuccaaaaaaaaaaaaaaaaauccgugaagccagauugggugugguggccaaugccuguagucucaguuacuugaaaggcugaggugggaggaucacuugagcccagagguugagguugcaguuagcaaaaaaaagugaagcuguuuggaaacaaucagaaauagccuccacuccagucuuuuuuuuuuuuuuucuucuugacaaugucuugcucuguugcucaugccugagugcaguggccugaucauagcucacagcagccucgaccucucgggcucaagcaauccucccaccucacccuccggaguagcuggggcuacaggcacaagccacgaugccuaauuuuucuacuuuuuguagagacguaguaucacuauauugcccaggcuggucuggaacuccuggucccaagcgauccucccgccuccgccucccauuuaacuucucuaaagcuguuucuuuagcaugggacaugccucacaggcugguguuaaaaccaaaugaaauacugcaaagugaaagugcuuugaaaaaccgaagacaggcagggcaugguggcucacuccugcaaucccagcacuuaggcaggcgggaggaucacuugaauccgggaguuggagguugcagugagcugugaucgcgccacugcgcuccagccugggcgccagagcgagacagugucucaaaaaaaagaaaagaaaaagaauuauuauugagaguuuuguuguagcugugagcuuagaggaagaagcgagguccaacccaagaaacacuuugggcaccaaauaaaacuggaaacccugaucccaaaacucacacaaaagugagagauaaggaugaaucaagaaacccuuggacaagaucaaaagaagcauuagaggucagucaagaaugucacuuuccuggcaggaaagauucgauguggagaaagccggcccggcgcaguggcucaugccuguaauccuagcacuuugggaggccgaggcaggaggaucacuuaagcuuacaguucgagaccagccugaccaacauagugaccagggucacuucuuggcagggucuccaaaauucuuacugagagacauuuaaugcaccgaagggcuucauauccgacguuuuugcuccgggggucaaccuaaagcaggaagcugcgcagcugagcguccgcacccccggucccucaggaacccagccaagucagccgacauccgcuccugaccucaggcgccuccuggcgggugcugcugcacgcaccugcgggacguggaccuccaggacagccccgucggcccccggacccggcuccuccgagaaucgaaagcgcugggcccggacccccuguccucggaaaucgugcucgcccaguagggcgucguugggccccgggcgggcgggggaccgcggaaggcuccgggcugccagacugcgcgagcgggaagccgcgggccacguggcc

SEQ ID NO: 13451 - RNA, 6888 nt, Homo sapiens
ggccacguggcccgcggcuucccgcucgcgcagucuggcagcccggagccuuccgcggucccccgcccgcccggggcccaacgacgcccuacugggcgagcacgauuuccgaggacaggggguccgggcccagcgcuuucgauucucggaggagccggguccgggggccgacggggcuguccuggagguccacgucccgcaggugcgugcagcagcacccgccaggaggcgccugaggucaggagcggaugucggcugacuuggcuggguuccugagggaccgggggugcggacgcucagcugcgcagcuuccugcuuuagguugacccccggagcaaaaacgucggauaugaagcccuucggugcauuaaaugucucucaguaagaauuuuggagacccugccaagaagugacccuggucacuauguuggucaggcuggucucgaacuguaagcuuaagugauccuccugccucggccucccaaagugcuaggauuacaggcaugagccacugcgccgggccggcuuucuccacaucgaaucuuuccugccaggaaagugacauucuugacugaccucuaaugcuucuuuugaucuuguccaaggguuucuugauucauccuuaucucucacuuuugugugaguuuugggaucaggguuuccaguuuuauuuggugcccaaaguguuucuuggguuggaccucgcuucuuccucuaagcucacagcuacaacaaaacucucaauaauaauucuuuuucuuuucuuuuuuuugagacacugucucgcucuggcgcccaggcuggagcgcaguggcgcgaucacagcucacugcaaccuccaacucccggauucaagugauccucccgccugccuaagugcugggauugcaggagugagccaccaugcccugccugucuucgguuuuucaaagcacuuucacuuugcaguauuucauuugguuuuaacaccagccugugaggcaugucccaugcuaaagaaacagcuuuagagaaguuaaaugggaggcggaggcgggaggaucgcuugggaccaggaguuccagaccagccugggcaauauagugauacuacgucucuacaaaaaguagaaaaauuaggcaucguggcuugugccuguagccccagcuacuccggagggugaggugggaggauugcuugagcccgagaggucgaggcugcugugagcuaugaucaggccacugcacucaggcaugagcaacagagcaagacauugucaagaagaaaaaaaaaaaaaaagacuggaguggaggcuauuucugauuguuuccaaacagcuucacuuuuuuuugcuaacugcaaccucaaccucugggcucaagugauccucccaccucagccuuucaaguaacugagacuacaggcauuggccaccacacccaaucuggcuucacggauuuuuuuuuuuuuuuuuggagauggagucucgcucugucacccagacgagugcaguggcacaaucucagcucacugcaaccuccgccucguggguucaagugauucuccugccucagccucccaaguagcugggauuauaggcgcccaccaccaugccuggcuaauuuuuguauuuuuaguagagacgggguuuugccauguuggccaagcugaucuugaacuccugaccucaggugaugcaccugccucggccuaccaaagugcugggauuacagguguaagccaccgcucccggcuggcuucacguuuaaauacacuugcauuucuuccuaaauguagggggugaugauauugccugugagaauagaagccucuuuccuuuuuuuuuuuuuuuuuuggaguuggagucuugcucugucgcccaggcuggagugcagucgcgagaucucugcucacugcaagcucugccucccggguucacgccauuuuccugucucagccuccggaguagcugggacuacaggugcccaccaccauguccggcuaauuuuuuuguauuuuuaguggaguagagacgggguuucaccgcguuagccaggauggucucgaucuccugaccugaugauccacccaccucggccucccaaagugcugggauuacaggcgugacccaccacgcccggccauuuuuuuuugaaacguagucucacuauguugcccaggcuggagugcaguggcgcagucucggcucacugcaaccuccgccucccguguucaagcgauuuucccgccucagcugggauuacaggcacgugccaccaugcccggcuaauuuuuuguauuuuuaguagagacagggguuucaccauguuagccaggcuggucucaaacuccugaccucaggugauccgcccgccucauccucccaaagugcugggaugacaggccugagucaccgugcccggccccugacuagaaauaucuuauuugcuugcucguugccucucuacaguaggauaugugcucagggagagcuauauccccagucugagaaugaucccugauacugugacacuagaagcacuuguugaauaaacagugcuaucaagaguuucuaucacauugcauugcaguuuuauauccccaaaggucguggauuggugaacagggcugccauuuuuguaauggaugccaaugccugacagaaauugcuguaugaaugauuccaacuuccagcagcuaaauuauuuauggcacacaaaaacauucuuuucagguccugcaucuccaguauggaauguauguuuggcccugugcugugguccuggcccaguaccuuugguuucacagaagaucucugccaggcaaggccaucuuagagguacaaaugccccugaaguuuccagaguucuagguuauguucagauguguuaaguugacauguguauauugcuuguuuuuagcuuuuguuaaauauuuuuaaaucggguaauuuagcuaguuuguaaggucugugagcuaagaauguuguuuuguuuuugucuuaagguacagagauuauccuggaacuuuuuuucauuuaaaaagugguuuuucggcugggcaugguggcucacgccuguaaucccagcauuuugggaggcugaggcgggugcaucauuugaggucaggaguucgagaccagccuggccaauguggugaaaccccaucucuacuaaaaauacaaaaaguagccgggccugguggugcacgccuguaaucccagcuacucgggaggcugaaacagaauugcuugaacccuggaggcggagguuacagugagcaaagaucgcaccauugcccuccagccugggcaacagagcgagacuccaucucaaaaaaaaaaaaaagugguuuuuuaaagaagauacugggugugauggcucacaccuguaaucccaguacuuuggaaggucgaggugggaagaugacuugagcccaggaguuugauaccagccuggucaacauagugagacgcugucucuaagaaaaaagaaaagugugacagagaugauagguggaccacaaagccuaaaauauugacucucuagcccuuuaguuugcugaccgcuauucuagaugaagccccugaacugccuuccacggccguggcagucuuuaaggccauuguuuuaggugucccagcagugucaugcagccuuuuuauauucagguugcuguaacaaaauaccauaaacuggguggcuuacaaauaacagaaauuuaugucucuugccgggcgcuguggcccaugccuguaaucccagcacuuugggaggccaaggcgggcggauugccugaggucaggaguucaagaccagccuggccaacauggugaaaccccgucucuacuauaaauagaaaaaauuggcugggcgugguggcucaugccuguaaucccagcacuuugggaggcugaggcgggcggaucacgaggucaggagaucgagaccauccuggcuaacacggugaaaccccgucucuacuaaaaauacaaaaaaaauuagccgggccugguggcgggcgccuguagucccagcuacucgggaggcugaggcaggagaauggugggugaacccgggaggcggagcuugcagugagccgagaucgcaccacugcacuccagccugggcgacagagcgagacuccaucucaaaaaaaaaaaagauaaaauuagccaggccugguggcacaugccuguagucccagcuacucaggaggcugagguaggagaaucgccugaacccaggagguggaggcugcagucagcugagauugugccacugcacuccagccugggcaacagagcgagacugcaucucaaaagaauaaagaaauuuggguaucaguucuggaggcagugaagucccaggaugaaaguccuuacagguucagugucuggugagggccagaauucugguucagacaguguccucuguguucuuaagugucuuguaccuuaagaagcaaagcaacucuccagggcauuuuauaagggcacuaaucaugagaacucugccuuuauguaauugccucccaaggcccacaucagauggguaauuaggauuugaacauaugaauuuugggugaacacauucagaccguaguguagcccuuucuguuuuuggaaauguugagauuaguguaaaaauguaucccauucucuuucuaaccucacuaccuggccucagacuggugaaggcuuggaaaaaccaauuuuaucacauuugcagaaauagacuuucacaccauacuuaagaccaaaggcuaaauagacaaaccagaagcuuaauauuaacaucccacucuuaacuuuuacuacaccaaguaaaugaaauuagggguaggauuuggcacacaccucugguccuaguuguaauugcugggcacucacaauaauucuaucucuguguccuuccuugaacuggaaaaugggaagcuuguguuuaugcuaauacuuaugaaggcauucccugguauuauuucuuagugucugcaaagcaucuugccgcuuugaaggcccaacuggaaaaucuuuacuagaaagccauguugcagaccuguuagguuuuagcuacagaaaagcaaucaacuauagaacaugcuaacagaagugaaaauuaggcugagugcuguggcucaugccuguaaucccagcacuuugggagacugaggcugguggaucacuugaggucaggaguucaagaccagccuggccaacauggugaaacccagucccuacuaaaaaauacaaaauacuagccgaguggcugggcacgguggcucaugccuguaauccuagcacuuugggaggccgagacagguggaucaccugucgggaguucaagaccagccugaccaacagggagaaacccugucucuacuaaagaaauacaaaauuagcugggcuugguggugcacgccuguaaucccagcuacuugggaggcugaggcagaauugcuugaacccgggaggcggggguugcagugagccaagauugcaccauuguacuccagccugagcaacaagagccaaacgcucucaaaaaaaaaaaauuagcugggcuugguggccaguuacucaggaggcugaggcaggagaaucacuggaacccgggaagcagagguugcagugagccgauauugcaccacugcacuccagccuggagaacagagcaagacuccgucucaaaaaaauaaaacaaaacugaaaaucauggcagaggaaucaagugccccaaaacuacuucugugugcauagcaauuaacugccaguuacgauacauggcccuuuaauauugaaauugaagguuaagcuuuuaccuuuuagcagaguagauucauaaggaauguacuuuugucauguuuauaguaauguucaguuacgguacauuuuauacaaacccagaaagacugacucuaugcuuauuuaaaaaugcaagaauauaaugaaaaaguacuaagauucccaauuauuugcaguuccaaguauaauugugaaaugccaucuuucauaacuuauuagauuggagcuggagugagccuuccaggaauuuuggcugccaaauguggugcagaaguaauacugucagacagcucagaacugccucacugucuggaagucugucggcaaagcugccaaaugaauaaccugccacaucugcaggugguaggacuaacauggggucauauaucuugggaucuucuggcucuaccaccacaagauauuauccuugcaucugauguguucuuugaaccagaagguaagcuuuuuuggcucaauaguacauuuggccagugaugcuauaugaaaaucuauucauaaauccuuucuccucagauuuugaagacauuuuggcuacaauauauuuuuugaugcacaagaaucccaagguccaauuguggucuacuuaucaaguuaggaggcaaguauggaugacccuuacuuuuuauauguaacuuaagccuuacucuacccuacccaugcgauacauaauuuaagaauagaauacaucugaagcaaaacagaaaaggcaugacuuuaaaagaacaacuuuuuuuuuuuaagugcugacuggucacuugaagcuuuacucuacaaaugggauaugaaauguguccacauuccucuugagucuuuugaugcagacaaagaagauauagcagaaucuacccuuccaggaagacauacaguugaaaugcuggucauuuccuuugcaaaggacagucucugaauuauaccuacaaccuguucugggacaguaucaauacugaugagcaaccuggcacacaaacuaugagcagaccacuucagcuugagaaugcagugggucugaagauggucaagucuguuugccuuagauuuugaugucaccuagacaacacuuaaacucauaugaaacaaaaauuaaa

SEQ ID NO: 13452 - RNA, 2924 nt, Homo sapiens
uaaccaaaucucaguggcaguguccaaccaggugcuugugggcgaccuuccaacaggcaccgcauugcccggcugccaggccgggccuguguacuguccccgcaucccauacagcuagcacuuauucacccucaaaagcgucccauccugaaaauaaacucuugcccacuuggugcuucaggaaccugggcuucuuccacuaauagcucucccagaugccccagugcgcagguggggccguccucuaggaccaggccuggcuggggcgcacccacaccuccuuggccagacgccaugggccgggaaggggcucuggcccuugcgggaaugagggcgccuagcauaggugugcaagugggcagcccccaccgugggguccuuaaguaagcuggagccugugagccaggacagucaggaguugcaaccuuggugauuucuaggaagacagaaaauggggucaagggccgggugugguggcuuaugccuauagacccagcacuuugggaggccgaggcaggcggaucaccuuaggucaggaguucgagaccagccugaccaacagggcgaaaccucgucacuacuaaagguacaaaaauuagccaggcgugguggcgcacaccuguaaucccagcuacucaggaagcugaggcaacagaaucgcuugaacccgggaggcagagguugcagugagcugagaccacaucacugcacuccagccugggugagaaccuguuaaaaaaaaaaauaagaaaauggggucaagaaacggugggaggagggcagauuucaugaaccugccugcuaugauguggcugcauuuccaucaugcauuguccuaaaaaaagaaaaagaaaaaaauaaaauguagacguggagggaugggggaaauugcacaggccgguccaggcugugaggcugcccccuaccagggacgacgagggccagcuccgccgcgccguaaggaaacuggccaagggaaccccuugaaucuggcgagggcccgccaugagacgcucggggaaccagacugccgagccccccucucugggccgacgccagcccggcuguggacuggagaaaaccgcaaggccaccugcagaaagaaaagaaggccaucgcgccuacgcagcugagcacccauacuccgcccgcgccugcgcaacugggucccccgacccccaccuccucucccgccugcgcaugcgcggcugggugcgcccccccgcccagccugugacgccacgugcauggggcggagcccaggcccuagggaaucguggggucguaucccgcggguggaggccgggguggcgccggccggggcgggggagcccaaaagaccggcugccgccugcuccccggaaaagggcacucgucuccguggguguggcggagcgcgcggugcaugguaagcggcgggccggggcgcuggcgggggcggccggggaucaccgacuguaggcgggccucccccacgcgggcgcgcugcgcuccggaggacggccucggggucacucgcaccccgggucccaccuccugcugccuuccuguccaggcuccauuagggcucccuggaugucugggcuccgcugaccgguggggggcaaguccaguguuuugggccacagggcgggccaaauagcaggggccuguagccccagggggccccagcccugcugcguucauucauucagcccgcuuuugcggacccgcccccagucugcgucagggacagaccccuccgcccuggaugagcccggcggggaagcuucgcguagcaguuucugggaaacagguaggaucaggccgcucggacaggacugaggguguaaggacgauucacccuggcauugggguggugucccgaggagcucauagguggucagggcgguucugcccgagcugaccugugagccgcgaaugcccuggaccgagggagggagagcccccuagguggacagacuagacuccuucaguggaaaacauucaacagccaggagagcguggaagaggaaggagagaugggagggcccaggggagcguggaagggaggguguuuuuauuauaagugcaccuguaagugcaaagugcaaaggaagcagccgccgggaagugccugggcagcucugggugucccuccaggcaccuguauuccagccuuaccugcgcgaagccacacaucccacgucacacaggauacggggaagucagccauagccugcaggcggggaaucugaaaccucgcgcaggaguuccuugggagagguggauuacaaggacucuuccucccacccgcugugcaagagccaugggcggccgguagucauuuuugaaggaccuggcaagcacuguacaaaucucaaaauugcuuuuugucccccuccccuugccuuggagagaguggcuggcuagugugugugucgucugccuccugaagguucggguaaaggaccagggaggugggcagcccuuugugucaggagaucuggaagcgccuccccucccaccgccuccuguguaaaggaaacagcaggugguguugacgggcgguucacgcaccgguuuuugccaaggagagaaaaaccuacugaaacccaccaggaggaugaguggaaguuucuaaugugcuucauuuuuugauacagcgugcauggcaggcauuugcauucaugacccuuccguguacuugaacugaaaaccugaagaaacuggccaacagauuaggcagccaucaauccacaucagauggccccuguauuuccaagaggugaccugccauccccaucuagaaagccaaccaggggacaggguagcuccuaccaccaacaacacugcucuacccucagauucucuucucugacuccugccuccaccugcuggaggguggccucagcaggagccacaccucucuguuugccugugug

SEQ ID NO: 13453 - RNA, 23469 nt, Homo sapiens
cguggggcggggcugcgggcgggcucccagcugcugggcccucaucggcugggccucgucgaccggcaagcggaacgcggcagcggggcugggccugugcggcggccgccggagcgcuuuggaaggcgcacggggcgaagauggcggcggagcgacaggaggcgcugagggaguucguggcggugacgggcgccgaggaggaccgggcccgcuucuuucucgagucggccggcugggacuugcagguagcgccgcgcggcgggcugugucgggugggccggggacugcugggagcgggcgccuggugccuuaagcccgcggcggccgaagcgcacagucauccccgcucuaccgcggcccgacccaggccucauggucccgggaccgcuugucacgcgucgccugcucggcuugggagugggggaacgcgggccagccccagccaguucugccgugccaguuucacccugccucgcccgcuugcggcgucagcgagacuucgggcgcugcggcagccggcgaggagagggagcgccugggggcguggcugccgcgccgaguaucugcuggaggccgggcugguccgagugagcagcucuugggugaagccccacucgggacuagguggccgcucauuuccacuuccgaaguccagcccgggaguugaccgccgcccagccuuccuaauugcugggagaauaccucuggggugguggcgcaagguuggagcuucuucaccuugcguaguuaacuuaucuguaaaaugggagucucguggaaauugcuguguaguucauuggcacguacugaguauucacuaaauacuugcuaagaagacuuaagcuucacgaggcagggauuuuuguacacugaugaauucccagugccuggaacaaugccuggcacauaauaagcauucgguaauuaacuguagaaagaauugcauaaauauucuuggccagcuucgucuuagguagaugaugacggugaugacuaauauuuauugaguaccuaccaugagccaagcgcuguucugacugcuuuacaugucuuuugucauuuaaccuucgcauuuugcagcugagauuaaagagguuaaguaacuugcucaaggccucacuagcuaccaggcagaagagguagaaguggaacccaguucugucugauugcaagcagacagagcccaagcuuuaaaccaccaugugccaagcacuuuacauaauaugauucguuggauccuagcaacacuaugagguaaagacuagacccauuuuauggaugaggaauuggaagcacagagggcaaagaauuugcucagggucacauagccaguaaguagcgggguuggaauuugaacugagucugcugccaaacguaaauuacuccccaaacauaagaauucgguaaagcaucacaccuagaucacaccuagacacaaugggaagccccuaugcugggcagaaauaaaaaguuucuaccugaaagaccuaaaagcacacaguguugugaccaacagaucuucugucucguuccccucacauuguaguggggaaacugaggaucaugcaugugacuugccuggcaggaacaggacuugaauguaggcucccugagaaugccaguucacuacauggccugagacagcacacugccucccagcagauuacuuuuaucccuugacagcucacugucuccugugaaguuggugacccugaggacagaggccaugucuauuucaucucugugaccucaaugcuuucuuguguuugugcaaagcaagugauuagugaaugccuguccguugaguuggugacagagaugucacaaaugaccaaaggauucccauauuccuucuguauguguaaaccuaagaugcgaguaugcauaaaucuuaauggauuaucucauccagugugcagguuggugagacagguacccccauuucacagauuaggaaacaacuugaaagaaaggaaaaguagcaaccuggacugacuccacaguuccugacuccgggcuguacuggaagcgcuuaagagugagggccuaagcacacuagcagggauggaaccuggcuccucucuuuaccaguuguguaaacuugaacaaauuuuuuuuuaauccucagugcuucuguaucaacuauaaaaugagaugauaagaguacuaauagcauagaguucuugaggauuaaacaaauuaacguauguagaaugcucagaacaaccuggcauguaaaugcucacuaaaugugugcuacuuuuacuagaucacguuucuucauaaaaugagaauaaagagugucuuccaccccagccauucuuacugccuucuuuucaccuuaguggguggaauuuguuucaguugacacgaagacuaacagcugagcuguuaaccuucuggucuaauuuucuuuggcccauggaugcaagcuaccuuguaaguguuggccaugucuguauuccuuugugcucaaaggagaugugcguuaggugaaggccuguuuaagggucccaagguacuaccucucuguuucagaucgcgcuagcgagcuuuuaugaggacggaggggaugaagacauugugaccauuucgcaggcaacccccaguucaguguccagaggcacagcccccagguaagggccagcuucaauuaucgcuacaugaguguuuccagcagugaagaggagcuauuuucugaccagagcguucaggccuggguguguggaccaggucugaaugagaagguuagacugagucaauggguaguacuucccagcaggccucagucauuuccuauacagagaugcaugacuuuuaacugggugugguuuaugguucaauccugggggaaaccacaaaccuacuuuuaagacuuuuacuuauguaguaugaggaaugaccacugcaacucuaaaguuuuuaaguaaaagccaaaaaacuuccuuucaagggugcuauagaugugaaaguuuaggcgaaaugacuuaggaaagcuguuuugauauuuuaggaugcccguuaccuuauuaagaagucuuguacaaaauaaaccuguguaacccacccuuugccaaguugauuagggagaccuugucuuacuagguaaaacaguguuaaccuuugcaaucccauuugcauccccugucgcugccucccacagcacccacagcagauuacuccugugcucugcagagugagacaaugcuggucuuccaggagacaggcaggggugcuuccuguaaaggugucugaaccuuuacagagaguguguaagcagaggugucuccccucucugcuuucgccuuauugcuucuacucucuaguguauguuuuagccaggaaauuuuauuuggguuugaauucaaccccagaauauaaccaacaguguuucuuugccaugaagugguaaauuauguuucucucuaaaggcaacugagguuuaaaauauauuuccucccuucgaagaaggagcacuaaccccagaucucauugcuuucuucuuucccuaacucccauccagagaaaagagguaggaggaaagugaucuuguaacuguuugcacgugcuaaccuaugagauguuggugauggcacaucuggguauuacugcuugggacauguuguuaggguaagugcuguucuugcagcugcuaguagagauggcugauuuucugggguaugagucuuugacagccaccuuaggguguuguugggauguuggcaugucagaauuauagagggggagagauuuaaacuuagucucuaaugccaguuacauguuuacuccuuucuuuucuccaguaaucccaaaguucuauuaaggcagugguuuauuagcaugggcccaggagccugacugcguugguucaaaucccagcucugccacuuaaguaaaagcuuugugaccuugggcagguuacuuaacguuucaguuccucauuuuccucgccugucaaaugguaaugauagugccuaccacaugggagacugaaugaguuaauacuuacaaagcaaauagaacacagcauguguuguuauuauaauuuuaguauuaucauuuuuagcauucauucucaauugaccuguuuuguuuacucuauuccccaacaaguauguacauuuaagaauaggcauaaaaguggccaggcgcgguggcucacaccuguaaucccagcacuuugggaggccgagacugguggaucacgaggucaggagauugagaccauccuggcuaacauggugaaaccccgucucuacuaaaaauacaaaaaaaauuagccaggugugguggcaggagccugucaucccagcuacccgggaggcugaggcaggagaauggcgugaacccggggggcggagcuugcagugagucgagauugcgccacugcacuccagccugggcgacagagcaagacucugucucaaaaaaaaaaaaggcauaaaaguaaaagaaucaaggacauagaguuuaacauuagaacugaagugaguaaaaagacuggacgcacauuugguccaagaggcauugcuuuauugcucugguuaaggcucagacuugguaguaggcuuagaaaagaacugaagacaagaaaaagggagggaggagggcgcaguguguugcaugguuuguccuuguugaggaggaaagcaaaugcuaggacuacauucucaggaaaaaccaaacuugugcuagcaccucagaggaauucuguguggggccugccucugcuuugaccuggcaguugcaggacacuuagccagcugcugcccucucccaucccccacuuuugacuucucacauacccuuuuauguugucacugcugccucagagcaacacccaacucuagaauaaggauucuuaauauggagcccgagaacccuaggaggaaucuaugaaaugagcgugagaaggucucuauuaauaccugaaauuacaggcaaaaguuuguguacauguuagcagguaucuuuuguggcaagagaguccauggcuuuuaugagauucucaaagggcugacagacauaaaaauguuaaccauugcuauaggagacaguuuaaacucaguaauaacagcugccauuuauugaguauuuacgagugaggcacugaguuaagcuuuuacaugaacaucuuuuuaguccucacagcaacccugugagguuaguacuguuguuaguacuguuagcacugagguuaguacuauuccuauuuuacagaugaggacacugaaguuggguaucuuuccaagaucacagagcuaguaaaacaaggauuuaaguguagggcuguuuucuacauucagcauuucagcucucagccccaacaauguucugccucuucuuguggacauucaaaguccuccagaguuuacccuuggacccaccuuccuaaucugauucccuuuuccucauuucuuaaauccuuuguuccaaccaaacugauuucuuuggugcucuaauucuuccuuauuuuugguucuccugcuuuuguuugagccucucaccugaucaggugugcccgcucucuugcuuucugccuauacaaaucccaugcauccuuccauguuuaccuccauccccacucugcugagcguguuauugcuaacccugugaccaggcugcacgccauaauucuguuccacagaacuccagucacaacuaucacuccuucaguucuuugacuauauccauguacuacuggguggcaucucucccacauugcccugaacucuuuuccugauauuuaacuuaauuuuucuccccaaguaaauuguaaauuccuggaagugggacggcuaguauuucaggagcagucaccaaagcucugccauguuucucaccuguguucucuucugauacuguucaacagcuuugaaauagguaaggugcuuaccauuucgcuggucaggaugcuaauucuuagaaaggucaaguaacuuacagcugcuguuaccacagauucaaggcgaagucugccuaaguccaaagcugcuucugcugccacaugcuaccucccugccagcaccucccaccccuguaugcagggucaagcaagagguaacaguuucuuccuuuuuuccccucuuucauccagcaaaaguuguacuuuaaacuuccgggaacuacgauugucugauucucuaaaauuacacgauccaacaagguagcuacuagcuauuuaaauuaauugaaauuaaacaaacauuguuacucguuuucucuaaccacauuucagaugcuuaauagccaaauguggcuaguggcuucucuguuggacagugcagauagagcauuuccaucaucacagagaggcagagcuaggguaaccggauuaaaagcagaaaaugucaucugaugaaggaguuuugugccacuucaguaugccagaguagccugggagauaguucuaauauugaaaaauugaacuuucugagauauuuagccaauuuguagagaccauaggacaaaaguauugugcaauugcuaauaucccuaggacauccaugccauaagguaacugaaagcauuacuccagacagugguucugaacuugaauauaugucggaauuaccucaggggcuccuuaaggcuagauugcuggauaccccuuccagaggcucugauucaggagaauuaagagggggccuggggauuugcauuucugacagguucacuguaaugcugaugcuccugguccaugaccacacuuugagaacugcuacucaagaguaguacuuaaaugugccacaccaugcaaaagacuuuccgugcaucaguaccccaccugcacacagaaagcccauagguuggugcugugauugucuuauuuacaugugagaaaaugaaggcuuugagaauuuaaauagcauguccaagaucccaaggguaggaggcagaauugggauuggaaucugguacauggauaccagaaucaaugucggauaccaucagagucuggguguaugaguuuugggggaaagaaacaaagccauagcagagcaagugauuugcccaagcaaguguacacacauauauuugaaaguuuaacaacagggagauagaaaauauuuuuuucauagaugcucauccuagccuagucauuggaagaaacuuuaggcugagcauguauggaaaauucccuuugggaagaugaaugaguggaacuaguacucucaggguacuaguacagaucucaucacuuggauccuuuugaaccaugucauaucaagcaucaaggaaugcccggcagacuguucucaggagccaacucaugcagggagcuuguuugcuacauugauugguuuuugucuucucacuucuaguugauggauccucaaaacucuucuguccccugauugucuccuugaaauaaaucuucaagacugaacuggagcuuucuuccuaguaaacagcucauuaaagccucacuaaaccuguauuacucucuguuagucuuuucucacacugcuauaaaaaacuaccugagacuagguaauuuaugaagaaaagagauuuaauugacucacauuuccacagcuguacaggaagcauagcuggaaggccuuaggaaacuuacaaucaugguagaaggcgaaggggaagcaagcacaucuucacaugguggcaggagaaagcaugugugaagggggaagugccagacauuuuaaaacgaucauaucuugugagagcucacucacuaucaugagaacagcaugagggaaauccaccugcaugauccaggucccuccuccaacacugggaauuacaauucaacaugagauuuggguggggacacagagccaaaccaugucacccucuuugucccauauuauauggaagcugcuuuuuuccccuaagaaauacagaauuuuuuuaaaucuugauaaaacuugucuuaugauccuugaaaaacuuaagcuuguuccuugaggacagaucuaaacuagguggaaaguggcaguggaagauaauuucagagagaauuaacccuucucacgcucauuuuuaguugugcccaucccauacaacacugcuuuuuuucuaaaaauaaauacuucuugacuaaccugcagcagaaguacacuggagcuugcuuuuccuccagugcugucacccucguauucauucauuccuacuucuuggcuauguguccuuccuucaacucucuggucucugugcacuguguaugcugcuuuccuauaaugcuacaccaaccccuuuuccccagcagccccaucaccaugauuguccacuaguucuuuggcaguugguccaaauauuucauuuuucugggaagccuuucuuaguuucccuguuacuccccgcugucuguacuacuuaagucuguacucauuuuuaguugugcccaccccacacaacacugcuuuuuuuccuaaauauuaauaaauacuuucuaguuuuuauuaaagccagggcagcuuaaauugggauuccauuuuaccucaugauaggacuuucuaauuuauacucaaucugugugaucuugaaaaaauaaaugccacauuauuuuauguguaaucuuaggggauuaaccuuucuccacauaacguccuccucucgccuaccaaaaauguaaccucagugucuucaccuccuuagcagcuggugaugaggguuaccuuucuuaaugcucccugagaucauuuugcuccuuucugugucuccagugauaauagagugacauccuucagagaccucauucaugaccaagaugaagaugaggaggaagaggaaggccagaggugagucuucuagagggggucagggggacaguucacagggaaguccaggguaauguguaaaucaccuagaacaggaccugguaaacauguuugguuauuguuagccauuacuacugugggcuggucuguguggguuauaucuuaggaagucucuucuacuccuuguagcuuagaagugaccccuguuccguuacuuaauguauuuauugaggaauauuaggggagggaaacaaggaaaagaucuagcagucccacuuuuugguauugacuaaaaagauuugaaaucaguuuguaaagaggugucuacguucccgugcucauugcggugcucuucacaguagcgaaguuauggaucagcauaagugucuuaccagcagaugaauggauaaagcaaaugugguguauauacacaguaggaauacuacucagucuuuaaaaagaaggaaauugucauuuucaacaacauggauagagaacauuaugcuaacuaaaauaagccaggcacagaaacacaaauaaagcaugcucucguguggaaucuagaacaauuccaaucuagaacaaucgacagagugugguuacagaggcagaagugagggcauaauggggagaugguggucaaaggguauaaaaucuuaagacaggaggaauaugguuuggggcuuuuucuuuuuuagaucucuugcacagcaugaugaauauaguuaauaaaacagcauuguacauuucaaaauugccaaguguuaauuucaaguguucucaccacaaaaauuuugaguauuugaggugaugaauaugcuaacuagcuugauuuaauccacuucauauuguuaaagcauaacaucacuuuguacaccauaaguauauacaauuauaaauugccaauuuacaauuuuaaaaaauaaggaaaagaaagaaaaaguuauucauuauauuacaguccauacguaaccagguauccauuuuuugguauauuucuuuccagcuuuuucuuuuuaauuuaaaaaacaucauguaaaaaacagaauaauaggcuuauaaguguauauuucccccaauagacauguacccaucaacuauuuguuuuuaaccuuuagaacauuauaauaaaaauauccauuauggaaacuacagacuaguauaaugaaaaagucuuaaacucaucuacccuuugguaacuacgguugauauucuggcauauuuccauccagucuuuguucuguauauaaauaugguuuugcuggaucaaugcuacaucucagacguuuccccauguccuuaaaauccuucauaugccuuuucauaugcuauaauaauaauccauuauaugggaugccugacauuuagauuuuuuucaauguuuuacuacuguaaauaucagugcuaugaacauuuuuguggauuaauuaaccacauuucagauuuuuuuuaggauaguuuuuaaaaauggaaauaccaggucaagggcaugcauauuuuuaaggcucuugaucacaggcucccaguucugaagccagggcuuugagaucccuuaauaaagacuuuauaguccauuuagcagaacuucaucuaccuggaaugaacaagaaugaacgccagccucauuucauggguuuugguucuccacaggaucugccucggucugucagacauuccuaaggaaaauuguauaauaacuauuucgggaaugcaguuaucucaucauggucagucuuuggggaagugggcugagaaauuacauguguucuauucucuauuuucauuccuauugugaccuucacaccgacucaaaaccuuccuuuuagauacuucuggauauaaaaauauauguuaauuuugggguuucacacuccugagugaaaggcagugucaucaaguacgugaaugcccagcuccuaaaugucuuucucguucuccucccacccagucacguccuccaggcagugaccuuccuuuauuucacauuccgcuuacuuccuugaccccucagcauuucagaccugaaaggacacugguacuguuguccuugucggggccuguggcuuugccucucauucccuggugaaugucaggaaauagagggcugagacuaauuuuuauagguucucaauuuuucuugcuuggggacaagcuguugacuuagcucugaauaggaguaauaaggaggcagugggccaggcugcaugacaacugguuuucaggcccauauaaaaaaguacuaacuuuauuaucucaagccaugccuggccuauugcaaagcccagugugggugucuuggggcuuguauuugagauuggagcuucucugaccuccaguacccuuuccucaggggccacagugugugucacaugaauggcaaggugaggugaggcuugggggagcuccuggugcugugucacaccaccuuaccugugugcauuacucugugcuuguucuuuugcauacaucugcugauuugaaccucacggcucugacuuaaggagcagguagguagggcaugugguccuucccucccguuucaaagacaaggaaagugagucacagaguagugcacuggcuuacccaggacauacaguggcagagccaagacuggagccuagcugcuuguacuaaccaugccagugccaccauuaaccccaagucacuagugguagcuacuucugacuaugacuguagucacugucuccuggagaggagccuggccaccagauugauagucccagcugagacucucuccugaacugauaagcuguuuugcaugcuuggaaugccuuuccccaguuuguucaccugauaaacucauccuuauccucaagauucagcccagaagacacccuuaaaggaagccuuggcuguccuucccacccaguguucccucacugacuucuguugcugcucacacugcauuuuaccugcuugccuccuuccauguguucccaacuagccaguaaauucuuuaaagacaagcauuguacccuuugccucagugugcccagcaccaaccuggcacaugcucuauucauguuuuccaugaguguuucauguuagagguguauuuuguacacagguuuuaugcugggggcucagagagaaguggacagcagauuguuggcccucccaggaagaaaagucccaacgagcugguggaugaucucuuuaaaggugccaaagagcauggagcuguagcuguggagcgagugaccaagagcccuggagagaccaguaaaccgagagugaguauaagggucauugucugugcccacaggacugagauuccagaacugggaaugccaccuucuucaccccgguagugacugauuuuuuucuuuuuuucauuugcuuacuuggucuucugugcggaacacgaguguaguuuaucucacccuuuaacgugaaaccaagauuuggggcagaguuuucagaccuacagccuauggucuagauuggguucugcauacauguuuuguuuggccuaucaaauuugacugacuuaguguuuuauuuuguuuuacuugaauuaauagucaucuguuuuauauaaaaucgggauuucugucuccuuugagaaaaucaaaaagucuuugauauugucuuguacccaaauuccuacauggucacgguuaaugagaguuuaguagcaucuguuuccuuuagccaggcacugccccuuccagcucuuaaccccaauucuggccaccuaauucauuuaccauacugccugggcauguaggcacugagucugauaucagagaaagugcaucuaguagcuaacaagcuugaucaggaacccuguccucuuucuuccucuuaccuaagauauauauaucauuguaucugaguaacccuuguaccauggaccaaccccuuaaauguguaugaacuugucccuuauagccauuugcaggagguggcuaccgccuuggggcagcaccagaggaagagucugccuauguggcaggagaaaagaggcagcauuccagccaagaugugagugcauccaccuucccaugagggaagcuuguggacuguucugccauuuuucugaagggauugguuacauauugugcauuaaccagcagccucugaaagggaaacuaacagagacagugcccuugcugugguucacgaacaaagacgcuuacuggaaaaucaaaggagguuuccugggugcugggugagagagcuggugagaacagguggggaaaggggaugggcaaaugaaggaguuuuuugagcagcccauggaucucaggcagagguacaguguaucugggguucucuagugaugcgaguauagcugaagaacuuggucuucagaccaccagagaagacuuaacaccaauuuuucuuuucuuuuuuuuuaguuuuccucauuguccacuacuuuuuagcccugugcauagggucuccuuccccacaaguguaaucauacacacaauuuugagucuuuuuuauucaauauuauaccacaaacaucuucuuguagucuugugaucauuaauuucuauaauauguuuuaaaucauuuuggguuuuauuccaaaauaaagucaagcaagaagaaaauaaaaauuuuauccuccgaggcagcugcuaaugcauugguuuuuagccuucuagacccuuugcugugaaugugugugggaguuguugugaacagaacuuguagauaacauuuuuaaugacuguggaauaguccaugagcaagauuugccaugguaguuuagucggacacucacggcauaccaagcacaagcaaagcgucgauugagucaccugcccagagccauauagcuagugaguggcacagucaagaugcaaccucagguguccuaaaacaaaaccccugcucuuagucugugcuaggccaccuuccuauucuagguuaaugcuuauuuaguuugcuuguugaguugcuugugcacacauguauauaugugugucucuauguguguuuuaauaguagcaacacugagaaauaguaaaaaccugcuaauuugcaaguucaaauugguaugcuugccagaucccugguaacuguuuacucccugucaucacagguucauguaguauugaaacucuggaagaguggauucagccuggauaauggagaacucagaagcuaccaagacccauccaaugcccaguuucuggagucuauccgcagagggugagugaaaaagcccuccuguaggucccaaaucagugaguggauagcaguugggaaaggaggaggcagaauguuuauuauuugaggaguaaauuguuugaagcagauucagcauaguugagauacggauucauagaucugcuccaaaaaccuuguauguccauuuuuccccuuugggccugaggcagaccuaaguggccaaauaagaaauaggugucggccauggcugaacaaacaagagaaaagguggaggcagacagguagccaccagaguagccugcucccuuuggaggcccagcgauuuuucaccacgggacugagagguuucuucuccccuuuucccaucacugucauuuccaucuucucucuguggaccucagcauggccuuuucuuccacagggaggugccagcagagcuucggaggcuagcucacgguggacaggugaacuuggauauggaggaccaucgggacgaggacuuugugaagcccaaaggagccuucaaagccuucacuggcgagggucagaaacugggcagguaaggggcagcacagguuagagccagacucugucaaucacaccugccaagcccagcagacccuguguaucacucacuuugguuauuagcucuuuacuguuuacaaaauacuucaaauuuuauuuguaugggaggaagaguguggagaacauggacuggaguuaacagaccugaguuuauaucucugcuucacuuucuagcagugugaccuuggacuauauagccucaguuuccucaacuauaaauugguacuaauaagaguccauaccuccuaggauuauuguugcaaggaauaagugagcugaugcauguagaacacuguuccauagugagcagucaauguaagcagaaaguguacguaauugcugcuguggcucaguaaucuaggguguucagggaaggugucaucuccuugauggcuuaaggcugaaaugaggauuccaaggggaauaagaaauuacagacucuugccuagccaggccucacaguguguugcucaggaugcagggacacucaggaaccuugcugccccuuugcaggcuggugugccaccauuaugacagcucagcagcucuuauuucuacuuauuuggcccuuccugacacucacucugccacuugugacuuuuucugcauuguguccucugcuacugccuucucacuccuguacccucuacuaacagacauucucuaucuuccauucaaagccucugaugauaucugauugguuaauagucacugguaucccucauacgguucucccaccagacucuuggccagcccauagguaggcugccuucucucaggauccacuuagcuuuggccauggccauggggucaccugaugaguguucuucagagggaacugugcacaugauaggcauuuagagcauagugacccuccuugccaauaugauccuuauuuuguagagagaaagcugaggcucuuggauauuaggggccuuuccuugggcacauggcugguguguguuagagccaagaccccaggccuucugacuggcauuccuuccugcacuccugcacaaugagacauccuuucuaaccuagaucuggcaguucucaaaguagcuacugcccuugcucaccucacuaucuucagagaucaaagcuuggucuuccaacaaccaugcccucugagcuucuggcuggcccucuccuggaaucccuuaccugccuguugaccauucaugccucaucaggagcaagggucagaguucaggguauuagauuuaccuggcccaaaguaguuaagucaucccuguucucaucauuucaucuacugcaucaagggcuguggacuagcccaggacagcuauucucacagagagugucccugucaguugugaugagcuuuauagggcaccuaauuuuuuuuuucuuugauuauuaaaauaauacauguucaucuuaauagaaagugcagguaaagaauaaaagcuguccugaagcuaacacccagaaauaucuggcaaguguaucuuucuucucuuacucauuugcauguauuuguaaacaugcuguuguaucaccugcuuuuuacuuuaucagugaaguauggcuaucauccuuuaucaguaagcuuauuucuacacuuuuaauuauaaugcuuacauaauuuucuagcccauaaaugugccauaauuuaaccaguccuugcuguuaaacauuuaggcagcuaccagaauuacaacauugcagugaauaucucugugauuaaaucuuuguacacuugggcuagacauaugauuauuguuucaaaagggcuucauacuuuuaagaugucaaauugcccuucaaaaaggcuauauuuuuuaugcccaccaccaguuacaagggagggcucagaacuucagaacaccaugcacuuuggguaugauuuuauaauacuaacaggaaauguuucuauuggaaagucuaaccauauuaugugugugaaacucugcaucucagaaaauuaaaauaucuuuaaagucuauuuuagcaugauaggaauaaauauuaauguggagaaugagcacaagauagaacuugauaucaccaugauguuuaucaacaaaguguucacugccaguuccacuugcauuuuauuucaguucuggcuuuuuaugaaaacuuagcuuaaaaaaaaaacagccacaguuuuauaaaguuaagugagaugggacuuuagcuuuucagucuaaaucaggacagcugcuuuaguuuuucucauaaauuuuacuauguuuuucauugucuugugaaccaaaaugaucagaagccaaaagucuugaacuuuucuugaaauuuuuccugaaaauuuucucagauuugcuucaaaaaucagucaguacugggcuuuuucaaaaucuuaauuaucugggaaaauacuucaagugaaugaauaaguugucucaguuaaaauauuuugagaaaauucaguuguauuaaauuuuuuuuguuguuuuaguaaaaggcaaaagauguauacaaucugaagagaaaccggagaauuuuguuguuguuuuagguuuuacguuaguuuguuugaguugggagcugaucugaagguucgaauugcaaacagcaagagugcacuugggaggaggggucacugcugcuggaagugagcuuuagcugcucccgugccuucuguagugguuauuuuuguggagaagauggcuggucucaggauuuguaacuguggcaagaaaguaccuagugccaguuuauucccccuguaaagauaggaggaguugggugauucgggcucuugaauugagacucauuuuccccauaacuuacgauguuugcagggagacaccaaaaaacacuauuuauagacgucugcucuaaccuuuccugccugugaaucaagcacccucacagcugcagauggccagccgcucacugggagcaguagcccagcuguuggcaguucucaggaagagcuggcaggccagcuccuuugaacagaugcguguggcugcccugcgggaugauuagagcacuauggaacuaauauucuuugaaugaugugcucuuauuauuugaaaaaucaggaggccuggucuucagguuuccccuccucuuccacuccccauccuccuugagagcaguauagacugggaaugccugucaggugaccuuccacuuacagcccauggcagcugauagcauuucuagucgauuuugguccagaauugaggcaaauauaaguggggcaggaccuugaagaaugauauaauuaguuagucgaguguuuuauguuguuagcuaagcgcuaugcuaaguauuucauuuauuuuaucuucuuuaauccuguuuuaauccccauucuacaaagaaggauccugagacuuggugagauccauauugcuggccagugcagagcugggucccuccagucucugccuuuaccugccaaccugcauagcauccuggauauucuugcauagccacauagacauuuguuuguacuuuuaguauguguuggguacagugcauguuuuuagcuauuuucucaaguaucugggaaguuuuaacucuguuuuauugaugaggaaacugggucuugaaauccaggccuauaccugucugaguguaaggcccaacaggagagugggacagugugaagagcacaggauggagagccaaauagcucggauuguauacugccucuaccgugaaccaacacugggauuuugggcaaguugcuucacccugcugugccucaguuucuucaucuguaaugaaucccuaccucauaggcuggggguuaagccuguggguuaaguaaguuaauacaugugaaguacucagcacagggccuggcuuaggaaugggugccucauaaauagucaccauguuuaucaggccacccugccucaccuaauuuuuagggaguguguaagagaaacagccagucagaagcuacacagccaaguccaggcaucaggcuuuccucaucucuuccagugaugacccaccagcagucugcaaugggacgugcugggaagcaaacccaaacagcagcugcuuccuuguguggaggauuuccuaaauaccaggccuugcgugcacauuaucucgucucauccucacaacagaacagcuccucauuuuacacacaaagacacugaagcccugggaaguugugacuugcuuaaggccacacugucuguuuagaggcagagcagaggccaaauggugguggcucagcuccaaagcuugugccauuucucuggcaucacaccaacucuccuugauaauagggacaguagggacugcuuccccaaaaggcguggagcugugguaaggagaguaucuccacuuuauagaaaaggaaauugaggugccaagaugcucaguaacuugcugagggucaucagcucauaagugaggagugaaacucaaggagaaguuugagaaagcauuuccaauauaaauauuauuuuucuaaaaccaucguaauuguaaagcuugacaaaauccuggcuggugggaauacacagaauauauacugaaaggaggcuuguucauugcauuaguuuuuaaaaaugauccauagcguguguguguguuuucucaucuauaaaauggagauacaccccucucagaggaugguuguggugauucagcgaggucguggcugugaaagccccuuuagacaauaccugcacagagucgguguaaaugucacuccuguuuuuucugcuccccacccccuuaacugauaucagcuauuuuggcuuaacagcuucuuucucaucuuaggccugccugaaaacguuauaguucccuuucuggcaggcggugguuucaaugaguacguauacuuugaauuauuauaaauaguugagggacaggcugccuaaagucuaauuggagaguuaaccuaaugucugugaaacuaaugaacaaaacgagauaguguagaucaggaauguccagucuuuuggcuucccugggccacuuuggaagaauugcuuugggccacacauaaaauacacugauacuaaugauagcugaugagcuaacaacaacaaaaagcaaaaaaaaaaaaaaacucauaacauuuuaagaaaguuuacaaauuuguguugggcugcauucaaaacuguccugggucgcauacggcccaugagccaugggugguuggacaagcuuggugcagagcuuaggcauuuacagguauaugagauuuaccuauucacuauuuccaaucaacucuuguggccuaucguagugucauuuaaacugugugucccagcccacacuuuuugagucccacaugcuuugaggcugaugcagagaagcagcuucucuagugcuaguaaugugggugacauucuccucugagcucuacuuuguaauucuguaaguccauguuuuucacauucacagaaaagaguaaguuugcuuuucagucauucuuuaauuauaugcuucagggcaauauuuaacugugcaaucucucaaaaccuuuaaugugccaauggccucugaagcugcuaguguaauauguggccuuuccuacaccuuccuuccuauggaacacacuuuggaaagcacuuucaguuggauuugcucucaguaccauuuuuggggcugugaagggggaagaguaaguuacaagaacugaucuaauuagaggcuuugaggggaagcaaaugcucaucuaguggccuuucuucuuugcaaaggucuaagucaggucaucugcuaagagaaagacugggagugaaguggacaggugguuuggaggagagaaggcggcuccauacaguuguggagaauugggaguccuaugugcauuuuguguuugucagccauccugagugcauuaugcaauuuuccccuuuaauccuaacaaaaacugagcaaggccuaugccuuaacccuuuaaaaaucuaauuacuaccuuuguugaaacuaagggugcuugaguaauucaaacccugguccaugugauucugagauaugaaaucuaacacugugucugacaccguguccuguucauuguaugaugaaucccagcagaacccagcacuuaauuggcuuuucagugcccuuuagaacucucuccccugcccucaauaguggauguaugaguacagauacacaugggagugaggugcacuagguaaugcaggccugaaaauuccaucacagaagaagaaucuggauugcuuugccugcauccugccacucaccugccaggcugugccaaggcugccucagcugcagacuuggaacacuccccuccaccacuccauugaggcuaaaacugacccuguucuauuaugucuuccagccuuaugacccugucucucccacccuaggcuguccugcuuuccucccuucaagcccuuguucaguugaagacaccaaggaggaaaaaggccgaguaacuugcccacauuacucaggagcgagggagcuagcaauaacguaugaaauauaugacucaggguuugaagugaauucugcuggaccuguaaguuccauaagggcacgauuuucccugucugggucaauagaucagcagcaccaaacaaugccaggcgcauugcaaaugcucaguaacaguccaagaagggauucccuucuugcuaggggccuuguuucugcuuguguucugaugccauccucucuccucagcacugccccccagguguugaguaccagcucuccagcccaacaggcagaaaaugaagccaaagccagcucuuccaucuuaaucgacgaaucagagccuaccacaaacauccaaauucggcuugcagacggcgggaggcuggugcagaaauuuaaccacagccacagguaccuugcauuguguggccuagcuuauucuaggaguguccucugggccucacgcaaaugugugggaagcagagagccguucuuccuccuaaauaccagcaggcacuccaugcuuuccccaaagcagacacgagggugguaaggacuacaagucugaagccuuaaguucugguccccacucuuccauuaguguggccagugacuguucacuucccccugugugucucauucuucaucuguaaaauuagaguauuagauuucucagggcuuuuuuuaagcuaccagacuucagaggaagucccaugcuaaaguccugugaagacaucaaauuagaacugcugugguugauggaggagaagggggugcagugucagcgucccacucaccuggcuuccuccaccucccuccccacaaggggccugugaaaauuacugggccaggaagaucucuucuagaucuggcugucgagaauucugggaaugccugcuccacaucucagaccaucugggcuggaucagugccuucuucauuuuaaagauggggaaacugagccacagcaaagugaagagacuaguaggagaggugcuagaggacuguugccaguaaauauauuuggugccuccuuucuguagaacagaagugucuaaauguuauuggucaugagccaacuaagccagcacccacaugugggaucagugaauuguuugucagucguugaauauugacugggcucgccugugggugacagcgggagacaagccccagcugugagccaggugcaucuagagccuauugagaccuccuucaucaggaacauucauuacacucaagugccuggugguuaagcgagugacccaucccagugaugugaguuauuugucucaguuucauuucacucauuaagcucagcacacugcugcccauucccaggguggacagcccaugcagaggcuuugcuaggugaaaaagcuugguuugcuaaaagucacaggcagaauccugcagguccaugcccuuagaugugccaaauuguaaguugcauagauuuuagggguuuggggcaaaaaggaaacuuauguuuaagugcucuagggaaggaggcauuguuuccaggugguuucauugucauaugaucuccagguucagaaggcagguagugucuggagaaacgauuccuggcccugagaaguugaccauuaauuucugacagauaguuuaagugccuccugugauauacaaaagagacacacacuguccuugugaaauucaugagcugcaggaggagacacuaaucagaucaucccagaaacguggaaggagggccagggauggagccaaggagcuaaggagggcuuuccugaggagguggcauuggauccgaggccugaguugugauuaggauuacagaaaggggaucaggcaggggagccucuggaaagaaggacccaaaugugggaagagaguauggccugaugaacuagaagcgggcagaagagaacgaggggaaagagggugguauaaaauuagguccuugggaacacaguaggguuguugguguuuaucucaaggaaaauggaaacaacagugaaggacucuuggcaaggaagggacuuggucccacaugccugagcguagcuuucgcuguucuguggagaaagucaggaaaggggauuugcgagguguuuagcuuuccacagggcagggguauggacagcagaggauggcacugcucaccgcuuccccaacuccugcaggaucagcgacauccgacucuucaucguggaugcccggccagccauggcugccaccagcuuuauccucaugacuacuuucccgaacaaagagcuggcugaugagagccagacccugaaggaagccaaccugcucaaugcugucaucgugcagcgguuaacauaaccgcccagccagcugccuggccucccuccuguguuucccauggccaguggccaugccccauggggaucgccccuccugcccccuugugcacacccagcaguccagugcaacgucuccuccauagcucuggguucuuagaucuugguuggacguuuguuuucuccuuaguugcauuuccuggguuuuugugaugaucaauggacuuuaaugaaaaaaaaaauaaaaacaaccaaaaaaauugaaggaauaucac

SEQ ID NO: 13454 - RNA, 61344 nt, Homo sapiens
ugcagccaccagccaaguucuuuccaucauccugggcccucaccucuggcauaggcucuugguagugggggcccagacagggaggcaccugccaccugcuucccuucucagccacccacagcccucauagggcagaaugggacucuugcugauguagguaaguccacagaaagugcuggauggaucaggggcaacacacacacacacacacacacacacacacacacacacacacacacaccagccccaggaguuccucccauuuguucccaucccuggaggacccugggguucaggacagguggaacauaguccuggccuucaggggauucacagccuagugcaagagauagagcucaccucauucuuucaauacacugaugccagugccuauuccaugcuggcugcuggguuacauacuuucuucuucuucuuuuuuuuuguuuuuugguuuuuuugagacggcgucucgcucugucgcccagguuggagugcaguggcgcgaucucagcuuacugcaagcucugccucucggguucacgccauucuccugccucagccuccgaguagcuggaacuacaggugcccgccaccacgcccggcuaauuuuuuguauuuuuaguagagacgggguuucacuguguuagccaggauggucucgauguccugaccucgugauccgcccgccucagccucccaaagugcugggauuacaggcgugagccaccgcgcccggccuggguuacggacuuucuaaggcauggcuuacccccggucaggggugugggaggacagagcagaucgcacuacaacacccucaucacccuucagcagucaccucuagacgcaaagacugcuuucucuaaauuaugcaacucugugccugagggccuuccaggaccccagaagcagcucucagccuguggcagaugcccucaaaugcaauagcucugagacaugccccacacugccucccagaguucccggguaggagugcgguccaguugcccguagagguaacuggcuucaucacacucccucugcuggcucccuuuccuuccugucucacuucccuacuccacugcccccaccgcuauuuccuggaaucagcucccaaauaaaccacucaaaucccugucucaccacgggcuucugagagaauacauguuaagacagggaugaugguguagaagagggaaccaguguucuguaagaugccagcuacaaccaacuguaugcaaagcaguguugaaccaaggggugggggugacggagcugucugcccuguaagaugccagcuacaaccaacuguaugcaaaccaguguugaaccaaggggugggggugacggagcugucugcccuguaagaugccagcuacaaccaacuguaugcaaaccaguguugaaccaaggggugggggugacggagcugucugcccuguaagaugccagcuacaaccaacuguaugcaaaccagugucaaggggugggggugacggaccugucugcccuguaagaugccagcuacaaccaacuguaugcaaagcaguguugaaccaaggggugggggugacggagcugucugcccuguaagaugccagcuacaaccaacuguaugcaaaccaguguugaaccaaggggugggggugacggagcugucugcccuguaagaugccagcuacaaccaacuguaugcaaaccaguguugaaccaaggggugggggugacggagcugucugcccuguaagaugccagcuacaaccaacuguaugcaaaccaguguugaaccaaggggugggggugauggagcugucugcccuguaagaugccagcuacaaccaacuguaugcaaaccaguguugaaccaaggggugggggugacggagcugucugcccuguaagaugccagcuacaaccaacuguaugcaaagcaguguugaaccacggggugggggugacggagcugucugcccuguaagaugccagcuacaaccaacuguaugcaaaccaguguugaaccaaggggugggggugacggagcugucugcccuguaagaugccagcuacaaccaacuguaugcaaaccaguguugaaccaaggggugggggugacggagcugucugcccuggugcagacaaggaguagguacauuugcuguagaaaacguaaaggcaguaacaaaacagaccaaaggccaguccacuuuuuacugucaucauguaccagcaauuugaaucaacuucauugauaaaauucuccaccugacuaaggcugauagcucucacugucccaugcccaccccuugaaagcccacugaugccaagcacacugaggaaagugcaauuaaucaugggcaaagagacgagggaaaccucacucaggaggcaacauugaccuuguaaucccacagagcuagcugcauuccaccaugccuuugcacauacuguuuccuuuuacuggaacaccuuuugauccuuaauccacuuuuuuuuuuuuuuugagacagucucucuuuaucacccaggcuagagugcaguggcuugaucucggcucacugcaaccucuaccucccggguucaagcgauucuccugccucagccucccgaauagcugggauuacaggugccugccaccacgcccggcuaauuuuuguauuuuuaguagagacaggguuucaccauguuggccaggcuggucuugaacuccugaccucgugauccaccugccucagccucccaaagugcugggauuacaggugugagccaccaugccuggccaguacuuuuuuuuuuuuuuaaacacuagacagugagcucuauagggacaggaaccuguucaucugugucuggcccacaguaggcacuuaggaaugggcugccacuaaguaggcaccuuaaguggacacccugcacuaugguucauggcagcccagccuaugaaaguuuauugauggaaugaaucuguagaaauuuuccauaauuggauaagggcauuacaaacagaagggacagagcaagcaaaagcagggaagacugaaagugcagaacuucucaguagaaagggcaaauagcuuuaugccacaggcaguacaucucagagaggaguuccacagccacuagcuuuagugucauccagaauguagucaacauacaugcacucuuccucagaccuucucauccagaaucucugcagaagggguucaagaaucugguugucucaaggaaacuuuaggaacacaaaauuuggagaggcacagggccagcugacaaagggagugauggacuauaaagagguaagagugcccugacuggguuggggcuaggccaagaauucauuccuucauucaguauucauucugucuuucaauaaguauagauugaucccagaaggcacucagguacauaugugcacaagguagacaugcucccuguuccuuugucacagucuaguggaaagacagucauuaaauaagcaaagaaauaaacaccuaacauaguuucagguuaugauuaaugcuuugcaggaaaaaaaaaaagccagagagggauuaaagacgggagaagguuauuuuggauggaauggucugggaagcccucuguugaggaugguaggagugagggaugaagccacuugaaaugaagaagcaagacaugcagauaucugggaaaagagcauuccaggaagaggaacgcaaaggcccaaacagaacacaugaaacagggaaacuggcugggaagcuacugcaauagucuaagugugagaugcuggaggaucagaccagaguggaagcagugaaggugaugggaaguggucagauucauaauauauuuugagaguggagucaacuagcuuugcuguuggaccagauguagaugugagagaagagggggagccaagguuauugcacguauaaaggggaugagaggacaguugaaggagacugaaucagagagguacagggcuggcagggcuggggcaggagauggcagaccacaugcagauuccugcagaccauggggaggacuuuacuuuuccauugagugugacgauuuugagccaacggaugugaucugacuuuucuuuuuuuuuuuuuuucuuuuuugagacagaagaucgcucuguugcccaggcugaagugcaauggugcgaucuuggcucacugcaaccuccaccuccaccucccggguucgauugauucucaugccucagccucccgaguaccugggacuaaaggcgugcgccaccacacccagcuaauuuuuguauuuuuaguagagacaggguuucaccauguuggccaggcuggucucaaacuccugaccucaagugauccgccugccucggccucacaaagugcugggauuacaggcaugagccgccacaccuggccgaucugacuuguuuucuaacagaaucucucugguugcggagugcaguacagacuagagagagacaggaauggaauggggcaguucugaggcugaugccaggcauccaagugaaagaugacaggagcuugaaccagguuagugacugggauggggaaacuaaauuuauuuggguaaaaacaauaaguggauuucaugaaacuuguugaaguaacgggugguaaaaaucauaaaggggguaggcaaauaaaugauugaaauuugauagugggucaggagcuucagcucugcgggcagcaguugugucuccuuggagaagugguuucaacucugagccguuuugucaucugcaaaauggggauaauaacgguccauacuucauagaguuguugagagggugauguaaagguuuuagcgcacgauguagcacacaauaaacacuuaauaaauguuaucuuagaagccagacugccagguucccauaaccauuucagccguucaccggcuggcuguugucaucuuggucaaauuaucccucugcgccucaguuuccucaucugugcaaugaggcacauuaaucguuaauaucaacugcauagaguuggguugugaagauuaaauaaaugaauacaaguaaagcguuuagaauaauguggacgguagcaagcacggcgaacguguuaacgauuauuaagaauguauuuuagccacauuucccagccccuuccccggccuagcauaccccauuuuguggaugggaagucugccucucagcaagguggccucuuggaggacgcugugcccgcgucaggcgauccugucgacugccgccaagacccggcuuccggcuuugaggggccacgccccgcucgcacucccuggcggaaccuuucagugcugcgcucgcguugccaacccggcgcgccucacgcaguugcgcccgcuguugggacuacuuccggcuuccccgccccgccccguccccgggcgucuccauuuuggucucagguguggacucggcaagaaccagcgcaagagggaagcagaguuauagcuaccccggccgcggagccggcucacugcacuacccccgcccccuucuuuccuccagacgccgaagucgcgggcgcucauggcgggccuggagguacuguucgcaucggcagcgccggccaucaccugcaggcaggacgcgcucgucugcuucuugcauugggaaguggugacacacgguuacuucggcuugggugucggugaccagguacgccacggagccggccaggguggaggagggaacugucuucugcccaaacucagaguaccggaggccugguccagagcgcccgauuuccccgcuucucccagugcagggucuggggcagauggcagcguugguaaaaccugcgggucggagguugcucaccugccccaucccagcccagagucccucacggcacagcuggcacaacaugauuuguaaacucaagggcggacacucgcuucaacacagccuggcagccucucaggccaggacuguguggaucuagcauuccauagaauggcaaagaaucuagacaggaguuuagcuccccagagcacuucucacccaccugaucccgucugaacuccuuaccacccagccucggggugaggggacugacucaguuccgcccucauaccacaguagagccuccaccaaacaucuggauccaagcacagguacaggagugagcuuugaccuacucagccccaggccagggcccuuuuuucacccguuagcaugggcccagagaguucacacgccuuucacccuuuacugaagggcccagcauaguccacucgcuacugccauccccaacucaagcucuaggaagcaaucacccccagagucguacacacauacacccugggugugagggucauauaagauuuucuccucauaguuguccccauagggccagccccucuucucccauccccaggcuccaccucuuacagcuagggacgucguugucauccccacagaguucuaggacugcuggacccaacccaccucacuaauucuuugcucuggcauucuucuuucuuuccugucucuucccugugacccucauccccaacauccacaucauccuagacaucugcuuccugggagaagugggccugccuccaugccugccccucacugucacuguucucucacucucagaaccaagacuagccaugggaaacagaccaccccaccuauugcaucuugccaugagauuucacccuuccucuccuuuuugacugcuucaguucucaacuccucuaaucauuuuuuuuagcuucucaaauagagucuuaauucuccccuccugacauagcuuuagggaccucucuucaaacuugcuuuguacauucugagcacuuagacaaguauccccuuucccccaccccucacugcugucccuauuccucucugucucuuagaacuaaagaccaagaccaccauaccccucucacacuuuacccccuccagcaggaaucagaacacaagaaccgucagggauuucuggcucuuuuuuuccccagaccucaauuaucucacugggaccccagguacacacucaggauccccauucccaccuccaaacucacacauacuucaucucucaaaugggcucuaagacuagauaugaggauggaaaagaacagcuagccuuucacacacacauaccuggaagcaggaaucauuucaccuucccaaacacaucugucccugaccuuucucuuugugcugcucuucauuccacauaccuuccaaaugucuuccagcauuucagaccuugggaccagguagagacagcacccccauuucagcgucaggccccucuuucaaugcauaguuccccuaacagaaaucuugucuccccacuugucuuacuccagcuuuuuaaucuuaagcagcucuucacuugccccagucauuuuauuucaacuuuuccuagauucuucaaagaaacugguaugugggauggugcaggggacaguggggcugagaagaggaguaagauuugauuuugaccugggaucuccuccauuggcccucagcucccccugcccuuugucuuguccuucagauggaacagcucugcuuugcacucugucccuccucauguaccucacuccccuuaccuacuccuagcuagcuacuuagacucugccacacugucagaaccccauccaccucugcugaggaacuuguucuagagggcgugucugauacccuucucuccuugccauuccacaaauaaauaucaaucacuguggaucugcuccuacauuucuuacccucacucaugcugucugaaucacuuugacaguuuagggacaugaguucacauaagucgauaccuucuagcuggcauuaccaccuugccauacacucaaggcuccaaaauuuucagaugaaauguacagaaagaauacaaucucauuuuaauaguuuuuuuuuuuuuuaaaaagguccuugaccaauuccccaagguccaucuaauuuuucucuguucauggugcuauucguugagcuucugcaggccagaaaaagaugcugguuucagacaucuuuggggaggcccaggagccuggggaauuagguuuuuguaaggcauugccaccuuuccucuaucuaccccagcacuaaaucuugcaugcccccgaaggaaugaguguuuggauugcaaacuagagugugguguauuuuugcuucucucugccuuuucuccuugauugccauuggggcucagguugcacuuguccuucugucgcuucugcugagucuacuuucauucagaguggaaacuggagaggcaucuuuccuauuaguuuauuuaagaagagguuuaauuuuucagccuggggccagccaacucagcugacucaauuguguuuuccaagcucagaggauauuuguguugccucuccagccaucugcuguuuccacccuucugggggugauaagaaggagaggaaggucccaagaguguaugcuugacuauacaaguugacaguuaaauggaaagcuagauugucugcuuucucuuagguuuugcuuccucuguuacaggggaauuguguacauaaaacuugauuagaaaaccagugcagccacuggcuucaacaaaaauccaauacuugaauuuggauuucuuucuugaagucagaaccacuccucacaagaacuuuacagcuuugucaagugguuugggugccaaggggauagguaagggaugacuuaggugguuaucgacauaaguuagagaauuuuguuuucuguugugggaaaucuaaggauuaugaugaaagagagaaaaugcccaaaaugaucuguuuaaguuucuuugggugaauuuuaguucagaggcauuggggcaaauucauggccauuaaagaaugcuuccagugccaggauuuugccuaagaagacaauuaucuuuauucucuuagggccagucuuguggaccuggcugggaaaaaccuucucuagccauagccugggcaaucaggagcucugaauuccaagcacagcccuacaccugacuugcugagaccuugggcagcucucugaccaucucaggccuuagaguuuucuuuucuuuuucuuuuucuuuucuuuuuuuuuuuuuuuuuuuuaauccgagaugucucacucugucacucaggcuagagugcaguggugcuaucuuggcucacuguaaccucugccuccuggguucaggcaauucugccccagcauccucaguagcugggauuacagguccccgccaccaugccuggcuaauuuuuuuuguauuuuuaguagagacaggguuucaccauguuugccaggcuggucucgaacuccugaaugcaagugaucugccugccucugccucccaaagggcugggauuacaggcaagagccaccgcgcucagccucaggccuuugauuuuucaucagaggaaguuaaaccacgugacuguguacuuaggcuacuuuccaacuguggcuuucugggacucuugauauuugaugucaggguuuacagggcaguugcagaccauguuuggccugauaucgccagggucuguccucuguuuacuggggaacaucaauugcacugcaguuagagauaucaguuucaccugacuucagggauuuucuguaacucuggaagccaaaggugaugggguggugagcagaccaaauuguuuauauuccaagagagaacucugguggauugaaugcuguacauggaggauauaauauaaauuuaaaggcguuugccagagcaaagaugaggaugucaucaaauuccuggcuuccaaaguaaacaaauccacgacacuaaacacuaaacauauucgggaaauuuacccaguuuggggugaggggauaguuucuuuuucgcagaagaaugguuugauuaguuuuacuuuuguuuuuccucacucucauuucuaugcuucaggccuaugaauuucauugucauccagccagguuuuaaaccaugacaguugcgacauccugaauuuuauuugggaucucuuuccccagaggauuucugagcaccaggggugacgaaacaggagaggccagcaauucucaauguguggucuccccuuguccuuggugugugaaguuuugcuuugcuggaccuuugucuuuuccauuuucuucaucuccggucccacucccucccgcuguauucucaugacuacagaucuucccaguccaccugccccauggugagcaauauaaauauacauccaugaaaaaagauuauagcauuuuuuugugcuuuuuaaaauuuuuacauaagugguacuggaguguaaaccucauuuuuuggggaacuuuucuuuaaaucauauuuuuucuuuuauauauaauacuaucauuagaucugguuuauuccuucugacugcuauauaguauuccacuauaagcauauuuugcauuuuaucuccacuuuugcuaccuuagccaaggcuauaaugaagauccuuuguuauguacccugugcacaggguuucuucugggaguagggauuuuggaucauaggauauuggcucaucuaauugcacuaaaaacugucagauugcuccccgaaggggcugugcaaguuuaaaugcccaccagcagggacuggagguucccauucuccccacaccuacacagacaucuggcaaaaaauagaaaacuggguaauaacaguccgaaucauguaacuuagugucucauuauuucaguucugcuucucugauugcuaguaaaauugaauaacucuuuagacacuauuagccgcucuuuuucuuguucauaucuuuugccacuuuuuggaguucccaauuguuauuguucauuuuccaggcauucccuuuauguagagguuauuaauuucuuuccuuugcagccauggcaaaugucucuuccuagccuguggcuccuuauuaauuuaguagugucucuguagaacagaagcuuucaauuaugaacagugucaaaggcagcauuuucuuuuauggaucuuguuuaagaaaucuuccccaccuagaaaucacuauauuauuuuuccuguagaaauaauuugagaacuauuucucaaacuuuaguauggaaagucuuaggauuuuuaaaaaagaaaagaggaagacaucacaacucacaauaaaagauguauuuuacacccaccaggcugacaagcaugaaaauggcaagcauuuuaccccuacuagauuggcaagcaauaauagcaauguugccaacuacacggagcaacaggagcuuucauacauugcuagugggaguauaaaucaguaacucuuuagaaaacaacuugacuuuaucuuauaaauuaaaagcuuuuccuccaugcauacuguauagaaauuuauccacguguaccagauguguacaagaauguucauagcagcauuguuuauaauagcaaaacaaauaagcuggaaauacuccaaaucaccaucaacaaguagauguauaaauugcagcauagucauacagaaugcuguguagcugugaaugugaaucagcuguaguuaaaugcauugacauggauacauuuccaaaaacuaucaaauaaaaaaggcaaaugacggaagugaugcuguguauuuaaaauucaaaaacauuugaagcuauauuuuuaugguugcauguauaguaauauaacucuaaggaaaaguaaagaaauuguuuaagaguggugauuacccuugaaggggaaggagggacauuuauuggaguaugcuacccaaggcuuuagcaguauugcugauguucuauuucuuaagcuggugguagagacauuuuauaauucuuuguuauuuguacaugugcuacauuuuguguauuaugaaauuauaauuuuuguacaucacugcagucaguuagcguguauucggaucuguguuuuuagucaacaccuugguaauccuauugaaguuagccuaacguccaaacuuugaaaaacacuacuuagaacuucgcaguguuccucaagaugacuggcuuuauucuuagcagugggauggggaagagauaauuauuaaaccaacacugcagauucuugacagguuccagugcugugucagaaagguagcucaauaugagggagagcgcaguagaacagaagcccagagaccugggcccuagaccucucucucgcuguaggaucuugggcaagucauuucucuugaccuccacaucuucaucugugaagugagguggguaagauuagcuuaucucgugagguucuuuauaguucuguguuuugaguucaugaucuuucuccucucaacuguggucuucccagccgggucccaaugauaagaagucagaacugcugccagcuggguggaacaacaauaaagaccuguauguccuccgguaugaguauaaggauggguccagaaagcuccuugugaaagccaucaccguggagagcagcaugauccucaaugugcuggugagucucugggacacgugagucugcugaugagauggggauaggaauggcuguuuugaaacccauuuaacgguacgaauccagagcuucaauguucauguagcccuuaccuagugaucccacuucuggaacuuuaucuuaaggugagaacccuaaguauagaaaaccuucgugcacaaagguauccaccaccuggaauuaagaaggaggggcuuucugucaacaggggaaugguuaaauaagguaaaucuauucagugacaagauagaagggaaaaacuuagguaaccccaaugggcuacuucaguuccuuaaauaaauugaauucuuugcugccuuggagcccuugcacuuuacauuuccuaugcuggaaggcucuuccccucccccaucugccacucacacagcccuucaccauuccuucauccuggacaauucucuuucauuuuugacuuccucaaaaauuucaguucugacuacccaguccuacuccccaaaaaaaucuaaauuaugucucuuuacgccaucauuuuauuuuccugccugacacucauugcagcuuguaauuguguacuuauuugugcuuugcuuuuauucugccaugggacuauaagugccacaaggacagugacuuuccuuuuguuaacuuuuuucuuagugguuugggugugaccauguagaaguauccugcuguauguauuauacugcacuuugcuuuuuuuucacucgguguuuuggaggcaagaccuugacauggaaauacauauagauauaccuuauuuguuuuaacuauuauauaguuucucauagcaccauaauuucuuuauuccuuucccuuuugaugaacauuuagaucucgugucagauaggguucuugguuucaaacaacaaaaaccucuuggguuaguuuaagcaaaaaggguuuauuaaaagaaccaggaucacccaggcgcaguggcucgcaccuguaaucccagcacuuugggaggcuaaggcagguggaucacuugaggucaggaguuugagaccagccuggucaauauggugaaacccugucucuacuaaaaauauuuuuaaaccuuagccgggcguggucgugggugccuguaaucccagcuacuugggaggcugaggcaggagcaucccuugaacccaagaggcagaguuugcugugagcugagaucgugccacugaacuccagccugggcaauagagcaagccucugucucaaaacaaaacaaaacaaaaagaaccaggauagcucauugaaacagguuuaaggcuagguuuccagaagcagugucccaaaucaugccccggaaaccacugcugccaccaccacugcccaguauuagauacuggcugauucugucugcccuggugcacccuucucuuaagcugcugaugugacccccuggccucugugcuacccucauuagcaagaugucugccccuugcugggucugcaucuccguguugcucaccugcagaucaaaguugaugcaucaguucaacaccucaauuaccaugccugagcccuuuugcaaaagagccugggaaguagguguuuuagucucugccuuggaaaggcaauauuccuaaaucagagaagucuccaagccuuaggaagguauuucauauaaacaguccuuauauaugucucuguggacauaugugaauauuucuuuagguugaagacuuuguuacucucccuucacccucccacucuuagccagaaauaucccagucucucacuuucuauuuucacccaucuaggaauauggcucacagcaaguggcagacuugacccugaacuuggaugauuauaucgaugcagaacaccugggugacuuccacagguacuucuaaaugaugucucuucccugggaaaaagaagagagaacuaauggcaagauaugaggaauaggguggauguguccagaaaauuaaggaaggugaauggaagaaccuuuuauuucugggcacaacuuccuaauuuucuuuucuguuuuuuauguauuugaagaggagacuuccauaggaaaugccacaugaaacaagauggugcagucaagaguccacaagugcagugguggcugcagaguagagguggagcccgggcaacucauucagucagagcagacuccugggaggaugugugccucauuggguccccaaccccaaucuccaacuuauuuaaaaaaaaauuauuuucuuuagggucguuuuagguacaagcaaaauugagcagaaagugcagagcauucccauauuaccuccugcucccauacacccacaguuuacagcuucccugugucaauaucccauacauaaugauucauuuguuacaacuaaugagucuacauugacacaucauuauuagggcucaagcuugcuguugugcagucuguggguuuugacaaacagaugagaaugugugucuaucauaguaucacacagaauaguuugacuacccuaaaaaucugugcuucuccuauucuucacucccuuuucccuaacugcuggcaaccacugaucuuuugacugucuccauaguuuugccuuuucuagagugucacauaguugguaucauacaguaguaugauucuagaccuuuucagcagauagagcuaggaaaauuuuuccuuauaaguuuaaauugccaccucuguuuuuaauauaacacuacaggauucuuuuucucuuauuccauacuuauaucucccuucuccuguggugagaacccugauucccagcagcaucaauguauuuacuuauuuauuugauccuagaauacacacaaauauuuucugaauugcuacaucagugccuaccaagaacaaaccuauuaaguaaaguuccaaaugacuuauuuccaguucuuuuugucuuuuaacuauguuccacaaaagauguaggcagaguaguguguuccaaagguacuuagauuagugcuuguuuuuaaaaucaguauaaugaaauuaucuguuuuauauauaguuaagcugauuuaugucugcuuuauuccauuauagggauuuuccccccaucuucauugaccuccucaggguuuuauuuuuuauuuuauuuuauuuuuuugagguggagucuaguucugucacccaggcuggaguacagugugacuguucaagcaauucuucugccucagcuucccgaguaacugggauuacaggugugcaccaccacacccagcuaauuuuugcguuuuuuuguuuuguuuuuugagacggagucuugcucugucacccaggcuggagugcaguggcgcgaucucggcucacugcaagcucuaccucccggguucacgccauucuccugccucagccucccgaguagcugggacuacaggugcccaccaccacgccuggcaauuuuuuuuuuuuguauuuuaguagagaugggguuucaccauguuagccaggauggucucgaucuccugaccucgugauccaccugccuuggccucccaaagugcugggauuacaggcgugagccacugcacccagccaauuuuugcguuuuuaauagagacaggguuuugcuguuggccaggcuggugucgaacuccugaccucaagugaugggauuacaggugugagcuaccgcaccuagccacccucagaguuuuagagugagcuuggcaucacuauaaaugcacaguuaucaaaccuuaaccgaaccucagaacugcccagaaacccuguugcauuuaauaguaucuaaucagcaauacccucuuugaaccuauuccaguccucacagacuuucaaaccacuggccuccacauucuggccacuccucauuucuccuccccucuuccaugcagcuucugugugaggaggucuuuuacauauuccccuccugcaugccacccuccaguguauuucccacgcagcaguuggaccagucuuucagacauagaucagaucauaguuaacaacucuggcuuaaaacccuucagugaugcugcuucacacccauuacgauggguaguaucagaauaaccagaaaauaaacaagcguugucaaggauguggagaaauuggaacucuugugcacucuugggaauguaaaauggugcagccacuauggaaaacaauaugacaguucuucaaaaaauuaccguauaauccugcauguccacuuccgggcauauacccaaaagaauugaaaguaggucuugaaaagauauuuguacacccauguucguagaagcauuauucacaguagccaaaaggugaaagcagcuuggcuguccauugauaagaugaauggaugaacaaaauuugguauguaaauacaguagaauauuauucggcuuuaaaaaggaaggaaauucuggcccgugcuacaacauggaugaaccuugaagacauuauacuaaauuaaauaagccauucacaaaaggacaaauucugugugauucuauuaaaaguaccuagauuagucaaauuuguagagacagacaguggauggugguugccagauacuggggcaagaggggaauaggaaggggaguuagugauuaauggguacagaguuuguuuugcaaaaugaaaagagaucuggagauggaugguaggugauugcacaacaguguuaauguacuuaacaguacugaacacuuaaaaaugguuaagaugguaaauuuuaugcauauuuuaccacaguuaaaagucuuuagggaauacucauugcuguuaggauaaagagcacaauccuugaugaggccuuaaagcauucaccccuucaaucucaccuuguacugccuuccccgcaucccugugcuucagccacagugucauucuucugcccucuucagaccucuucccucugucuaaagugcucucccugaccucacguagccaacuccuguuuaucuuuugguuaccgauuuaaacgucaguuccuuagagaagcuuccucuggcccccaggcuuacagcuucaaaacauuuuaguaaaauguuuuuuuuggagucagguuucccucuguugcccaggcaggcuggaguacaguggcacaaucagcucacuuauaaacaggccaagcagccucaaccuacugggcucaagugacccucccaccugagccucccaaauaauugggucuacaggcaugugccaccaugcccagccaguuuuuuauuuuuuguagagaugaggucuuugcuguguugcccuggaucaaaacaucauuuuuuaagcauuuaauccaucagauauuuuacauuuaccuucuuaggguuggucuucccuccuugccugugaucuccuugagggcaggguuugggugucuucugcaugcaauagacaaagggagggaaggggaagugagccaggccuggccggcagaaugcugcgccucugaggaaagggggaagugagccaggccuggccggcagaaugccgcgccucuggguguugcacacucccugacacccuggccccucuuaguggguaagggagggacauuuggaguguggucucuugacuucuucacucuggacuuccacugggagagaaauugacaaaaccuguggaagaaccuaggaauuauacuggccauucaugcucauuagagcauuccgucuguucagcaauacugaaagagaauugugauccugucucuauuuguuuuuuaaguacauuuguuugagggguuugugugugagggaggggauauguguuguguuuuguuuuguuuuuugauuacugugaaaugagggacacaauaguacuaccucaggguuuuucugagaauggaaugagaugucagcacauagagugcuuagcgcuuaguccagcucuuaguaaaauacacaaaggggaaaaaaaugugaucaccaggagucaucuccguggaaaugggcggugaaagcugagguauggcucugccuccugaucagaggcccugucucccuccuaugccuuucagccauagcuuccuccauguagcccucuuuauuaggucauuguggcaugucuugccucuuccagcaauuugugcuccucagugagcaaacugugauuugcuaagaaauauaaaccuauuguguuccauucugcuguacccuuucugugucggaugagaugguaggcugucuuuugccacaaccaaaauggcaguuguucuuucaaggcuuagaaauugugugagaacuucuccuucaggaccuggugguuuuuuaaucaggccugaauuuuacacaugccuagggagaucagaggccucccucugaucugauuaaaaggaaagaagacuugaauuuacccucccacccagcuugggcaggcaagcagcucauuuuuuacccauggauguccaauggccccaacaucauuuguuauuccuucauugaauuacuuuugaaacuuugucaaaaaucaguugucuguacaucuguggaucuaucucuggaucccuuguucuuuuccauugaucucuaugucucuuccucugucaauauuacucuaucaguauugauuauuguaggccuuaauauugaguagaauaauuccucccacuuuuucuucgucaagguaguuguagcuauucuagguucugugccuuuucuuuuuuuucuuuuuucuuucuuuuuuuuuuucuuuguuugagacagagucucacugugucucaaaaaggcucaggcuggagugcaguggugugaucuuggcucacuucaaccucugccuccgggguucaagugauucuccugccucaaccuucugaguagcugggacuacagaugcgugccaccaugccuggcuaauuuuuuguauuuuuaguagagacgggguuuuaccauguuagccaggauggucucgaucuccugaccucgugacccacccaucuuagccucccaaagugcugggauuacagacgugagccaccgcaccuggccucugugccuuuucauauaaacuuuagaguaagcuuguguauaucuaugaaaaaccuugcuaggauuuugauaggaguugcauuaaaccuauagauuaguuuggggagaauugacauucuugcuaugaacaugauauaucuuaucucuccauuuauuaauauuuagguuuuauuugauuuccaucaguaucauuuguaauuuucaacauauagauccuguacauagcuuguuauuuguuuaaagcagaaagggagaugauuaugaauggcauauucuguccuuuguuuugguuuucaaauguucauuguuaguguguagaaauguaguugauuuuccuguguugaacucuucuauccugucaccuugcugaauucaagguguuuaggguuuuuuuguuuuuuuuuuuuuuugguagauuccuugggaauuucaggguagacuaucaugucauuugcaaauagggacaguuuuauuccuuacuugcuaauaugaaugccuuuuguuuuucuugccuuauugcaguggucaggauguccaauauuauguuaaauaagagugaugagaaagaauaugcuuuccucguucccaaucuuaggagcaaagcauucagucuuucacaguaaaguauauuguuagggguagguuuuuuguaaauguucuuuaucagguuaaagaaguuccccuuuauucuuaguuuguugagaguuuuuaaucuugaauggauuuaucauguuggauuuugucaaaagcuuuuuucuguaucaauugauaugaucauaugauuuuucuuccauagcuuauugauaugguagauuacguugauugauuugugacuauuaaccagucuugcaugccuagaacaaaucauacuuggucauggcauauaguucuuuuuauacauuuuuaaauucaauuugcucauauuuuguugaggauuuuuuuuguguguaaguucauaggauauacuagucuauauauguguauauauauauauauuuuuuuuuuuuuuuugguguagucuuugccugguuuugauaccagaguaauacuggucucaugaaauggauuggaacguauucccuccucauauauuuucuagaagugacuguaaaauugguguuaauucuucuuugaauguuugguagaauucuuccugaaaucaucugagccuggagauuuuugguuuuuguuuuuuuauuuuauuuuuuuagaauguuaaguguaauucaguuucuuuaauggaacuauucagauuaucuauuucauuuuggcugaguuguaguuuaugguuuuuaagaauuggucuauucugaguuguuggauuaaguuguucuuaguauucucuuauuauccuuucaguggcuacagaucuauuguaauaucuccuguuucguucuuguuauuggugacuguguccucucuuuguauuugucagucucgccaggaguuggucaguuuuauucuuuuuuuuugaagaauugacuuuguuucauuuucucucuuguuuuucuuuuuuauugacuucuguucuuaccuuuauuacuucugcuugcuuugaguuaauuugcucuucuuuuucuagguucuuuaggucagaauuuugguuauugauuugaauuccuuccucuauuuugauguaagcauuuagugcuaugagguuucuucucagcaauccuuuaguuauaucccacauauuuucguauguuuuuauuuucauuuuaauucagugcuauauauuucuuuuuugugacuuugauccaaggauuuucuagaaguauguugcuuaauuuucauguauuuagagaguuaacuuuuuguuuugauuucuguuaugauuccauaugguuggagaacauacuuuauaugauuucaguuauuuuacauuugugagcuuugcuuuaugggccaggaugugguucauuuuaaaauaccaguguuuuaggaagccuggaguccugcccacucuguuaccucagccugccuccacaccucagcuguggcucacgucacuugucucucacaggcauagaaaaagaggcccaggcaggaugggacaggugguaggggcagccuuccgaggaccccugaguuagugacagaacuggaccuugaacccccagagcucugccugccuggaacaggaaccugguucauccuccccauggagccuuugccuuccaugacccuucccaugacacgugaugaacacacaaugaagcugagggaggggugaggcgggugaggacagaggaguagccaauccaggcccugugccccuacacccucaccucuuucuaauggggugguaaacaaggaggggcaacucagaugccuaagaagcuugggcccaaaucucagagacagcguggggcuguugccccccucacccagguccagcaggcggccuguucccccacuuauaaacaggccaagcgcaaugccaggagcuaucagggccgccgccgccgccgucguugcagccagaauaccacuuccaggguuccuagccaacugcaagcaguugacucuucaucugcuuccugcaggaccuacaagaacagugaggagcuucggucucguauugugucuggaaucaucacaccuauccaugagcagugggaaaaggcuaauguaagcaguccccaccgggaguuccccccugcuaccgccagagagguggacccacuccggauuccuccacaccacccacacaccagucggcagccucccuggugaguacagagugccuagcgggaagcccaugcuucuguagagggauuccagccagcuauccccauccugccacuugaccccaucccuggcccguauguguuuucaacaaaaugaucagugucuuggggugcauggaguuagaaaguggagacguaaguggagcagugaguucuugaacugcuacuagucacccuaauuacccaaaauccuaagccugccugauuucuuucuaggggccacacagagccccugagucuguccaaggaucagugccucuggggcuuaugugcaguagucuaagguugcugcccagguaauucacagcuaauucauuccagagcuuuuugucuagacagggcccugggccagucuuucugagaaaauguaaacauguagagguacuagcccagaggagaugcagucccagugucuugcccauuucauuucauuguagucccccaaucucacuaucaaguucagaaguuuuccaaaauagcaugggaugugagugagucacauuccaagguuuuugcagauuaggauggcagcauuaggacuggagacuucugcucagagggaggagacaaggaccaggggacccuagucucuagcugagacagcacuucucaguuuggagcccguacugugauaccauacuguugguagggauaagggacagaguucacugugagggacaugaauaagcacuuaauaaauguagacuaccauuguuauuuuauucugguuugcaauuauaugccuuuaguuagcuaaaaaugggaaaucaguuuaauuauuccaaguaaugauuggcguaucucuuuggcaaaaucuuuaccaaaaauauugaguccugugaagagaauggagaauaagaaaaagugguugaaaagguugaaaauggcuugucugauauaucuuauuuuaccaaagggaauagagauaagaugaccugccugaguucgccagccacuaauaaagaggcagagccagggcuggggucuagguguccuuacucccugcacagugcucuggcugugauguaaacagaugugaucuaaccaccuuuccaugguggaaagauuuaagaauaagcccuggucagaagucaaguugggaaaaaauuuuagaccuaaaguaaauaguaauucucagcuuuauuagacccaaugcccauuucaaaacaaguauucugugaaauaucccuuacuauauugaaauggaauucauagguauucuaacuuaccucaugcacauuucagaggaaaucaguauaaaguccuaacuauaacauaaauuagaaaaagagaguaauugauaagaugaugauguguauuccaugcguaggugccugaguacacuggagagcauggauguuuacaccuguauguggaauuaucuugaauucaacagugacaaaggcuguuguauauagauguauuaugucaacaacucaaauaccacaaaacucuguugcuguuacuaacaugacuuuuuugaaaugguaaacagcuguuaggagaauugcaaacaaaauagugauugaauauuguuucuucaguuauaccauaguuacauuccuggaaaaaugugcuuguuuuaaaguaguagaaaaaaauacuuaguguucauauauaaaauggccuuacauucagauaauuuauuuaggcuuuacaccuccaugaguaucuaacaagacauuugaaaauugugugggaugcaggucauucuucauuucgugaaacucuacuaugaauuguagaacauccagcaucucuggucucugccuguaaaugccaagaacgcccuccaacuacuaugacaagcaaaaaugaccccagggcuugcacuauggcaccuggaggcuaugcuucccuauuugggaaucauagacguagaguauagaauugugaaaguaaaaauccuagccuuggaagaacugagagaaugagaaaaucaccauguugcaacuucugcugaaauaauguaccuagucacaaauugucaaugguugauaaaacuauuaaguaaaggucgauaggggacuuuauauuagguggaucuggcgaguagcaucugaacccauugguuaaucuuaacgcuaaaagugggauagccagauacuguuuucuaauauuaugcaauaguaaguucacagcaaccucaaucuagaucuaacucccaguuuaaaaauaugaaggacagaagaaugagucaaacaggugcaugaggauacaacauccaaaauuggaauauggaaaaauuauauaggauaaauugaccuuguuuuuucaacaaauaaauuaaucgcauggggagaaaagggagaaaaggaggcucuuguggaaagagucauaccaacuaaaaugcaguguuggaccuuguuuggaucuugauucaaacuaauucaaaaaauuauuuuucaaacauuuggggaaauuugagcauugaccagguauuagauagcauuaugaauuacugccaguuuuguuaggugaaauaauucugcuuauguuaaaaaaagucuuuaucuguuagagauauacauugaaguauuuaaaggugaaugauaugucugggauuuacuuuaaaauaauuucagcccccgccaaaagaguaagguguuggggaggggaaguauaaguaaaauaagaaugguggacuauugauaauuauugaaguuaggcgggaauacacacaggaacucaugauacuauucuuacuauuuuuugguauguuaaaaaauuuccuuaauaaggaguuuuuauuaauaccaguucuucacauaguccuccaaaaaauagaagaggagggaauacuucccagcuucuucugugaagcuaguauuauccugauaaccaguaccaaagacaugacaagaaaacuacaagccaguauccuuuaugaauacagauaugaaaacccuuaacaaaguacuaacaaaccaaauccagcaacauauacaaaggauuauauaacaugaccaagugaaauugauuccaggaaugauugauuuaacaucugaaaauaaaucaguguuaagauaccauaucaauagaacaaaggaggccaggcgcccgguggcucaugccuguaaucccugcauuugggaggcugaggcacaggaaucgcuugaacccgggagguggagguuguagggagcugagauggcgccacugcacuccagccugggcaacagagacugcaucucaaaaaaaaaaaaaaaaaauacaacaaaggauaaaaacuacauguucaucucgauagaaaaauagcauuugacaaagucugacacccuuucaugacaggagcauucaguuagccugggaaauauagugagacccugucuuuacaaaaaaaauuaaaaauuagccaggcuugauggcauauaccuauagucccagcuacuuagggugcugaggugaaagggucacuucaaccugggaggucaaggcugcagugagcugucaucacaccacugcacuccagccugggcaacaaagugagacccugucucaaaaacaaacaaaaaaaaacaaaaccaaacaaaagcaaauaaaaaaacaacaaauucagcaauaggaggggccaggcauggugguucaccccuguaaucccagcacuuugggaggccaaggcagguggauuauuugaggucgggaguucaagaucagccuggccaacauggugaaacccugucucuacuaaaaauauauaaauaaucugggcaugguugugcaugccuguaaucccagcuacucgguaggcugaggcagaaucgcuugaaccugggagguggagguugcagugagccgagaucacgccacugcacucuagccuggacaacagagcgagacugugucagaaaacacacauacgaaaagaacaacaacaaaaaacaacaauagaagggaauuuucuaaagccaauaaagagcaucuacaaaaagcucacagcugacauucuccuuaauggagaaagauggaguguuuuccucuuaagauccggaacaaggcaagcauguuugcuuuuguuuuugccacuuuuauauaacauuguacuugauauucuagccagggcaaucacucaagaaaaauaagggguauccagauuagaaaguaggaaguaaaaauaccucuauuugucaaugacgugauaucuuguauacagaaaauccuaaggaauccuccgaaaaacagaacuaagcaaguucagcaauguggcaggauauaaaauugauauccuggcuaacacggugaaaccccgucucuacuaaaaauacaaaaaauuagcugggugugguggcaggugcuuguagucccagcuacucaggaggcugaggcaggagaacggcgugaacccgggaggcagagcuugcagugagcugagauugcaccacugcacuccagccugggcaacagagcgagacuccaucucaaaaaaaaaaaaacgauaaaaaucaguuguauuucuguacauuagcaaugaacaaucuaaaaauuaaugaaauuaucccauuuauaacaacccccaaaagaauauaauacguaaaaauaaauuuaacaaaagaagaauugugaaagauuugggaaagaauuguguaagauuuguacagugaaaacuguaaaacauuguugaaagaaauuaaagauuuaaguaaaggaaagacauucugugcucacggcuaggaagaauuaauauuagccauacuccccacuugaucuaccuauucagugcgaucccagugaaaaucccagcagguuuuggguuuuucccccccagaaauuggcaagcugauccuaaaauucagguagaaaugcaagggaaccagaauggcuaaaacaaucucaaagaaaaacaaaguugaaagacuuccagaucccuauuucaaaacuuauuacaaagcuucaaucaucaggaccguguggcacuggcauuaggauaaacauauagagcaaggaaauagaauugagagucuagaaauuaacccauacauucauagggaauugauuucagcaagguugccaagacaauuuaguagagaaaccauagucuuuucaaauggugcugggacaauuggauaucuacaugcaaaagaaugaaguugggucccuuccucgauuaccucuaaaugaaucacacaccugaguguaagagcuugaacuauaaaauuucuagaccuagaaauaagucuaccuuggguagucuuauucccugaccuucaguuagacugugguuucuuagacacaauaccugggagguuaaaagcacaagcagcgagaaaaaauagacaaaucaaacuuugucaaaauuaaaauauuuugugcauaaaaggauaguaucaagaaacugaaaagauaacccaaagaaugggagagaauauuugcaaaucagauaucugacaagaagcuuguauccagaauauauaaagagcucuuacgacugaacaauacaaaagaaaacucaauuuuaaaauguucaaaggauuugaguagauauuucuccaaggaggauguacagauaguccaugagcacaagaaaaggugugcaacaacauuggucauuagggaaauggaaauccaaaccaagaaauaguauuauuugcaauagccaaaaaguaagaacaaccuaaaugucuaucauuugaugaauagcaaauaugauauaugcuuacaacugaauauggauauuacagcaauaaaaaugaaggauuuguuauaauguggaugaaccuuuaaaacaucacguuaagugaaagaagccagucauaaaagacuauauaugauuuauuuaugugaaauguccagaauaggcaacuuuauagagauagaaagcagauuaaugguugccaggguggagguggaagaugggaaagcaggaaugaggagagacugcuaauggguaccagguuucuuuuuggggugaagaaaauguucugaaauuagaacauuugcauauucugugaacaucuaaaaaccaugcguuauacauguuagcugguugaauuuuauaagugaaauguaucucaauaaagcuauaaaaaauggguauuuuacaaaaguccuagacuuggguuaauuggaaacaugaauauauaaugauagaaauuauuuccuucagaucaaaccauaguccaagagaauugauaauaacugcccaugacuggggcuuuuuuuuucuuuuuaauauuuuuucuucagcugaagagugguuuguuaguaccuaaacaauauuuuaaggacucaucaucauaccagcaaacgugauuuauuuaaaauuagcuacugaaugccuucccccuaaggaagaaggcaaggauaaccgcucugaccacucuuauucagcauaauacuagaaguuuuagcccgcacauuaaaacaagaaaaagaauuaucauacagauaaggaaggaagaaauaaaccaguuuauauaugcagaugacauaaugaucuacauagaaaaucccaaggaaucuaccaaaaauaauaauaaaaauaaguuugaccagguugccagauaccagauuaacauacaaaaguuaauuguauuuuuauauacuagcaauaaacacguggaacgaaauuuaaaauacaguacuguuuauaguuguucaacaacuacucagauaggcugggcacaauggcucacgccuguaaucccagcacuuuggaggccgaagagggcagauuaccugaggucaggaguucgagaccagccuggccaaccaacauggugaaaccccgucucuacuaaaaauagaaaaauuagccaggugugguggcgcacgccuguaaucccagcuacucgggaggcugaggugggagaauugcuugaacccaggaggcagagguugcagugagcugagaucgcgccacaccacugcacuccagccugaacgacagagcgagacuccuucccaaaacaaaacaaaacaaaaacuaaaauaacucagcuauaauucuuuuuuuuuuauuguuauacuucaaguuuuaggguacacgugcacaacgugcagguuaguuacauauguauacaugugccauguuggugugcugcacccauuaacucaucauucaacauuagguauuucuccuaaugcuaucccucccuccuccccccaccccacaacaggccccggugugugauguuccccuuccuguguccaaguguucucauuguucaauucccaccuaugagugagaacaugcaguguuugguuuuuugcccuugcaauaguuugcugagaauggugguuuccagcuucauccaugucccuacaaaggacgugaacucaucauuuuuuauggcuacauaguacuccaugguguauaugugccacauuuucuuaauccagucuaucauuguuggacauuuggguugguuccgagucuuugcuauugugaauagugccgcaauaaacauauaugugcaugugucuuuauagcagcauguuuuauaauccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucuccagcagguauaauucuaacaaaacuuguauaagauuuuuauacugaaaacuacaaaaugcuagugaaagaaaucaaagaagaucuaaauaaauggagagacauaacauauucauggauuaaaaaaucagcauaguaaaaaugucagauacuccacaaauugauacacuauuuuaaugcaauuccuaucaaaaaucccaacaagaauuucugcagauauagcaagauacagcagauaauauuuauauggaaaggcaaagaaucuaagauagcuauaacaauuuuuuaaaagaauaaaguagaagaaaucauucuacccaauauuagggcuaauuauauagcuaaaguaaucaagaugguggaauuggcagagggacagacauauagauaaguagaacagaauagugaacacagaacuaagaccagccaacuuuugacaagggugcaaaaacaagucaauggaggaaagaaugucuuucaguagaugaugcuggagcaauuggauaaucacaagcaaaaauaugacccuugaccuuaaccuucuauaaaaaugaccucaaaguggaucauugauuuaaauguaacauacaauaccacagcacuccuagaagaaaacacaagaggaaaucuucagugucucaggcuuggugaagaguucuuagauacagcacuaaaugcacaguguuuaaaaagaugcuaaauuggacuucauugaaauuuaaaacuuuugcucugugaaagacccuguuaagaggauagaagcauaaccuacaguuugggaggcaaugcuuggaaaccauauauucaacaaaggauucauaucuagauaaagaacucucaaaaucaacagcuuaagaaacuauccaauuagaaaauggaaaaaugaaggccaggcaugguggcucaugccuguaaucccaguacuuugggaagcugaggugguuggaucaccugaggccaggaauucgagaucagccuggccaacauggugaaaccgugucucuucaaaaauacuaaaauuagcgggugugguggugcaugccuguagucccagcuacucgggaggcugaggcagaggaucacuugaacccgggaggcggagguugcagugagccgagauggcaccacugcucuccagccugggugacagagcaagacuccgucccccccaaaaaaagaaaaaaauggaaaaaugauaugaagagguaguacacugagaaggauguacagauggcaaagaagcaaugaaaagaugcucagcauuguuagccauuaagcuaggugaaaugcaaaugaaaccacaaugggaguuucacaccuauuagaauagccaaaauuaaaaauagugaugauacuaaauucuagagagagugcagaaaaacuggaucauguacacugcuggugggcaugucaaauguuacagcuacucuggaaaaucauuuggcaguuucuuaaaaaacuaaacguguacauaauaguuagcuccaggaaucacacuccugaacauuuaucucagaaaaaugaaaauugugcccacagaaaaaccuguacacagauguucagaagaguuuuauuuguaauagccaaaagcuggaaauaaucugaugugccuccuccagugaugaauaguuaaaggaaccgugguuuauccauacuguggaauaccacucggcagcauaaaggaaugaauuguugaaacacagcaauuugguuaaucagaguuauuaugcugagugaaagaagccauucccaaaaggucacauauugugugauuccacuuacauaacauuuuuaaaaugacacaguuauagaggcgcuaaacagauuagugguugccagggguuaugagggcagggcuguaggugugguuauuaaggggaguagcaugagagagaucuuuguggugguuuaacuauuagaggaaacugagugaaguauauuggaaccucuugugcuguuuuuccaacccccgugaaucuuuuuuuuucuuuuuagacagagucacccaguguggagugcaguggugcgaucucggcucacugcagccuccgccucccggguucaagcaacucuucugccucagcuuucugaguagcugggauuacagaugccugccaccacacccagcucauuuuuguauuuuuaguagagacgagguuucaccaugucgggcaggcuggucucaaaauccugcccucaagugaucugcccaccucagccucucaaagggcugggaucauaggcauaagccccuguuccugggccccugugaaucuuuaauuauuuaacaauaaaaggguuuuuaaaauuuagaugcugaagagccacuuagauucuuaaguccaugguauuuauucaguucuguguagggggacaguggaucuagcccugaguguuucauaaaggccagugaggccuuuuguccugcucgcucauaccuagucagggaugagcaauggacugggagcacauaggaaaaggaaucugagccuuaccugaaggcuuccccaaggaagggacugaccacuaagcaggcuccuaaagaauaaggaggagauguuagccagacagagaguagggcagaaagggcaucuuagccugaaagccuguccugugcagagcccuggaaggacaggcaguggagcuagagccaggcaggggucguuaaguggguugcugagaccaggucaagcuuccccacuuaggguaagggaaaggauacaauacuccuuaucaggguagaaaauuaccaagaagugaugugggccucaguucagugaaucuuuacuaagugaaggcucugagucuuuggucugaggaggcuuuggggaacauguggauauucuacuaggcccagaaaaugagaaggauaccagccaagcacuggacugcugcagguccagcaaguccugccccaaccugguuuugguuggcagaaaccucugguccucuaucucuggaguuuaccccacuucugacaguaccaccacucaguuauuuuugucugaugccaagauuacuggcuuuuuucaagcgcauauuuucuuugcucuguguuuucacccauugcuuggaccugugcauuguacauuuuuggugaguccucuauucagcaaauguuuuucucuguggguucagggauccuaggguugggccccugcuuuagaggcaugcacuuccccuguggcaugggaaauaggugaguuagagagauaauugcuguuacagagguuagcacagagauacuucaugaguauccugggaaaggcuacuuggaagugcugccugaguugugucuucaccggaaagggaauuauuucuuaaacucucuuucugccuuuucaugugucugaauuacuacguaacagauuuuuuuuuuuuuuuagggagaagguuguuccaggcugaggaaacaguagguuagaggcaucaaggucuaaaaacauggggcugucccugaacuuuagcuggacaaaaaugauuugucuggaauccuagcauauaccagcuguggaggguggggccagauuuggggaagccccugaugugaaguacacgaaucucccuguggacaguuggaaaccacugaaggauucugagggcaacagugccuuuggcuaaagagccugguggguuggagaggaucaggcagaagauugagcuugucccuccuccauaucgcucugaaggaaggacuugguucccuuccuucccugccccaccucuccccccacgucaaggagaguauuuugcggcaauuaggaacacaggcuuugaagaaugaucagcuggguucauacccugagcuuacaccuuucccugucucagcacauuuagccucuugaagccucaguuuucugaucugcaccuugggaauaauuauagcugugucaaagguuuuguaggauugaaugugaucguggauaucacauguugacauucaguaaauauucaguggucuaguaacuggucacuggaaaaaaauauucaguggaugcccauucagguagcuggcaaagaugagaacaaaugugaagguguaaugaguagagggucucucaagagagaaccuuguuuuauuuuuuuuaaauaccuaccaucuuccccccaaaacagauuugauggaggauuaggugugagagugucagcccagagcggguguugggcaaguauuuaggcccaggcccagguccauuauggacauuguuuccguuaucaucaucaucaucaucaucaucaucaucaucaucaucaucaccacccuguguugaggacagaaguaauuucccuuucuuggcuguucaccaugcguuggccugugaaccgaguguguuaauuuaugguugcuuaucuucuggacagcccuacaagaagaucaguggcauccccacuuuacaggggaagagacaguggcugagggagguaacguagcuucucagcguuaucucgcugggagggugagcacugggauuuaccccgaagugggucuaacucagcagcuuaugcuuuucccacugcaccugucagcguuaguucauguaauaagcaaugugguguacaaauucaauguaguguagacugauuauggagaagcccauccccuuucuccuccucaauuaagucuuucugaggcagaucuauuucacaagaguaaggcacugaacuggagagaugguuggaagaggaggcagaauguuuaggaggcuuuuucuuagccucuagcaaauugacagccuaucagaucuccccucuguaaucaccucaccugccucugcccccacucccugcuuauuccuuggccagccccauuuguccaugagcucagauagcuguguugacccugauuucuuuacuauagcucccaucaccaccacuuugcucagcaaccaggcacucacacuuccaccuuuuccuuucucccugaaaugcccaguuuuggggggaggccacagcaggaaggaggcaaaaagcagcacagaagcuggccucucuggcugcugcagaguauuaauuaucccaucacugaacacccuuggcuggcgcucggagcagaaauaucagccucugcuccuucccauaggacacaguccagugucucaccccucaccuuaaacacucuuguuuugccucucucacaccuggaaauuuccaaauacaaacuaaaguuggaauugucugcccuagagcguaaagagacuuguuucccuguguguguagugauguauggcugcagcuugucaaaagauucugggucugcugugauacugggugcgucuaggcuaggaguauagcuagagaggacauuccauuguaguggaagauuggaggugggcaggucuuuucuacuccugagaagucuaggaaagaauuacugaaaacaaccaucuguaaggaaaauauuuuuuuauccagccuaacuuuucauuaucauuauaagucuaaccuauuuccuuuugcuucaucuguccucugauagucaggagacuguaugccccaaauccugcuccauguuuuguaaaaaacaguuuuuucuaugcuuaaccagcuucucuaaaaauaaaucuuuagauauaaagcucuuauuuaugucauucugaauucauuuuuaaucccaaccaaucuguaucuuuacauauuuuuaaauguuccaaauaguuugcauuuugcauuuucuuuuuaaauuucauaauccauuuacuaaagugccaaacauaacucuuuuaguaucugauauuucauuuugcuaguaugcuaugguuuauauaacuucuaugggguaugucaagcauuucuaauuugugauuaauacagcuaugaacaucccuguguauuagguuuuuuuuucuuuuacuuccuugaguuauauuacuuacacuggaggaccucaaacuuuauguucucaggaacccucuagcacucucaaaaauuauugaggaccccagagagcucuuauauggguuauauguagcaauauuuacugcauuagcaguuacaaaugauauuuucaaaauacacauuuauucauucauuuaaaaauaagcccauuauguguuaauauaaauaacaaauuccugugaaaauaucucuucaaaacaaaaaauuuagugagaagaguaacauucuuuuacauuuugcaaaucucuuuaaugucuggcuuaauggaagacaacuagauucucauuucugcuucugcauucagucuguaggggauauguuguuuucauugaagccuuucacauaucaguuguuggaaaaaaagaggacuaguuuaauaaccuuuucaaauaauucuagauauucuuuacuguuaaaccaacuugacgaguaguaguuuuuguaaggguuaguuguaauguggaaucaauccauaccagugaacuuguuauauaucuguuacaucaaaaucugcuggucuaucaugccauuugaauggaccuuuuacccguguauaauacuauuguagaagaucguguauuuuggucauuuggaaaauacugauucacugagauaugcagaucugcucaaaguugacacaucuuauuauacaauaucauugcuaauuuuugcuugaaaacuugaauuuucucauuggcaguaaauagcauucauuauuuuccuugaaguaaugggcucacauccuuuucgagaaaauguccgcuauguagccaaguugaauaagcaugguuugucauucuuucaaguaaaaacaaaaaacaaaaaacuguuuucuuugaaaaaaugacugcuucagccagcagcuugaacaacugcacaaguacuuuucaucaugacaacauugugccucugugugcaguagaagugcuuuaugcaaggccaggugugguggcccacaccuguaaucccagcacuucaggagacugagacaagugaauugcuugagccuagaaguuugagaccagccugggcaacauggugaaacucugucucuauaaauuagcuggaugugguggcgugacccuggagucccaacuacuugagaggcugaggugggaggauugcuugagcccaggagguggagguuguggugagccaugaucacaccacuguacuccagccugggcaacauggugaaacucugucucuauaaauuagcuggaugugguggugugacccuggagucccaacuacuugagaggcugaggugggaggauugcuugagcccaggagguggagguuguggugagccaugaucacacuacuguacuccagccugggcaacagagcaagacccugucucaaaaaaaaaaaaaaaagugcuuuaugcccguuucccacuucacgcagaauauuaaaaagacauauucaaagauugaaauuuuacaaaacuugacaaucuauaccucuucaucaaguacauucuaaagugaagcuggaugugggugagugagugguaagggagggugcaauaacggccagguuagugcugcugcuuugagucauacuauggcaucagcaguuccacccacuguugcuuuugcaccgucagugcaaaugucaacacagcaaaaaaaaagcaaauagcuucugagauagaauaguuuugaccucaugggacaggaguccaugagccacauuaaaauuuuuuuuuucucgaaguuuacuagccauuuggauuucaucuuuugugaagagguaaucaaaucucuuguucauuuuucuauuggcuugucuuuuuaugacuuguuggcauuguuuauauaauauauucugaauuuaaguccuucauuaaauauauguauuacaaaugucuuccuccccucuguagcuugcccuuuuacccuauuaaugguuuuuuuuaauuauuguuaaagcauuccuaauuuuuauguaaucuagcuuaucagugcuuuucccuuuauguuuggugcucuuuugauuuuuguuuaagaagucuuugccuuaugccaaggucauggagaaauccucauauauuuucuccuagaagcuuuaaugguuuaccuuuuauguuuagaucuauaauccaucuaaaauauuuuuuauguguggugugagauuuauauuuuuccacauugauauccaguuggucuagcaccauauuuugaaaagauuauccucuaccuauguuacuuuaauaauuuaauuuucauuuuucauuacuugugcaacuauucucuauucuuaaaauuuguuuucauuccuuucgccuuggagucacauaauaucccuuugguuuuuuccuguggauagcaaaguucaauaacauuuauacagcuacuguuuauucagugccauugauucuagacaaaugcugggcauuuaauccaugugcucuuauuuaauccccucaacaauuccaugagauugguaagggcuauccccauuuugcagguaaggaagcugaaguucauguacaguaaguaacuucacaacaguaagaagcaaaaguuguguuauaauaguaaauuauugaauucuacuuaugggacucaggcacuacacuuuuguaagcauucucauuuaauauguauaacaacccugugaaauagauacuauugucuguauuuuacacaagagaaagcuagagcuuggagauuuucuaacuugcccugggucacacaucugugaaauggugaggccagaauuuggacuugagucuuaugcccaaaucaaucuaaguguccaucaugugccacuuacugggaauaugucaugagguguggacccagccuucaaggagcucacaguugauaggggcuaauugcccuuuucauuccagaucauaaaucuuuuuaaaacaaugguagaaguaugucugagaucugcugaagcacauuaaagagugauuaaucugaaggauagaaggaaaguuuucagagagaugaugccugaugagcuaaauuuuaaaggaccaauaaaaguucugugguauugaggguaauugacuuuuauggcagagggaacgauggguaccaguggggcuaugaaaucaucuuguagaagugggggaguuuuuguuucacucaugucagcaugugaagggagaaaagaugaacaugagggccaaaucacaaggccaguaugugcuaagaagcuggauuugauccauggggugaugggagccaucaauguuuugaaaaguuacgugguugggacucgguuaaccacggauuuuuuuuuuuccucuugaagaaucccagucauauucugacaguggacguguuaacaugguuaauauuuauugagcuuuuacugugggcugagcaguuacauuaaauguaaaguauauguaaaacaauaucuuuuaagccucauaagagaaugagguagaugcucuugguaucucuguuuuaugcaaaagaaaacugaggcagcaagagcuugacuugcccaaagcaacacaucuuaugagcauuggagcaggauucagcccuuaguauuuccaacuuuugacacauguauuggcaguuguuucagaagaaaugaguuuggcuuggauugcuccaagaacaaagaaaugaacuuggcuuggauugcuccaaauacugguuugaacacaguacagcaguggagcagaaacagaggagaugacaccaugggguaagcacaguccgaugcauauaacccauggggccaagaucaggagaaugggaagccacuggacagguuuuacaagggagggacuucauauuguuuacauuaaaaaacaaaauaacccucuggcuccuuuguagagauggauuauagagggacaagaguaaaaacagacccagagaagaagcugacacaggcagccaggcaagaaauaauggugguaggugguagacuauggugguauauaaggcagguggcucugggguauauuuggaaguauaccugacaggacuugcugauggguuggcuuaaugaagggaagaaaacucaaggacaaugcaaguucuuuuuuuagccugucauuucugauuugggacugccauaacuaaugcuucaguagacauacuuuuaugcaacuuggagcacgucucugaauguuuccuuagaauagauuccuauagaauuacuacauuaaggaccaagcccuguuuauagagauuuugauacagauugcucaguugcccuuuuucuaaacaguuguguuaauugacauucucacuauguuucaaugucauuucccuauccuuaccaaugcuggagucagucucauuauucuucuaaauuacuuagaaaaacauugucuucauaacaucuguaagcuaacugaacucaaaguguaaggccaguaaagugaggaaaguguuugcagcauaugugugcaucauaaauugccacaaaugaguagcuuaaaacugcacccacuuauuaucucauaauucucuaggucaagaguauggauuugcuuggcucauucaggucacuggcagaauucaguuccuugcgguuauaagacuaagguccguaucccucucccucagcuccauaagaccuucugcauuucuucucaugugucugccaccucuucaaagccagcagugcuguguugagucucuucuugggcauucuucuuccuccacaauccauguucugugcuuuuaaggguucccauguauuagauuagcccaccgagauaauguccccuuuugaggucaacugugccauacaacgaaacaauaauaggauugcuuucucaucacauucauagguacuggggauuaggaguuguggagucuugagaggggaucgaauuccaucuaccacaaucuguucucugaccucucaaaugugaaauauaucuuucuuccccugagguuuccaagagucuuaacccguuacuacaucaacucagucuaaaaucuuaucuaagucucauuagcuugaaggaccaagaucuaaucaucucagucaggugcaguugaggcuccugagcacaacuccuuucaaucaguugaccaaagaaacaaguucuuuguucccaucauauaguaguggagugacagaggauaagaaaucuguguuuucuaacauagaaaaaaaacaugugcaugaaaguuauuaaguacaguauuauuuguaguuacgcaugcauaccccagaaacaucagugcuugcaauagaaaauuaaguaaauuuuuaaaauuugcuucacuugaguauguauuacuuggccauuaaaaauguuaauaguaaagacaacuuaggaaauacagcaccuauguggaggaaagcaaugagauccaaaaugauauaguauuguuacagucacauuaaaacaugcuuaugaaagaagacaugaaaauaaugcaaaaguaaucauuguguuagagucagauuaugggugacauuuuucuguucugaaugcuuuacaauuuuuagcauaauuuauguauauuuuuucuuucuguuuuucuuucuucuaaaaaucuuugaucacuuagcuuaaauguagcauuucccaacccuucucagucccugguucagcuuugaucucacaggauauccuucaggguaaggaaauggaaagguuuauugcucuguuugcucagggcccugugaccagugcuucucuugcauauguacacauauacuucuuugcaguuaucagcaucuucauuuccccaauucuaaguuuccacucuuagcuggacaaaguuaauaaacucagacaccaaaacuucauggcugaauuuguacucugacugggaaacagucuacccccaaaucagcagugucagcuuaccugggagcuugugaaaaaugcagaaucugaggucccacuccuagucuucugaaugagaaccugcauuuuagcaggaucccccacugacucaugugcaccugacaguuugagcagcacuugccuaggugguucaaauaaugcuguggaauuagggauuagggucugaaaauauuuagguuguugauacuaguugugccacgaaaccacagcuggcacuccagaagccuggugugcagacaguguucacacccagugaucagccacagguacagauuagcagcugggaaggcagccauguuggcauucuguacugauaaagaagguucugguucuagaguaagcacaugccauccugaguuuccuauucagugcagccuuacagaaugcauagaguaaagcuauuugagaauaugaaaacuccucauugagaaagcagauuggagaauagcagaguuuuaaguaccgcuaaauggucagugaauucaccguuguuccccucugauauccugcaguccaaauucagggaaacccaaagugaggaaaugaacauuggcguggacggagaguguuccaggaaaggccugcacuucuggcuaaaggagcagggaaaggcacuacaaaugcucagagagagugggaaaaaucuccuguguuucuuuuuccuuuucuccauucauuuacaucccagccugcagcagucugcagacaccuaaaacugaggaagaaccuuccuuuccaacaagaggaccuguggucucaagaguaugagacaaaccacuguugcuuuuuucuucccuuuguccucccuccacuugauguuggacacaggcaccguuguaggaacuacauggcagagcagguaaagccccagcuuucugcucagaggacccaaaaaggagccuuccaaggaaauggaaaguacugcguggaccacagagcgggaggagcucagaaagcaccccauaaaguuguuauggccuuaccugcagcuguacauaagugaaccugauucuaaauagcauaucaaagacuuuagaauauaaguacaggagaacuggcucuucaggucccagacugacaacuggauagcacaugcaugguggagaccuuaguagcauuguaaagccuauacaaacagaacugacauugaaagcaaaacuuggagcccaaacuuaacuagguugauugccugcuaaaacaaaaauaucaagauucuuccaaaauguucaaaguaucuggaauaaaguccaaaauuacugggcauaaaagaaccaagaaaauuucaacucugaaaaagacaaccgaugucaguauuaagaugacacagauguuggaauuauuugacaggcuuuaaaguggcuauuaugaaaaugcuccagcaagugagggcaaacagucuugaaaugaauggaaugauagacaggucagcaaauaaacagaagaccuuaagaagaaccaaauggagauuuuagcacugaaaaauacuguaagaaaauuuaaaucucacugcauaaaucaguaauagaauggauuugacuaaggagucagugaacuugaagauagguaauacaaauuauccuaucugaacaacagagagaaaaaaagauuuuaaaauaaugucugagggaccuguggggcaauuauaaaaggucuaacauuggggccacuggaagagaaggagaagaggaggagaaagugcaguacagaagucuuuaaagaaaguaauggcugaaaacuucucagauuuggcaacaggcauaaaccuacagauucaaaaagcucagcagacccuaaauaggauaaaccuaaagaauuccaugcccaaaccuauaaucaaacugcugaaaagauuaaaaaagaagucucgaaagcaguuggaaaaaaacaacucauugcuuaaaaagaaacaagaauuugaaugguuacgaauuucucaucagaaaucuuggaggccagaaagaagaacagcauucuuaaaguauggagagaaaaagaauugucaacccagaauucuauauccagugaauauuucaccuucauuucuaaaggauauuaagauauuauuaagaauaucuuaacaaagaaacuaagagaauucauagucaauagaucuucucaaaaggaguuuuaaaaggaaguuccucagacagaauggagaugauaccagauggaaacuucaaacaucagguauaaaagaagagugguagaaaugguaaauauguggguaaauauaauggacaguucucuaaaauagguuucauaguuuuauuaguguucucuuagagggacagaacuaauaggcuauaucuacauacauauguauuggggaguuuauuaaguauuaacuuauacgaucacaaggucccacaauaggcugucggcaagcuaaggagcaaggagagccggucugagucccaaaacugaagaacuuggaguccgauguucaaggacaggaagcaugcaacacaggagaaagauguaggcugggaagcuaggccagucauguccuuuucauguuuuucugccugcuuuauauucucuggcagcuaauuagauugugcccacgagauuaaggguggauaugccuucuccagcccacugacucaaauguucaucucuuggcaacacccucacagacacacccaggaucaauauuuuguauccuucaauccaaucaaguuggcacucaguauuaaccaucacaugucuaccccuugucaacuugaacugauacacaucuccugagaucauacauaaucuucaaauaaagccaaaauaaggucauaauuacgccuaacauaauacaacuauccuucguacaacuagaaacucaccaauccccaacccaaauacuauuacauaaaguuaacaauacuuaaaugcugauacaaagucaguaaaccuuaugucacaugauaaaggagaaaggaaauaaaaugaagaugcuuucuuaauuaaguguaugcaugcacaaacauguuuuuaacaaaaggaggaaauacucaugacaauuacaguccucguuucugcagcuggucacguggucguagcugguauugaugauugccuucuacuacuacccauucuguauucccuuugccuucaguaagcaccucagcaggucguuuuuuuuuuuuccugguggagugacccaaaaagggucacuucauuccugaagggucuggaucauuuguaguccugccuggauugggcuguuguaguuucucauugaucuuaaucacagggcaugguaauacuaagagaugccuuaauggaucuccuguauuccaugcauacucuuccuuaccuccguucuagaguaguagacugauuucaucuugauagucugggucagucaccccagccaacauuguaacucccuucucagccuguugacuuaaagguagaggagcccaaaguaucaaguggcaaucuuaacuuccaguuuaauggaauuauugugucuccugguggcagcguuccucccucuggaacuaagaccucuaggccagcagaacgcaaugucaugggaauaggaagcaaaaauuuugcuaguggaugucaaucuuuuaaaaacuaaauuaaaaaaaaacuaaacaaauuguagcacagcaucugacacaaagcaaacucucaguaaaucgcagcagcugcuguuauuacauucuuccaggucuuuccuuuaacaaaucuguucaccugcaaugcuacauuuuaucauuauggcaggcccuguggguguuacuacuuagauuuuacaucuuaaagacugaagugcagaaguuucauggcagaccccugccaaccagcuggaaaauucccaacccaauguccagagcgcaucucugacucccaguccugaggccuuuccaguucaccagaccaccucagccauuagaagggugucagcuggauuugugugcccaacgagguguguugcuuuuauguaaaagagaagcacauaaggaagaaaucaugaguguucaggaucccuuuccagucccuuaaagaggcugcuuuugcaguagcgacauacuacccagugagcucagccaugcaguuuuuccugcaggguuagaguggaucacuuccuucaguugaucaccauuugaaguagcagggguuugaguucagaggccauguacgaaaaugauuuuaaaaauaccuggagccucauuuagcacaugcaagacugagacucagccaagggggcuaucuagagaaggacggaacccccucccucuguacuauuuacucugaguucauaaaaaaauuagccaggcgugguggcgcaugccuguaauccuagcuacuuaggaggcugaggcaggagaauugcuugaaccugggaggcagagguugcagugagcugagauugugccacuguacuccagccugggcaacagagugagacuccgucucacaaaaaaaaaaaaaagaagaaguaaauggguucuaaguguguaaauaaugaggucacagaagucuucauguguugcagugagucuuuguugaauaugagccaacugaauauguuguuacaguuucuaguaccuuuuuaaaaauuuuuuauauuuuuccuuaauaauagagaugggggucucauuauguugcccaggguagucucgaacuccuggacucaagcaauccucccaccucgaccucccaaagugcuuggauuacaggcaugaacuacugcacuuggccuuuagagacaugguuuugcuaugcuggccaggcuggucucgaacuccuggccucaagugauuugcccaccucaggccucccaaagugcugcgauuacaggcaugagccaccgugccuggccugcaacugccuuucuagccuuucuuguucucuuguuucuucucucuuccccacauuucgugggccagagagaaaaauagagaugguugcauauuucagagcaaucuuuauucccaagcauuuuaucagccacuagaagcccccuauguuugccacucugggcgggggggcacuucauggagucagguaagaugcuuacugcccucuggcaccaccuggucugccucuaguuaggcaggauguuggaggcugcuagaaacuuugacugcuagcuccaugaacuguggcuugggagcaguaaccuaggucaggaaaaauuccuucccuaggaaaccuggccuuguccauuuaaaucacaguauccugcgauuccagcccaucagguggaacugacuggaggagcaccuacuuuuggauuuuuucccgguucucuaauuaauggcuucuuaccuguaagcuuagauuagcugcuguuuauaaggcuuucccaaggucuggcaggaacgugccagugccccagaacuaucagguuuguauugcuugccagggcucugcgaagauuccaaagcacaucuuucaaaauacuaaauauuuguguuguauuauauccauaucccuaugcauuacggaaaaaacaggaaaguauaaagaaagcccucaccacccaggagugacugucacuguuuacgcucucgguacgcuucuuucugguuguaauuauacauaccaccaccacuacccugcauacacacguuuuucaccguugauuucccuaggcuauugaugacccccuuuccccucaguacuuaacacuagagcaugagcauuucuccacaucauuuuuaaaacauucccagaacaugguuuuuauugcuuccauggcugcacuuggggaccugccaugauguuccuaacuggucuucauucaggcugacugcaguuuccuugauuaaugucuuugugaguauauuuuaauuuaaauucuuuauuuaaaaugaauaccuagacauaaaauuaucagaucaaagaauagagagauauauaagagggucucacucacuacugcuggccugugcuccaugucuucccaccgcucugccgcccagcuccuccaccgaucacaauggaagaagagaucaccauacucgucauugacaauggcuccagcaugugcaaagcugguuuugcuggggacgacgccccuggaaccauguuucccuccacugucaggugcccccaacaccagggcaugaugguggggaugggccagaaggucuucuaccugggcgacaaggcccagagcaagcacggcauccugacgaugaaguaccccaucgagcacaggauuuucaccagcugggaaggcauggagaagaucuggcaccacacccuacaacaagcugcauguguuccuggaggagcaccuggugcugcugacugagggcccccugaaccccaaggccaacagaaagaagauggcucagaucauguuugagaccuucaauacccuggacauguacguggcaguccaggccauacuucuaugccucugggcgcaccacuggcauugucauggauucuggagacggagucacacacacggugcccaucuacaagggcuaugcccuccccacgccauccugcgucuggaccuggcuggccaggaccugaccaccucaugaagauucucacagaguacgacuacagcuucccuaccacagccaagcgggagaucaugcgugacaucaaggagaagcagugcugcgucgccccggacuuugagcaggagauggccaccgcuaugucauccuucucccuggagaaaagcuacaaacugccugacagccaggugaucaccauuggcaacaugcaguuccaguguuuggagguguuguuccagcccuucuuucuggguguggaauuuugcagcauccaugagaccaccuucagcucuaucauaaggugugaugugggcauccacaaggaccuguaugccaacacggugcuggccaguggcaccaccauguacccaagcaucuccaacaggaugcagaaagagaucacugcccuggugccagcacaaggaagaucaagaucaucgugcucccagagcgcaaguacuccguguggaucagcagcuccauccuggccucauuguccaccuuccagcagauguggauuagcaagcaggaguaugacaagucgggccccuccauguccaccacaaaugcuucuaaauggacuacaagcagauguguagcauuugcugcauaggauaauucacacguauaaauuugccccugacaaauguauacaccucaugccagccucacaaaacuggaauaagcuuuuggaaagaaauuuguccuugaagcuugugucugauaucagcaguggauuguagaacuuguugcugauuuugaccuuguauucaaguuaacuguucucuugguauuuguuuaauacucuacauaucuuugauuucagcccuuaagugcaugugguuuggucacuucauggcugaggugaagaacaugcuuguggaagacaagucuauggcuuggggggucuguguggcuggcagucucccacuggugcaggguauucaugugucagggcugaguauucugggauuucucuagaggcuggcaagggcuccugaaccaguugucauuucugucuugccuguaggacccaguuuccuuucuuagcugauguuuuccugccagaacaccaugggcuguuacuugucuugaguuggaagcgguuugcauuuacaccuguaaauuuauucauccuuuucauuuauguaagguuuuuuugguaugcaauucuugagucuuuaagagaugacaacaaauuuuguuuuuuuucacuguuaugugagagcauuaggccuagcagcacaucauuguguaagaaaaaauaaaagugcugccauuuaaaaaaaagacauauaagacuuuugaaggacuguguauuuuugugucugucuauaucuauauauauuacagagauaauauagaauuacucuccagaaagcaugcagucauuuaugugccuucuagcucaugcauucuccaugaaggcagaaaucggcuauuaggguugggggcaguccuagagauuacagugguuuguggcccuccugcagguacagugcauaaacagauacacaguacaucuguaguacuaaaauuuuauacaggggcuauauugacaaaaagguugagaaguacuguucuagcuguaugugacuccauacaucugucuccaccuuggaagcuuucaaaucuuagcuuugggauuuugguuuuggguuuaagaauaauauuuuucugacguaaaacuucuugguucauuauacaaaguugaagaaacugagaaaguugugaauaaaauuuaucuggagguuaccaauauuaauauuuuaaaauauuaauacuuaauauuuuaaucuauguuuuuagguuuguguuccgcccuucuuacauaauugucauuguaggauuaucauuguucaucugagccaaggaccacccugaaauaucccuugugcuauggucucaugcaaggguuucccaugccugugaguguguuugugaucccacauguaucaggugccuggcugcucugggacuugcaguaauugucucuuguuuguuucaggugugauccccugggcccguuuguugucgggggagaagacuuagacccuuuugggugaguacugcuggggagguggcagcaacacaacuugcuuuuguggcuuuucagccccagcucaucuucuaauuuuagaguuuucggucagucucuuccuuugggguggaggaggcaguuguugcugagcagcugagaaagcacugccacauacgcugccccuccacaccuagagcggugcaggagagcacugaguguuggcagggaggugaacaagccuagcaggcagcucuucugccauuucccggucccccugcccacccuaguuuaucagauguauagugaggagcacauggugggccuuagggcagcucagggcuauucagagguugccccacuuaauaaagggagucucugagccccauuagacucuggaugguucuuaugcauccaacaaaguuacuacagccucugcuauccacugucuucccugaaugauuccaaauagauuuuaaccucugcuacaaagugaccccgacuucagcaucucauuuguagacaguggggauaucacuuaagucugcagugcagcuuaagcagugaccucaaaauuuggggaaccaucagcucauucauccuaguuugagcacaugaggucaggucaguggaacuccaugagggacagaugcugucaggagccacacuuaggcaaucuacaggcagucagaaauugcccugaggcccuuaagggaaagagaaaaaaaaccaacaucacgaauuaccucaaugcuauaauuaguccuuaaaccuaaaguagcacccugcagaaccuugugagugcauuguaguugaccuuggcaaguucuggcucuuggucuugaucaaguuggcccucuugaguauaugauauggcagggaucucaauuuugaggagcccuacagaaccaaaagcacugugcagaaccaaccccugcagagccagaaguacucagcugugagguaugcucuucguauaggcuuuguguucuugcccuugcccacuuuccgcuggcucucaggcagccauccacaugucugcuugggccauccagaguagacaucccagccauucuuggugcauuguaaccucccucgccuuuucuccaagggcaguccuugccacaccugcuuaccuaacuuuucuucuugccucaggccucggagagguggcaugauuguggauccccugagaucuggcuucccaagagcacuuauugacccuuccucaggccucccgaaccgacuuccuccaggcgcugugcccccaggagcucgcuuugaccccuuuggacccauugggaccagcccacccggguacguagucacucagguaugcugagaaguaggaccugauggcagcuugguucaguguggcagcaaugaagguuucuagccccaggcacagagcugccgcugccuucaccuguugcugccaggagaguggagccuccuccagggcccugccugauuucucccuggagccuucuaggagcuuccuaucccucagugccucucuuuccccagcuccacucuggggaggacucaaaguaggaggaacuaacaauucuugaaaguuaaguauguggcagaaacucaguggauccuuucuucagcagucuuggguagaugguggcgucuacauuuuauagaugcagaaaaugaggcccugaaagauuagguaacuuauaccaagcgggggagucaggauucaaaccccgguugucuggcucuugagugcauguguuuaaauuccucacaccgccacaucauguugaagggcaggcucccucagugcagggucaugucugcccauguuccccuggucucuccaucacuccaacucaucagccccucuuuccauuccagaccuaacccagaccaucuccccccgccgggcuacgaugacauguaccugugaaggccucaagaauguaacaucccaggcuucccuccauucuccuggagcugccaccgcuguccccaucagcaaccauguucuugcaggcugggggcaagggauucugcucauguguuugcagaccggcugggauagccuccccaccccuuaucagagccaagacaccugcugcagcucuccaccuagcugcagauagcucccaaagagaaaucagugugucucuuucaccaucagcuccuccccuuucaccaccagcuccucuccacuucccaagggagacuccggcaaccuucagcaacauauauccucgaccagaugcagugcuauaagaacagaacgcauuuuggauguuauuauuaagaaccaaaugucaauacagaauucauguugccgguuucccacuuuucuuuuuacauuaaugcauagcugcuuccauuuaugagacuuuagaguuugaguuucuguagggcugaaugacucuuuuuccugcccagggcccauucuugcuucucaggcaccuuccguuuauuaauugccauugcuccugacaucacuaagauggguccccuucuggcugcaugaauggaaaugagugacuggaaaucccauaggccacaagaaugacuuucacaagggcaggaacauuguggaaagacugcaucauucugaugaggcaaaauccuccagcuauuccugucugggccaguuuuguagguccaucugugcaugggcagcaguagucaaaaagccaaggaaaaaacagagcagaccugaaggcuaaucuuauuuuugccacuaacuuagugaaugacccuaagcaaguuccuucuccucuuagggccuugugccaagccuaugaaauuggagguggcuuuccugcucuaaagcauuuugaugucucauucuguguuugguaaccccuauaaacuggggcagaggaaaagaaugaugguucaaggccauacuucccuugaaccuugugugguucuugccuaacucugugguuuuuggaccccauggggcccagacagagcacaggagcaugggcugccucugagugugguguugaacuucgggaggagcagggagcccugcaccuuguguccuggcccaccugaccuuugguguucuccggauccuuuucagcccgaggccugacagacgcgggcagugaugagcccuguucuggaguggaaagagcacgauagagcaccaggcuaagaggcacgagaucaaggcgguagucacuuccgcucugcagcuagcauuucaaccauauguggauccuuucauuucucagcucccuggauuccuuccccuaaauuaggaccuauuauuuaccuguagguaagcaagcuacuguagcucuucugagguaucugccaggcuguuuucuguagccucagauugccuaucugcuuagccugagaacagguagaugaaaacuaaacugaugccuaggcccagggucagucucagauggaagcugggccuggguggggaggcuagcaugcguggcucccuggguauuucugucaguccccauggcaagcagugauuuaguaaaacaccccagagucagggaagccaaccaccuugaaaccuuuagaacaucucugcuuuggagaaagacccagagaucaggcagaggugcagauucaaucauuacucauaaccuuugagagauggcaaaugggaggaguguuagucuuuguuuuggaauuggaccauucuugcaaccaaaaggacuuagagcaguuugcucauaaagacauccuuuauuauaaaaggaaguauuuaaaggaugauagagaccaucagauagaagcagggaagguagauaacuuuuaggaccuugaugugaggaaaagauaaaauuuaaacaauaaauuugccacuuagauuuucuagcagcaaaguccgaaaagauaguuauauacaaaauucuguuuucugaaaacaaaauugugauucaccuucagaauuggccauuuuuuuugugaguuuccuugcaucaaggacacugagaaacacagucauugucuuagguguucuaugggaggaagugaauagagccuuuaggaacuuccuggucaagcuuauggugcuuauuuugaucugggccacuucccuccuuccagucaugaguaaucaucaaggagcaaguuggaguguuucagguguauauuuuguagaacccaaaagauuggagccuuaacaauaaacaucagcacuaagugaccuguuccuccuuuuuuaaauagcagcuuuauugagauauaauuuacauacccauaauuuacauaccuguuuaaaguauacaauucaguggauuuaguauguucacaguguugcacauccaccaccauuucuaauuccugaacauuuucaccaccucaaaaagaaaccacacacccauuggcaugacuccccauucccuugcucccagccccaggcaaccacuaacaucugucucuaaagauuuuuuuuuuuuuucuggacaguucucauaaguggaaucacucaguauuauggccuuuugugucuggcuucuuucauuucaugugauguuuucaagauucauucaugcuguagcauguauccaugguauggauauaucacauuuugcuuauccuuuuaucaguugauggacaguuggguuguuucuacaaaaaggcuauuaugaguaaugcagccaagaacauuuguguaccaguuuuugaguuuucaguuguuugaguuucagauguuuucaguucauuuggguauauaccaaggaguggaauugcugguucacaugguagcucuauauucuacuuugugaggaauugucagacuguuuuccacggaagcugcaccauuuuacauuuccacugguaauuuaugaggguuccaguuuccccacaucuucaccaacucuuguuauuuuucaugcuuauggccauccuaguuagcgugaaguagcaucucauuguggucuucucuuccauuuuuuaaaaaagaauuuugaccuacaccaagcaaggcagagaccagagucagucccccuuggggagcaaucugugguuuugauaaucaccaccuugggaugaacauggcuggugagcugcagagcaguugauuugacuuuuggggaugguucuaggcuggaugugauacagggcagguuuugucucuagagaaaguucucaugaccuucaggucuaaugagauucagaucaucacuuugguuugguuugaaauuucuuuguuuauccagugaauuacaaguagaauaaagaucugguucuaaauugucuuuugguggugaagugccauagaccauuucggaccauuucuaugauguaccagcagcccccacaucacaccuccucuuccuuggcuugucucuuccccaauucuuagaguuagcaguguuucuuacugcauucaucuccucagucauaagugucugucaaccuccguugugaagucaugagucucuugagacugaaacuccaagaauguauugugcucacaguggcgaugguguuccugugcuggauggucagugguuguugacauguaguuagaaaauagguagcaaguuccacgcagccucacucuuuggaaccuaguuucuccuauggccucccuuucuacuguuguuaauaacauucuauuaaugauccaugccucucuucacaggaggaauauuagaaucuauggagcaguuaguauucuuugucaccuaaauuugucuacuucuguacauuuccaauaaggcaccaccagggcaagggaagauuccccacauguauauccccagcuguuucugucauaaaacuugcauguguauaaaccacuauugacuuuuugcaccaaaggagauauucaaggacagacauccaaguccccagcccuuuauugcccuugggauaccacaaggcacagauacaggcagcugcuguguggcucuggaguuccuaauccccagauuguagcaaugaugaugugauccugcugcucucuggaccguaaccuuuuugguuacaaaagguaaauuucuguuuacugcaucugaaccccaggacuaaugcgucacugcauuaaccccaggacacauggaccaagucacugcggccguacuuggcccugaaucuguccuggagggugggucaaaaggcaaggguggcagguaggaugguaggcagugagggguggcaaggccuagcugacugaggacagacccagcaacaaugacaggagguuugaacaccucacgagugguagugcccaugggaggugcgaaguggaaggcccagcccuugcuuggaggaacgugaggcugauggugcagugcaauagaggucacuggaugcccauuugaacagcugcguuccagaugagccaccuaagguggauguugugagagucacaguggguuuagagggacaagguagugagaggaugcugcugacgcauuaguccugggauucagcugcaguaaacagaaauuuaccuuuuguaaccaaaaagguaaugguccagagagcagcaggaucacaucaucauugcuacaaucuggggauuaggaacuccagagccacacagcagcugccuauaucugcaccaaaaaguagauguccuucacacugccaucuggacaccacucagcuagcucauccaaguucaaggcucaauugaaugcgucugguuguuggaaccuacauggccucucaaaugguacuggcauggaauauuggggagaugucuuuauucccucuucccaccuuuccuggaaggugcacugggacagaggucuagugagccaaucuucuguguugucuacgccauggaccaugauauaaauggguaccacagccuugcaugccugagccuaaccaucuccugagaugcuugcucuaaguacacauuaguacaugcugggccccaaucuagaucucaagggaacggccuucagauccauuuuugacaaguuccuuuugugaguccuaugaucaugcaaguuugagaacugagaagggaggggaagaccuaccuccuuguuacucagaccaccagcaacagcagcaucaccugggaaccuguuacacaugcagaaucucaagccccaccccagacauugaaugagaaucugcauuuuaacaaguucuccaugagauuuguguaaacuuaaagugagagaagcucacauggacuaugucuuuuuccuuuacgugaauaucgaguacaaagaauugagccagucaguccucuugguuaauggcacauuaugauuaaugcaugcaugaacucugauucgaaguuuucguugauuuuacccccaguauccacuccauuccuuugcccccaugggucacuuagauguguuucauguuaucuuuaaaaaugcagcaccuuuauagcauacauuauaucuucaaaccauaaccauaaugagguguuauccccauuuccuguaccagaaaaggaaggauugggaagguccaguaauuugcucagggucaagcaggagucucagacucagucaagcgugguuacucacagcccucccuuucucaguguguggccuuccucauccacaaaaugagcaucaccccuaccugcaggauucuugcaagauccaaccaaauaaugugucuuauuaacagagaguuggggcucggugggugcuugcugcaauuguuacuaaagucauauggguagauaagggugggacucaaggacaagagaggaaccuuggaauaucccccagugcaggaaacaagcauuuaucaggugcacacagcgugcuaggcuucuccucaucgcauguaguaccccugacaaccccaagguaaacacagcuaguggcauuaguugagaugcugcaccuacccccugggguggcagaaccgugauuggaacccaggucagugcucuuuucaguagaacugcuguacccagaccucacauccucucuaggugaggugcaugggucccugggcaaaacccauuccagaagcugggaaaccacgucaggacuugugugagaaaggagugaugcuucauaauccccaggauggucuuaaggcuccucagucaguccuauuugcacagcgugccucaugcuccugaguaccuccaccugcagccacagugcccagagcaccugguuaggaggagcaucugaaaccaccugcacaaccuccauuccacagaggaagaaacaggcucaagaaacccauaugugauggggagcuccuaacaggcuucccugggccacaggaaugggcucgggcucucugcugggcucugucaccuggcuccaugugcugcucaccucggccuucugaguuuaguaggauggcagcuagucuucccuauugacaggugaaaaagcagguccacagcuguugagugacuuucccaaggccacacagaccacaaauccuggcuccaaguccagggcguuuccaguaagcacuguccaaaucagucauggaggucccugagugacaaaaauaugcaggaccccuucuuucccccucccaguucccgcagcuaggcugaguguuaagaggaaggugccauacagguucagcacccuggucagcgcccagccucccuaaagccgcuggaggaggccuuuggagccagcucaggucagugucugcugcuuccuuacccaggauggcccacucuuggggacagacaggcauccugagaggagggggccuggaccuaggugucuugccacccaauacagagcccugcccucucccucuccuucagaaggaaguaugggagcaguuccauccucaagguuucuugguucccaggacagaaauuugagugagaagcaugugaagagagggauggcccaggggcccuuggccaugguggccuuggacaaguuuggcuuuccccaucuguaaaauguagauaaggauggacccaccuccccaagauccugccuaucugugagaguccaugacuaagugggccaugggcuggacugaguucagugcucccccaaccugcccuccuccucucccccacagagcuucccaauuuacauguaaaccuugggcaucaaagugacagcugauagcccagguuugcccacaaaugugcucugacuggcgugcauguuauuaaauuugauaagaugcaugauggcagcuauuagaguuuugacucuguucuuuaccaguagugugaccuucggcaagucacuuaacguagcugugccaaagcauccucauauguaaaauggagguagugauaggaccccucuguaggauuguuaugagcuuuaaaugaucuaguccauguaaagacauagaugagggcuuggcacagagagaacacuauuguuuaaaaauagggugacuuaauguguguaauaaguaacugguucauugcaguguacaaacaugaaguguuuucuuuuuauucagcugaccucuaucaacuacuccuuucguaucucaauaucuugggcccagccaauaaguaacugggcacuuugauuuucaaacucaguccagcccagcuuaaacuuuccaccucccaaacuugcaagagguggucucuggcuucuucugagcucuugcuccuccaguguggugggugagggggaggaagggagaaaaguaaagucucuucacuggccaugaugaugaggauggugagaggagauuuugguuuuuguuuauuuguuuuuuuaagaaacagagucucuguugcccaggcuagaguacaguggcauggucaaagcucacugcagccucaaacuccuggccucaagugauccucaagauggagucuugcuauguugcccagccuggucuugaacuccuggccuuaugugauccuuccaccucacccucuggaguagcugagauuacaggcacaagccacuaugcccagcuacagguggucuuacucuaauccauacuagguuuuuggguuggguuugguuugguuugguuugaugcugggguuuucaguagacuacaugcauaauuugggagugguggugagugcuuuguccuggacccucagagaggaguggggaucucuguccaaucuaagaggcuaagaggcucacagcccaucucuuugacauaguaugcuggccugcagucacuugcgccacccacagcucagccuccucucaccucccugcaucagugcuuggaaccccaggaacacugggguccuuccccuaccuacaagggcuuugggacacuuggaggggagguaggacugucccuccuccucccugauccccaauaccaccaucccuucaagucagcgugggcuguucccacgaggggcuucccacuucaggaauuuucuggucagaaauagaccucaucuccauguucacaaacucuucugagcuccagaagauaacauuucaagcccucucaagaauacucuccuuacauuuuucaucuguucagugcuguaucuccaaaaccuagcacagagugcucaaaucuuuguugaaagaaugaauaaagggugcuuggauggguaacacucagguggucugcaggcccugcagcucagcccugcagcugggaggcaggcaucgguccccuucuuaagugauuuauuaaguccugggcagggggaaggguguggaggucuggucccagcaaguggcaucucauuggacacucccuuguccucaaccaccauuuucaggcagcgggauaaucccuuucagcauucuuuuacccacacaaagguccagcaguccagcugcucuugaaaaaucaggaguucugguaacccugagcccauccaccacagggcaacagccagccagaguugaagcagaccuccccuuuaauccugccgcuguccacagccaccugcuuaguucguuaaugucaccugccgagcccugcaggcauuugcacuugggucccugcuuuaaucugaugagaaaggguggggacucucagggggagagucagcaguaguuaacaacucuccugugggugccuaacccccaugagugacuucaguaaaaugaaaugcggacaugaaaaggaaucaaaaauagaggaauagggagagauuggaggaagggaagaaagaugagaugggagagaaauggcuuugcugaaugcccuuggcccuaagucaguacuggcccagacacugagccacccgggaagagguuggcauggaagccgccuucuuccucugcccucccugcuccccuggggccagcuuuccuuccacuugcuaaccucccccucagcccaggagagcagcagcugccaccuugaccuugguggcucagaguccaaguagggacagguuguugagaugaaguaccuggagcuugagguuauguccucuggcugcagcgggaucccugagaagggcugggggguaccagaguccacagucccauggacgggccuccccagcgccagugucaccccuaaagggcaugacaucagaagauucuucuugccacacacaucugcaagcgauuauaaugg

SEQ ID NO: 13455 - RNA, 1980 nt, Homo sapiens
ccccacccaguucaguccucuccucugcaauaagcuggacuccggcagccgguucccacccucacaucggccucugcccccaaaccucgcccuccgcccugagggguggccccugggccuccccgaugggcugcaggggccucgcuugguuuaugugugaaggugggggcaggggaaggcgacgggccgcucaggagucugcuggaagcgugagggucggccgcgcuccgcugcccuauccugggcccaccccacccgccaacgaccucgccuggcugcucccuagguaccugugguggaagcggcagcggcggcggccgcucuccccucugcucacacagacaauauggcggcgauggaggaggagacacacggcucggccgccagccgcagggaccagagcgaggcugcagccgcugcugccggaagcggaaacccccuccuaccaggaggcggggcgagacagcuuccgacuccgcccccagaggaaucucucugaaugcggccaugcugggauguccuauuguaaccuuagggauucaguucuggccuagggugcaaaauggaaggaauccccaacgcaaagcagaauaaggagacuugcaauaguuaagcgcauuuuauuucaauaguguuaacaagugacaacagagagaacacgaaccucccauuaggugaacaguugguuugacccaaguuaagauggcgguacccagguuucccacacuucacccagcuggccccccuuucuugaaaagaaccaugcgcgaccugcagagcuguagagccaagcauucugggagcugaagucucuuuugcucugaccccucguuuuaaauuaggguuucagcaacacuuucuauucaaacuuggaguucggaagaagugaaugaaaguuggacccuaggaagggcauggcgcaggagucugagaagugaggauacuagcucucaagagaccaaggcccaauuccuuccuccuacaggaguccugccaagagcugugcguccaaaauacaguguuuuuuuuuccuucuaucugccucccaccccugcucuccuugcccgagcuaccuccccaaaacagccacaaagcacuuucuaccaugcagagcucaucauggucucccuauggucaaaaaucucccauggaccucuuuaugcaccaaagauagcccaaacucuucacuugacauucagaguccuccauaauuuggccaaacccuccuuuccagccuccuauucugccacucucuucucaaauuccggaagauuccacccacaagacugcaaacaauuccuggaacuuagcuguguugccucccucccuuuacacuggcaguuacuucucuuacugucaccucauggacuggauaauuucuguaugccgauugaacuaauucagggauccuuuccucuaggggucuccucucuguuuaacucccuccaacccagacacuaucagucaguaaccugaggaccucagucugucuccuccaucagacugggagcccccaguggacagggcuccaucugaugaucaaccucuccuuugcaggcccugauaaaagcugaagcgucuaagaguugcugaaaggaguucaaguauuagucucaccucuggugggacagaggugugagcacuggaacgagggugaggaggccagguucuuucaguaccaaccauuaucccuaacugucucagaauagcugguugucucaggaaugggccucuccacccuccacagcccugccuucacaguuugucagcugacuagcaccucugcucccaaagaggcaccucuuccccaugugggguuagggcuggugguggcugcagacuuauagugauggccucagggagguggcuguggccuucucuggaccucaucugcuagacagcuugugacaucugaucccaauugccugggaacccacaacaguuuuucucucaguguccuguaacugggccucaauuucc

SEQ ID NO: 13456 - RNA, 7786 nt, Homo sapiens
caguauccaucccagcuguuuauugaaagggaaggugggauggaaggggugcaggaugaggagggggcgugaggcacaaggacaguagggugugcccuggugggggccgccugaggauccccuaggaggcccuucaggcugguggagacugaagguaaggguuagggaggggaggggcgagagccuugagcgcugcucuccagcugcaucagagcucccucuagugguacagaagagagaugacgccuccggcuggggagggaggggcuggcgccucugagagagcccauuuauuaucagggucacggccaagaccgugggcuugguuucuagguagguggacuuugaggggcaaagacaacccacuuuuccugcccccuacccccggcucuuagagaccauuuaaauccauauccaaaguauauccagagccaccugggaccaucaggccucuggcuagucuuucugggccaaaccuguccuccacccugaggacccucagggaaccaggaaggugaggggcuggcuccgccccaccuguagcacaagagcuggcccaggaggaggcugaagauguguuucuaguuccugcaugcugcuuuguugugugaccucggacaugucaccuccagccuucuucacccaccucaccuaucaacuagggcuaguaauugccuguggugggugggcuggggggcucugaugccaaaaugcagguagaagacacacugugagaggcaaacgucuucacucauccugcagggaaaggccaagugagcaucugggacccauucgagcugaaugacccccaccccuucaucugugucuauggagggcagugcguguccucauccuggcgagaagaggaaucugauccaaagcccucauggcagagaggcaggagcugauggcuugaaagggcaaggguuugcccaaggucaugcagaggaaggaguggggacggguugaaggagauguuuucugccccugagggccuugggaagaggguguggguaggaaguuuugggaggacuugaggaaugcugguaucuuggaagaguuggggccccacuccuggggagggagcacugggauuugagcuccagauuugaccuggaguugggcucuaaagggacccugcuaaaagggagaaguuggggaaacacugagaggggguuauggugagaaggggggaaggauccaggacccacaucuuaggccaugugggcagcucaggagucccucuugggcuggauagucugcacagaagauugcccaaaggggcuggcggguggcgagaaccaugacuggccacuggcauugcggaaaaugggugacaacugcugcucuggcucauccccgaagaccuccacguggcugucggcuucgggguccaagggcucugccuugguguccuggcucagccagccuaucauggcccagaagaggcagauggcgagcagaacuccagcugccacacagagcgcugugccugccaggcgacaggugcccagggccugguuguagucggcugcccgcugauccaacaccaggaacucacccucaccgaugcccuccagcuuggggggcacugcauagccaguggucagagccgccacacccagcagcagaagcaggguccccgaggacaggcugaucuagggagaagcagacagaccaggaagcagucagggucagccaggggccccuggccaagggaucaccuuggauccucaccagacuuaaggguaaccccuugauccauccucaggagaugggaaucacagaacacacuugcuggggucuaacugacaggaggcauaaacugucauguuuuauuuggaauccugaggccucuuaauuuccuucccagcucccaccuagcaguggguuucuccggccaacccuguguuucccuccaucccaacucaucucuuuauccuuucuaccuuccugucucuguuggguuaacuccuaugcaccaucagaucucaucucaaaccucaccuccucagggagaagaccccuggacugagucaggucucuugcuuuacucugggcaaacugugcccauucauucuucaauacacuuaccauugugcacacuuggacauguauuuugguugcuauguaagugacgucugccucucccgcaguacugagagcuccaugagagcagacugugccuguuuuggcucacuaggagucuucugugccuagcacgugccggcacagagcaaaggcugaauaaauguuugcugaaugauuaaauaaaccacagcuaaaagaguuccucgaagacagggaccucaugucuuaaauucuguguucccaagagccuagcacagugccucgcaauaagaagaugcuuaaaaauuuuaaauacacacuaaccuuuccuuggaagucuuccuugaucauuuccucuccugguguucccuacagaccugaccugaaguuauguaaguuggccucucugcagagguuggcaccuuaccuccucacuagagugaaguccuuugaaagcaaaagaagggacccucugccucagucucccgagaauauuuagcaaagagcuaugcccauagcaggcacucagcucauugccaccucuacaccuugacccauuggugcacccuggccgacuagucuccuuggcuguuaaagacaucaauucuucacauuuuuucucugcccuggcaagguacuccagucuaccauugagaaaccacaguaagauuuaagugagaugaaccucacuuccugccagucagcauaguccaucucuuaaccauaguaauuaguucaaggcuggcaagugacccaaugagagccaacacaaugcuugucaggacuucugggaauuaaaagcauuguuucuuauaaaugauuuuuaaauuucugaaucuuuuaccucuccauauaaacuacaagugugcaaagugguaaguguauugaagaaugaaugggcacagaguuugcccagaguaaagcaagggacccgacucaguccagggaucuccucccugaggaggugacauuuugacguccacaaaauaacgugcugggguuuugauuggcauugcauugaaucaaagaucagguugggaagaacuaacaucuugacuauuccaauccacgaauaugaacuauuucuccauuuauuuaguuauuugauaucuuuugaguuuuguaguucuucucauauuacagauauuuuguuagauuuacaccuaaguauuucucucuucuuuggugcuaagguaaaugguaacauguuuuuaauaucuuacuauuuugcuuucucucuuccuuucuucucucuuuucuuuucuugacagagucucacucuguugcccaggcuggagugcaguggcacaaucauggcucacugcagcuucaaccuccugggcucaaacgauccuccuggcucagccucuugaguaguaggcaucacaggcccgcgccacuacauccagcuaauuuuuuauuuuuaguagagaugaagucucacuauguugcccaggcugaucuugaauuccugggcucaagcaauccuccugcuucagccucucaaagugcugggauuacagguguaagccaguaccuguggccauuuuuuguuuguuuguuuuuuuaagacagaguuucacucuuguugugcaggcuggagugcaacggcacgaucucugcucacugcaacugcugucucccggguucuagugauuauccugccucagccuccagaguagcugggauuauaggcgcccaucaccacacccagcuaauuuuuguauuucuaguagagaugagguuucaccacguuggcuaagcuggucucgaacuccugaccucaggugauccacccaccuuggccucccaaaaugaugggauuacaggcuauuuucuuuucugaaggaaauaccacaggaaaugcugacuucccuuagaugguguggagugaagaccugagaguccacacaguaguggccauuuggggaacauguggggagagucugaagcuaacaggcuaccaggguaggggcaccaugaggaggcugaagacuaagaaaacuugcaaaguccuugguauaaaggguugaacugcuggaucaaacuuugccugaaaguaugcaaccuuggaccuugggucucuucuaaaaaaugagcaacauuuucccuucuuuuuucuuuuuuuuuuuuuuuuuuuuuuuuuuuuuugagacagagucuuguucugucgcccagcuggagugcaauggugcaaacuuggcucacugcaaccucugccuccuggguucaagcaauucuccugccucagccuccuaaguaacugggauuacaggcgccugccaccacgcccggcucauuuuuuuuuuuuuuuuuuuuuagagggaguuucgcucuuucacccaggcuggagugcaauggauugaucucagcucacugcaaccuccaccuuuugguuucaagugauucuccugccucagccucccgaguagccgggauuacaggcgcccgccaccacacccagcuaauuuuuguauuuuuaguacagacaggguuucacuauguuggccaggcuggucuccaacuccugaccucgagauccaccagccucagccuccgccuaccaaagugcugggauuacaggcgugaacuaccgcacccgguccauuuuuguauuuuuaguagagaaaggguuucgccaugcugacagagcagguguugaacuccagaccucaggugaucugcccaccucagccucccaaagugcugggauuacaggcaugagccaccauuauuuacauacaauaaauauguaaauaauuauguaaauaauuuguauguaaauacaaauacaaugaaggcucccuucauuauuuaaacccauuugaauuggguuuucuguugcuugacugugcaagacuccuaacuacuacgcuaucucuucuuuuuuccucugagccucaaauucagacucauuuccuccaucaaggcagaggaaucaugggaggugcucaucuggccuuaccuuccaacacagugagggccagggccggcgggggcacaggaccggaggucccucagggucgucgcugagagcagugccugcacaguccucauagaagaggugcagguaggagcggaccccauaccacuugccauccuccacgcuggggccgcggcugcagcugcaggaacgauugcagcucggcaucauggaccccuggggagcagguaaggugcagcugacggagggagggauuagugggagcugcucauggugaccuucauaagcccccuaaaucuuugugccccacccgcuucuccucccacucgagacacccuacacgcauagcacagucuggccuuuuggaaucccagccuguccuucccaaagcacacugcgaaugagccaaugcacugaaggccuuagcccagugccuggcaauuggaggugucaauaaaugugcauguuuacucuggaggccacccaguaccugggacugugggcucuggagccugaccacuuggacuggagucguggacacacugcuuccuggaggcgugaccuuagacaagugcuuccaccuuucugggucucaguuuccucaucuguaaaacagaccuaauaaucauacuucuuucauacaguuacugugucuaaugcugagaaaugguagcuguugugauuaguacuguaauuuuuuugcuauuacuuccaucuugaacuuuuuagucuccauaucuggaaugagagagccucacccuccgcuccccuucagacccccuccuggggguaauugucauggcugacacuugggcuggaguucccaagcugcaaggcuauaaaaagguccuccccaggacugccccugaaagccuccagauuccaaugaauuuugacuccauuggaagugaaagucagggucccucaggauuaaagacucuuaggcuuaagggcuguuagauuuccagagaaaccuaucaaauaaccuuuuuuuuuuuuuccacaaaaguggacacggaucuugggaauggaagguacuuguauauccauauacagguuuggcccgaaccaaagccaggagguguugggggaggacugggcuucuaccccagucuccaugauggcccucagccuuaauuagcagccuccugcaaaaugaaacaaugugcuuguuccaaaggguaagauaaagguccugacagcugccccucacuuccaaucagaugugguccucaaaucccugcauagagaaacucaccgaaacagcacagagaaacacacagacauacucacaaagcauacagagacauacccagauagguacgacacacacacacacacacacacacacacacacacacacacacacgguuggagguucugcuuggagucacacggcacacaagauugcugucaagaaagccuguccauaaauaguggcuguacacccuccucacuuacaauucagggaaaagaagagcggggaaggaaaggaggaaaaacaacaacaacaaaagccacgacagagaacgggaaaaggcagagacugaaagcgaaggaccgucggaggaggagggcgagaggucuggagaggagggcucgccggaggaggcgggcggggcgggcugugcggagggugcggccagcgcgguacccgccccggcgaggcgcuggggaggcccggguggggagaagaaauggggccugggggacgguaggagccuccgugcggagaccacuguucaaggccacaggugaggagguguggagggggcuucggggcuguugaccugggucagcuccuccccuccaauucaccgcuuccgcgacuccaaauagauggaaucacucaguccugcugcuacuggagagggaaggugaccuugacgcugccucccgcucggccuggccccuccgccuggcguuucagggcugcacggaguaggucuggcgggcggggggcggggcgcaggcacccgggacgaggguugccaugggaaccgcuagggaggcguccccagcccgggagccgggaggagcucggugggaggggagcgggaggcggagggggcugcgcuguccgacguggggagacugcggcggagggaggaggcgaggggcggcaggcacgggcggaagugacggaagccagggcccgaagauggacggaaucugucgccucugcacagccucauucaguuguguccuucccagacccucagacucgcccacuacagcguccagcgcugcccgggcgggggagaaggggcgcccucccgggggggauggguagggggugucggccggggaaaucaggccauuucccgccucccuuccccaccggcacccgcgccacucuuccugacaggaccaccgaugcccugcuccacaccaacugcguccuuuucccuagagagaaacugaggcagagagggguaggaauggguuuuugaaguguuggcggggguggggguguccuuugaagccucuacccagccuaucaacccugaggcgucgaggggcgauggggcuguuucugucucccgccccugcugcuucccugggacccccaccucccaaagccgaggcucaggcgcaaaggucccggcccuggcgggacacggcccgggcugaggaugcgggcagagcgcggggguucuccaggggcuggggcuggggccuggccgcgcguggggcagggcuaagcucaccucucugccugcugucuccgccgagcaaaggcggguccgguucgcgccugcgccgcaguuc

SEQ ID NO: 13457 - RNA, 3039 nt, Homo sapiens
auacaaaagauaaauauuuauucagaacaaaacuuuuaacaaucaauuuuacauucuaagccacaaggaaauagcaaaacauauagcaaaggaaaagcaaacacuaaaagaaaagcaguguacugucuuuucuacuggauaacacuuaguuggcccaugaccucucgcuuggccuaucucccaaguacauuuuagaguuaacagcucacucauaauuuuggguuaaaauccaucuuucuccugagaaucaggaguugcacaugagcuccagcuagcugcuucucuaggguucguagcuauugaggcuaaggugcaaauguaaaccuuugguagguuucuuuacacaggggcacccccauuucucacugguggcaaugaauggggaagggguagggccuccaaaggaccuggcacacuguaauccagaaguggugccccagggagcaacgaaugcacccuggagugugguccuugguccguuccguaucucccaaguauucagaagccccuccuuaaaaaccuucucuuucugcucccuccuccaggugauuucucagcauuccucugggcugaucauucuggagagaucagacuuucugggcccucaaguguugaggaaauuguugugaagugugagagguaguggaaugagcaccgggcuuggggucaggggacucuacuauaggcuggcucuggcaccagacagcuaugugauuuucacccagucauuuaaccucuuugggccuguuucaucugcuggaaaaccagggaauugguccaaaccaacucucagguucuuuccagcaggaauauucuagauuccaugauucuauaaaaaauggcuucugagccaccaaaagagcugucaugaaguccaugcaucuuugugccauaagagaggcccuuggccaccauucagagcuuauugauucagauuauauacacuucuaacaacacugguuucacaaauucucagaccacguagauuaaaagcagcaaauuaaaugagggaggggaagagcugcaaaagguagacacucugauagaagccacagucaacaauguuuucaauucagcaaacacugauggagugccuaccacguguugggccccguaccuagugcuggggcauaaagaugagcaaggcagcccaaagggugaaaauccaggggaagaaaagguauggggcggggagggcgggaggggggcaaggagagagagaaaaaguacaagaaacaaaacaaauacccaauagaaaaacgaaaauaaaauuuuaaaagggaggggcaacacaucugcacgcuacaguucuccgcagucguuauuggugacagagucaccaauucagaacaggcugaaauggaguaaacucgguuuaagaaggcauagagagaugucucuuguagguuuuaaaaagaucuccuucaaaaacgauaaaaaaugguuuaaaaaaaaguuuuggcacuuaagagggauaagcuggcuguguguucacccuggcaggcaggcggguguuuagugcccggccacgccgguuagcugagcugccacggaauugugcacugcuuugggacacugggcaaaggcguguccucgcuugccacagagguugcacacgaugcccuuccggcaguaagggcucaggugccccuccuccccgcaccugaagcaccuguccugcgugcagcugccgcucauguggguccgggaaccacauuuaaagcaugucuugggcugccccuuguaccagcuguagccccucucggcccccaggaagaaggccccuggcaagugccugaccccgcccucccccuggcgcagcucgaucucgcauuuguacuccccgguccagaucccaaaccugucggucacuuucaccggcacggccagcacgucgcaguggcgcuugagccaagucacaauguccuccacguccaccgucucguuccggaagaggaugaagagcgucuucaagcuggacuugcuccgccccagcaccacaaaguucucccagcaguccuccugcucccgcuucuccucguagacgcguaggaacagggccagcuucuccgcugagcggaagcucacgucgaauucgcggcugcccgggaucuggaugaccgcguagaugucgcucggguccaugccgauggagcgcaggauaagcgcuccuaccacgaagucccgggucgggcaggcgcccucgucucccuggaaacagaugcggacgaggaagcgacccuugcccgggccugccgccgccgccgccggcucauccuggaggggccgcucggccgcguccucggccucgccgggccuggccggggucgccauggcggccgccgccgccucggccuucuuccuccugcccgccuccgcagcgcccuucuuuuugcggggguccaccgccucgccggccggaucucuccgacggcccuucggauccccgcggccagccggugggaagucgccgagguccggcgccgccaggcccgcggggccgccgagcccggcgcucccuccaccgccgccgcuuuccuccucccgccgcggcggccgcggcucgcggaauucgcccuucuucucggcuagauucuucaccaccugggcccagcccaucuucucgcggccgccgucggccuccucgccccgggccgcgggccgcgcggggggcagaagcugcggccgcccccguuuccucucuuccuccgcgccgccgccgguggccauuuuaccuccuucccagcauccuccacucgcucccgcagccaaagggcgcccaucgcgcgcgcccgcccgccggggcuguguggguuugguuuuuuuuuuuuuuugaaauuugacgcuacccucccccgccgcgcccucaaagguaucacaugcggcgcauauuggccagcgccggcucugcgcccccugcgcugagccucucuuccgccagcgcucgcuccaaccucaccuccguccgcagcgggauggggcgcccggaggcggcccuuuccccagcgcggguuuggcagccuccggccucgcucucga

SEQ ID NO: 13458 - RNA, 3039 nt, Homo sapiens
ucgagagcgaggccggaggcugccaaacccgcgcuggggaaagggccgccuccgggcgccccaucccgcugcggacggaggugagguuggagcgagcgcuggcggaagagaggcucagcgcagggggcgcagagccggcgcuggccaauaugcgccgcaugugauaccuuugagggcgcggcgggggaggguagcgucaaauuucaaaaaaaaaaaaaaaccaaacccacacagccccggcgggcgggcgcgcgcgaugggcgcccuuuggcugcgggagcgaguggaggaugcugggaaggagguaaaauggccaccggcggcggcgcggaggaagagaggaaacgggggcggccgcagcuucugccccccgcgcggcccgcggcccggggcgaggaggccgacggcggccgcgagaagaugggcugggcccagguggugaagaaucuagccgagaagaagggcgaauuccgcgagccgcggccgccgcggcgggaggaggaaagcggcggcgguggagggagcgccgggcucggcggccccgcgggccuggcggcgccggaccucggcgacuucccaccggcuggccgcggggauccgaagggccgucggagagauccggccggcgaggcgguggacccccgcaaaaagaagggcgcugcggaggcgggcaggaggaagaaggccgaggcggcggcggccgccauggcgaccccggccaggcccggcgaggccgaggacgcggccgagcggccccuccaggaugagccggcggcggcggcggcaggcccgggcaagggucgcuuccucguccgcaucuguuuccagggagacgagggcgccugcccgacccgggacuucgugguaggagcgcuuauccugcgcuccaucggcauggacccgagcgacaucuacgcggucauccagaucccgggcagccgcgaauucgacgugagcuuccgcucagcggagaagcuggcccuguuccuacgcgucuacgaggagaagcgggagcaggaggacugcugggagaacuuuguggugcuggggcggagcaaguccagcuugaagacgcucuucauccucuuccggaacgagacgguggacguggaggacauugugacuuggcucaagcgccacugcgacgugcuggccgugccggugaaagugaccgacagguuugggaucuggaccggggaguacaaaugcgagaucgagcugcgccagggggagggcggggucaggcacuugccaggggccuucuuccugggggccgagaggggcuacagcugguacaaggggcagcccaagacaugcuuuaaaugugguucccggacccacaugagcggcagcugcacgcaggacaggugcuucaggugcggggaggaggggcaccugagcccuuacugccggaagggcaucgugugcaaccucuguggcaagcgaggacacgccuuugcccagugucccaaagcagugcacaauuccguggcagcucagcuaaccggcguggccgggcacuaaacacccgccugccugccagggugaacacacagccagcuuaucccucuuaagugccaaaacuuuuuuuuaaaccauuuuuuaucguuuuugaaggagaucuuuuuaaaaccuacaagagacaucucucuaugccuucuuaaaccgaguuuacuccauuucagccuguucugaauuggugacucugucaccaauaacgacugcggagaacuguagcgugcagauguguugccccucccuuuuaaaauuuuauuuucguuuuucuauuggguauuuguuuuguuucuuguacuuuuucucucucuccuugccccccucccgcccuccccgccccauaccuuuucuuccccuggauuuucacccuuugggcugccuugcucaucuuuaugccccagcacuagguacggggcccaacacgugguaggcacuccaucaguguuugcugaauugaaaacauuguugacuguggcuucuaucagagugucuaccuuuugcagcucuuccccucccucauuuaauuugcugcuuuuaaucuacguggucugagaauuugugaaaccaguguuguuagaaguguauauaaucugaaucaauaagcucugaaugguggccaagggccucucuuauggcacaaagaugcauggacuucaugacagcucuuuugguggcucagaagccauuuuuuauagaaucauggaaucuagaauauuccugcuggaaagaaccugagaguugguuuggaccaauucccugguuuuccagcagaugaaacaggcccaaagagguuaaaugacugggugaaaaucacauagcugucuggugccagagccagccuauaguagaguccccugaccccaagcccggugcucauuccacuaccucucacacuucacaacaauuuccucaacacuugagggcccagaaagucugaucucuccagaaugaucagcccagaggaaugcugagaaaucaccuggaggagggagcagaaagagaagguuuuuaaggaggggcuucugaauacuugggagauacggaacggaccaaggaccacacuccagggugcauucguugcucccuggggcaccacuucuggauuacagugugccagguccuuuggaggcccuaccccuuccccauucauugccaccagugagaaaugggggugccccuguguaaagaaaccuaccaaagguuuacauuugcaccuuagccucaauagcuacgaacccuagagaagcagcuagcuggagcucaugugcaacuccugauucucaggagaaagauggauuuuaacccaaaauuaugagugagcuguuaacucuaaaauguacuugggagauaggccaagcgagaggucaugggccaacuaaguguuauccaguagaaaagacaguacacugcuuuucuuuuaguguuugcuuuuccuuugcuauauguuuugcuauuuccuuguggcuuagaauguaaaauugauuguuaaaaguuuuguucugaauaaauauuuaucuuuuguau

SEQ ID NO: 13459 - RNA, 1393 nt, Homo sapiens
uggcuuauucgacagaucaagaaaaugaggcccagggagaggaaauaacacauggaaugaaguggugagcgagcagcagccauuugaagaaauaucccucuuccuucugggucugggugaccagcuggagaagagacuggagagaguggaggaagggacagccacccagcagaggaggcaagagcauggaaaaugucucuuucagccaauuuuccugaggaacccuggcugaggcucagggcugggaauggaaagugugcagggaggaggcgcagccgcguccacccggagaaacugucugcaauguccugccgggagaggccagggggagggaacugcugggaccgcagugggugaaggagccggaggggcagauccgggaggaugaggaucuggcaucuguccagggccaggucuccugggagaggaggggcaggcauuccccgagcucccugcuuccuccuugggcuccccggcucugccaacuccugcugugcccugcccaugaaucugggcaucaaccacuccuggaauggagaugcuggcaaacucgacucucuggggaugcgcacagcugacucagggagggugcgguggccaggaagaaggaucgauccuauucucagagaucuucgccagggcugguuaagaucugagagccaucagccacaucaaaugcauccugaucucuaugacaucagugcggucccucugccugguaaaucuccucuugcuacucacaaugcccauaauuccaccauuauggauacaaccaaggcucuuguucaguauacaaagguauggucauacuaaucauuaaaauauuuaaaugcauuccuacuaguugguaauaacccaugcccugaguguccuccaaguaccagguauaacagacccuccaggccuuccucuggaagccuccagggccccuccccuuaacagccauuaaagggguaguacccuuaccacggcagggccacccagggcuauguggaucaucaguaagugauggucacaaccauuauuacuacuuuucauaucacuccuggaaacaacccuuuggaucacaacuuugucuccuguuuaaaggcaaaugguagaaauuuagaggugaagaggcccugugcaaucucuucaucuuucagaugaggaaacuaacgcccagggagaagcagagacuugcccaaggucacacugccaggcaguguaaaacaagguauuagaaugcaggucccugacuccugacacuuccuuuaggugucaguuuaucuggaccccacacacugaacuugagcagguaauggaaggaagugauggggagggaccugucucaagaaagaagugagaaccaaucauuuggcucuuuaccuggucaccauagucauggcaacag

SEQ ID NO: 13460 - RNA, 2802 nt, Homo sapiens
cacagagugauuaaaaaaaccccagcuuuugugauuaauucaaagauggcucgucuguauuugggcccuggggaaggggaaaggggacagaagcagcaagcccagaguuccaugguuacuggguggugcugggauucacaacagggcucccuuagccccuguucaaugcugcguuucccauggccagggcuugagagccugggugugguuuccaugcugacccagguuugaauccuggcuuuaccacauacuugcagugugucaccugaacuccaguuuccccaccuguucacaaggauccucaugagugcagagccugacauguggaagugcuuaacaaacaggagcucuuauuauuuccaguagaaaguagggcaauccugucugcucacuuuccccugaaucuuccccucuccaggccacacugagggcucccagucuuugugcuauguugcuucauucuguggcagcucaguacuccauccucaucuuggugggagaaggaggcagagccuggucuacuagggaguagggggagggacgccccaauacccaacacccacuccaauccuguucuucucugccugcuucccacuaccaaggcugagaagccaaauccucuuuccuggacucuccuguagccaggguggcuuuaggaccccagucuggcccaugagaugcugaaaggguucugggaaaguuccugccuuccugaugaaggcagcaggcauggcuguuacgcuuuucccuccuucuugccucuaacgugcccaugcugccuagagcaguggcagccaucuugcaaccacaaauggaaggccaagagaaucacagacaugacugcuccaacaccaguggggagugccuaucucuggacugcuugcauuuacaaauaaaucccucuguaagucccucuauuugcagugaggcauuccugacacucugauaccguccugcccaccugagcaugcuugaagaugugcaugaugaagaugguaaggcccaggccgaagauguaggcugcaaagcugguguagaaguagguguggguauucuucuucaagcugcagggaaggugugaagaaagaggaggaggguuagauauagggacugaacuaguaauaccccuucugagggagcuggggaagacccuagagguugugggggggugacugagcucugggcugggagucuggaggugggugugcacgcugauacugcccccagcuaugugucucuggacaaguugcuuuccuucucuuagccucaguuuacucaucugcaaaaugggaaaaugagcucaucuccuugguaguuaugaauaucaaaugcugcaacuuauaacaguggcuguaagacuuuagucagcauaaaaaucaucuggaaagcuugugaaaaaaugcaggauucuaggucccacccccagggagucugaucuaauagcucuagagcagggcccaggaaucugcauuuugaaaaaaacaucugaggugaaucucauaccguuggaucaugcuuugagaaacacagauacagaaacugcaaagauaaguuacuacuuuuaagugcaguggacguaauaguucaauagccuauuugugguacuaacuagaugcuggcugcaugaauaaaugccaguggcuuccuggaggugauucauccaagaucagcuucagaacagaugaaucauauacagcccggcauugccauuacgugacuucccucuccaaugccagcuccguaaccucugcauguccccagcaccugggaugugcccagccaguacuauggacucaauuaacauuuguggaaugaaugagugcuucugacccccuucucuccuuguccugggugcuucuaagccuucggcugcaaguaccuugagaacucaccuaucuugagaacugggauacaagugacucccuuugggaauguugcacugauucuggaaaucagcugaggagcugcuuaugcugugagcccaggcuaaaaaaugagacucugucucugagggugcuggcaguugaaucugucuccagcaaauagccugggggcuucuuauggguuucacuuuguauuaccucugaacagccaggaguagagacggcuggcacagacaucccucuacuuacagacuggccaggucucuuccaaaggugacugugagcccauaugcuccuaagguuugaaguggcacuacacaaauaacccagguguaugugagugggaaaaaccuaaguuucacauggaaacuggauuucaaugaugcugguaguaaguuucucauuaccacugucacuguuauuacugcuuuugcaacuaucaggcaugaggaaaucaagagaaguucacaaaccaccucaaaguuaagugcaacauugccagcccucacagggaugacggggcauaaaaugauggagcuguugcuggcgcccccugcugacggcaagucccauugcauaggugcauuaacuuggauaagaccuuucuuguguuuuaaacgcugaccuaaguugcccaccuucucccccucgugcucacugucuacaacagacugaaaaaugucugaguaaagagagggcagggaacagcuagagcagcugagacauggugaccugacgcuaggcugauaaaagaugaugaugaugacugcaaccaggauucaaccaagagcgacugaggucagugugugcucagcacucucuccagauuuucaugguaggaacucuuguuauuaacucaagaugagaaaccagaggcucaggaaggucaggccacuugucaaggucacacagugagaaa

SEQ ID NO: 13461 - RNA, 1933 nt, Homo sapiens
gguguuuuggcgugaguaauacuguauagauguaaguguguguaguguuugcaauguuguagugugggugcaugugucuguguguccuguuuguugagaggauucauugcaugugguucuguuaggagugauaaugggguguuuugagacauuuccuccuuggucucuauuuuuugguguguugguuaugcagauuugguguuucgguagugugcgcggaggucaguguguugguuguauauuaugguguacuguugugcguugugcauuuggcagguugugucuauugguguguggcuguuggguuugucuguugugucagucguacauauaaaugccacguugggcgugugggugugugcauuuguauauugcucugugggugugcgaagcaguguguuuguguaacccugcagguuuggccuaugcugaguaaccuaagaugggagcucccugagccuuggcucugcccuugccuuuggcugcuggagacccugggcagcaauggcccuuuguccagccacaggaaaaccccaccccccuccaucggcaggggacuugggaggggcccagacugguaggcuccagccucccguccauuguucuggggccucucuggaaaacaggaugggaggugaaagguggacacaggccuggacccccacacucccugaaacaacccaggggcacagcacagaauccuuaggagggagggccuggggacaguccccauuuuguggaugagaaaacugagggguuucauuccuauuaaaagggagagagccugaagccccacacccuuuaugugcccacccacagccuccugccggguuugggggauggaaaaaugacaccccagaauggaaacaaaacggucuauugugguuuccauuucugaaugcuuaccaugugcuaagugcagaagugucauaacucugcagguuaaguucauauuuuguacccauuuugcacaggaguacacugaaccauaaggcaacaauuuauucuucaaaggacacuacucuaaacauuacuguauuucaaguaguacgcugugugaccuugagcaaguugcuuaccuucucugggccaggcccuaguucagcucugggacacagcagugaccaaaggagccgugguuccugcucucuuagagcccauagccugggcagggaggaggaggcaaggaauggcaaauacacaagaaaacaaagaucauuucugaugguaaugaauucagugaauaagagcaggagaauguaaaagaaaguagccuagggggaucugagaaggccucuggggaggcgacauuugaccugagacuugaagaaugaggagucuggcaaagaccuggggcugaucaguguucuaggaacaaguaacagcaagggcaagggcccugaggcaggacagagcuauuaauaguuuaaggagggaggccucugggcuggugagagaaagggaaggggcccaguuggguagugggcaggggaggaguuuggaucuuauucuccgugagaugugcugguucuggugguagugggggggccuguagucuccuguuacaaggguuggggguguggggacagccagagccaaaggucucucccccacagcuccggcagucccagcccagaggcgccggccuggcggcuggaagauugcacugugggcacaucuggggagcagcugccgagccagggccagagugggucacguggcacagggcaggaccguccuggagccuacaaggccaagacuccuaggaggggcaguggagaacacucuggacgagaacagugcgucaacgaggaggaacugugcacuguagacguccaggcacacggcccccugcagccccacacagccccugccucaggacagagugccuggguucaaugccaccucccagcuuugugaucugaaacaaguc

SEQ ID NO: 13462 - RNA, 1360 nt, Homo sapiens
cucucauuccacguucuuaacuguuccauuuuccguaucugcuucgggcuuccaccucauuuuuuucgcuuugcccauucuguuucagccagucgccaagaaucaugaaagucgccaguggcagcaccgccaccgccgccgcgggccccagcugcgcgcugaaggccggcaagacagcgagcggugcgggcgagguggugcgcugucugucugagcagagcguggccaucucgcgcugcgccgggggcgccggggcgcgccugccugcccugcuggacgagcagcagguaaacgugcugcucuacgacaugaacggcuguuacucacgccucaaggagcuggugcccacccugccccagaaccgcaaggugagcaagguggagauucuccagcacgucaucgacuacaucagggaccuucaguuggagcugaacucggaauccgaaguuggaacccccgggggccgagggcugccgguccgggcuccgcucagcacccucaacggcgagaucagcgcccugacggccgaggugagauccagauccgaccacuagaucauccuuauaccgacggggaaacggaggccagagagggcgugggcgcuugcaccacuuccgucccauccuugcggguaccuggcuaugcgggggugccuaaggagccuggaaaaagcgcucccccgucgugcuuccuggggaagggggcguucgcugcgcucggagcggcgucccuuccaacccgccggucucauuucuucucguuuucacaggcggcaugcguuccugcggacgaucgcaucuugugucgcugaagcgccucccccagggaccggcggaccccagccauccagggggcaagaggaauuacgugcucugugggucucccccaacgcgccucgccggaucugagggagaacaagaccgaucggcggccacugcgcccuuaacugcauccagccuggggcugaggcugaggcacuggcgaggagagggcgcuccucucugcacaccuacuagucaccagagacuuuagggggugggauuccacucguguguuucuauuuuuugaaaagcagacauuuuaaaaaauggucacguuuggugcuucucagauuucugaggaaauugcuuuguauuguauauuacaaugaucaccgacugaaaauauuguuuuacaauaguucuguggggcuguuuuuuuguuauuaaacaaauaauuuagauggugguaaaguuguagugacuucuuggguugaggggaggggccugggcuggggguugaccccugacccucuucacagcugguucugggaggagaauuggagggcuacaucuggauuguugcucuuaccggccugaau

SEQ ID NO: 13463 - RNA, 1360 nt, Homo sapiens
auucaggccgguaagagcaacaauccagauguagcccuccaauucuccucccagaaccagcugugaagagggucaggggucaacccccagcccaggccccuccccucaacccaagaagucacuacaacuuuaccaccaucuaaauuauuuguuuaauaacaaaaaaacagccccacagaacuauuguaaaacaauauuuucagucggugaucauuguaauauacaauacaaagcaauuuccucagaaaucugagaagcaccaaacgugaccauuuuuuaaaaugucugcuuuucaaaaaauagaaacacacgaguggaaucccacccccuaaagucucuggugacuaguaggugugcagagaggagcgcccucuccucgccagugccucagccucagccccaggcuggaugcaguuaagggcgcaguggccgccgaucggucuuguucucccucagauccggcgaggcgcguugggggagacccacagagcacguaauuccucuugcccccuggauggcugggguccgccggucccugggggaggcgcuucagcgacacaagaugcgaucguccgcaggaacgcaugccgccugugaaaacgagaagaaaugagaccggcggguuggaagggacgccgcuccgagcgcagcgaacgcccccuuccccaggaagcacgacgggggagcgcuuuuuccaggcuccuuaggcacccccgcauagccagguacccgcaaggaugggacggaaguggugcaagcgcccacgcccucucuggccuccguuuccccgucgguauaaggaugaucuaguggucggaucuggaucucaccucggccgucagggcgcugaucucgccguugagggugcugagcggagcccggaccggcagcccucggcccccggggguuccaacuucggauuccgaguucagcuccaacugaaggucccugauguagucgaugacgugcuggagaaucuccaccuugcucaccuugcgguucuggggcagggugggcaccagcuccuugaggcgugaguaacagccguucaugucguagagcagcacguuuaccugcugcucguccagcagggcaggcaggcgcgccccggcgcccccggcgcagcgcgagauggccacgcucugcucagacagacagcgcaccaccucgcccgcaccgcucgcugucuugccggccuucagcgcgcagcuggggcccgcggcggcgguggcggugcugccacuggcgacuuucaugauucuuggcgacuggcugaaacagaaugggcaaagcgaaaaaaaugagguggaagcccgaagcagauacggaaaauggaacaguuaagaacguggaaugagag

SEQ ID NO: 13464 - RNA, 1277 nt, Homo sapiens
auuuaagcaccagcccagggugagguggaggcguccgaaacccuaaagggacuucucaaugggguucaagguuucagugagggacgcagggagggggaaacugccucagaucugcaaucugacuuugggaaggccacccccaggccugucugugauguugaaggccggagacccccaacaaaugccgcugguuugcucugaauuccccaaaggcccagaacguggcaguuggggauugccggguccuccauuccccgcccggacacaauggccgccggcgcccugcacaaagacugggugagggugaggcgcugggccucuccucaggucaggaagaggggucgaggccugcucgacggccccacagcugagaccacguuuuccuggggacaggcccaaaguggcuuucuggcgcccccgggagggcuccggggccgggggcugcaccucuccggagcccagggugggccggcugcggccuagcggcuucucgagcucacuaggccggguacccgccgagccaccgccccguugcuaggcaaccgcccucccccgggggcgcccccuagaccuuccugagaggaggggccucgcccccggcgguccgccccagcgcagccaaucagcgagcccagccggcacggaagcgggacggcgaaggcuccuauugggcgcaacggcugucacgcacaggggaggcggcgcucucaccugcgagccccgcgagccguggggggccacaucccccuucaucggcccgguagcuuccagacgcaagagcucuucgcggccgaguuccgcgccgcggacccgggccggccuaccuggcugccggccuaccuggcugacugcucgcgccgucucucccgaacaagccggccucaguuuccccugaagagacaggggaacuugcaagcucagucacuuccggugccgcggcaacgcgcgcgagcccgagacgcaaagggagugcgcgccuugagugacuggcaucaggaccggggagagaucgcccccucgcgguagaucuggggaaucgggaggcgcaaaaaaucaacauuuauaaucacauuuccauuuauucauucagucagucagucagucacucaucagucaaucagccuauuucauccguccgucaguuuauauauagaagaagcaucgccuugugguuaagcacuuugucuggauucuaacucugcuaguuaggcaaguuucucaacugcucugugcuucaauguccucaauuguaaaauggguaauaguaccaaccucuc

SEQ ID NO: 13465 - RNA, 15294 nt, Homo sapiens
ccgcggcaccgcccccuccacgacccgagcgcccgcucgcgcggcucccacaaugcaccgcacaauggcccgaccgccgccacuaccggggccugagggggccuggcggagcccgagcgcggcccggcccgcagcguggggccccgagcgcggugagugccggcgagggccccaggggacggcggggagaggggcgggaggccgucucgcugcguccgcgcgcccuguacccggagcggcggcgcgccucaucucgggccccucagcgcggucgcccacacccccgacccggggcccggucugcgccaacccggccccagauaggcccuggggugacgaaaacucucccuggaccccauaccugugucugggggacccgaggaagccaccgguccccucccuuccgagaccuggagacgcaguccugagggucccccauucccgaccccuaggcucccuggagacccagauaaggcgcugcugaccuuaccagggacccgggucugggggacgcagauaagcugcaccugcucccucccuccgacacgccuacccagacccacauaacccccuuuccugcuccagauagcccgcucuguacccuguuucauuuuccagacuuacauaacucccuuugaggcuucccucaaauaucugggucuggagaagucgaauaagccccaccuguaguucccuccucaguggccauacucccaggcuuucgacaucuuccaucccguuacccauuuugagacccucuugaaauucagaggauacacuucugacuauccccauccccccagccuuccagcccuuauaaucccccauuucauucuuguggggaucccuuagagacccaggaaaguugcucaugauuccuucccauccucgcucuuccuucccaucccagagacucccuccagacuucucccuggauuuccuuugcuucuccagcccucauccacucccaucucucccaggcucggggaauugaaccuuucccacaccacaguggggugaucuaaaaguuggccugggaccaggcuguggcccaccuugguggggagaaaggggccuguuagguggaggauauggggacaccugugugggggaaucggugcuuucaccugcaagcuuagccugucuccuggcuuguguguuuuuccaccugucagccaugggacuguguguagagucuggucuuggguuucuaaccuuucucuccuaaggugaggccaccagauugggagcgggggugucgaaucacguuuucuccccaugaaaaugggguugugaugaguugcagccauuuguucaaggccuccccaggagugggaggcagcaggaaucugaggaaauagugaaucaaagagacuccaaagagggcccaucuacacugacagaagaauuagcagccugagaguaaauccaaccccuguuaauccuguuugauguuucuuggaauggugcaagucauugagacucuccagccucccuguaauuuaauucucccaccacucuggagugggcgggggggaagggggcgacagcauucccauuuccccucuucucacuguuuuccagccaaccaguguguuuuaggauuuguuucugguucugagaucaggaucuguuuuuuguuuuguuuuguuuuguuuuuucuuuccucuaagucuauuuauaauuucccaguugcuauuuuggguucugcuuaagggaagauucuaucccaaggaacguucugggucuauuuccuccggcagguguugaauugaguucuucagauccccaaguaacucuugggcaggaggauaaaagcuauuuuaggguagucacugaaguggagcuguuaauccucugugggucucuuuaguuaagaacacucaaagauuaacccuuuccuugugcagggguguuaucucucaacuguuuuuuaggggggagugaggagaauuugaguguggcagcagaagguggaaacaugcaacucaauacaaagacaaagauaauagcucucuuuuguuggguacuucuagcaggccaagcucugugcugagcccuuugcauaccucacuaaaauaauccuuacagcaagccugugagguaaguauuuuuagcuuuacagaugaggaaacaggcuaauaauggagaaagaacgcaguuucuauagagaugauguaacaccauaaaaacuauaguuucaucagagagcagcaggcaucauggcccauaacaggggacggacagacuggggagaaauaugucucaguuucagcuuucaaagaggaccauacagaguuuuuagcaagcauuccuguuugggauauggagcccuaauaauacaagagaguauaggaaaguggcucucugcuuaagagagaacucuggcccaggagauggugccuggagggagguaaaguaaggggcucuuuaaaggggaugugccgaggguuaguugugagggaaaaggggaagacugcauucugggggagauguugggaaaggaaggaaacucacucugaggccugagaaguaacauuaaagaggaaaaaaagaaguacuauucaggccucaugcggaaaaagaggcagacacagccgagaccucagagaaggcacugcauguauucagagcacacauuuuguaucagccacuuucaagaguauuauuucauuuaauccucuauacgaaucuuacagguaaggaaaauaaauccguauuuuagaaauugaggaaacugagguucagagaaauaaaguaaccugccuaugguuucccagccaguaaguggcagcucuucugauagcaaguccaagguucuuuccccuuucagaucaggcacuagaaagaaucuuaggcugaaaauauacugaguugugccaguaacugggaaggauuguguuuguuuuauggaaacagguucugucagcuucucuauagucuauaguuguuaagauuaaaaugugagaccagaagagcagcuuugaaagagaaguagaauucuuucacaguuuugcugaggaaggacaagucugaaggaacaggccuucugcuuauguaagacaaacccaggaaucuuucuggaucagaggaguuuucagacaaagggcagagagagacuagauccccaaaaggguuccuagguaacacuagcagcuuugguuauccaagaggcugcuggugacuguagguagggacuuccugugccuuuugaaaaguguaggagaguaggaucaggguguuggcucuuuucuuugugaagacauagccccauuaaaagcagaucaaggugagcacauggcugcugcuuuccuccuuugguucuaucaguacaagcuccuuagccaccaccagccucuuuccuagaagcccauuacucacucuuucaguagcagccuacuaaacuauugugucuuguuugugcuuguucaggagaacagaugagguggacgugugggagguggggacguaauguucucuuucugaguuuguguggaguuuccagggcuaggcuccucucucacaucagccaaauugaugugacuuguuuccuucuggcugccauucccaacuuuccagaggcugaggugcaugauuucaaauugaagggggaguagaauuugacuuugaagguagggguaauucccuccaaucuaaacaugcacacucgagcacacucucugcucaauuccaaggugcauaguaauugcugguauuacaaacagguaauuccacccuugcaaaggaggaggggacuuaaacaaugaaagccagacgucacaggccuuugagguuuauagugaagcaggcacauaugccauaaugacuugaaggcucaagugggacuaguuuuuagugcuaccuaccccuccccagcaugugauucaugcaaaaugcagccaccuuaaugcagaucuuucuagacaaaucuacacucgugauggggacguguuuaucauauuacaucgcaguguuucuucaacaagaggaaugguuccugaacaggacguagcucauguuaaugaugagcaaagcucucuggggcaugaacccgcugaucccaucaucuuguucacggccagucuguuggaugaauggucacuguaagcagcaggugcuaaugagcugagcaagcauucuguggcccacagcuaguuugugcaguuggagcccuccccagauucucguggauaauccccagacacccccuuuucucucuucacauggaaaagccucaugaucaaauuuuggcaccaucucuucaaagggaaucccccuguuguagcagguugcaucgugguugguaaucugugguaagcuugggaguaugaaugugggucucuuguccccuuuugagagucagugugguaacucccauccucuuccucuggauuaguaucuggaauggaguugugucguucuugcacaucuccccuucuauucaacaagagaaagaaucagacuuuaagauuucggcuccccacuugggaauggcugcgaacccaguuuaaaccagaacuaccugggccuagguuggucccugagaaucaaccugcauucagugacuaguuuaccuaucugaaauaaaguuaggguuccuuuucuagauauuagguauauagagaugaaagagagaugaugcaagcccucagacaaucaggcugguggagaggaguaaauuccaaugcgagcucgcuaccgucuucuaaaggagaugugcauauguacucugaggcccuguaggaggggccucucagcaccuagggguguuggacaggcuuugcuaaagagggauggucugggcccugagacacagugacccagagaaguggugguggucaggaugggaccaguucuaguccugguuuagggaaaaugcuaagaaucugcuguugccuucccauauagacccuccugauguugaugcacugcuaagaaacacaucugguaccaggacugacuaggauguaaauuuccuaaguagaggcuuccccuuccuccucucuugccuuuugggcauuuuauugcuccuuagcaccuccaugaggaggacaauuguggaaaguaguggacgaggaggugccaggguaauaagaaggaggaaccgcuaucucuagguucaauggaaaggauauaaaagugagguccagaagaaaaaguuugaaguuuuggggcuuuugguuccucaguuuaucuuguuucuuauuagccuagaugguacuaguaauaguagcuaccacuaagcacuuaauggaugcccagccuucugcugaaugcuuuauauucaugaucucauuuaauccucaaaacauuuuuauaauuuaggagauuauuaugcccauuuuauaaaugaggaaacagcucagggaaguaaguaauuggcugaaagucacacagcuucuaaguggaagggcugggauuggaacgggaucugucugcuuccagagcccauguucucaugguauugggcucccuaacaccagguguucugauguuucaggugaagagauuguuuucugaaagcugcguuggaggcugugacagagcugagagccuguguggagcggauggggaggcuuucucaauaacauggcccuuugccauuagccuugccaugaccacauuuuucaccagcgucccccccuggauucaagaugcaaagcaggaggaggaagugggcuggaaacuaguucccaggccucggggccgggaggcggagagucaagugaagugccaaugugaaauuucgggaacaccuuucucaaauggggagaagcugaggccucacagccucccgcaaccagagcagagaccauauagcugcccucagcugcacuguggcaaggcuuuugcuuccaaauacaagcuguauagguaggugacacucucauaucucuuccugcccugagguucccagagggaaaaagcagagagacucugccuaguguggguuuuuaaucuguggcagaagaguggagguuaauuuguccuacaaguauacccugaaugccaaacaguugaagucacucacuaaaaaaugauucagauugcuugauucagacacuagaaucugauggguugccuccccaaaguauugggauugcuggcgugagccacugcaccuggccuucuuacaccuucuuagugacgaucugggugccaaugucaggcagccuugaguuuuguuuguuuguuuguuuguuuuuuuaagaaaugggagucuugcucugucauccaggcuagaguacaguggugcaaucagcucacugcagccuccaauuccugggcucaagugauucucuugacucauucucccagguaacuaggauuacaggcuugaaccaccgcaccugguuguuuuuaauuuuuuguagauauggggguguggcuguguuccccaggcugguuucaaacuccugggcucaagugauccuccugccuuggcuucccaaagcagugagauuacaggcaugagccaccgcacuuagcccugaacauuuuuuuuuaaauauugcuuuccucaccuuugucaggugauggucagaauuuuagcuagaaguuaggaaucaguauucgaacuuuagaaggaaaaguagaccuucuggcccagucuguaaauuuuaaaguagagguucagaguagggacauaacuuacccaaggucacacagcuucagagguccugcagugccucuucuacugaaucagccugcuacuuacucauuuaacuaugucugucucccuguugcccacuggggcagcugcuuuucugaaacuuguaagcccaagaaccccuacuuaaagugaaauuaaacguaaaagcccugacauaaggcagauagagaagagcagcuuugguugcuuuggugaggauggggaggcauggucaaaagcaauuuugggccaggcgugguggcucgcacuuguaaucccagcacuuugggaggcugaggcgggcggaucacuugaggccaggaguuugaggcaagccuggccaacauggugaaaccccaucucuacuaaaaauuuuuuaaaaauuagcugggugugguggcacaugccuguagucccagcuacuugggacucuguggcaggagaaucacuugaacccaggagaaggagguugcagugaacugagauugugccacuguacuccagccugggugacagagcaagacugucucaaaaaaaacaaaaaagagcaauuuugauuuuauccuuuucgcauuagaggaaccaugaacuugcccuuuagaaaugagauagaucagccgggugcgguggcucacgccuguaaucccagcacuuugggaggccaaggcaggcggaucacgaggucaggagaucgagaccacggugaaaccccgucucuacuaaaaauacaaaaaaaauuagcugggcgcgguggcaggcgccuguagucccagcuaccgggaggcugaggcaggagaauggugugaacccaggaggcagagcuugcagugagccgagaucacaccacugcacuccagccugggcgacagagcgagacuccgucucaaaaaaaaagaaaugagauagauuggccugaugcacagucauccaaccauccauucaucuauccaacauuauugagcucuugcucuguaccaggcacagugcucggugcaaggggcggaguagugagccagacagaugggggugcugguccuccuuggguuuauggucuuaauaguggguacagacaguaaacaaguaaauacaugaacaagaugaccacaaagccucaguuccucaucuggaaaacaguuaauaggaagggacuaaaauaggcaacaggguagcaugguagucaggauugcccucuugacaauucugugguccucaggagugcuuagauucucugugugcuccuauaaguuaagggaacuccagucaaggccauacucuuaggcuuucuuuuuuuucuuuuuuuuuugagacagggucucacuuuugcccaagcuggaguauaguggcgugauuauaacuaacugcagccucaaacuccugggcucaagugauccuccugccucagccuccugaguagcuaggaucacaggcauguaccaccaccacacccgcuaauuuuugcauguuuccuagagacaggaucucuucccuguguugugcagggugaucucaaauuccuggccucaagcagucccuccaccuuagccucccaaaguauugggauuacuggcaugagccacugcacccggccuucuuagacuuucuuaaugaugaucugguugccagugggcggcugcaggaaagguccugggucaggaggcaggagcccugacucaucacauauaauuuacugugugaucuuaggugaguugcuagaccucuuugggccucaguuuccucaccugcaaaaugagggaaaugaaaaguggaucacucagcaccucccucucuacauuaccacgucaguuccaucacaggagguugacaguaacccacauaggcacgagcacucuugagcaugcauaugugggaugugggcaggggguguguuugauacccuccagguagaaaggaucacagagugcuguacgagagagagacagcuguugcauaccugacugaacauaggucuuccgaaggccuguuuaaauucagccucugcuagggugagggggcugccuuuuuuuuagacuccuuuccuugucuggagaucaagguuaaugacacagcuuaugcagagccuggcaaacagugggugcugaguugauucugaauaugcucuggagcugugaauugcaguuccuggauucugagccacuuuucaaccauauaggaucagguaaaccaagggacacugaagugccauaccauuaaaacauuucuuaaaguguuacugguuuauaugacaagcaauucaagugguacauacuggcaugcagugaagaaugaaugauccucacacucgaagucacuauuccucuccccaaaggcagcugguggguugguuuuuguguauccuuccuaagacauucaaacauguauauucucuuucuuuuuuauuuucaaaacagauuguaucacauguacuguauugaacuuccuuuuuugacuuagcccuguauaucuuggaaauuuguucuagauaaggaaguuuauuuauuuauuuagagacggagucuugcucugucacccaggauggagugcaguggugcgaucacagcucacugcaacuucaaauuccugggcucaaguaauccugccuuagccucuugaguagcuaggacuacaggugcaugcugccaugcccaucuaaugguuaagauuuuguagagacaaggucucgcuauguuguucagguuggucugaaacuccugggcucaaaugauccuccugccucacccucccauagugcugugauuacaggcaugcaccacugugcccagacugcacguuuagguauauuuuauuuucucuuuauuguaucauuuaaaauuauuuaaauguaauguuuaaaaaaugaaauacuuucacguaauucaaaauucaaaaaguaccaaaacuuauacgaugaaaauucuccaugacacccaucuauaagcuguucgguucuuuuucgcauaggcagccacugguaucaguuucuuguauguccuuccagaaauauuuuagccauauacaagcaaacauacauauauuuuuccccuuuucacauagaguccuagucuacauccacuauucugccuccuugcuuuuuuucuacuuccugucucuuaggagcauguucccuguaaguacacaaaaagccucauuuuugaaaaguugagucauuuuauggacuuaucauaauuuauguaaccaguucccuauugauagauuggacguucagauuguuucugauuuuuuuugcuacuacaagcaaugcugcaaagaaugucgguacacauuauuuugcagauaggcaaggauaucuguagaauauaacugguuugguauugcauugcaagccuuuaccaugguuuuuauaucuaguuuccuguuaauggacaccuuugguuguccagucaucccuugugaucuccccucuuucugcuuucuccccuauccccugucucuacccccaggcacauggccacccacucagcccagaaaccccaccaguguauguacugugauaagauguuucaccgcaaggaccaucugcggaaccaucugcagacccaugauccuaacaaagaggcccuccacugcucugagugcgguaagaauuacaauacgaagcugggcuaccggcgccaccuggccaugcaugcugccagcagcggugaccucagcugcaaggugugccugcagaccuuugagaguacccaggcccugcuagagcaccugaaggcccacucacgccggguagcaggcggugccaaggagaagaagcaccccugugaccacugcgaccggcgguucuauacucguaaggauguacggcggcaccuaguggugcacacaggccguaaggacuuccugugccaguacugugcccagcgguuuggccguaaggaccaccugacgcgucaugucaagaagagccacucgcaggagcugcucaagaucaagacagagcccguggacauguuaggccuacucagcugcagcuccacagucagugugaaggaagagcugagcccugugcugugcauggccucucgggacguaauggggaccaaggccuucccuggcauguugcccaugggcauguauggugcccacaucccuaccaugcccagcacgggcgugccacacucccuggugcacaacacgcugcccauggguaugagcuacccucuggaauccucaccuaucucuuccccagcucagcucccuccaaaauaccagcuuggaucuaccucauacuugcccgacaaauugcccaaaguggagguggauaguuuucuggcggagcuuccuggaagccugucucucucauccgcugaaccccagcccgccucaccucagccggcggcagcugcggcccuccuagaugaagcacugcuugccaagagccccgccaaccucucugaggcccucugcgcugcuaauguggacuucucccaccuacugggcuuucuuccacucaaccugcccccguguaacccaccuggggccacaggaggccuggucaugggcuacucccaggcugaggcacagccccugcuuaccacuuugcaagcucagccucaagauuccccaggagcugggggaccacugaacuuugggccucugcacuccuugccuccugucuucacgucuggccugaguagcaccacccugccucguuuccaucaagcauuccaguagcccccacagaggcccucagcucaguuuuuggcucuguuauggagccuuaguacccaccccgucugugucccccaugaaggcagcugagcuuucagagcuggguucaaaaaaaaaaauuccagugucuguauacaggagcacuugguuuggggguucaggcucuaggaucgauuccagaaggagccuugagccccaaccccgugaaaagaucucauaccguaggacuucagguauuauuuacuuuuauuuuuuugaccugaaucgggagccacacuuggcccucuuccucuccaaagcgccagaaccuccuucucuuuggagaauggggaggccucuuggagacacagaggguuucaccuuggaugaccucuagagaaauugcccaagaagcccaccuucuggucccaaccugcagaccccacagcagucaguuggucaggcccugcuguagaaggucacuuggcuccauugccugcuuccaaccaaugggcaggagagaaggccuuuauuucucgcccacccauuccuccuguaccagcaccuccguuuucagucaguguuguccagcaacgguaccguuuacacagucaccucagacacaccauuucaccucccuugccaagcuguuagccuuagagugauugcagugaacacuguuuacacaccgugaauccauucccaucaguccauuccaguuggcaccagccugaaccauuugguaccugguguuaacuggaguccuguuuacaagguggagucggggcuugcugacuucucuucauuugaggucacauuuuucccccguggggaaauaaacugacuuuggacugcuucagucucugccaucuuccaugacugcauuuguuccugccugccucggcgguauccacagaagacaggcaagaggauuggagcaguuuucucacaggucugcaauucuguuuuucuccaaguacauuaugacccccucauccuucucuugaacuggagaggggaagaaaugaaaggcaugcccacguccgucaccuccccauccccuaguccccaccuugaacaucaugagcuguuguuauuagucuuggaagcagagucuggguugguguggauagcaaaggaggaagucugagccccucauuggucuuccucccaccugucccuuuuccgggaaguuguggaauuguuggaagaagaguuugcagaagguuaggaauggguagauagcuaaguccuaaucuauggguacauuguugugucccaaaccaaaauuuuccuuauccacaaugucccuucugucucuuccacuuuacaguggacucggccacugugcauaggcuucucugcucuccaucaaaucacuuccacuuuccugugcccccacccccgccuccaguuuuccgcuaguauccggcaagguuucuugcaacaaaugauuaguucuuuucuucugacucguggggcucccugcugcagagagcacagcccuugccuggagcccaggaaccccauccuugcuucaucucaguucuucaugggcuucacucuucccacucacggaagggagguagcucagggaccuccacugugggacccuugagacgcuuccacucugauucagaaacacacuucuaccucuuuacuguuaacucuuaacagaugcagucagcaguuucugggcacuucucucaguaggugccucaugcugacuucuccaguaggguuucaggacaaacuaccaaggaauugccucagccuccuaccaguccucccucacccaccuucugucuagguucacuugguuugucaucaggaacugagcagguccaggacucagcuuucugcuucagccuaagccaguacuccuuguuugagguaaaagccuuaaaauuuagcucccuagcucuugauuagaagcaauuuggaguaaguguguuuugauuuaggcaggguagcuugggauaccuuuuuaaaaacaccagauauuaaaaugucuggcaagguuagaaucagacuagaugauuugcuucuaaaaauuaguuucagugagucccagggacuaauuaagguuuauuuuaaaaagugucuaccuugguacgcagccaccuccugcaugcugugcauguuauugggacuuguauuauaggugaugguaugugagaauccaguugggacucgcuguugccauccucuuuguuguaucugguuuucaucacuagacucagcaacccuucucaccuuaacugccaccuucccuacacucucaguuuacagaggccacugggccucuggcugcagaauacaaagucccgggcuguuagaggaguccuuuccucucugccugcccuuuccugucccucccucgaauucucucuccccguaagugaugcuggaaaagucauaggacuggcaaagcaacuguuuaaacccuuuguaaccggggccuugcccccaccuccugucuuuucuccuugccuuccccacuccuguguccucccaucuauccugucuuuccuuuccuccucucaguguccucagcacccacaaggaauuuuccuaucacugugaacuuugcugguacagaggaauaauaucugccuucaccuuuuuuuuuuuggaccauagcuagccagucauuucuuaaaccucccuuccuaaaaucuggggggucggggggaaagaaaaaaaaagccuuaguggccugguuguucaaaggauaagaauagcuuuauccugcacucaguacccgaacucacuucaguaugcuuacugaggccaugagaaccugaggggcaucugcccaggacaggagccauggcauaugacaaagaccaaugagggaccaggaaaaaaagugauguccccuuucccugccaccuccagccucugccagcaaugagcugucccccucccacccuacacaguagcuggucagggcugaguacaguccuggggguaaggggaugacaugcccaggugucagcucaaaggaucucugcaucaucuugaggugggaggcagggaaaggagcgccaaugagguucccugcaacccccgcccuccagcccaccgcccaaccuuuuacaaauggcauuuucuuaauugaaaauccgggaagcaggugugauuacuuuuuugcucguagauauuguccuaaguuggaauucucccacugcccuaaaacuuucccuaguaguccuuuaaacuccccccucccuuuuugguagcuguuuucuccguccucucuccaccugcccucuuaucuaggagcuguuuguaagcacgauuuuuuuaacagguuauauuguacaggaucaauauuuugcuuuuuaacaaggauauuuauguaauaagaaacuuugccuuaggcagguguuggccagaaaaguccagauuccucugggaucccacccuggccucuccuggaacucugaaccugcuguggaaggaauuggccaugaccuucaccucuggagaguagggucuauggcgagggaaaaggguguucaccaugauaaccuagugccuccauagagggguuuggaaaaauuccaguccgauuucuuugugugucagcugacuuccuuagcugauuguucccacuugcaccucuccaccuuuggcacuagaacuccugagacaccacuucucaugcuucucccucccuaccagcggucaaggcuuuggagccacucuuuuguaacuccagauuauuuaaagagaaaaguacaagacagaaaucuucuagcacuuuguaaacacagugaauaaccucuuggaguauuuuuggcuuuauauaaaacaagguuuuuaauuguaaaguauaagugccauuagaaaaugcacagggcauaucuuuguuaaaguagauuuuucaauguuuuacagaauuacauuuucaaaaaaagguuuuuauaaugaaguuguuuauuaaaaacuucugaaugauguguuuggga

SEQ ID NO: 13466 - RNA, 5614 nt, Homo sapiens
agguccugaaaucuauacuugaaaaccuuaaagcaucagagagcugccauuuuccgugauuucgguaaaaagcagcucagguuauccuuccuuugaggccauucuagggggucccacaaaucuuuuuaagcaaaauaaaaauauuaauaauuauuaaaguuguuuucacauuguugagguauauugcauuaagaauggaauuuguuuuuccaucauaaaaguagcacauacuaauucuagguuuugaaaauacaaauauaaaaaagaaaaaauauuacccauagcuacuaccuuaaucuaaauguucuauguuuugcgguugaaaugaaaaagaauuuuuuucaauuaaaaaguguaauaugggccgggcgugguggcucaugccuauaaucccagcacuuugggaggcugaggcaggcagaucacuugaagucuggaguuugagaccagccuggccaaacauggagaaacccugucucuacuaaaaauacagaaauuaaccugguguuguggcacaugccuguuaucccaccaacugagguaggaagauugcuugaaccugggaggcagagguugcuauaagccaagaucaugccacugcacuccacccuggaugacagagcaagacuuuaucucaaaaacaaaagguaauauguccauggcucacaacuguaaugccagcacuuugggaggccgaggcaggaggaucacuugagguuaggaguucgagacuauccugggcaacauagcgagacccugucucuacaaaaaauuuaaaaaaaaaauuagcucgggguggugggaugugucuguggcccuaccuacuccuagcuacucaggagucugaggugggaggauggcuuaagcccaggaggucaagacugcggugagccaugaucaugcuacugcacuccagccugggugacagagugagaccuugucucaaaaaaaaaagacaaucaaaaguugccauagucugaugguuacccagagguaaccauuauugacauuuuguugccaggcacaguggcucaugccugcaaucccagcacuuugggaggcugaggugggagaauuacuugagcccaggaggucaaggcuacaauaagcugagauugcaccauugcacuccaguguaggcaacagagagacccugucucaaacaaacgaaaaagacauuuugguaauuuaaacacguuuuccucccuacugggagacugaacagcaggauuuaaacgauggugaauggaaggugagcuaugaguuagggcugcccaucacaugggcagauucugugacuuaaugacaauaauaaggucaugaagucuccuauacagggucuugcucugucacccaagcuggagugcaauggcgcaaccauggcucacugcagccucaaacucuugggcucaaaugauccuccugccucagccuccugaguagcugggacuauaggcacaugcugccacgcccagcugaagucaugcucucuauccaugagcaucuuuauaacuugcauagauauauuugggugaaauccugucuuggucuuucccgauucucccugagcagguuccaaacauuguuuagggcucaaagggaaauuagucuucagaguuucuccaguaaaguaauuacggagaucgggucauuuauucaacagauugggugccuaccaugugccaagacugugccaggcacuggggauaugaugaugaaaccaaagaugcuagcaugaacacaaucacuaaaccaaagucacacaaauaaauuaaaugugggagggacaaggagagcuauacauguacugaucaucugcuaugcuggaaguuuauuuagcaaauguaaucuuauuuaaucaucuggacccaagggagguaaucugaccucucugaaucucagcuucaugugaaaacggggauaauauuauugagagagaacauuuguuacaggggcaaacccuguuccaagguuucuuucacucaaaguauaaacaaugaggcacuuuuuacacuuuagacacuaaaacuuuuuggaggcaaagagggcugguauuuagugaguaucugcuaugugcuaggcacuuuacagagaucucauuuaaucucaguuccauucuuugaauuugcuauguacccugcuguccaaaugacggcacugagucagugagagguuucauaacuugcccaaggccacagaacuggauggagaaagacugcagagauucaaacccaggccugcugacaugcagagccaaugagaauauauuaucuugcagugcaguuuaugggauauaugugucccuuugggaauuccugggugucugcugguggccuguuaacuugguucuugaauaugcacuuugcuuauaacugugcaguuugaaaagugacucauccccaaacuaggcaggguugagugucuguccuguuuaucuuccacaugccaccugcacuaacuucugaagauaaucuauaauaaaagcacugugauuaaaaaacagaaaaacacacaccaaaaauguauagguuugucuguuggugcuucugacaagaaaauaaacucaugaaucucauuaacuuuaaaaaaaucacaucuacuuaagguuuaaugacuaaagccaacuuucuaacauaucuguaccguucucugaacauacuguuuucacacuuaacuacgauguugucacuuguuucugucugauucugcaagggcagagaccuugaaauauucaaaucuggauucccccaugguuugacccagcugaagucaggcaguguucgcugaaagaaauaaagguguuuccauaaugccuguauuagcuuucuuuuggggcuguaagaaguuaccacagauuuagugucauaaaacaauauucauuucuguuucacgcuucuugugggcccgacgucuggauuccauggcucagcugauucucugcuuccagucucacgaggcugaaaucaaggugucuauauuccuuucuagagaguuggggaggggguauaaucuguucccaaguucauucagcuugucagaauucagcucugugagguuguaggacugaaguccccauuuccuugcuggcucuuggcaggacuuccucugagcuuuuggaggcugccuggauucccuggcuuguggccacuuucaaagccaguaacaguggguugaauuccucucauacuuugaauuuaauuccucugccucaucucuccaaaacaucucuuuugccucccuuuugugcuuuuaaggguucaugugauuacacugggcucacccauauaauacggaaucaucuaauuuuaagggcuuuauuuccauuggcaaaauaucuuuugccaaagaaugcuggcugguaaucccagcacuuugggaggccgagauggguggaucaccugaggucaggaguucaagaccagccuggccaacauggagaaacccagucacuacuaaagauacaaaaauuagcugggcaugguagcgcaugccuguaaucucagcuacuugggaggcugaggcaggaggaucgcaugaacccaggaggcggagguugcaguuagccaagaucacgccacugcacuccagccuggguaacacagcgagacucugucucaaaaaauaaauaaauaaauaaauaaaaaagcaacauauucacagguuccagggacuaggacuuggacaguuuugggcaagcggggaagacauuauucugucuaccacaguaccuguauuaaacauguaaauuucaguuauucccuguaggucagagggcaguaaagcuacuucagaagacaucggaaagaagccaaaugacuugccaaagaguacuguaucagccguagauugaaaaaaaagaaguuaaaaauccuuuguaaaaaaucaaggcaaacaguuuuuugagggacaguaguuccuccuuucucucaggguaaagcuagagagauuuuuaagaggugucuuauucuaacuugcagucuuuucccuuuguaggauuuugcuuaccggacucacaaguuuucugugaccaguauuagaagcagaaaacacugaaccccuuggcguuagaguuugggcuacaccauaauggucuccuaucaauacuggcucucgcuacguguuaacauuagggaguggagaguguguuuccucacccagggaaaccguuuaaauguggccacugauccugccuucauaguuuuuaagagcuggcaucaauccaacuccggacggacucuagaaauguuucuggacaacgacugaaccuauaguuacagaaaaccuaugugcugggcgcucugaauuucauuucagguucuaaaacuaaggcucagagaggcuaaguauauugccuauuguuucucagcugguaauaacagcuaccauuuauuaaacauuugcucuaugccaggcgccauaucauacggaccugauaaugucaagaucucccuucacauccucuuccaaucugucaagaauuguauguuaauuuuaauuccaauaaugccaugaaauacaagacaaaugcagaucagaaaacugaggcucagagagguugaguggacagccagggagugacucagccaagauuccagucuagguccgcuggacuccagggccugaauucucuccaggguacugccucuaaaaacgcccucaggugcauucuggucaguauggccccagaguccaaguucuuuacacgacccgucaacauaucaccaaguuccuaagaacgcucuaggcugcuggugcaggcucugcaaauacacagcggccugaaagcacaggaagaaaugaagaaccgucuaaguccaucagccguggaauaaccguuuuacugguaugagggucuuuuugucucauuauuauguggcagugagucauuuagaggugaccaaaagggaaaguccugccucucguccccuacgagaaguguagguaagaaccguuuaggcgaggagaagcacgaagugggaacugcgagucgagcuccccauccucacuccccacccgcacccgccaggagguccugaagcaaaaagcaccgaagggguuaaggguggccgggggagcccagccaccgccccuucccagcaucgccucccagaaucccgcaggcccccagccaguucucgcaccucgcgagacuccacccagccccuuccccgaacagcgacccguccccguuccuagcugaggucggugcuaggcggaggacgcgagagggagagcggaagggggccgccgggcacgccgggaagugugguccacgcgcuucacgcggccauauucuuccggagcgggggaggccagagaggccguugggacuacgacucccaggcgcccuuucgguuuguuuuuguucaaaaaaaaaaaaccccacacucccccuccucacucuucacacacacucacacacacccacggcagacacgcacgcacccgggcgccgaagggaaagccgcgucucgcccucccgccccgccgucgguccugucucagucccucagcagagcgggaaagcggaggccggagccgugaccucugaccccgugguuaugcggagccgccgcauuccuuagcgaucgcggggcagccgccgcugccgccg

SEQ ID NO: 13467 - RNA, 540 nt, Homo sapiens
gaugguugggcgaaaacuugcucuaaaaaccacugacuguguagcuuuuguggagaucauaccccagaacuaaaaggccauugcuaauucccugaaauccuggaaugagacccucaccuccagguuggcuacuuuaccugagaauccaccagcuauugacuaggcuuacuacaaggcccauguagccaaggcaggcuugguggaugacuuugagaagaagcuuaaugcccugaaguuucugugccagaggauaaauauacugcccagcuggaugcugaagacaaagaagaugugaaaucuugugcugagugggugucucucucaaaggccgggauuguagaauaugagaaacagaaggagaagaugaagaacuuaauuccauuugaucagaugaccauugaggacuugaaaaaaacuuucccagaaaccaaauuagacaagaaaaaguaucccuaaugaccucaccaaccaaucaaggauuuauaaaauugaguccaggaggaagaucuggcccuuauauuacacauucuggacauuaaa

SEQ ID NO: 13468 - RNA, 540 nt, Homo sapiens
uuuaauguccagaauguguaauauaagggccagaucuuccuccuggacucaauuuuauaaauccuugauugguuggugaggucauuagggauacuuuuucuugucuaauuugguuucugggaaaguuuuuuucaaguccucaauggucaucugaucaaauggaauuaaguucuucaucuucuccuucuguuucucauauucuacaaucccggccuuugagagagacacccacucagcacaagauuucacaucuucuuugucuucagcauccagcugggcaguauauuuauccucuggcacagaaacuucagggcauuaagcuucuucucaaagucauccaccaagccugccuuggcuacaugggccuuguaguaagccuagucaauagcugguggauucucagguaaaguagccaaccuggaggugagggucucauuccaggauuucagggaauuagcaauggccuuuuaguucugggguaugaucuccacaaaagcuacacagucagugguuuuuagagcaaguuuucgcccaaccauc

SEQ ID NO: 13469 - RNA, 1005 nt, Homo sapiens
agaaacgaucaaucaaaacguuuaaugcucaguuuucacaaacacaaucaagucuaucaaauuucuggauuuacagcaaaaugugcccccuaaaaacauguacacucuucaguuucuccuauacauuuuuuuuugccuaucuuucaaaaccgagcacuggguauuuuuaacaugagccaugucauauguacuguuuaacuaugauucaggaauaaacaaaauccaugauuuuuuaguaacccauaguguauuuauagaaugaaaaguucucuaucaaauuacacuuuucacugggaaaaauaaauaaaauggacaaauggaucuacacaaaguaaacauuaacuuugguagauuucaguguaguucauaacaagcauauuugcccuuauucccccagagcugcucaacuaccaagaauuuuuaaaauauuuuuaacugagauuuuauuauguugacauuuguuucucauuccacaucaucuucagccaagcugugaguacuuacaauucucugacuaauuguugggaucuuagucagaagcaucuggaacacuggugguggaagaguuugcuguaagaccugcaguaacugcuguggcuguccacacacagcaauugcauuugucagauggucuacacccuucucauauucaccuugagcuaguaacucuucaccaagcuguauuucuucaaagaagaacuucugaacagcuucagcaucuuuaaggucagguaacuuggaaagcccagcucucuccuuggcaagcuucuguuucuuucuucauucucgaagccuguucuugaaguuggggucacuucaucuuuuguggucaaaguagaugcaguacgcaauaaaaagggucccgcaugcaccggcggcgauggcacuguuccgacccaccaucuucucuacagcgcuaagcguggacaguggcagcaggaaccaugaaggagcggugggccacgaacccucagagcaguuggcgcagcucagacccgauggcgu

SEQ ID NO: 13470 - RNA, 743 nt, Homo sapiens
aaaguucucuaucaaauuacacuuuucacugggaaaaauaaauaaaauggacaaauggaucuacacaaaguaaacauuaacuuugguagauuucaguguaguucauaacaagcauauuugcccuuauucccccagagcugcucaacuaccaagaauuuuuaaaauauuuuuaacugagauuuuauuauguugacauuuguuucucauuccacaucaucuucagccaagcugugaguacuuacaauucucugacuaauuguugggaucuuagucagaagcaucuggaacacuggugguggaagaguuugcuguaagaccugcaguaacugcuguggcuguccacacacagcaauugcauuugucagauggucuacacccuucucauauucaccuugagcuaguaacucuucaccaagcuguauuucuucaaagaagaacuucugaacagcuucagcaucuuuaaggucagguaacuuggaaagcccagcucucuccuuggcaagcuucuguuucuuucuucauucucgaagccuguucuugaaguuggggucacuucaucuuuuguggucaaaguagaugcaguacgcaauaaaaagggucccgcaugcaccggcggcgauggcacuguuccgacccaccaucuucucuacagcgcuaagcguggacaguggcagcaggaaccaugaaggagcggugggccacgaacccucagagcaguuggcgcagcucagacccgauggcgu

SEQ ID NO: 13471 - RNA, 17345 nt, Homo sapiens
ccgccgcggcguccagggucggcagcaaccgcagccgagcccgagcggguggcggcgccauggcgugcgcggggcugcucaccgugugccugcuccggccgcccgcgccccagccccagccccagaccccgcggcacccccagcucgcgcccgacccggggcccgccggacacacgcucuuccaggacgugagugggcgcgggcucugcucgcggugucucccuacccgagucucuguuagucucacccuccgggguuguucgggccccgccgcuguuucugggucucuuccccucucucuggcccugcuguuuucucuugaccuuucugcccuugugugaccuguucugucucuccaugucuccucuugucccugcuccagugucacugccccugcugccucccaccccucagcccaccccauuugugugucugguguuggcggggggcuggcgacaaucacagcagcggucaccccacucuguggcagcuccaggcugggcugacuggggaaggggagccuggaaacgcaagggccccucacuccugacucuagugccgcccccagaguucuucaggccccacuccagggcagcagaguccuacaguugguaagggcugcucagagucacccucccauggggccauggguggcccugcggccaccaugggcaccagccacggcccugagcccuuucuccaccguucaccgcugugcucggcucuguccuggcccccucaugccccaacuccagagggaggcaaagcugucucccacccccuccccacugccccuagugacucagcaccuugaccacagcccuggcuggaagggaccugacccuccuucuucccaaguaggaaaaccaaggccugaggggauaugucucaggucagucauggaggcagggauacaauagggugaccccagauguccccauucccagcuuagcaccccugcccacucccaagaucuccaucuacccuaccugggccucccuggcuugcugcgugccccucagccaguggcagaccuucucugaguuaggcuagagguuagagucuuuccugagccccacugacccugacaaaacaggacccuggagggggcuggcguucaggaccuggaguucaugggggcucucggcccaggcuuggcccaccccugcuugccaggccugccagucuccccuuugcugggcugcuuugggugaccugggagcaggucacuaagagagacggggaccugucuugacucugcuccucucugccucuguugcucuucaucuccacuucuccauaaaugaaaucugccgaacuugccuucugccacccccacucccccuuggacguguguguguacacacacgccugccgaagguccucagagucagccccauaggaagccccagcccugaaagaguuaaccccagcugcuccugaucuauuugcuaguggguaacucaggcgccugcagagacagaguagccacugccugcuguugguuuucaacagcacgcaaggaaacagcucagagagggcagcugggguagaccauggccacacagcagagcucggggcucaggucuaggacggcugugcaagauuccugggccacaaccuggcccaucuccucaaccuuccucaagcuggaacugugccaggggcugauguaucagauagaacuugggcugcacucugggugugggagguggggacgcaggggacuggccaggagcaccccccacgaggccaggcccugcaggagaagugagcagagguggcacccgcugcgugcucuuccugugccccgcuugcaggaaaagcuccugcagggcugagcugggcaggugguuugggaccaggcugggcgggaggaaaggcgaggcaggggguaggucggccagcugggacccugucggguugagugggggccucuggcuucccagguggcacucacaguucucucuaugucccuuuguccucuagguuuuccgcagagcagacaagaauggugaguguggcuuccccugggucccacaguggggcagggugggaggcauccaggaggcccagggagaguugggagguugggugggaagucaagaguugagacaaaucuugggggcccaaaacaggagaaucaaucaaggcacuucccagaggaagugcuguucucagccaaguuuggcaggauggagaguggagagaaugugguuuggccacggacuggagauaggggcugacuuucacacagcacccuggcauggugaugggcacuuccuguacguggcccucuguuguccucacaaccaccagcuagauuggaauucacccuauuucauaaaggagcagagggccagagaggugaagcaaguugccuaaggucacacagccuuuaauugauaggcucgaacuugggucuuugcagcauuuaaucccaggcuccuugugugaggcacuuggaagagugagguaauggagaugaggccuuuuuggagauuuuacucagguuuuuagagggcucaguaacuugucaugugaccaaccaucuggaccagggaggucuuggaggacacaacuaaacccacgccuugggcaaggauaaagcuggguccagugccaaaggagucggcuccuccugccuuggguccugggcagucucagacccuggucugggagaaacuuggaagcuaaagcaggagcccuaggggacccauccagcaacaggcugcucccccuagaugacuuggagcagcccacugugcccuguguggcccguggagggucugagcuucgcagucagccuggggcuccuuucaucugggucuucacgcccucuuguguuucauccuccuagagacgggguccuguccccacucuuugccccuucuccuugggucucuucaaauugauggggauuguuugucccaacccauugaucaggacacaugcucucacuuggaccagggaguucugucuggggagguucagauccucccccgggucagcuccccgcacccaucugcucagagaccucacacaucauucaggccaaaucccaugucuuugucccacauaaguacucccagccucugcuuacaugccccugugauggggagcucauucccuucugagccagccugcugcugccuacagaggcuccaacuaguaggaggauuccaucugccuccccguggcuucucugugaagguccuggguccagagaauggagguuccuugugcccugcagugaggcugguccccaaguccuuccaggugacaucuaggcccugccacaauguggccgugucccagccuguugcuuguuuuuucacuuggcaaacauuuacugaguuccuacccaacgcuauguacauacugcccugucccuuuggugccugcaaaguagguucuguugccuucacuggacaccuucaaggaccccaguccuuuuguccccaacagucaggccccccacugaccucagacucccaucucaccuagcuagaugguugucagaugcuaugaggccuuugggacccuggaccugguggcaggggugcagucagggucagggauaccuccucugcucccuguccucccccugccaccccagaugaugggaagcucucauuugaggaauuccagaauuacuuugccgaugggguucucagccugggggagcugcaggaacuguucagcggcauugaugggcaucucaccgagugaguaugagagggggccguggguagaugcgaggccagguugucuuuaccccacuguguccccugcugccuugguuccuuuuguaggaugaggaagagggggcagggagaaagguaccagggcucaguuccaacuuuacccgccugccuacccccucuccagcuacagccuugcccacuacacugcuuccagcugggaccccaaaauagccaagucugagucaccacccauggcucagcuccccauucccgcuucccacagggaccagaggaugccuggggacagcugggccccgccugcuuccacccgagaaugcagugcauaaacacgcaaccaucuaccccuugugugcucccacaucuacgcgucuuggcaggagugugcacgcuccuucccgugccugcucccaggggugcacacgcaugaaccgcuguuacucccucuacuucccuucuccccuuuccugagggucagucucaggcuccugagacuugggcuggaaccuucaucugcagugcuuccccuccccuccuggccagacuccccacccaguuccuuguccuucagggccucacuuaggcagcucuuccucuaggaaacccucccuaaccuacaacuaaauaccccaugccgucccuggacuucauugccuugcaccuggcuuccccuucgcagcucugaccacuucucacuggccuguguccacauccaucuuccccuggccugagauccucuugguagccaagaaugggucugaaucuuugcccuuagagugauuggugggggcaguagaacccauucuccaacccugcaaggacucuguccacaggagcaacuuaaucugggguggagcagaaguggccuuguuaggcuaagcugggaguugguggggugggauguggggcauuggccccauuagucccaguuuaccaggcccaggucugaagggcgccuucucuuuucccugcagcaauuuagaaacagaaaaacuguguggugaguaggcccaugggagcucuuuucuccuguggccccugggccccaggguacguguggcaagggacuguugcuggucuccugaugggacagguugggcugggcucaggauauaaggccugcuuggcugcugaggaauuccagggggccagaaucccaggguggguagauggguggggguccaggaacccuugagcaccucuucugccugcagacuacuucucagagcaccugggugucuaccggccggugcuggcugcauuggaaucgcugaaccgugcagugcucgcugccauggaugccaccaagcuggugaguggaguggcugauggugggggauccacugugaggcagugggcaucugcugugcugugggauccuccacagucuugacucaggguuauagagcuaggggcuuggguucaaauccuggcucccacuuuguagcugugccccuugaccucucugggccuguuuccucaucuguaaaccaucauaacaauagagcugcccuucauacaucacugugaccagugagaacgaaggcagggauuuuugucuguuuuauucuguuuccagcacccagaauaaugucuggcauacacugggugcuucauacuaggggcugcuguugcuuuaguugcuggcccaucacaacuguggugggauaucauucagggcugggcuaggcguggaaggcugugcucacagguucacagggcagggccuggcccgaggacauacgugaguaggcagguacgugaacacccacgcguuuguguggacacguguauacacaagcucgaacagugcugauagccagggcuugaggcccuugaguggugacuuccaaaaaauaagcugcccuucccuuuguguguucaagaaauaucuccaccucccuuugcuccauagcucuuguaagggggagggagcagugagcaggcccgggauugugccugaccccacuuuuuacagaaggggaaacugaggcacucauagucaacaaugaccugagcacauggcuaggcacagggcuccuccuccuggugacuuucacaugagauuuaguagcuuuucaagggaucgccccuuggggccuggcaucggauguauguccaaaugguacaugacgaggguuuggaggaacucccauaucuguggcauggacacaaguggggcaucaccuuuauugccauaaaguagggcccuguggguaggcagcuggacuggcauucucugaacuggcagugguuggggagauucaaacugcaguucaaaaugagggucccaugggucccaaauaccuucuccuggcccagaaaggguaugggggugacccauccagucagcuccaaccuccaggaggacccugccagcuccaaacacuugacucuuuagauagagagcugucccccaacgcagugccaccccccccaguccagccugacucaguugaacacaucguacagcagccuggagccacacuccugguacauggcccgaguuauccagcggcgcuggaaggagugcagggaggccaccauggagccgccgguccacacagccaugccacgcccaugcuuggccaccagguggggccgcagggccgcguagccgugccgccggcacugcgccuccagcuccuuguccaggcgcucggcgaagccaggaaacaguguggagccgccggcuagcaccacggugucugccaggcguguccgcagcguuuugggcaucuucugcagcgcccggaaggccagcgcgggcagccccugcucagccuggcccagcaggcccggcuggaagauggguucggggcagcggaagcgcucacugcugaggcagacgcagcacccguuacccacgcugaaacuggccggaugguggcgggcggggucgcggaggucgcccucgaaguccagggacacguagcagcugcgcuucuugagaugugugauggccuugcggggcagggccugcugcaagaggucaggguucgccgccaccagcagaucccgcagguagcgcgacagggugcugccugccacguucagucggaagguggccuggugccacgagugacccgcguagaugggcguggcguggcacacgcccgcgcccgccuccacggccagcccgcugaacgcgccgguggagcagagcgccagcaacgcggugcuagccauguggcacgcgggcacugccagggucucgaacagcagcuccgccacccuuucgcggcccgcgggcggcgccaacggcgagucgcucaccagcacgggccacugcucugggcacacccgcaggccgcccaccagcaggcgcucccacagcccuuccagcgccucccaguccgccaccacgccgugcuugauggggugcgcccgcgccacgccgcccgccagcucgcagcccggcgcuccgggcagcaccggccggucccagcugggcaccaagcuagagcucuucagcacuaugcgcggcugguucucgcccgcgaagcccgccuuggugaagcccgagcccugguccaccaccaccgcgaugcggcccagggaggacggccggugcacgcggcggcuccccgacaccgacgccaccuucgggcucggcccagccgcggggcugaaggcuccgcuccuccgcgccacucggcuucgucggcccgauaccucccggccucuguccuagggaguaguccccuucagccuuuggcucugccuccggagccuaaguucuuccucuucuggaccaaaucaccacccuuuucagcucuuggcuccgcccucuggucugaaagccccgccucuucuguccgggccauccgccuccuuuucagcucguggcuaguuccuaggccugaggcccggccccuaguucaggcuucagucuccgcucuggcuggguuccagccgcaucucacccucuuggucucccucuggcgccgggcuucaggcuccacgcucucaggacccgccucugcuuugcuguuccgccccgucagcccuugcugagauggcugacgagauggcuaggacugauccuuuuagauccuaagaagcccccgggaggagcagaacuuugagggcgaaggggccuugugguaaggccauuuggacauauaucccccuugaggacccaggcagccuccuggcaccucucaccugggcuugacggaaguuccugguuguggagaggggaggggcuggucagaaggcagaaaagaacuuggauugggcucauugugaccucacuccccagcagcugcacuucgcagcucccuaccuuaugacaacucccuggacccauccucucuucuggacagagccaagggcagugauuuuggcauccaggggucuggcuucagcagcccagcacagucugauuccuuucccaaaccacuuagaauuaucugauguacucuguccagauguguggcccccuaccccucccagugcugaagaaaaagcuuuuucaucacagaucugcagcuucccugaagagcccccgagaggcucuggcccuaccuuuaugggcuuccacggauggauucacgugggccucaguuugagacucaguucuuuuuuuuauuauuauuauuuuugagacggagucucggucacccaggcugggcgugcagcguugcaaucucagcucagugcaaccucugccuuccgaguucaagugauucuccugccucagccuccugaguagcugggacuacaggcaugcaccaccauacgcggcuaauuuuuguauuuuuaguggagacaggguuucgccacguuggccaggcuggucucgaacuccugaccucaggugauccaccugccuuggacucccaaagugcuaggauuacaggugugagccaccgcacccagcaagacucaguucugaagcugacucacugugcaguccuaagcaagucuugaucuuucucuggguucgguuuucuccuccaaaagguaguaauaauccccccacacaggaaagaggucacuucuugucucugcaaagccucauccuccugaggaccaguuugguugcagguagaagacucaggugaauguaacccaaaauaaggacuuuauugaaaggaucuuacauguuauggauaucaagagcaagggugaaaucagguuucaggaacagaaucugacugcggggcuguggggaacccaggaugugcacugcauuguguuguuuguuuuuugagauggagucucgcucucuugcccaggcuggagugcaguggugugaucucagcucacugcaaccucugccuccuggguucaauuccccugccuuagucucccgaguagcugggacuacaggcgcccgccaugaugccuggcuaguuuuuuguauuuuuaguagagacgggguuucaccguguuagccaggauggucucgaucuccugaccucgugaucugccugccucagccucccaaagugcuggguuuacaggcgugauccacugcgcuuggccugcauuguguuuuuauucugaaggcuggcuuagccugugcauguucaaguagagaacauggucucuuacagcuccugaaucacaguccuagggggaggggcugacaggaccagcuugggccaaucacuguaugggcaggaggugcagccccauggaagaacaugguuacccugauuguaaccauguggaugguagggaagagucaguucucacaauuagcaggagugauguuauagcucuugcagccuccagccuggugcaggcaagguggaggagauguucauccugguggcggugacaaaagugcaucuucagcagaagcugggcugauggcuguagugagcugggacuucaguccugcugcaucugcccccaaaagagggcauccugagguuggucaccagaguguggcaggaaggcgggcugcagguuuggcaggccagggguggcauuggguguggagcuggauuugggacccgggagagugaggagaagcagcagcaggaucccgcccacagaaaguguggcagggcuucuucuaagugauuuggggagugagacugaagcugugggcuuuuucccuguugguaauggagaccuguugaaagcuuaugagcaggggagugagcugcccuagacagguaagugguuuggaauuagucuuugucacguggggaaggagaugggacaggguagguugggagacaggugccuuggggaagacuggggggccugaaugcuuugggguuaccaagcacaauguguaggagugaggggccagagagaggcccagggcuuccagcuucuccugggugcguccccaggcagaauccacgucucaggccuugccccagcugacugccauccuggcuguucuuacccaggauggugccuguuggccgggaacccucccucaugccuaagagggauuucuggaugcuggggggaugucaggcuuuaccggaagcaggucccucucacuagcguggccaagccuggguuugcccaagcccaccucccuugagccugcagacugggcaggaugugaccuggauuuggaguguugggggaaggaaacugccucccgccacuguagcaagguuugggguucuguucugacccuuggcacaaggaaggagaaagcaaaagacagcccuggcuccagaccguggcgauggcucugccuucaucacgccccguucaccccucugcggcuccuaggcugagcuuugcccaccccgacuccgcgcccagacgccuccgacaggguucgcaggcgccaggguugccacgcacucuuuauugggcgggguccgggccaagcguuuaaagcugcgggcgagggcagcggcaccguuugcgcggcugcuccucggcggggccggcuucgcggggagccuuccccggggaccggaagcgcgagagcagccgcggccagcucagagcugcccuggccccgcccucuuccggccgccgcgccucuugccgccgcagcagcagcaguaccggcauccucggcucgcgcucgcuaccuucgcccgcuccgcgcaaucugggugccgccggggagcccagcccagcgccggacgcguagucaauccguugcccagcguuggccagcggcugccgcuuguccagggggagaaucagcacgauccuggucuggggguggaacaggggcgugaggcgggagagcgcgcuagggccgagcccacgacccggggccgcuccgcgcuucuccugggacccucguccacccggguccugucguccacccggguccugucauccucucgugcacagggcuggaggggaccccuguccaauucaggccgcggggaagcccgcccuucccugcguggcgccccggacuccgccuccuuucuggaaacccucauccaucccaggcugacuuccugagaccagcuccgucuaaguuuaugagaucccuuccaggcccuaugucaggggcuuucagcaccucccacccccgccugguccagggcuucugcucauuugagagggagacagggaaguucugagccuaggagcugaagagaggacacuagggaauucccccugccucuagcuccaguaguaccaacuagaacugauucuccguguugggaucuccacccguucguccaggguugggagagaaucccacucaugcucaccccccggggcucucaagucucauccacuuucugguucuggaaucucugcccucccuucugggcuuuuuuuguuuaagacugagucaaacagggucuugcuguguccuacaggcuggagcaguggugcugucaacggcucacugcaucccugaccuccugggcucacguaguccaccucagucuucugaguagcugggacugcgggcauucaccaccacaaccagcuaaguuuuaauuuuuguagagauggggccucccuauguugcccaggccaaucucaaacuccugggcugaaguuauccacccaccuuggccuaccaacguguugggauuacaggcgugagccaccuugaaaggacccccauccacacccauaugggcuccugggauccucauccuugggagagauuuucgaauuccucccucacccccuaggacuucugcauacaaggccuagacucccagcaucccuucccacccacuuguccagcuuucucugccccccagcugccuccccagcccugcuccccaucccccgcccucacagccggcuucuuccgagugaggugguugaggaacgauuuccaccaggccuuguccaugucagccggccucuccuugcgggccugcuugggugcuuugguccuuuugugggaacuauaguuucccauggcagggcuggucaccacuggggacgauggcccacacuccgucugcucugcccccugggcccuggcaacauugugaccucacgggcugaccucaccaauugcaggcucugagcaccgccuuccagggcccacaggugaaucugggcuccacucagucacuucuagccuugguuucucagcuguaaaacugggcuaaugaucauaaaugaggcaaugcauguaaggugcuuaguggugaauagagggggauuucugugguuuggguaugaauuuuggcccugcuacuaacuugcuaugugaccuuagcccagguaaucaaccucucuggaccuguuuucucaucugcaaaauggggucaauuaugguuccuguaaauuguuacaaagguuaaaugaggccuggcaugguggcuaaugccuguagucucaguacuuugggaggccgaggcggguggaucaccugaggucaggaguucgaguccagccugggcaacauagugaaaccccgucucuacuaaaaauacaaacauuagccaggugugguggcacaggccuguaaaccuagcuauucaagaggcugaggcaggagaauugcuugaagcugggaggcagagguugcggugagccaagaucaugccgcuucacuccagccugggugauacagugagacucugucucagaaaaacaaaagacuaaaugaaauucuucuugcaguagugcuuggcucugagugggugcuucugucuguucucugguugaaagcaacagaaacuaaucaucucaaauacccaaaaaggaauuuuuugggaagauuucauggagauagaaacccuggccugucugagaaugaaaagacccagccucuucucugucccugucuccuagcucauaagccuggcccaggaggucccauccgauggcugagcugaggcaggucauggcaggagaugaagucucugauggauggggcuucuggagucuccucggagagggcaggcaccuggacugcagcuccccaggacucccacccugaugcgugugugugugugugguagggguuaggcaauucucaggacaucugugacuccuggguguacaagugggcaggcccuuuauuguauuacacuugacgauagauggcugguaggucuggcaucgagagcuuacgugccagacccugggcugaguccuaugcaggaauuaacuccugggacguucuugcagcuccaugugcugaguuucaucuuuccuguuugauagaugaggaaauggaagcuccaggaacugacgguuguugaggagccucagaaucccaugcugggccaugcagggccuagcauuugggcagccucccugccucucugccacccugagaggggcugggaggaggcuggcagugucgguuggggucagugccggcgugugugucugagugagaauggcaaccugauugucuuuuaucagcagcuccuaguaaaaagcacccaguguuguguguaugagugaaugaaugaaugagugaauacguagauugugagucuggggccacaccacgccauuauuuugccuugugucaacauuggcccuuggauaccucgugauagcccccacccagccuagcuguggcugggacucacuggcuaugacagugcugaaggugguagccccaucagggaaggggccaugagguccagagaggccaggcacuucgcugggcagaugcccccugugaguuggccucacaccuccggggagggaggccagucccggacaaggagggauccagacccucccugcccaucaggucucaguacccuccugccugugccagguuugcgugccccugcucuuggcacugccaccgcugcucugaugggcaagaggcaggggacccacucaagagaucagugcccgggcugggagaugcugaccgucccuccuuggcccacaggaguacgagagggccuccaaaguggaccaguuugugacgcgcuuccugcugcgggagacggugagccagcugcaagcccuucagagcucgcuggagggggcgucagauacccuggaggcccaggcccauggcuggcgguauguaagggugcugucaaccuguggggcuagugcacaagcgcccauuguacccccauuccaaauccccacagucccagcauccuggagccugcauuuucgggcggggaagccauggcaggguagccauggcggggugaaaugagacuggcuuuggggcuaggccucggagucccaggaggcuugucuuccccacccaggcuuaucccguccuggggccccaguccucggcccugugagccucacuuccucuaggucagaugcagagagcguggaggcgcagagcaggcucugcggcagccggcgggcaggacgccgagcccugaggagugucagccggucauccaccuggucccccggcucuucugacacaggugcgccugggguggggugggaggccuggccgaggcaggcaccgcauccccccuucccccagggcccgcuccuucacugccccucacuucauucugagcaccugcgggaccugagaggccccugccugacccugcacgggccccacacacagggcgcagcucagaggccgagaugcaguggcggcuccaggugaaccgccuccaggagcucaucgaccagcucgagugcaaggugagggccguggggccagggccccacaagggaggacccuccugguauccaccagagccaggcccaugcuggaggcccggcccacacucugugcccucacaggccccccggcuggaaccccugcgugaagaggaccuggccaaggggccugacuuggugagcccaggagaggggcaagcggcuggauggccgugucugggggugcucaugaauuggggauucauggggccgguugcccaccaacccucugcagugcgcaugugccccgcccccaggccuggcaagcaggugccggguucugagaaccugcaggaaccaccaccuuucucugggcuuugguuccccaucagcauuuccgaaagccaggucuggggcaguguggacggaagcuggaggguggaaggaagugguggcauacugcaggaggaggaacaguggcuggaucaagcagcacccuuggagacagggagaagaggauggagacagggaggcuggggggcagguuggcggcaggaacccagcuaaaggguagguuggaucuggcaucagucaagaaggcuaggggccaggugugauggcucaugccuguaauuccagcaccuugggaggccaaggugggaggauuacuugagccugggagauagaagcugcaguaagccgugaucccacacaccacugcacuccagccugggugagagcaagacccugucuuaaaaaacaaacaaacagaaaaacagcugagaaccuccuggaggccacagccagucccuccccugugcccggccccgcaccagcugaccggcugccucucccaccagcacauccucauggcccagaggcagguccagguggcagaggaaggccugcaggacuuccaccgagcccugcgcugcuauguggacuucacaggggcccagagccauugucugcagugaguccccagcuggcaggugggauggccaguggggagggggugagcagagaggggugcuggggcuggccauccugggugggucaggguucccaugaggccccaggccggggaggcagaggugguggcagcccuggccuggccugcccaucucuuuggcccuacaguguguccgcccagaagaugcuggacggugccuccuucacccuguaugaguucuggcaggaugaggccuccuggagaagguaugagugccagucuggccgcuaacaccauggaauguggcccuggagugagucaggccaggguucuaauucugcucucccgcucacuggcucugugaccucagaugagugaccccaccugcccgagcccccgaguccuuuccaaaauggaagugauaacaguuccaacuccuaugggcuaaaggaggugacugggaagagcugaauacagcacagggacacaggaggcacucagugaauacacacuugucaccauguaugugacaaugccuaugccaagcaccgugugcagugcccuucauuccacccacacagcuuccccgugucacaggggagaggacugaggcuccagaggcagugugagaagggccggggucugauccuggcagcaggauggggcgggaguggggagagcgaggucacuguagccugggucucugcaggcaccagcagucgccuggcagcaaggccuuccagcgcauccucaucgaccaccugcgggccccggacacccucaccacuguguucuucccagguaugcgguggacccccacucacuguggcccuggaggggcagugggcuccugagggcuccugacccccugccucugacccccagccuccugguggauaaugaauaacaacugagccagaccugcacacgccgagggccccgggacccugccugccucccucuggagccuucuggacuggccagcccagcgcaaagaccaggacuugucuccuccuggacuugggccugguggaagggcucucagcccagggaucagggacugggcugcuugcuuucuauuuauuauugauuuauuuaucccuguauuuuauuguuugucacuucagccuccaagcuacuuuggcuucugccuggcucaggagaccuggauucuggucccugcugucccugccuggcugagcgacccagggcaggucccgucccugucugggugggccucaggccaucuggccgccuagcgaggguccugcuuucuuccugcugucuugggaccaggcuucugcuccuccucagccagcggcagaagcagggcugaugcucagggaccccccaacccucaaaccuugccuccgaggcugggccugagcugggugccccgucgcccucccaggccacuaggcucugacucuuccagcacccauggaugugccagaggccucuggguugguuugcaugucauuugcauaucguuugcaugcccucaucccacccauucucagggcaguaugggaagccccaaggugaccuggccaaguagcaauaauuuggguccagggucaccuauugcccccagaggccucugaaccccaggcugggaccccagcacagaggcaauaaaggcaguggucccuuccaguguugccuccugucucgca

SEQ ID NO: 13472 - RNA, 4036 nt, Homo sapiens
cucagggcucggcguccugcccgccggcugccgcagagccugcucugcgccuccacgcucucugcaucugaccuagaggaagugaggcucacagggccgaggacuggggccccaggacgggauaagccuggguggggaagacaagccuccugggacuccgaggccuagccccaaagccagucucauuucaccccgccauggcuacccugccauggcuuccccgcccgaaaaugcaggcuccaggaugcugggacuguggggauuuggaauggggguacaaugggcgcuugugcacuagccccacagguugacagcacccuuacauaccgccagccaugggccugggccuccaggguaucugacgcccccuccagcgagcucugaagggcuugcagcuggcucaccgucucccgcagcaggaagcgcgucacaaacugguccacuuuggaggcccucucguacuccugugggccaaggagggacggucagcaucucccagcccgggcacugaucucuugaguggguccccugccucuugcccaucagagcagcgguggcagugccaagagcaggggcacgcaaaccuggcacaggcaggaggguacugagaccugaugggcagggagggucuggaucccuccuuguccgggacuggccucccuccccggaggugugaggccaacucacagggggcaucugcccagcgaagugccuggccucucuggaccucauggccccuucccugauggggcuaccaccuucagcacugucauagccagugagucccagccacagcuaggcugggugggggcuaucacgagguauccaagggccaauguugacacaaggcaaaauaauggcgugguguggccccagacucacaaucuacguauucacucauucauucauucacucauacacacaacacugggugcuuuuuacuaggagcugcugauaaaagacaaucagguugccauucucacucagacacacacgccggcacugaccccaaccgacacugccagccuccucccagccccucucaggguggcagagaggcagggaggcugcccaaaugcuaggcccugcauggcccagcaugggauucugaggcuccucaacaaccgucaguuccuggagcuuccauuuccucaucuaucaaacaggaaagaugaaacucagcacauggagcugcaagaacgucccaggaguuaauuccugcauaggacucagcccagggucuggcacguaagcucucgaugccagaccuaccagccaucuaucgucaaguguaauacaauaaagggccugcccacuuguacacccaggagucacagauguccugagaauugccuaaccccuaccacacacacacacacgcaucagggugggaguccuggggagcugcaguccaggugccugcccucuccgaggagacuccagaagccccauccaucagagacuucaucuccugccaugaccugccucagcucagccaucggaugggaccuccugggccaggcuuaugagcuaggagacagggacagagaagaggcugggucuuuucauucucagacaggccaggguuucuaucuccaugaaaucuucccaaaaaauuccuuuuuggguauuugagaugauuaguuucuguugcuuucaaccagagaacagacagaagcacccacucagagccaagcacuacugcaagaagaauuucauuuagucuuuuguuuuucugagacagagucucacuguaucacccaggcuggagugaagcggcaugaucuuggcucaccgcaaccucugccucccagcuucaagcaauucuccugccucagccucuugaauagcuagguuuacaggccugugccaccacaccuggcuaauguuuguauuuuuaguagagacgggguuucacuauguugcccaggcuggacucgaacuccugaccucaggugauccacccgccucggccucccaaaguacugagacuacaggcauuagccaccaugccaggccucauuuaaccuuuguaacaauuuacaggaaccauaauugaccccauuuugcagaugagaaaacagguccagagagguugauuaccugggcuaaggucacauagcaaguuaguagcagggccaaaauucauacccaaaccacagaaaucccccucuauucaccacuaagcaccuuacaugcauugccucauuuaugaucauuagcccaguuuuacagcugagaaaccaaggcuagaagugacugaguggagcccagauucaccugugggcccuggaaggcggugcucagagccugcaauuggugaggucagcccgugaggucacaauguugccagggcccagggggcagagcagacggagugugggccaucguccccaguggugaccagcccugccaugggaaacuauaguucccacaaaaggaccaaagcacccaagcaggcccgcaaggagaggccggcugacauggacaaggccugguggaaaucguuccucaaccaccucacucggaagaagccggcugugagggcgggggauggggagcagggcuggggaggcagcuggggggcagagaaagcuggacaagugggugggaagggaugcugggagucuaggccuuguaugcagaaguccuagggggugagggaggaauucgaaaaucucucccaaggaugaggaucccaggagcccauauggguguggauggggguccuuucaagguggcucacgccuguaaucccaacacguugguaggccaagguggguggauaacuucagcccaggaguuugagauuggccugggcaacauagggaggccccaucucuacaaaaauuaaaacuuagcugguugugguggugaaugcccgcagucccagcuacucagaagacugagguggacuacgugagcccaggaggucagggaugcagugagccguugacagcaccacugcuccagccuguaggacacagcaagacccuguuugacucagucuuaaacaaaaaaagcccagaagggagggcagagauuccagaaccagaaaguggaugagacuugagagccccggggggugagcaugagugggauucucucccaacccuggacgaacggguggagaucccaacacggagaaucaguucuaguugguacuacuggagcuagaggcagggggaauucccuaguguccucucuucagcuccuaggcucagaacuucccugucucccucucaaaugagcagaagcccuggaccaggcgggggugggaggugcugaaagccccugacauagggccuggaagggaucucauaaacuuagacggagcuggucucaggaagucagccugggauggaugaggguuuccagaaaggaggcggaguccggggcgccacgcagggaagggcgggcuuccccgcggccugaauuggacagggguccccuccagcccugugcacgagaggaugacaggacccggguggacgacaggacccggguggacgagggucccaggagaagcgcggagcggccccgggucgugggcucggcccuagcgcgcucucccgccucacgccccuguuccacccccagaccaggaucgugcugauucucccccuggacaagcggcagccgcuggccaacgcugggcaacggauugacuacgcguccggcgcugggcugggcuccccggcggcacccagauugcgcggagcgggcgaagguagcgagcgcgagccgaggaugccgguacugcugcugcugcggcggcaagaggcgcggcggccggaagagggcggggccagggcagcucugagcuggccgcggcugcucucgcgcuuccgguccccggggaaggcuccccgcgaagccggccccgccgaggagcagccgcgcaaacggugccgcugcccucgcccgcagcuuuaaacgcuuggcccggaccccgcccaauaaagagugcguggcaacccuggcgccugcgaacccugucggaggcgucugggcgcggagucggggugggcaaagc

SEQ ID NO: 13473 - RNA, 23151 nt, Homo sapiens
aauaaaggcucaaaauucuuccaggcaccaagauuuuuauuuacccaccuuccugcuuucuuuuaacauuauaggccaaauuauucucuuuuugacccaggguugugaaaggaaccaucugguuauaaagugguggcagauuucacgaaaucugccugcauucauguuuuucuggccccucucaaccccuagcugucacuucucuguucuuucucaguugccccuuaacagucuauucuaaccccuguaaaacagggacuaaaaguacuaaccucauuguaaugagguuuaagagaaggcccagcacuaagccaggcucucaggaaaauucaaacaacaguuccucuuugcccuucaauauagccccuucucaucugucaugggcugaagaaccacuggaccuguaaaccaagcacacagguauaaguccacagaccaggugaaggccuagauggcaaaacacaugggcuuugugacuccacuacugacuuccaggcuaaggaaggacugacuuagugagcuguuccaagaccacugagcucaugguucccuguggcugggaccuccaucaugaccggggcuugaagaggguacucuguucccgcugccacauuuggaacaguaugacggcugcagcagaggccaaaaacuaagugaucagccccagagagucgaugggggacacugacaaaccaaucacaaaguuggugccauuagcucuuagggaggagagguggggccugggcaaggacagcagcuggagggugaaacgcagaccuggcucucaguagcgguagugauccggcuugaaggggccaucacaggacaugcccagguacugggcuugcuucucaguuagcuuggucaacuucacauucagcuugcccaggugggcuucagccacugccucauccagcuggggagaaacaaaggaagaccgggaaucagugccauuuucugggaccccuacacgcgucuggcugccaauagaggcagaaguguucuguuaggguuucugccaugugugguacucauguuaacucuuucuauccucacacccagccucaguuaauguguuguuuuggcugcccagccccccucaaaagggaaccaugccacacccuccccuacauguggcuugacaggaccaucaaucacaucuccuuccucauucuucaacucaagcagcuaaccaaaaugcuucucuggaauugaucuaugcacaggacauauuuuccaugacaggcagagacaaggugcuccaaccccacugggauuccuaaacagggaaggguaucuaucaaucucagcucaccaguuccaagucuauuuuacaagugaaaugaagauagauccgagagacagaaggacagagccaugaugacacggaauccuagguuuccaguguuuggauccgagaauaaaguucuuuuuuuugugacagagucucauucggacgcccacgcuggagugcaguggcacgaucucggcucacugcaacuucuacaucccagguucaagugauucuccugccucagccucccgaggagcugggauuacaggcgugcaccaccacguccagcuaacuuucuguuuuuaguagagaugggguuucaccauguugguaaggcuguucuugaacuccugaccucaggugucgaacuccugaccucaggugaucugccugccucagccucccaaagugcugggauuacaggcgugagccaccgugccuggcagauucgagaauaaaguucuuuuuuggauuaaacugguugcuuuuuuugauuaaaauguaucuauaaauucuuugauacuccuuuaagaauuagagccuaauccccaccgccuccccccaccccaccgagugauuccuuucuaaugaauagaagaaagcagaagugauggugugugacuuuggacacaaguucauagagacccuguggcuuccuccuugcucuccucuggaugacuuacucugggggaagccagaugccaucuccugaggaugcauaagcagcccucuggagaggcccaugcaugaggaauugagaccuccugucaacagcgaugugaagaggaucuuccagacccagucaaaccuucagaugauugcagcccuggcagaaaucuugaccgcaaccucaugaaagagccugagucagaagcagccagcuaagcugaucucaaauucuugacccacagaaacugaaauaauaaauauuuauuauuugaagccaguaagucuggggguuagauuguuaugcagcaagauaacugauacacugguuugaauaguguuucuaucacuugugaccaaaaggauucuaauccacugccauccuccuuuuauaaaaugaggaaaucaagguucagaaacgugaaaugacguguccacggucaccaagcuagugaaugacagagcuaggauuugaacccaggucuaucuggcuucaaagccccaaaaugugucucaagcaucccagcuuauggccucuagagcagcuuugaagagauuaugcagaaaccgaggaggacagaggcaagaguuaaauacaagcaagccucuaacucucucaugagguaggccucucccuaccccuaagggaccccauccugucccaugauggcauggcggccucugaccacagcucagcccacagcuuuuacauucccaagugguuucacaucuacuguuucauuagagccucccaaacacccuuaagaaguaggaugggugcgguuuauccuuguaucuucagaugaagcaaagagccugcagaaggugaugugcucagcagagaggcgggcaacaguaggaccagggcccagccuagaacugaguccacgucaguuccagagguagaacgauggccuccaacccccacaguacacauugaaaucaaccuucugcuuggcccggacuagcccagaacuuuuccuucucccagcacccugaaccagaaggugugugucacguccuaaggucaacaccuuggacagacagagcuagguucuauuccuggccugauacuuaacaucugugagagcaagucggucucuacaccugacuuuccccauucgcaggauggauggaucacucaucucucaaggcuguuacaaagaucagugcuacucagagucauucgugcaguaggugacuuaauaaaugguggcugccuucucugucauuguugaccaagguaccuagucccuugccugcauacagcaugugaggcaugaugccaagaguguccuguccccaagccacauguuagcaaugaugaagaaaagugguaaggacagggucaggugcugaggcgggagcuuugccucuuucacuuccaacccugcccucauuucaaaggccugaccaauuucucaccaaacucauagccauauuucucccaacugggauuagauggggaucaagugagaaucuuucaaccccacaaccagcugcacagaacaagguaugccuugagguccuuaugaguaaaauguuugguccagcaagacauugcuccagggagauuaguuguuggcuggcccuggaggcagaugccccaggccucuuccugcgucuuccucaauugguagaaccagccuuucaaaagaugaagggaugguauguagaccccaucacagcuucuccagcagcaaaaggcuggaagagcaagagcuacucuuaccauuuagcucauaaggagacugaggauuggacaggguaagggacaaagcaaaguucaccuguaaaacugccaagaaaagccaggacuaaaacaucuguccugaccccagggaaggguggacugcaugggguguuagggugagcacuggauuucaugucagaggacuucaucuucaugaguaugcagaccauacaaccauagugagaugccaugcuuagggauguaucuuuuuuuuuugagacagggucucacucugucaccaggcuggagugcaguggcacaaucucgucucacugcaaccuccaccuccuggguucaagcaauucuccugccucagcuucccaaguaccugggacuacaggcaugcgccaccaugcccagcucauuuuuuuguauuuuuaguagagaugggguuucaccauguuggccaggcuggucuccaacuucugaccucaaaugaucugcccaccucggccucccaaagugcugggauuacaggugugagccaccgcgccuggccagggauguaucaucuuauuacaaggccacaacgugcagccugcagacugcacucagcuuauacacauguccaaguuaacccacccaguuauuuuuuaaauuauaaugaggccaggugcaguggccgaggcggguggaucacuugaaaucaggaguucgagaccagucuggccaauauggcaaaaccccgucucuacuaaaaauacaaaaaaauuagccaagugugguggcaucugccuguaauccuagcuacucaagaggcugaggugggaggauugcuugaacccggcagguggagguugcaguaagccgagaucacgucacugcacucuagccugggcaacagagugagacucuaucucaaaaaaaucaaaaucaaaauaaaauuuuaaugaguugccuguauuugaaaaucauuuuguauagagaucuugguaucucuggcucuccugaaagguuagaagcccuggucagacggaccuggguuccuagguggcaaccagcccuuuaccccuucagcucuuccaguccuuguucagcuggcaucacucauuuaccugccuagccccuguggguguguggguucaugaucucaggaaauccucacaauccugaaggggguugcuauuaccuucauuucacagaugagaaaaugaagacagagaaagaauuugccuggauuacacagccuguaagugguggggcugagauucaaacuggggugugucccgcuccaaggcccaggcucuccucaccaccugguccugccgcucugcugugcuccagggagccacucccuacugugggucucaguuucuucuucugucaauggggagaaugacuucugcacuguagaggaccccaugagggccucuaagagggcagacaggcaagcacuuuauaaacucuggcaagcccuguguggggaucccaggauuagacacgugacccuuggcuugagguagaagaauaaacccaccuucuugggcaggaaaugaaccccaacgggguacuugucuggauggguccacagcucgaucugcgccaucaccugguuggugaaggaguuacucaucacgaagcugggguggcccauggcacaacccagguugaccagccgacccucggccagcaggaugaugcggcgcccauucuucaaccgauaccgguccaccuacacgcaggcagggcaacagugaaggcaggcagggccccgcucccacagcccacccucugaucuggcaggccucucugccuccaacagugcccaugaggaguccgaacugcuccaaaacaaccuccagcacauggcuuagcacaaaaauaacagccaauauuuauuaagaaauguugagcuggccggggcacgguggcucacgccuguaaucccagcacuuuggaaggccgaggcaggcggaucaugaggucaggagaucgagauuaucuuggccaacacagugaaagcccgucucuacuaaaaaaaaaauacaaaaaauuagccgggcgugguagcaggcgccuguggucccagccacucgggaggcugaggcaggagaauggcgugaaccugggagguggaguuugcagcgagccgagaucgcaccacugcacugcagccugggcgacggagcgagacucugucucaaaaaacaaaaaacaaaaaaacaacaaagaaaugcugagcugcagacugcacaguucugcugugagaacuucacgugcucacacuugcuuggcgcauaugaggcacucaguaagcagcagcuaauguuaucguuaugaucacugucaugugcccuguacuaaguccuuuacagguaacuaccacauuucaucccagaaacaacccugugauuucaguacugcugucauccccauuucagauucagaaacugaaguuuacaaggguuaggucacuuguccagagccacacacuaagaggaggcugcaauuugagucuggacggucugaggacagaucccauguucucaauaaccaugaaauaguuuugaaugcagcuuagcaaaagcugaaugccguggcgcucacauuggaaucaccucagaagcuuuaaaaaaugaggauacccaggccagacgcgguggcucaugccuguaaucccagcacuuugggaggccaaggcggggggaaucaccugaggucgggaguucgggaccagccugaacaacauggagaaacccugucucuacuaaaaacacaaaauuagccaggcaugguagcacaugccuguaaucccagcuacucaggaaggcugagccaggcgaaucgcuugaaccugggaagcggagguuguggugagccaagaucgcgccauugcacuccagccugggcaacaagagcgaaacuccgucucaaaaaaaaaaaaaaaaaaaaaaaaagauaccuuggccucauucccagagacuccuauuccuguggcccacaguguggcucccaggugacugccaagguugagaacucccgguuuagugagugaacgugacauggaaauccccagccucagugccccaguccuccgucugucccagcugucugaacacacaaacuugcuuucuccccacucccagcucuucccuugccaucccuccacccucaggcagccucccaaacauuuccccaaaagcccagguuuccaagcugcuccagaggccuaguaccgauccaaggaaaggucucugaugcccaucaggcauugauugaugcuucaaucaauaagcacucacugauacccaucuaagccccuugcagggacacgucaaccuggacucuacccuccugguacaacaguggggucagagaccaaagccagugauggaugcugcacuaggggucuguacuaagagugugggcauugccucugccagaggagcuggccaggaagggggucucuuuuuuauuuuauuaauuuuuuuuuuuuuuuuuuuucugagacggagucuuacucugucauccaggcuggaguacaguggugugaucucagcucacugcaaccuccaccuccuggguucaagcgauucuccugccucagccuccagaguagcugggacuauacgcaugagccaccaugcccagcuaauuuuuuguauuuuuaguagagacaggguuugaccauguuggccaggcuggucucaaacuccugaccucaagugauccgccugccucggccucccaaagugcuggaauuacaggugugugccaccgugccuggccagaagggggucucuugagcugggcugagaagaugaacaaggagaagggcauguguucuguuccagacaaaugcagcugucuggacagaugagcagaaguaggagcugcaguggguauucagggaguggucaauuauggccugaguacagaggcccuugagaggacggacaagagauaauguugggcagaagguuggcaagacugucaaggauguugagggugggcauagaguccagcuuuggagggcagcuuggcagaaaggugcccaucaccccaauguagcagguuucaccugugaugccuuugcaaaaaggaggucuagacagauggcugucagggguguggcugccacagaagcacgcccuggccacccccacacugugaugagugccaggccuucuaggcagagauggaggugcccucugccuagccgggaacugacacccuagacuagugcaggaccuagccaaggagaacucccacgcaggagcagagcacccaagaggagcaguguaggggauguggguucauagagcugccugucugccucucugggacuugggcuucugguguggcugugacugggugggugucagggcuuuggccaacucugugucuguaucuuccuuaucauaucucaaacacggcacagcaccaacucaaagaaccucacauaggugggcuuuucucccuuuaaaaaaugugguggaccugguguggcagcucacgccuauaaucccagcacuuugggagauaacuuaagcucaggaguuugagaccagccuggggaacacagcaaggccucgucucuacaaaaaauaaaaaguuagccagguguaguagugcacaucuguagucccagguacuuggaaggcugaggcaggaggaucagcuccuucagcccaggaggucaaggcugcagugugccaugaucaugccacugcccucuagcuuggguaacagagugagcccaucucaaaaaaagaaaaaaaaaaugaugaacaucucuacauacauauuuaauuauccuaaggaccaauuauaggagagauugcccagucaaagagguugcuuaacuuuaaagcucuugauauccaaagccaaaaugucuuccagaaacauacuacuuuuauaaucagagaaaaaaauaaacucauaauaauugcaacucaaguaaaacuucacacccccuauaagaacucaucuuccaguuucagugccccaaugcccaaugcaaaccuguucuuucccagcucagugcaugggccugcuccucacacagugauucaagcugugucccuuuuuguuuuuuguuuuuaguuuuguuuuugagauggagucucgcucuguugcccaggcuggagugcaauggcgcaaucucggcucacugcaaccucugccuaccacguuuaagcgauucucaugccucagccucccgaguagcugggauuacaggcacccaccaccaugcccagcugauuuuuuuguuuguuuguuuuugagacagagucucgcacugucacccaggcuggagugcaguggaacaaucucggcucacuacaaccuccaucucccggguucaugugauucuccugccucagccucccaaguagcugggauugcaggugcacaucaccacacccggcuaacuucuuguauuuuuaguagagacgggguuucacuauguuggccagacuggucucaaacuccugaccucgugaucugcccaccuaggccucccaaagugcugggauuacaggcaugagccacuguaccuggccuuuuuuuuuuuuuuuuuuuugagauggagucucacucuuauuaaccaggcaggagugcgagggugcgaucucggcucacugcaaccuccgccucccagcuucaagcaauucucuccugccucagccucccaaauagcugggauuacaggugcccgccaccacacccggcuaauuuuucuauuuuuaguagagaugggguuucaucauauuggucaggcuggucucgaaccccugaccucaugugauccgcccgccucgaccucccaaagugcugggauuacaggcaugagcuaccgcacccggcccagcuaauuuuuuuguauuuuuaguagagacgggguuucaaccauguuggccaggcuagucucgaacuccuggccucaggugauccgcccaucucggccuuccaaagugcugggauuacaggugugagccaccaugcccggccaaagcuguguccuuuguuacucugccuccauccugaccccacaugccguccauccaccccagcacucccuaagcugaggcugccaucauccccugcagggauucuacgagccuccucuaaaagccucucuccccaccacccgccauuguugcuuuuauucugcacacaguagcuagagugaucuuucuaaaacuacagccucaccacauacagcucaccugccugauaccuucagggaugccggcugcccacaggauaagguugccacgucuggcuggcucugaugcuaggcccucuucuccccaucccccugcacagguugccaccaucuccucagcucuccucccuggcagccagcacuccucugcacucccaucugcccagcccacuggcaaggcgggagcuucucaccugcggcuugauguucaccuucuccacggcguucucguugagccacuugacaucgaucuccacgucaaaguguccaauguuacacacaauggcaucauccuucaucugcucaaagugccugucaggcagcccaagaccgugggagauugucagggacagaaagcugucccaacucugcccuccucccucacuccccgggaccccccaucuggcaccuaccggccaaggaugaugucaauacagccugugguggugacaaagauguugcccuccugacaggccucauccaugguggucaccucauagccugugcagagacaguggcugugggucaucuacgguggccuugccccucccucuggccccaguggcugacaaccaacccuugcccuauccuacccuccauggcagccugcagugcguugauggggucaaucucggugaugaugacgcgggcuccgaaaccccgcagggccugggcacagcccuugcccacaucaccauagccugcuaccaccgcuaccuugccggcaaucaucacaucuguggcccgcuugaugccaucuaugagggacucccggcagccauagagguugucaaacuugcucugaaaggaaaggggguaaggagacaauaggggcaggcaaggcccuggggccaggacaacuuggccucagaguauucugaagagcccaggcaucaugggcccaccaagcaucccggccugggcugaaccccuccagcacccaaugcccccacaagcccuucaccccgaucggcucaaagagcuucucucuaaucuuucucugccaguguggagccuuccuaggcaucaguuacuaggagagauugcccggucaaagaccuugcuuaacuugaaagcucuucuucccaaagccauaaagcuccuaacacccagcucugacaccccuuuuaaacgcacucauuagccugucuauaaccgcuuuugcccccucaaaugagggcuucaugucccuaaucucagccuuccugggcacucuucuucagaggccucguccugagcugcagccacuguagcgggagcugucacugccccucggcucaccuuggugacggagucauugacauugauggcaggcaccuugaggaucccauuggccaucaucuuguagagguuguggaccccagucguggucuccucagagaugccucggaugccuaaacaagaggggacaggacaagccucagagaugccacaccugugcucaugcaaauuccucaucuuuacccccuaaagccauuccucuuucuggguucccaucucugugacugaucccacaggccccccaaucacccagacccgcgugagggaggaguccccaacgcccuccuacagggaagccaccaccaggccuagugacucugccuccgaacaacucccagcuucucuauucucacugccgcugcucuaguccgugacccugucgcuucuucccagucucccuaccacaacccauccuccaugcagcagccauuucuaacauguaucuucucagagaaaucuucucaacgcccuccaguuauuuccccuugcucugcaaaucaggucaaacacuuuucuauuggccuauuaggcccugacacaucuggucuucacgaaguucacaccauacccgcagugaaggcucccuuugcucacugcuauccugugggccucuuuucuguuuccugaacacuccagccauuccugccucagggccucugcacucugcguaccugcuuugaacaaagcuggcucccucccagcuauucccaaccauggcccugucugugccugcccuugggccaucagcucagcugcccuagccucgcacccucagaagucaggaggccccagcaugaaugccagagccugccauccucccaucuuccagauccugcugcuugaggugaugggaguccugccaggccugcggccaucaugugggcaaacaggccccacccaggccaccagcacccagcccaccugccccgcccugcucaccuggcagaagcugcggguacuugguguggaugagguuggugaggucgcccccgucguccagaaucauguugaggggcccguccuugaaguacagggucugcucaaugcaccacagguacuccucguccguuucgcccuuccaggcauacacuggagggugaguggcacaucagggccuggacuucccaacugguaccugcuccagggaacaacucuggcagagccaaaacuaccuccuucccaacucccauccccagccaccuccggccccucugaaaacucagcaguggucaggacacaacuuggagccagauagaucugaguucaaacccuggcucugccacuugccagcugugugaccuugggcaaaucacuucaccucucugagccucagucuucuccucuguaaauagggcucacaauaguauggauuaagugagacagaagccauguacagccccccgccccagauauagauaucaggaaaucauucuuuccuuucccauccccuucugccugggcgccaaggacugaggcaucaacccugagugaccagggcuugauaccccacaacgccucccccucagcaggauccacacggcaggauccaggguuugcucugcacugaaaggacuggagcacuagcagccucugugugggggaaucucaggcaaagucuggccaaaaaaugacuacgagcagcuaccaugugugggguacuugcuuucugccagacaugacucuaaauccuccauaccccaucucauucuuccucauagaaacccugugaggcagccaugaccauuaucaucacuuacagaugcccagagaggagcuaagacgcacuugggccacucuaaaugaaauuccagaauagacaccagaacugagggcuacugaccaccagcccacacuccucccauguggcaugacuagggcacaggugugggguucccaggagccucuugugagcaaaggacgcuggccaagcagagccagcugcuucuacccacaacuggagcagacaauagucuuaagaauugcagugagccaagaucgcaccacugcacuccaguaugggcaacggggcaagacucugucucaaaaagaaaaaaaaaaaagaagaaagccacggugccaaggcugaggaauggggaucaugcccauucagcccuggucagucugugaaggagugcugugccacccccuccuguccaccugugguugguuagaagcaaucuugaauguccuaaucacugggucagaucuaaccacuccccuccccaaguccaagcagacaugugcccagccugugaaaacuccauucucguuagacuugguccuuccucaguccuuuagaccgccauacccuaggcagugaaccucuuuuucugccccguagcccuccccaguucuuuggaaagagauccacauccuuccuuuaaugaacuuccccuccgcuucaucauguaguucccaaucauaagaucuugcucuuccugguuacacggcuugaccugggucaauaaacaacuuccacaggauuuuagaugaugaugggacaaagcagcucuuuccuguggggucgcugggcuaggauuuuguggcggugacuccucucccuuucugauauguaaggaagucuguugcucuagcagucagugaagcaaagagggcagaaucccuucacaaauuccacgucucagaagcaagcaggacuuacccggaaugccagccuuggcaauggcagccgccgcaugguccuggguggagaagauguugcagcuggaccacugcaccuagaagagccaucaaaacaaggcuguuggucacugauggcucaaaagcaccagggacgcugggcgaggaaaagggagagcuucggguaguggggagaggcuugggaucuaggcacagcaagcucuaggaucacaggcuggggaugcugggugggcagaugggagccagagcaggggcgagauccaacucagguuuuaaaaccucacuccagugcuguguggaagggaaaggguggaagcaaggggacaacugcagagacuguuggagaagacuccagacaagaaauaugacaguagcaguggagaugaugagaaguugucacauccugggucuacucugaaggcugcacugacaggauuugcagagggaugaguuguuggaguaaagggaguugggaguggggaggaaagggaggggaggagaugacucccagauucgugaauugagagaacccagaaggcuggaacagagguuccauuuacucagguggggaaggcuuugggaagaagagggggcagaaaauccugagucuguuugaacgcguucugccugagaugaguacuagaccuccagggagcgucaacgcccccgcuccuggauaugccagucuugaguuccaggagaaguccaggcuaguacaaaaaugugacagucaucaccagauagugucuaaagcuauaaaaucagaccgccaagagugaaugcugaaaagaaagaagagguccaaggacucagcccugagccccucuguggauuuuggcuccauugcccuacccugcuuugggaaaccagcuugcuucuugacucucugagaccuuaggagagcuguuaaucauuggcacacaugacccaggcugaaccaaucagagcugccaucauccagcagccaugauggguccaggguaggccugugacccccgaagggccaaggcaagcuggcccuuaagagacuaaguaggacauggguguugaauuuuuccugccagagcauccaucaggaggaugccuugaggguagccaacagugaccuucccagccagggagaaaaucugcagaacacucaccacaagggguggcagcacugggaaacggaggaaaccgagugagagggaggaaccccuccaggcccgcggucagcuccacaccuggaagguccccacccuggcacagucgucuucuucccuggcugaacccagggagggcaaggacucuggggugauacagcugugggccucaccucagcacccagggugacgagggucucaaugaggacggccgucuccacggucaugugcaggcagccagcgaugcgggcgcccuucaguggcuuggaggccgaguaccgcucccgcauacgcaucaggcccggcaucucguucucagcaauguccagggccuugcguccccaggcagccaggccgaugucggcuacgggaggaaacaggugggaguuccgugaguccccucaucccaccaaccaagaggggcggucacugcauggaccccgauccacguguggacucaacacacuagggcuuagcacucugucaccgcauucucucacucaugcaacaaguauuuaugaagccagaguacucaagaaagacacggucccugccuaccugcaccuuucugacuugugggagaacacauuuaaucacacagggacacaaaaauuacaacauaaagaagcgucccuuugaaaaauagcucacaugauacuucccacuacccugccuuucugcugacaccuaccaaccuccaggccacuccucacucccuaaagacucccuaaagauguuagcugcugguucuccaucuuccucucucagucaucacucucggugauucaacacuuauaaauacuaucuaacauuuuggauuugacaguuccuugaucuccuuuuagauguaaaaaugcuuccccacuccugauguuucuuuccaccuggaggaacucauccguauaacgaaugcucuuggccucucugccccaggggagguggggugagcuugucugaccaguaaaacugagaggaaaaaauggugugcucagcuuagcucucccuucuuuuugcaagcaagcacucaccugcccacuugcaggaagcugguguucucugcuuuuccagagaccaaccuacccuggcccaccuugccugcaacugauuggguaacugcugaaucuggggguucaauaagcaggaucauuuggauuucauauuaaucuauauccucuggcuuugagguuauuaguaauaaaagguaauauuucagguguugccaccuaaaauacuaaucuacauccucuggcuucaugguuacuaguaacaaaaaguauuucaggugcuaucugccaccuaaaaugucucgaauuuguucaaauucucaggcaggaaagaaggauauuauuaugagcuaacucacuaucucaauacucuccccuaccacacugguccacuuccaaggucauacccuaggucagucccuaggucaaaguuugcagacuuccccgguaagggauguuccucuggcaugcuuguaaaucuccccuggaaaauaugauucagcaggucuaagacuccuggugauuuuuaucuuuagggaagcugagauccugccaaacacccaaagagguaggcggugggaggcaaaggacucuguagagaauuuaauaaucuaagaauuuaauaaucaauaaaauugucugucagucagcuuccuacagugcauuuuaacaauuucagagaugaaacacgccucccgcaugagagaccacuccggcugugccucaacucaagccacccaccccagcccuccuacccuaguaggccaucaccagugauagcucuccuuggaaaucuggacuucaagcacccaacucuagccacgccucaucuuucugguuuucuccuuccagaggccaagcuccaacaaggcuguggccugucaggugagaaccucuauucaauucauccuaccaauuucuagugucccuucuacccccuuucccuuugagaacucacuuggcaaaacucucagcccaauuaaacccgacccuccacugcaccggacccacugaacccagcaggaggacaaucacaaccccaccaagacaucauauuuaauuaauuaauuaauuaauuauuuuagagacauagucuggcucuguagaccaggcuggggugcaguggcgcgaucucggcccacugcaaccuccaccucucaggucccgguucaagcaauucuccugccucagccuccccaauagcugggauuacaggaacucgccaccaugcccagcuaauuuuuguauuuuuagaggagacgggguuucaccauguuggccaggcugaucuugaacuccuggccucgugauccaccugcuucagccucccaaagugcugggauuacaggugugagccaccacaccuggccaagauaucauauuuauuaagaccauaaaagacacauagcacauugcagcaauccuaugacauuuuccuaguaaauuuacucccauuuucuacucuccucaacccuccaacaccuuuccccauugaaugacaaucucacuucccaauucacugagaugaauucagaaccaggccacuuuuccccuauggaauccacuagucaccuauagcagucaucuacagcuucagaccaggcacucuuuccuguuaccacagaugaguugaaugggcgcgguggcucacaccuguaaucccaacacuuugggaggccaaggugggcagaucacuugaggucaggaguucaagaccagccugaccaacauggugaaaccccgucucuacuaaaaauacaaaaauuagccgggugugguggugggugccuguaaucccagcuacucaggaggcugaggcaggagaaucacuugaaccugggaggcagaggcugcaaugagcugagaucaugccacugcacuccagccugggugacagagugagacucggucucaaaaaaauaaaauaaaauagaugagcuguccugugggcggcaagccacccaggcaccgaggcaagagacagaggacacgagcuguuccaguauaauaaaauauaaaacaagaauaguuauacuagauauagaucuuauauaugauuauauaugaauaucauuaaucauuaguuuguagcaauuacuuuuuauuccaauauuaugauaauccuugcucuauaaucauagccuaggaaaaaccaggccauacagagauaggagcugaggggacauagugaggugugaccagaagacaagagugcgagccuucuguuaugcccggacagggccaccagagggcuccuuggucuagcggugacgccagcgucugggaagacgcccguuaccaggcggaucgugguccagcgguagcaaaaggugucaaggaacaacacccgcuacuuagcagacugggaaguggcggcggcgggaggggggggggugucucccuuuccccaggggaguuuagaaaagacucugcuccuccaccucuuguagagggccugacaucagccaggcucgcccacaguuauccagaggccuaaccaucucccugugaugcugugcuucaguggucacacuccuagucugccuucauguuccauccuguacaccuggcuaugccuucuagauagcaguaguaaauuaguaaaaauacuaauagucccugauaugcagaaauaauugcguaagcugucuuucucucugucuccucucccucccugccucggcugccaggcagggaagggcccccuguccaguggacacgugacccacaugaccuuaccuauccuuggaggugacucacauucuuuacccugccccuucugccuuauaugcaauaaauaacagcgcagcccaacauucggggccacuaccggucuccgcgcauugaugguaguggucccccgggcccagcugccuuuucucuugucucuuugucuuguaucuuuauuucuacacucucucgucgccgcacacagggagagacccaccgacccuauggggcuggucacuacacuaucccugcuccauggggccugauuccauauccccucuccuccuuaaggacuuccauacuccacuaaaacugcucuuccguccaaagaccagccugaucuccauaccugaugcaaaauuaccuaagaccauguuucuaccagcagcacagauugcaugaaugacuugcccuccuuccugaaacccuuucuuuacuuggcuucugugacuguccugugcuuuuccaccuaccuuccugguuccucuuuagcuaacagacuuuaggguuugggggcccucagggcuccaucaucucccaguucucuuauguuuaccaauuaagcucauccagucuuauggcuuuacauaccuucucuacggggaugacucccacguauuuauauccagcccaaacuacuccccugaacuugagacucgaugugauccaacugccuccacagcaccuccacuuggauguccaguuggaucuauuaugugucauguuggaguccucauggcuccuuugcccccacuaccgguuacucucccaaucuucccauuuuaggaaaugaaaccaccauucaaccagcuacucugcccaaaaacuuaagauuugauuccucuuuuccucuuucaccucaaucagcacguuuuuggcucaacaagugaaauauauaagcaauccaacugcaucucaccaccuucaucuaaacugucacuucucaggcugggcgcgguggcucacagccuguaaucccagcacuuugggaggccaaggugggcggaucacccgaggucagaaguucgagagcagccuggccaacauggugaaaucccaucucuacuaaaaauacaaaaauuaguugggcgugguggugggcacuuauaaucccaccuacucaggaggcugaggcaggagaauugcuugaaccugggaggcggagguggcagugagcuaaaauagcaccacugcacuccaaccugggugagagggagacucugucuccaaaaaaaacaauaaagaaauaaauacacugccacuucucaguuggacacugccacacucucuucacuggucccaugcucuaacaugccauucuccccacagcagccagaagagggaggcucuuaaaaauuuaaguuacaucaccuccaucauucuacuaaaguaaacaaaacuaaacaagcaaacccuccaauggcuucccucaaucuucgggcccuaucugcaugacugccugccccuccuccaucucuccacuuuccccacucacuagcuguucaacacacaggcuuccugacugacuucaggcaagcuccacucauuuccaccucagggcuuuaacccaagcaguucucggccuggaaggcuccucucaagcaccuaauacaguaccuggcacacaguaggugcugaaaaaaaccuggaaacaggaaagaaccuaguauaucccugcuagaggaaccaagagugcaccagggugacucaaauagaggcauaagaugaguugggacuucagucccagugaaguggggaaccuacaguuuucaggggccagcauucagagaccagauuugucuuuugaaaagaccccauuggcugcuguguggaucugcggagcaagagauccagggagaccugcaaggagagagaccagacugggguggugaccguggagacagacaaguggcagaucugcucacauaaaauggagacaauacuacuuuaucuguaugcaugucugugccaccccugucucugggucaccuuugugucuccagcaugaccuggcucagagaaggggucagcaacuguuuaccgaccauaucuguccucagaacugaaugaaagauccaugagaggggcuggcacgugacaaggguggcaaagaaaaacaacacaaaucugaaccuagucugagucccagcauuuacuaaugacccagagaggacccagagaggaguuugcugcagguuccauagccaauuaaccgcagaaccagaacuggcagccaggcagggcuagagcagaggccccucucaaggccccuccugggaggggcccggcuguaugggacaauggguuaugcccugugcugcuaagcuccaccccuccaccaccacaugucccuccagcuaaaaauaacuccuucagugcccucgaggacacugugccagccccacaguuuucccugggacccucaacuccaaaggcacaggagaggcuagaugcugcaaucucuggagcuaaggacuugcaaaagucacaggaacaccuguccccaggacaagccaagaggaacagcaagagccccuguaaacaucaguuucuucaucuguaaaguguggauaaucaucccuagcuugcuaugcgccuuaaguaaagauaaugccauaugaucaagaucuggcauacagcagggccuccuuccuccagccccacccagcuaagcuccccauccccaaauccagcuuuaucuccacccacacaacccaauggccccaauccugacccacuaaucucuccacaguaugacaagcccccauuccagcucuacuauugaugugaccuucacauaaccuuucuggguucaguuucagcauccacacaauggagacagucuacucugguagcaacuugaugaacuacuucaacagaaucuuugcaagucaccucccaagggccucaguuucaugcucuauauaacgggauuacguccaccucuaugaagauuauuguguaaacacacguaaaucaccagauauacagcaaguguuuccauaaauguggauggcauucuccagacuuaauagugucuuuuuuuguuuguuuuuuuuuuuugagacagggucuugcucuguugcccagguuggagcgugguggugcaaucucggcucacugcaaccuccgucuccccggcucaaacaguccuccugccucagccucccgaguagcugggaaugaaggcgcccgccaccacgcccagcuaguuuuuguauuuuugguagagauagcguuucaccacguuggccaggcuggucucgaacucuugaccucaagugauucgcccaccucggccucucaaagugcugggacuacaggggugagccaccacacccgguccaauagugucaaaguuacuugaaaagcuaccagccaaacugaacugguuuuugcugaaaauucacuaggauuguuccgcguguauucgcuugcacacaguggugaaagggugcgcucagagaucuagauggccugcguuccaaucuugcuccaucaccaccagcuguaagacugagggcaaguuaccucugccucaggauucucaucauaaaaugagaacaguuucccuauagagccaugagacuagaauaaagcuagaaggcagugccgaucccacaggaaacacuaaguaaacguuaacuaucccuguauuacacuucaaucggugggacagcaggauuuuucaaaccacuccaaauuuucuucgagauuucugcaaggcugccccugcuggaggggugggggaccccacagguuggguaacuggcccaaagucccaggggagaggaggaucggagccggccuggggcucgcuuuccaggccucuccucauacacccuccggggugcccucgccgucccuguaggaggcccagagagggguggacgcucgucggggccgcccagcuggacaggguccgguccaggccuaggaggccgggcgcaggccccccgagcaggguccggcaggugccagccgucccaggccguggccaggugugcucucccgcggagcacgccgccaguuugcggcucgcagaccgcgcggcggccccggcgucgcggggcaugcugggacuuguaguccacggccacccggaacggcccgcucauggccgcgcgagaacuccaacuuccagcuggcuucgcgcggccagaaacgcgccgaggcugcgauuccaggggguccagagagccccgagucggcccugcagcccccgccacgaacaagccccgggcgggugccgggcggccgcaaccggcugcagguccugggacucaccgacuuuguagggcaguuugucagacaugcuggcggcacucgugauggaaacgggcgaagggggcugggccucagucugggaacaggaacugggcgggcagcgccgagcagggauaugcgcguggcgccgacgccuuuaaauaucuuccucgcacuug

SEQ ID NO: 13474 - RNA, 23151 nt, Homo sapiens
caagugcgaggaagauauuuaaaggcgucggcgccacgcgcauaucccugcucggcgcugcccgcccaguuccuguucccagacugaggcccagcccccuucgcccguuuccaucacgagugccgccagcaugucugacaaacugcccuacaaagucggugagucccaggaccugcagccgguugcggccgcccggcacccgcccggggcuuguucguggcgggggcugcagggccgacucggggcucucuggacccccuggaaucgcagccucggcgcguuucuggccgcgcgaagccagcuggaaguuggaguucucgcgcggccaugagcgggccguuccggguggccguggacuacaagucccagcaugccccgcgacgccggggccgccgcgcggucugcgagccgcaaacuggcggcgugcuccgcgggagagcacaccuggccacggccugggacggcuggcaccugccggacccugcucggggggccugcgcccggccuccuaggccuggaccggacccuguccagcugggcggccccgacgagcguccaccccucucugggccuccuacagggacggcgagggcaccccggaggguguaugaggagaggccuggaaagcgagccccaggccggcuccgauccuccucuccccugggacuuugggccaguuacccaaccuguggggucccccaccccuccagcaggggcagccuugcagaaaucucgaagaaaauuuggagugguuugaaaaauccugcugucccaccgauugaaguguaauacagggauaguuaacguuuacuuaguguuuccugugggaucggcacugccuucuagcuuuauucuagucucauggcucuauagggaaacuguucucauuuuaugaugagaauccugaggcagagguaacuugcccucagucuuacagcugguggugauggagcaagauuggaacgcaggccaucuagaucucugagcgcacccuuucaccacugugugcaagcgaauacacgcggaacaauccuagugaauuuucagcaaaaaccaguucaguuuggcugguagcuuuucaaguaacuuugacacuauuggaccgggugugguggcucaccccuguagucccagcacuuugagaggccgaggugggcgaaucacuugaggucaagaguucgagaccagccuggccaacguggugaaacgcuaucucuaccaaaaauacaaaaacuagcugggcgugguggcgggcgccuucauucccagcuacucgggaggcugaggcaggaggacuguuugagccggggagacggagguugcagugagccgagauugcaccaccacgcuccaaccugggcaacagagcaagacccugucucaaaaaaaaaaaacaaacaaaaaaagacacuauuaagucuggagaaugccauccacauuuauggaaacacuugcuguauaucuggugauuuacguguguuuacacaauaaucuucauagagguggacguaaucccguuauauagagcaugaaacugaggcccuugggaggugacuugcaaagauucuguugaaguaguucaucaaguugcuaccagaguagacugucuccauuguguggaugcugaaacugaacccagaaagguuaugugaaggucacaucaauaguagagcuggaaugggggcuugucauacuguggagagauuagugggucaggauuggggccauuggguuguguggguggagauaaagcuggauuuggggauggggagcuuagcuggguggggcuggaggaaggaggcccugcuguaugccagaucuugaucauauggcauuaucuuuacuuaaggcgcauagcaagcuagggaugauuauccacacuuuacagaugaagaaacugauguuuacaggggcucuugcuguuccucuuggcuuguccuggggacagguguuccugugacuuuugcaaguccuuagcuccagagauugcagcaucuagccucuccugugccuuuggaguugagggucccagggaaaacuguggggcuggcacaguguccucgagggcacugaaggaguuauuuuuagcuggagggacauguggugguggagggguggagcuuagcagcacagggcauaacccauugucccauacagccgggccccucccaggaggggccuugagaggggccucugcucuagcccugccuggcugccaguucugguucugcgguuaauuggcuauggaaccugcagcaaacuccucucuggguccucucugggucauuaguaaaugcugggacucagacuagguucagauuuguguuguuuuucuuugccacccuugucacgugccagccccucucauggaucuuucauucaguucugaggacagauauggucgguaaacaguugcugaccccuucucugagccaggucaugcuggagacacaaaggugacccagagacagggguggcacagacaugcauacagauaaaguaguauugucuccauuuuaugugagcagaucugccacuugucugucuccacggucaccaccccagucuggucucucuccuugcaggucucccuggaucucuugcuccgcagauccacacagcagccaauggggucuuuucaaaagacaaaucuggucucugaaugcuggccccugaaaacuguagguuccccacuucacugggacugaagucccaacucaucuuaugccucuauuugagucacccuggugcacucuugguuccucuagcagggauauacuagguucuuuccuguuuccagguuuuuuucagcaccuacugugugccagguacuguauuaggugcuugagaggagccuuccaggccgagaacugcuuggguuaaagcccugagguggaaaugaguggagcuugccugaagucagucaggaagccuguguguugaacagcuagugaguggggaaaguggagagauggaggaggggcaggcagucaugcagauagggcccgaagauugagggaagccauuggaggguuugcuuguuuaguuuuguuuacuuuaguagaaugauggaggugauguaacuuaaauuuuuaagagccucccucuucuggcugcuguggggagaauggcauguuagagcaugggaccagugaagagaguguggcaguguccaacugagaaguggcaguguauuuauuucuuuauuguuuuuuuuggagacagagucucccucucacccagguuggagugcaguggugcuauuuuagcucacugccaccuccgccucccagguucaagcaauucuccugccucagccuccugaguaggugggauuauaagugcccaccaccacgcccaacuaauuuuuguauuuuuaguagagaugggauuucaccauguuggccaggcugcucucgaacuucugaccucgggugauccgcccaccuuggccucccaaagugcugggauuacaggcugugagccaccgcgcccagccugagaagugacaguuuagaugaagguggugagaugcaguuggauugcuuauauauuucacuuguugagccaaaaacgugcugauugaggugaaagaggaaaagaggaaucaaaucuuaaguuuuugggcagaguagcugguugaauggugguuucauuuccuaaaaugggaagauugggagaguaaccgguagugggggcaaaggagccaugaggacuccaacaugacacauaauagauccaacuggacauccaaguggaggugcuguggaggcaguuggaucacaucgagucucaaguucaggggaguaguuugggcuggauauaaauacgugggagucauccccguagagaagguauguaaagccauaagacuggaugagcuuaauugguaaacauaagagaacugggagaugauggagcccugagggcccccaaacccuaaagucuguuagcuaaagaggaaccaggaagguagguggaaaagcacaggacagucacagaagccaaguaaagaaaggguuucaggaaggagggcaagucauucaugcaaucugugcugcugguagaaacauggucuuagguaauuuugcaucagguauggagaucaggcuggucuuuggacggaagagcaguuuuaguggaguauggaaguccuuaaggaggagaggggauauggaaucaggccccauggagcagggauaguguagugaccagccccauagggucggugggucucucccugugugcggcgacgagagaguguagaaauaaagauacaagacaaagagacaagagaaaaggcagcugggcccgggggaccacuaccaucaaugcgcggagaccgguaguggccccgaauguugggcugcgcuguuauuuauugcauauaaggcagaaggggcaggguaaagaaugugagucaccuccaaggauagguaaggucaugugggucacguguccacuggacagggggcccuucccugccuggcagccgaggcagggagggagaggagacagagagaaagacagcuuacgcaauuauuucugcauaucagggacuauuaguauuuuuacuaauuuacuacugcuaucuagaaggcauagccagguguacaggauggaacaugaaggcagacuaggagugugaccacugaagcacagcaucacagggagaugguuaggccucuggauaacugugggcgagccuggcugaugucaggcccucuacaagagguggaggagcagagucuuuucuaaacuccccuggggaaagggagacaccccccccccucccgccgccgccacuucccagucugcuaaguagcggguguuguuccuugacaccuuuugcuaccgcuggaccacgauccgccugguaacgggcgucuucccagacgcuggcgucaccgcuagaccaaggagcccucugguggcccuguccgggcauaacagaaggcucgcacucuugucuucuggucacaccucacuauguccccucagcuccuaucucuguauggccugguuuuuccuaggcuaugauuauagagcaaggauuaucauaauauuggaauaaaaaguaauugcuacaaacuaaugauuaaugauauucauauauaaucauauauaagaucuauaucuaguauaacuauucuuguuuuauauuuuauuauacuggaacagcucguguccucugucucuugccucggugccuggguggcuugccgcccacaggacagcucaucuauuuuauuuuauuuuuuugagaccgagucucacucugucacccaggcuggagugcaguggcaugaucucagcucauugcagccucugccucccagguucaagugauucuccugccucagccuccugaguagcugggauuacaggcacccaccaccacacccggcuaauuuuuguauuuuuaguagagacgggguuucaccauguuggucaggcuggucuugaacuccugaccucaagugaucugcccaccuuggccucccaaaguguugggauuacaggugugagccaccgcgcccauucaacucaucugugguaacaggaaagagugccuggucugaagcuguagaugacugcuauaggugacuaguggauuccauaggggaaaaguggccugguucugaauucaucucagugaauugggaagugagauugucauucaauggggaaagguguuggaggguugaggagaguagaaaaugggaguaaauuuacuaggaaaaugucauaggauugcugcaaugugcuaugugucuuuuauggucuuaauaaauaugauaucuuggccaggugugguggcucacaccuguaaucccagcacuuugggaggcugaagcagguggaucacgaggccaggaguucaagaucagccuggccaacauggugaaaccccgucuccucuaaaaauacaaaaauuagcugggcaugguggcgaguuccuguaaucccagcuauuggggaggcugaggcaggagaauugcuugaaccgggaccugagagguggagguugcagugggccgagaucgcgccacugcaccccagccuggucuacagagccagacuaugucucuaaaauaauuaauuaauuaauuaauuaaauaugaugucuuggugggguugugauuguccuccugcuggguucaguggguccggugcaguggagggucggguuuaauugggcugagaguuuugccaagugaguucucaaagggaaaggggguagaagggacacuagaaauugguaggaugaauugaauagagguucucaccugacaggccacagccuuguuggagcuuggccucuggaaggagaaaaccagaaagaugaggcguggcuagaguugggugcuugaaguccagauuuccaaggagagcuaucacuggugauggccuacuaggguaggagggcugggguggguggcuugaguugaggcacagccggaguggucucucaugcgggaggcguguuucaucucugaaauuguuaaaaugcacuguaggaagcugacugacagacaauuuuauugauuauuaaauucuuagauuauuaaauucucuacagaguccuuugccucccaccgccuaccucuuuggguguuuggcaggaucucagcuucccuaaagauaaaaaucaccaggagucuuagaccugcugaaucauauuuuccaggggagauuuacaagcaugccagaggaacaucccuuaccggggaagucugcaaacuuugaccuagggacugaccuaggguaugaccuuggaaguggaccagugugguaggggagaguauugagauagugaguuagcucauaauaauauccuucuuuccugccugagaauuugaacaaauucgagacauuuuagguggcagauagcaccugaaauacuuuuuguuacuaguaaccaugaagccagaggauguagauuaguauuuuagguggcaacaccugaaauauuaccuuuuauuacuaauaaccucaaagccagaggauauagauuaauaugaaauccaaaugauccugcuuauugaacccccagauucagcaguuacccaaucaguugcaggcaaggugggccaggguagguuggucucuggaaaagcagagaacaccagcuuccugcaagugggcaggugagugcuugcuugcaaaaagaagggagagcuaagcugagcacaccauuuuuuccucucaguuuuacuggucagacaagcucaccccaccuccccuggggcagagaggccaagagcauucguuauacggaugaguuccuccagguggaaagaaacaucaggaguggggaagcauuuuuacaucuaaaaggagaucaaggaacugucaaauccaaaauguuagauaguauuuauaaguguugaaucaccgagagugaugacugagagaggaagauggagaaccagcagcuaacaucuuuagggagucuuuagggagugaggaguggccuggagguugguaggugucagcagaaaggcaggguagugggaaguaucaugugagcuauuuuucaaagggacgcuucuuuauguuguaauuuuugugucccugugugauuaaauguguucucccacaagucagaaaggugcagguaggcagggaccgugucuuucuugaguacucuggcuucauaaauacuuguugcaugagugagagaaugcggugacagagugcuaagcccuaguguguugaguccacacguggaucgggguccaugcagugaccgccccucuugguuggugggaugaggggacucacggaacucccaccuguuuccucccguagccgacaucggccuggcugccuggggacgcaaggcccuggacauugcugagaacgagaugccgggccugaugcguaugcgggagcgguacucggccuccaagccacugaagggcgcccgcaucgcuggcugccugcacaugaccguggagacggccguccucauugagacccucgucacccugggugcugaggugaggcccacagcuguaucaccccagaguccuugcccucccuggguucagccagggaagaagacgacugugccaggguggggaccuuccagguguggagcugaccgcgggccuggagggguuccucccucucacucgguuuccuccguuucccagugcugccaccccuuguggugaguguucugcagauuuucucccuggcugggaaggucacuguuggcuacccucaaggcauccuccugauggaugcucuggcaggaaaaauucaacacccauguccuacuuagucucuuaagggccagcuugccuuggcccuucgggggucacaggccuacccuggacccaucauggcugcuggaugauggcagcucugauugguucagccugggucaugugugccaaugauuaacagcucuccuaaggucucagagagucaagaagcaagcugguuucccaaagcaggguagggcaauggagccaaaauccacagaggggcucagggcugaguccuuggaccucuucuuucuuuucagcauucacucuuggcggucugauuuuauagcuuuagacacuaucuggugaugacugucacauuuuuguacuagccuggacuucuccuggaacucaagacuggcauauccaggagcgggggcguugacgcucccuggaggucuaguacucaucucaggcagaacgcguucaaacagacucaggauuuucugcccccucuucuucccaaagccuuccccaccugaguaaauggaaccucuguuccagccuucuggguucucucaauucacgaaucugggagucaucuccuccccucccuuuccuccccacucccaacucccuuuacuccaacaacucaucccucugcaaauccugucagugcagccuucagaguagacccaggaugugacaacuucucaucaucuccacugcuacugucauauuucuugucuggagucuucuccaacagucucugcaguuguccccuugcuuccacccuuucccuuccacacagcacuggagugagguuuuaaaaccugaguuggaucucgccccugcucuggcucccaucugcccacccagcauccccagccugugauccuagagcuugcugugccuagaucccaagccucuccccacuacccgaagcucucccuuuuccucgcccagcgucccuggugcuuuugagccaucagugaccaacagccuuguuuugauggcucuucuaggugcagugguccagcugcaacaucuucuccacccaggaccaugcggcggcugccauugccaaggcuggcauuccggguaaguccugcuugcuucugagacguggaauuugugaagggauucugcccucuuugcuucacugacugcuagagcaacagacuuccuuacauaucagaaagggagaggagucaccgccacaaaauccuagcccagcgaccccacaggaaagagcugcuuugucccaucaucaucuaaaauccuguggaaguuguuuauugacccaggucaagccguguaaccaggaagagcaagaucuuaugauugggaacuacaugaugaagcggaggggaaguucauuaaaggaaggauguggaucucuuuccaaagaacuggggagggcuacggggcagaaaaagagguucacugccuaggguauggcggucuaaaggacugaggaaggaccaagucuaacgagaauggaguuuucacaggcugggcacaugucugcuuggacuuggggaggggagugguuagaucugacccagugauuaggacauucaagauugcuucuaaccaaccacagguggacaggaggggguggcacagcacuccuucacagacugaccagggcugaaugggcaugauccccauuccucagccuuggcaccguggcuuucuucuuuuuuuuuuuucuuuuugagacagagucuugccccguugcccauacuggagugcaguggugcgaucuuggcucacugcaauucuuaagacuauugucugcuccaguuguggguagaagcagcuggcucugcuuggccagcguccuuugcucacaagaggcuccugggaaccccacaccugugcccuagucaugccacaugggaggagugugggcugguggucaguagcccucaguucuggugucuauucuggaauuucauuuagaguggcccaagugcgucuuagcuccucucugggcaucuguaagugaugauaauggucauggcugccucacaggguuucuaugaggaagaaugagaugggguauggaggauuuagagucaugucuggcagaaagcaaguaccccacacaugguagcugcucguagucauuuuuuggccagacuuugccugagauucccccacacagaggcugcuagugcuccaguccuuucagugcagagcaaacccuggauccugccguguggauccugcugagggggaggcguugugggguaucaagcccuggucacucaggguugaugccucaguccuuggcgcccaggcagaaggggaugggaaaggaaagaaugauuuccugauaucuauaucuggggcggggggcuguacauggcuucugucucacuuaauccauacuauugugagcccuauuuacagaggagaagacugaggcucagagaggugaagugauuugcccaaggucacacagcuggcaaguggcagagccaggguuugaacucagaucuaucuggcuccaaguuguguccugaccacugcugaguuuucagaggggccggagguggcuggggaugggaguugggaaggagguaguuuuggcucugccagaguuguucccuggagcagguaccaguugggaaguccaggcccugaugugccacucacccuccaguguaugccuggaagggcgaaacggacgaggaguaccuguggugcauugagcagacccuguacuucaaggacgggccccucaacaugauucuggacgacgggggcgaccucaccaaccucauccacaccaaguacccgcagcuucugccaggugagcagggcggggcaggugggcugggugcugguggccuggguggggccuguuugcccacaugauggccgcaggccuggcaggacucccaucaccucaagcagcaggaucuggaagaugggaggauggcaggcucuggcauucaugcuggggccuccugacuucugagggugcgaggcuagggcagcugagcugauggcccaagggcaggcacagacagggccaugguugggaauagcugggagggagccagcuuuguucaaagcagguacgcagagugcagaggcccugaggcaggaauggcuggaguguucaggaaacagaaaagaggcccacaggauagcagugagcaaagggagccuucacugcggguauggugugaacuucgugaagaccagaugugucagggccuaauaggccaauagaaaaguguuugaccugauuugcagagcaaggggaaauaacuggagggcguugagaagauuucucugagaagauacauguuagaaauggcugcugcauggaggauggguugugguagggagacugggaagaagcgacagggucacggacuagagcagcggcagugagaauagagaagcugggaguuguucggaggcagagucacuaggccuggugguggcuucccuguaggagggcguuggggacuccucccucacgcgggucugggugauuggggggccugugggaucagucacagagaugggaacccagaaagaggaauggcuuuaggggguaaagaugaggaauuugcaugagcacagguguggcaucucugaggcuuguccuguccccucuuguuuaggcauccgaggcaucucugaggagaccacgacugggguccacaaccucuacaagaugauggccaaugggauccucaaggugccugccaucaaugucaaugacuccgucaccaaggugagccgaggggcagugacagcucccgcuacaguggcugcagcucaggacgaggccucugaagaagagugcccaggaaggcugagauuagggacaugaagcccucauuugagggggcaaaagcgguuauagacaggcuaaugagugcguuuaaaaggggugucagagcuggguguuaggagcuuuauggcuuugggaagaagagcuuucaaguuaagcaaggucuuugaccgggcaaucucuccuaguaacugaugccuaggaaggcuccacacuggcagagaaagauuagagagaagcucuuugagccgaucggggugaagggcuugugggggcauugggugcuggagggguucagcccaggccgggaugcuuggugggcccaugaugccugggcucuucagaauacucugaggccaaguuguccuggccccagggccuugccugccccuauugucuccuuacccccuuuccuuucagagcaaguuugacaaccucuauggcugccgggagucccucauagauggcaucaagcgggccacagaugugaugauugccggcaagguagcggugguagcaggcuauggugaugugggcaagggcugugcccaggcccugcgggguuucggagcccgcgucaucaucaccgagauugaccccaucaacgcacugcaggcugccauggaggguaggauagggcaaggguugguugucagccacuggggccagagggaggggcaaggccaccguagaugacccacagccacugucucugcacaggcuaugaggugaccaccauggaugaggccugucaggagggcaacaucuuugucaccaccacaggcuguauugacaucauccuuggccgguaggugccagauggggggucccggggagugagggaggagggcagaguugggacagcuuucugucccugacaaucucccacggucuugggcugccugacaggcacuuugagcagaugaaggaugaugccauuguguguaacauuggacacuuugacguggagaucgaugucaaguggcucaacgagaacgccguggagaaggugaacaucaagccgcaggugagaagcucccgccuugccagugggcugggcagaugggagugcagaggagugcuggcugccagggaggagagcugaggagaugguggcaaccugugcagggggauggggagaagagggccuagcaucagagccagccagacguggcaaccuuauccugugggcagccggcaucccugaagguaucaggcaggugagcuguauguggugaggcuguaguuuuagaaagaucacucuagcuacugugugcagaauaaaagcaacaauggcgggugguggggagagaggcuuuuagaggaggcucguagaaucccugcaggggaugauggcagccucagcuuagggagugcugggguggauggacggcauguggggucaggauggaggcagaguaacaaaggacacagcuuuggccgggcaugguggcucacaccuguaaucccagcacuuuggaaggccgagaugggcggaucaccugaggccaggaguucgagacuagccuggccaacaugguugaaaccccgucucuacuaaaaauacaaaaaaauuagcugggccgggugcgguagcucaugccuguaaucccagcacuuugggaggucgaggcgggcggaucacaugaggucagggguucgagaccagccugaccaauaugaugaaaccccaucucuacuaaaaauagaaaaauuagccgggugugguggcgggcaccuguaaucccagcuauuugggaggcugaggcaggagagaauugcuugaagcugggaggcggagguugcagugagccgagaucgcacccucgcacuccugccugguuaauaagagugagacuccaucucaaaaaaaaaaaaaaaaaaaaggccagguacaguggcucaugccuguaaucccagcacuuugggaggccuaggugggcagaucacgaggucaggaguuugagaccagucuggccaacauagugaaaccccgucucuacuaaaaauacaagaaguuagccggguguggugaugugcaccugcaaucccagcuacuugggaggcugaggcaggagaaucacaugaacccgggagauggagguuguagugagccgagauuguuccacugcacuccagccugggugacagugcgagacucugucucaaaaacaaacaaacaaaaaaaucagcugggcaugguggugggugccuguaaucccagcuacucgggaggcugaggcaugagaaucgcuuaaacgugguaggcagagguugcagugagccgagauugcgccauugcacuccagccugggcaacagagcgagacuccaucucaaaaacaaaacuaaaaacaaaaaacaaaaagggacacagcuugaaucacugugugaggagcaggcccaugcacugagcugggaaagaacagguuugcauugggcauuggggcacugaaacuggaagaugaguucuuauagggggugugaaguuuuacuugaguugcaauuauuaugaguuuauuuuuuucucugauuauaaaaguaguauguuucuggaagacauuuuggcuuuggauaucaagagcuuuaaaguuaagcaaccucuuugacugggcaaucucuccuauaauugguccuuaggauaauuaaauauguauguagagauguucaucauuuuuuuuuucuuuuuuugagaugggcucacucuguuacccaagcuagagggcaguggcaugaucauggcacacugcagccuugaccuccugggcugaaggagcugauccuccugccucagccuuccaaguaccugggacuacagaugugcacuacuacaccuggcuaacuuuuuauuuuuuguagagacgaggccuugcuguguuccccaggcuggucucaaacuccugagcuuaaguuaucucccaaagugcugggauuauaggcgugagcugccacaccagguccaccacauuuuuuaaagggagaaaagcccaccuaugugagguucuuugaguuggugcugugccguguuugagauaugauaaggaagauacagacacagaguuggccaaagcccugacacccacccagucacagccacaccagaagcccaagucccagagaggcagacaggcagcucuaugaacccacauccccuacacugcuccucuugggugcucugcuccugcgugggaguucuccuuggcuagguccugcacuagucuagggugucaguucccggcuaggcagagggcaccuccaucucugccuagaaggccuggcacucaucacaguguggggguggccagggcgugcuucuguggcagccacaccccugacagccaucugucuagaccuccuuuuugcaaaggcaucacaggugaaaccugcuacauuggggugaugggcaccuuucugccaagcugcccuccaaagcuggacucuaugcccacccucaacauccuugacagucuugccaaccuucugcccaacauuaucucuuguccguccucucaagggccucuguacucaggccauaauugaccacucccugaauacccacugcagcuccuacuucugcucaucuguccagacagcugcauuugucuggaacagaacacaugcccuucuccuuguucaucuucucagcccagcucaagagacccccuucuggccaggcacgguggcacacaccuguaauuccagcacuuugggaggccgaggcaggcggaucacuugaggucaggaguuugagaccagccuggccaacauggucaaacccugucucuacuaaaaauacaaaaaauuagcugggcaugguggcucaugcguauagucccagcuacucuggaggcugaggcaggagaaucgcuugaacccaggagguggagguugcagugagcugagaucacaccacuguacuccagccuggaugacagaguaagacuccgucucagaaaaaaaaaaaaaaaaaaaauuaauaaaauaaaaaagagacccccuuccuggccagcuccucuggcagaggcaaugcccacacucuuaguacagaccccuagugcagcauccaucacuggcuuuggucucugaccccacuguuguaccaggaggguagaguccagguugacgugucccugcaaggggcuuagauggguaucagugagugcuuauugauugaagcaucaaucaaugccugaugggcaucagagaccuuuccuuggaucgguacuaggccucuggagcagcuuggaaaccugggcuuuuggggaaauguuugggaggcugccugaggguggagggauggcaagggaagagcugggaguggggagaaagcaaguuuguguguucagacagcugggacagacggaggacuggggcacugaggcuggggauuuccaugucacguucacucacuaaaccgggaguucucaaccuuggcagucaccugggagccacacugugggccacaggaauaggagucucugggaaugaggccaagguaucuuuuuuuuuuuuuuuuuuuuuuuuugagacggaguuucgcucuuguugcccaggcuggagugcaauggcgcgaucuuggcucaccacaaccuccgcuucccagguucaagcgauucgccuggcucagccuuccugaguagcugggauuacaggcaugugcuaccaugccuggcuaauuuuguguuuuuaguagagacaggguuucuccauguuguucaggcuggucccgaacucccgaccucaggugauuccccccgccuuggccucccaaagugcugggauuacaggcaugagccaccgcgucuggccuggguauccucauuuuuuaaagcuucugaggugauuccaaugugagcgccacggcauucagcuuuugcuaagcugcauucaaaacuauuucaugguuauugagaacaugggaucuguccucagaccguccagacucaaauugcagccuccucuuaguguguggcucuggacaagugaccuaacccuuguaaacuucaguuucugaaucugaaauggggaugacagcaguacugaaaucacaggguuguuucugggaugaaaugugguaguuaccuguaaaggacuuaguacagggcacaugacagugaucauaacgauaacauuagcugcugcuuacugagugccucauaugcgccaagcaagugugagcacgugaaguucucacagcagaacugugcagucugcagcucagcauuucuuuguuguuuuuuuguuuuuuguuuuuugagacagagucucgcuccgucgcccaggcugcagugcaguggugcgaucucggcucgcugcaaacuccaccucccagguucacgccauucuccugccucagccucccgaguggcugggaccacaggcgccugcuaccacgcccggcuaauuuuuuguauuuuuuuuuuaguagagacgggcuuucacuguguuggccaagauaaucucgaucuccugaccucaugauccgccugccucggccuuccaaagugcugggauuacaggcgugagccaccgugccccggccagcucaacauuucuuaauaaauauuggcuguuauuuuugugcuaagccaugugcuggagguuguuuuggagcaguucggacuccucaugggcacuguuggaggcagagaggccugccagaucagagggugggcugugggagcggggcccugccugccuucacuguugcccugccugcguguagguggaccgguaucgguugaagaaugggcgccgcaucauccugcuggccgagggucggcuggucaaccuggguugugccaugggccaccccagcuucgugaugaguaacuccuucaccaaccaggugauggcgcagaucgagcuguggacccauccagacaaguaccccguugggguucauuuccugcccaagaagguggguuuauucuucuaccucaagccaagggucacgugucuaauccugggauccccacacagggcuugccagaguuuauaaagugcuugccugucugcccucuuagaggcccucaugggguccucuacagugcagaagucauucuccccauugacagaagaagaaacugagacccacaguagggaguggcucccuggagcacagcagagcggcaggaccagguggugaggagagccugggccuuggagcgggacacaccccaguuugaaucucagccccaccacuuacaggcuguguaauccaggcaaauucuuucucugucuucauuuucucaucugugaaaugaagguaauagcaacccccuucaggauugugaggauuuccugagaucaugaacccacacacccacaggggcuaggcagguaaaugagugaugccagcugaacaaggacuggaagagcugaagggguaaagggcugguugccaccuaggaacccagguccgucugaccagggcuucuaaccuuucaggagagccagagauaccaagaucucuauacaaaaugauuuucaaauacaggcaacucauuaaaauuuuauuuugauuuugauuuuuuugagauagagucucacucuguugcccaggcuagagugcagugacgugaucucggcuuacugcaaccuccaccugccggguucaagcaauccucccaccucagccucuugaguagcuaggauuacaggcagaugccaccacacuuggcuaauuuuuuuguauuuuuaguagagacgggguuuugccauauuggccagacuggucucgaacuccugauuucaagugauccacccgccucggccacugcaccuggccucauuauaauuuaaaaaauaacuggguggguuaacuuggacauguguauaagcugagugcagucugcaggcugcacguuguggccuuguaauaagaugauacaucccuggccaggcgcgguggcucacaccuguaaucccagcacuuugggaggccgaggugggcagaucauuugaggucagaaguuggagaccagccuggccaacauggugaaaccccaucucuacuaaaaauacaaaaaaaugagcugggcaugguggcgcaugccuguagucccagguacuugggaagcugaggcaggagaauugcuugaacccaggagguggagguugcagugagacgagauugugccacugcacuccagccuggugacagagugagacccugucucaaaaaaaaaagauacaucccuaagcauggcaucucacuaugguuguauggucugcauacucaugaagaugaaguccucugacaugaaauccagugcucacccuaacaccccaugcaguccacccuucccuggggucaggacagauguuuuaguccuggcuuuucuuggcaguuuuacaggugaacuuugcuuugucccuuacccuguccaauccucagucuccuuaugagcuaaaugguaagaguagcucuugcucuuccagccuuuugcugcuggagaagcugugauggggucuacauaccaucccuucaucuuuugaaaggcugguucuaccaauugaggaagacgcaggaagaggccuggggcaucugccuccagggccagccaacaacuaaucucccuggagcaaugucuugcuggaccaaacauuuuacucauaaggaccucaaggcauaccuuguucugugcagcugguugugggguugaaagauucucacuugauccccaucuaaucccaguugggagaaauauggcuaugaguuuggugagaaauuggucaggccuuugaaaugagggcaggguuggaagugaaagaggcaaagcucccgccucagcaccugacccuguccuuaccacuuuucuucaucauugcuaacauguggcuuggggacaggacacucuuggcaucaugccucacaugcuguaugcaggcaagggacuagguaccuuggucaacaaugacagagaaggcagccaccauuuauuaagucaccuacugcacgaaugacucugaguagcacugaucuuuguaacagccuugagagaugagugauccauccauccugcgaauggggaaagucagguguagagaccgacuugcucucacagauguuaaguaucaggccaggaauagaaccuagcucugucuguccaagguguugaccuuaggacgugacacacaccuucugguucagggugcugggagaaggaaaaguucugggcuaguccgggccaagcagaagguugauuucaauguguacuguggggguuggaggccaucguucuaccucuggaacugacguggacucaguucuaggcugggcccugguccuacuguugcccgccucucugcugagcacaucaccuucugcaggcucuuugcuucaucugaagauacaaggauaaaccgcacccauccuacuucuuaaggguguuugggaggcucuaaugaaacaguagaugugaaaccacuugggaauguaaaagcugugggcugagcuguggucagaggccgccaugccaucaugggacaggauggggucccuuagggguagggagaggccuaccucaugagagaguuagaggcuugcuuguauuuaacucuugccucuguccuccucgguuucugcauaaucucuucaaagcugcucuagaggccauaagcugggaugcuugagacacauuuuggggcuuugaagccagauagaccuggguucaaauccuagcucugucauucacuagcuuggugaccguggacacgucauuucacguuucugaaccuugauuuccucauuuuauaaaaggaggauggcaguggauuagaauccuuuuggucacaagugauagaaacacuauucaaaccaguguaucaguuaucuugcugcauaacaaucuaacccccagacuuacuggcuucaaauaauaaauauuuauuauuucaguuucugugggucaagaauuugagaucagcuuagcuggcugcuucugacucaggcucuuucaugagguugcggucaagauuucugccagggcugcaaucaucugaagguuugacugggucuggaagauccucuucacaucgcuguugacaggaggucucaauuccucaugcaugggccucuccagagggcugcuuaugcauccucaggagauggcaucuggcuucccccagaguaagucauccagaggagagcaaggaggaagccacagggucucuaugaacuuguguccaaagucacacaccaucacuucugcuuucuucuauucauuagaaaggaaucacucggugggguggggggaggcgguggggauuaggcucuaauucuuaaaggaguaucaaagaauuuauagauacauuuuaaucaaaaaaagcaaccaguuuaauccaaaaaagaacuuuauucucgaaucugccaggcacgguggcucacgccuguaaucccagcacuuugggaggcugaggcaggcagaucaccugaggucaggaguucgacaccugaggucaggaguucaagaacagccuuaccaacauggugaaaccccaucucuacuaaaaacagaaaguuagcuggacgugguggugcacgccuguaaucccagcuccucgggaggcugaggcaggagaaucacuugaaccugggauguagaaguugcagugagccgagaucgugccacugcacuccagcgugggcguccgaaugagacucugucacaaaaaaaagaacuuuauucucggauccaaacacuggaaaccuaggauuccgugucaucauggcucuguccuucugucucucggaucuaucuucauuucacuuguaaaauagacuuggaacuggugagcugagauugauagauacccuucccuguuuaggaaucccagugggguuggagcaccuugucucugccugucauggaaaauauguccugugcauagaucaauuccagagaagcauuuugguuagcugcuugaguugaagaaugaggaaggagaugugauugaugguccugucaagccacauguaggggaggguguggcaugguucccuuuugaggggggcugggcagccaaaacaacacauuaacugaggcugggugugaggauagaaagaguuaacaugaguaccacacauggcagaaacccuaacagaacacuucugccucuauuggcagccagacgcguguaggggucccagaaaauggcacugauucccggucuuccuuuguuucuccccagcuggaugaggcaguggcugaagcccaccugggcaagcugaaugugaaguugaccaagcuaacugagaagcaagcccaguaccugggcauguccugugauggccccuucaagccggaucacuaccgcuacugagagccaggucugcguuucacccuccagcugcuguccuugcccaggccccaccucuccucccuaagagcuaauggcaccaacuuugugauugguuugucagugucccccaucgacucucuggggcugaucacuuaguuuuuggccucugcugcagccgucauacuguuccaaauguggcagcgggaacagaguacccucuucaagccccggucaugauggaggucccagccacagggaaccaugagcucaguggucuuggaacagcucacuaagucaguccuuccuuagccuggaagucaguaguggagucacaaagcccauguguuuugccaucuaggccuucaccuggucuguggacuuauaccugugugcuugguuuacagguccagugguucuucagcccaugacagaugagaaggggcuauauugaagggcaaagaggaacuguuguuugaauuuuccugagagccuggcuuagugcugggccuucucuuaaaccucauuacaaugagguuaguacuuuuagucccuguuuuacagggguuagaauagacuguuaaggggcaacugagaaagaacagagaagugacagcuagggguugagaggggccagaaaaacaugaaugcaggcagauuucgugaaaucugccaccacuuuauaaccagaugguuccuuucacaacccugggucaaaaagagaauaauuuggccuauaauguuaaaagaaagcaggaagguggguaaauaaaaaucuuggugccuggaagaauuuugagccuuuauu

SEQ ID NO: 13475 - RNA, 10951 nt, Homo sapiens
acaugaguucacacgcuaacagugagauugugagacucagcuuucccacguguaaaucaggacucauaaucagucccuguccugccacuucuuuacagccccgguagcaacauagauuaaauaagguauguaaacguucaagcgcggagccgucucaggucaauguuuacucagcccagggcaauuccucuccaaguccuacucugcgaaauuucacgucagcuucacuaacuucucuacauucccagaugcuccccgggaaccggggguuggggaugucccucuuuucucaagcccgccgagcugaggaaaaacggggugggaaagcagaguguguaaggcugaggaggugagccagaggggggagggagagcaggaauaagggcaguggggagaaugcaggugcacggacguggugugggucgagaacaggguccgcaucgggggacuuggauauaggaugcagugaaaggauuuggggagcagugggagaggugagggcgcugcgauccgggaagaaucaggaaaauaaggagccgguaggagggaguggagauccuccucgcggagagcucgccgcggcgcagggcucccagcuccccgcagcugccuccccgaacacucacccucccgguuccgagaacguuucccggcccgagcgcccggcccgcaaaccgggaggggaggggaggggaggggcagggggggauccgcagcccgggauuggccgccgccccgccagccggugacgcgaggcgggcgggccccuuugugacgucacaaucagcuguuugaacguuccaauuugugccgugagccccgccgcagcggccgcacagacucaaagccccgcgggcgagcucagcagcccggagcgaccgcggccccgccgccucccccgcgagucccggcgaugcggcccggccugugagcggccggcgacccugggacgccccgccgcacaacuaccucaacgccgugccgccccccucccgcccccaggugagucccgacccgggugggccugggggcuccccugccacggacacgcccugcgccccccgcgcccgggccuuugucugucuccgccggcggccgccggggccgcguucccggcucccgauugguugccgcacgcccgguagaccaugacgucguucuauuugcauaugacauugagacgucaccaaggccgguaccgcccccacaggcucgggucgcuuguccucccgugacccgguagccgcugugucggggcugggcccugggugagacgcugcaauccaaagggggcugcagggggaucggcgauuuccuaggcuuauccaggggcuggggucaggccucugauccccuacuuucucuuugcaaccugagaaggagucagacggcgcugcugggccuagguugagggggucgucaggaguucagggcugcaugggacuccaggugguugggacagcaccagaugguggugggauccccucccuccggcuccagacuccgcccccagggacuaacagaauaacauccuccuaaucccugauuugugugcagcgccuuagcugaugucacuccuagacccaaaaugaagggucuuagaccccagugcauggaaggggcaacaggcccagagaggaggauuagcucucucgaggucacauaaccaauuagagucaugcucacugagugacagauggauuauuagccaggggcaaagacauaauaggggcucaguacaagugguaagauacacauccuccuuccacuggggacccgaucuugggcucagccuuaucacgguuugauaggcuccuagguguccuuacuccuggacccuuuuccagggaaucucuggagauugguucaccuuuugugguccugaccccuucuguccucacuguaccuugaaguccuagaguccaauaaaaucgcugccucccagcuguuuggaucacagagaggugagucauuggcugccucggggugucuccagggcugauguugggguggaggguggggugaggguucccucuauuggcccuuuaccuucccaacuuccuaggucgucagcuaggaagggccugaccuggccuagugcagacaauugcagguguuuugcugcucccucgucaccucugcccacagagaguauaggagaagggauaggauaaggagaguuucugacuuaacaaguggaugggccuagaggcugaaccaggaacuccauuccugcugggaguuugcucaaggaugggcuggggguagggguggcuuagggcacaaaugcuauucugggcagagcugcuguaguuauuaaagggaaugguucucccuggagcagaacugggaaugugagaaccaggaagcuggcagggcugggaaaggaaaucugggaggcuccccaaguggucaggagagggggcaggcacuggcuggcuggugacugcuuucacuccuggcugucacugacuugcugugugaccucaggcagggagcuuuuccccugagccucccuccccuaaaccuaucugaaauuuggggaggcacagugcaggcucugguacacagugggucuucaguaaaugcaugcuaaaucuuggugccaguaaccccagacccuuuuguagcuaggcgaggggugguguggcuaggucaaggucuuuuucaccucccuguaccccugcaucauuguauucuuggggauuguuugcugagucuuuccugacuguguacacucuggacuggaugcacaguaacgugggacuaggucugcccugccacuaucuagccauguauuuuuggauagauuuaugucuucuuucugaucaucagauuuuaaaaugggcugggugaauaugauggucccugaaacagcucuuaacuucucuuucauauuccaugaauuaguagguucuuggaaggaggaugugccucaucaaggccucgauauucccuuccuucaagaggggccaaacuuucugggcuuuugguaauggagucacuagcucccuguggcuacauauggguugggauacaugaauugugcuggguggacacuaguuggggguggccccaccuucuuaaucccuguagaucucccacccccaucccaccagagaagccagcaucuuaagccuacugugagucugcagauguggaaauauucucaggguauggaagugaggugauucugcagcaagugugaaaacauuucuagggaaugggggagguagcaauaagcauggcaauacugcagguggauuagcagaaagaggagaaaugccuucagggaagucuggacaugcccccaggaaguucuacaggaaguguggaaacacccuuagagaauggugacaagugucucagcagcaaaaccguugagcaucuuuagggaacagguguggagagucagucaggcuucagguacugggggaguauggccagcagcccccagccaagcucuaguccugagguaggcuggcauggggaggggguagaucuagagcuaccaccuugguguuuccauuucugcaguagggggccucccucuucaucuucacccagggaaggauugguuaagggcuuaccucggucuggguccaacccucagugcucauccuuaagggcuccugggaacugacagcucccucccuucaucaucaccucccacugaccugcugucucacugagcccaagcaaccugaucuuccuccuaccccuggaugcugcccuugaacaggagccugggaaaagggggucagaggggggagggccugccggcaugccaucuuuacacuucauaugacagacacaaccgaggugugccaaaucacaugguaagaugguagcaguucuaugggauuucugcuggccagugcuuuucaaaccacacaggcuccaggagugguucuuaaucucuggggucaaagauugcuguuuaggaaaucaugaugaaaaccaagguccuuuuucccagaaaaauacacauggaccaugaccccuggccaccaaauugaaaauaucaaauucagacagacacccagaaaaggcaauagaauauagugauucugggugcugccucuggaaucugauuguguggauucaaucccaccuuugucuccuacuagcucugagacuuugggacaguuaacuucucugagccucaauuucuuaacuguaaaguaaggacaguaauuauccacuuccuguaguuguugugaggauuacaugagguaauauagguaaagcugcuuagcauagugccuggaacauaaauguuagcuauaucauuauuauuauuuugagaccaaguuucgcucugucacccaggcuggagugcaguggcaccucgcagguuccagugauucuccugccucagccugggauuacaggcaccugccaccacgcccagcuaauuuuuguauuauuaguagagaugggguucaccacguuggccaggcuggucuugaacuccuggccucaagugauucacccacuucugccucccaaagugcugggauuacaggcgugagccacugugcccggccuagcuauauuauaaugauaacaagcagacaauaugggcaauuuccucccugccuggagaacuccuauuuacuccucagagugcagcuuggauguccaauucucuggagaccuucccuggcagagcugugucaugugucacucuauguuccuaaagcacccuguaauaauaacuaauuuauuaguuuguugagugcuuaccauaugcccagacaguucuaagcacuuuauaaguguuuagcucauuuaauucuuccuccuccaucuuuuuuucucauucaauaacuuugguauagcucauuuaauucuuauuagagccuggaggaggauacuauuauuagcuuauuuaauucuuauaagagcccggaggaagguacuauuaucauugucuuuugacagaugagaaaacuaaggcacagauaaguuaaauaacuuucuaaaaucauacagaagauaaaaaaaaaacccuggauuugaaugcagaaagcacaucuucccaaagcguccgcacacauccccguuguguguacccuucucccugcucugggggugauaucuucuggccucuuccccaggccaggaguggggugaaccucaaucagugguggcucucacguccuucugauucccagguuuuugcacugccauagggcgcccccgugaggcgcuucgccccccaccauguuccagcgccucuccagccucuucuucagcacccccucgccccccgaagaccccgacugcccccgcgccuucgugucggaggaggaugaaguggacggcuggcucaucauugaccugccgggugaggccugggucugucuccugggccugugaagucauucuaagggcagauggccuagcagcggaggggaagggcgcugcugggggacgggggagucccccaagccuacuggagguggggucacggggccccuucccaugaaagccggggcucucuccuggcggcccaggagaggcccgcacgucagguccccuagggcagcagggcgagacgccuggcccgugggugccccggggcgcugcggacgggcugcgggucugacuaacgaugcccuuucucuccccgcccccuuguccggugugugugugugugugugugugugccuccucgcugcuccccuccucugcacggcucccaucccgcgccccguagacagcuacgcggcuccacccagccccggggccgccccugcccccgcgggccgcccuccgcccgcgcccuccuugauggacgagagcugguuuguuaccccucccgccuguuuuacggcagaggggccuggacucggucccgcccgccuccagagcaguccccuggaggaccuccucaucgagcaccccagcauguccguuuacgucaccggcagcaccauagugcuagagcccggguccccuuccccgcucccggacgcggcccugccugacggcgaccucagcgaagggugagcgggccgggggcggagccuggaggcccagggagacggaucuuggaggccaggguccaggcuaggaggcugggguaguggggccaggagcccgccccgcgcucgaggggguagcggccuugggaggguugccuuugagacaaaguggggggccggugggccuccgggcgaggcuagaagcgggccugaggacggaggggcggggcuugagagggaggggcguggccaagaggcuggggccgggguuggaggcuugaggagcguggcuggagcgccuagggagugggacuuaaacagaaaggcaaggguggaauaggggguggggguccagucucccccgagguccaguuuaccuguuaagggcuagaaccgaggaggcaccuccggguugguacccacaagaagggcgucgggcaccccaaucugaacagacacagaacugagccgaagcaagggugggagauggcagcgcccucuagaccccccgcccagcuuacccggcuugaccgagccuggcucuguccucacagggaauugacgcccgcccgccgcgagccgcgggccgcgcgccacgccgcuccucucccagcgcgggcggcgcugcuggagaaggcgggccaggugcggcggcugcagcgggcccggcagcgggcagagcgccacgcgcugagcgccaaggcggugcagcggcagaaccgagcccgcgagagccguccgcgccgguccaagaaccagagcagcuucaucuaccagccgugccagcgccaguucaacuacugagcguccaccggccgcgccacgaaccccuugccgaucccgaucccugucgggcuccuccgacuccucgggcuggacaccgaaaccucccuucuuaaagcgugugagguugggugauagccguuccuuccccgacacccucaauuuccccaucucugauccucuaaucugccucugaacccauucacccuucacccucacuccugguccccauacccagcaucuaaucauccaugcccccuacuccuggccccuccauccuuucuucucugguccccaucccugucucucccuuucacccuugcccuccaguccucuaccucuggccugccccuauuucugaaagcuucuuccagucccugaucuggcucauuccccaccuucaacucccaccuuacaugucucacacuaucccaugguuggcauuacacucacuccuguucccuuauucuucauucccaguaauucccuaccaaaugguggggacccugagcccagcucugaccagguagagccugugcagccugggcugcugucauugcccuccaguaagggcucaggguuuugcuuuuagucuccccuuccuucugccuugggggcgguacucuguggagcugcuuaggccuggaaagguacaguauguagaagaggacugugagacgugaguuagagggagaagauggagggaaucuagggaacgaggcagccuauuggagaugcggacaggacagacacguugagaagcugcagggagcagggcaccaagggagugugcacugugcuugcucagagaggccaaacccugcucccaggcugaagccuggagucugcccccacuucccuuuucuauaauccacccuucugcaggcccugaaaucugaagggcuuaguuaguaccuugccacucuacccccaacacgucacccgaguagaagcugggcaaggcccuaccauccuggccgucuguucacaagcccaaggugcuagaacuagcuuaggagacaugcaggccacagggcuucuaggcagggaaagggcacacacccuaggucagcgugcagagcagugaugcuggaggacacaccauggggugaagccaucccaaggcugacagcucagucuucaccuugccucuggccuuguauuucacacccugcucaguauggcuagccagcaguccugaguaggaguccaggacucccacugucucaaucugcaaauuguuccuauccagguucagggccuucagggggccucuuuucauuuucucccacaggccucucuuucuuucuagguugcuggggagaaauggguacccuaugaucccccuccccuucuccuccaguaaauaccuggaagagggaaccugaaucccugggggagacagaaggggcaggggccaccagccuccccuucuuguggugagacugaauuuugggcucagacaccagcaacagccucuugggaugcccugaguugcuucccauuuccucuuucuagccguccuuuucuagugugugcucacucuuccuaggaacuuuuaagacuucuugguaccuaugaacauagguccuccccucaccccaacucuagguuuccaggccucacagccaagcugaagcuuggagaaaacucugcauucccaugagggcaaaggcagcugcccucccugacccuauagccccaggccucaugggggguauguggggaagggaugggguauccccauggaugcugggaugaggacagaggaagaccugauggggucuccuauuccagggaauaagccaaauuaacacuaaaaacggaucaaagcucccacgccaguccacuagggccccaguaguugacagccuugcuccucucccaaguucuccuucagaaccuaguugcuuuuauucuuccagcuaccacuugggcacuucacagccagccuagggucuucggcaccuccaagagcugaaucucccuccaacccuucuugccuacuccucacugccagcugggaccuaggcucaguccuguguggugcccaugauccuucuggugggggaagaguuuaaguuauagggcauuuggcucaaauuuuaaaaggccuuuuguuuaccuauauuucuggaggcuccuguauucuagaacccaaucucucaccugcuugguugcaaggcucauauuuuuuuguaccuuuccuauagauucuguagcauuugaguguggcaauauuuuaauuguguauagauuucuaagaaccaacacuacucagucuccugcuagucugacuccugaagcaucagcccuugucauacuguauugacuguguacgugccuuucaccuugagcaugcuucaggauuuuuuuuuaaaccacagaacuugaauacaugagggaaccagaguucaaaguccuaugcaaccuuaggaggggguuagagagucuguuuugauugauguuuucugaggcccuagaggaguuuguaucaauuugugaguauuaaugucaguacuaccagcacuuugccaaaacugucagagggacccguuucuagagugagucccaguuacaucaaacagugacuuccaguuauuccccaguaagucugagugguuccuucaagcugggugucuuuccagccuuugccagucuagccccagcagggcaccguguaugaaugcaguuuggugcuguuuuagaguaugccugcuccccagcccccugccuggaacccucugagcaacuugcucugaccuauaaugucuuaggugcaacacggaccccaccagagcucuuggauaccccccuagauccauguggcuuuaugugaggggacugaaugcagacacaccauagcccccuucuacuacuuucccucucgcccugccaccuaguuccacauggaaccaacaaguugagugcaucccuguuggguguuuuguguugagacuggcugaaaugaggagacuuugaccaugugacgugucaacagacucaaggagacaaccaccucaacugggucauguggcaugccuguguauguguguaacagaauucugauuguuagacuguaaugcuauuccucuaugggagaaaaaaauuaauauaaagaaaaacaaauaaaaauauauuuaaagcacaugauccuuucugccugaguugagcuuaaguaugagaagcaucuuguaaucuuaagcacaguaguggcauaggauauuaugauaaagcuggccuugguucuggugugugugucauaugggagaggaagaggggagauaagcuuacugggaacagagccagacaauggggucugacucauaaaugacuacuguuagaggauccuuacaaugcaagacacauacaugaagacagcugaaauagagaugagaauaacagcaugacagaaugaccaaacucauccuuguggucucaggcacuggguuagagcaagggcaaguagccacuggaggggaaaggaugaagucuaauccugggggagaugcagcagaaggcugaagcccaggcugagacaaggccagggccccaagcaucagagucuccucaaguugcagguaggguggggcagaagcagcuggcuuuggagacuacacacauuuugaagaaggacagccagagugaaauguaguggacaucucugaaauauacagcacaaaaugaccccuuuaauuugggagcugcucugucuaaccacagaacuaaagguggaaaccugaccuaaacuggacuagauuuuuuuuuuuuugagacggaguuucacucauugcccaggcuggagugcaauagcgcaaucucggcucaccgcaaccuccgccuacuggguucuagcgauucuccugccucagccuccccaguagcugggauuacacgugccaccaugcccagcuaauuuuguauuuuuaguagagacaggguuucuccauguuggucaggcuggucucggacucccaaccucaggugauccacccgccuaggcccuccaaagugcugggauuacagguguaagccaccaugcccggcccuggacuagauucuugaugcuggcacaaucuuacaggccaguuugggcuuaccuccugcaaggaggagaugucagcacaauuguuuuggagcaauccaccaugcaaauggaggagcagauaugugac

SEQ ID NO: 13476 - RNA, 670 nt, Homo sapiens
gcucagacaccagcaacagccucuugggaugcccugaguugcuucccauuuccucuuucuagccguccuuuucuagugugugcucacucuuccuaggaacuuuuaagacuucuugguaccuaugaacauagguccuccccucaccccaacucuagguuuccaggccucacagccaagcugaagcuuggagaaaacucugcauucccaugagggcaaaggcagcugcccucccugacccuauagccccaggccucaugggggguauguggggaagggaugggguauccccauggaugcugggaugaggacagaggaagaccugauggggucuccuauuccagggaauaagccaaauuaacacuaaaaacggaucaaagcucccacgccaguccacuagggccccaguaguugacagccuugcuccucucccaaguucuccuucagaaccuaguugcuuuuauucuuccagcuaccacuugggcacuucacagccagccuagggucuucggcaccuccaagagcugaaucucccuccaacccuucuugccuacuccucacugccagcugggaccuaggcucaguccuguguggugcccaugauccuucuggugggggaagaguuuaaguuauagggcauuuggcucaaauuuuaaaaggccuuuuguuuacc

SEQ ID NO: 13477 - RNA, 781 nt, Homo sapiens
auccgcuuucaaagauccuaacacacacuaaaguuugagaaugcgguugaaagaggagucagaagugucggggugcgggaagggaucugaggucagaggagggaucuguuguccaaagaggcgucugcagucaaagaggccuggagaugaagcaugggcugggguuuucaaaaggguuugggggugaagacagagucugaagucgaaaaagaggucuaaggucggaggaggagucuaaaaucggaggaggaggaucucggaauucaaggaggggucugggguccgaggaguuuggggucagagacaggaucuggggucgagagggauuugcggucagugaaagggucuggggcccgaaaaggaagccugggauuugaggaggacacuagcuguauucaggcuggaaggaggaagggguuuggucccugagcugcguaaagugcagagccacugaagucucgcuugccccgcgcucuccccucgacccugcgcugccuuccuggcuguccaucuacacgcaccugugugccagcugcaggcugauagcgcugagcagacgggggcgagucagaccgggacacggccgagggcugggagaggcgcccccucccggcugucgcgaagaucaggccccgcccuccgcccucccacucccccgccgcagccacuuccggcaggcgcugcgcugcuggggggcgcgggcgaggauggcggcggagaacgaggccagccaggagagcgcccugggcgccuacucgccaguggacuacaugagcaucac

SEQ ID NO: 13478 - RNA, 25789 nt, Homo sapiens
gcaauaaaagggguagcagagcuuccugcccucaccguggugccgagguaggugaucagggcugggguuggagccgaagggagggcaggagggugggcgggugggugagggugcccauggguggccgcgagucuucugaaucuggaguggaggaagcccugguguuugagggugugcauguaugcugggcacucacccaaggaggcugcauugggagccagagggagucgccuaguaucuggucuuguggguugggggaucgugcccuaguucagcucccuugucacugccaucuuccagugccugcugccuugggccgccuugaaccuccaggguuuccagcuccuccuccuucaccccagugccacugccaugauggaugugagugaacuuggggagucugcccgcuaccuccgccagggcuaccaggagaugacgaaggugcacacuaucccaugggacgguaaguggagacagagggggaggggucauagccacagagaugcccuuauggacucagaccaggaauugggagggguggcaccagcucagggcugaaggggcauuggggccugacagcuggagcccuggaccuuuccugcagagucuggggccuggaaauuaaaaccccagggacacuguauaucacugugugucugugagcaagccuugguuuguuccccugugaaaugggauaauagcaccugccuuccggagcugcaguuuaugaagacucaggcuggagcccgaggccucugagaugagacugaucggcaugugugcaggcugccuccgcguguccacaaaacuugugcugggguuauuuuuagugguuucugcagagccaaagccacccuuuauuagggacaggaauaaaggcuguacuauuuaugaccugguuugcucauaggacaauacuaacaauaggcaguguguaccgaaugcuuauugugugucaggcccagagcagaugacuuuccaugcaucaucucaacaaccuggggagguggggccagcaccagaccuagcuucacagggcgccaggcuaagagggaccuuguguuugauucgacacucugcuguugccgucuugaaaguuuuaauuguuuucaacaaggggacccacaucgucauuuuguacuggggucuguagguuauguagaugguccuagaugguucuagaugguccugacccaggcacuuggcagagcaggggacacaaacuccgguuugcagccugaguccaugcuucuaaccaccaugaaaucugggcuccucaaagcucuggggacagcuggccaggcaggagagcacagguuacaguuaggaggccuggguuugagucuucagugaaauagggaaggcaggaccccucccuaagagucauaugccugauauugaggggcugcucuguaugggaccuaaggagaucuccauaacauuuugcaugugagggaacuggcccagagagaaucagggauuuuccugaggucagagggcaaauauggcggaagcaggaauuggaacccaaccauuaacccagacucauccuccaauaaggggaucucuagggacccucccagcuccgcccuuccugagccuggguuuggaggguucuucacuggaacuccuggguccuggcagaggggcuuuggggagggucacagcuguauggauaccauggcuugggaacuccagcuagaaccuggaggugccucagccccucucugaguccagagcucucucugcaacccagggaagaagcgagucugggugccugaugaacaggacgccuacguggaggccgaggucaagucggaggcuaccgggggcagagucaccguggagaccaaagaccagaagguuccguucccccuuuccugagauuagccucucugucccuaggccuccuggccaacaggaucugcccucugguugaagggggucuggguaugugggugggggugacaggugaggucggucgguuccucccggucccccggccccugacacgaucucccugguaggugcugauggugcgugaagccgagcugcagcccaugaacccgccucgcuucgacuuacuggaggacauggccaugaugacgcaccugaacgaggccucugugcugcacaaccugcgccagcgcuaugcccgcuggaugaucuaugugagccccaggcccgggccaugggcgggguggggcuuguauguggggcggggcuagagaugaggugcugggggcgggcccauagcgguggggcggggcugugagcgguggaucggggcugugaaugauagagcggguccauagcggggguggggcugugagcgaugaggcggggcucugagcagugggggcggggcuggagguugggccuugggaccuuaggggagcagcuguagcagugcggggcgggucuagaacucaccugcggacuauggaggccgugcgugugggcuggggcagggcugugagcacaagucaggggugaggccaggacggccacagagggugugguguggcaagucaaguagcuccuugaggaauaucgcaggguucuucugaagacuggggccuggggccuggggaugggaacuugcguaucccucccaaaacccuaccuauggggggagaaugugguggcccaugccuguaaucccagcacuuugggagggcaaggcgggcggaucaccugacgucagaaguucgagaccagccuggccaacauggugaaaccccgucuguacuaaaaauacaaaaauuagccggucgugguggcacgcgcuuguaguccuagcuacccugggaggcugaggcaggacccaggaggcggagguugcggugagccgagaucaugccguuguacuccagccugggagacagagcaagacuccaucucaaaaacaacaacauaaacccuaccuauacucucucuucagaccuacucaggccucuucugugucaccaucaaccccuacaaauggcucccagucuauacggccuccguaguggcugcuuacaagggaaagcgccgcucagauuccccgccccauauauaugcgguggcggacaacgccuacaacgacaugcugcgcaguaagggccgccuggacuccuccccaaccgcagaccccgaccucggucccgggaggccucuguaagggacccccuucccccacuggcacugccccccuuuugacgcugcuggacauggucgcccagccguucugucccuccgcaugggagcugaccuccacuagggacagccccaccugcuccuucccauuccuggcucugggugguggggucugccccagauggauacccaggguguuccaccuguggcuggccccacaccuuggcugacuucucuauccccuucccuuuccuccagaccgagacaaccaguccaugcugaucacgugaguguggggcucugggggugggguggaaaaugcuggccaucuggcagaaagagggcgguaccacagucauuucccaggauugaauccaaagugcuuaggccaggacuuuuaccaccuggagcuagugucccagcugaagcuaaauuaggccugagcacuuucccugcccccauucugaacagauguguucuugaugggggauagggaggggacacccacaaacggagugaccaccagccccacaccuccucuccccggggccuggaaucucccaccuugauccucugggguucuaauucuggcucaggggcagcggaaagauuccucugcuuuuccuccuuuuuaccaucuacuuaugucugaaucuuaccucugaucuuuccauugccucugugggaaaaugguagaauaauucuuacaugccaggcucauguccagucaggccaauauggacaauguuuagugugagugugcaugcgcguaugcaguuaagagcaagugccuuggccgggcacaguggcucaugcccguaauuucugcacuuugggaggcugagguggguggaucacuugacgucaggaguucgagaccagccuggccaacauggugaaaccccaucucuacuaaaaauacaaaaaauuagcugggcgugguggcaggugccuguaaucccagcuacucaggaggcugaggcaggagaauugcuugaacccaggaggcggagguugccgugagccaagaucacgccacugcacuccagccugggccacagaaugagacuccaucucacgaaaaaaaaaaaaaaaaaaaaaaaagcaaguaccuuuaacccagacgggcccggcugagugugguggcucacaccuguaaucccagcacuuggggaggcugaggcaggaggauugccugaggccagggguuugagaccagccugagcaacauagcgagaccccaucuuuaccaaaaaaaaaaaauugaaaaguuaaauaaaaaauccuaccuaccacacaaaguuaugagucagugaguugauauaugugccuggcacacagcagggacagccacagaacuccugaggcccaguuccuuguuccuaaaaugggggugauaauggagccugccuuccaggguuuucugagcuguaacugagccaauggaguaaagugccgggcacugaguuaguccguaguggacaauggcaucaucguguguugucaucucacagggauggucuacacuggcuugcuuuguacaccucugaggguugauccauccuuggggguuucaagcuggggggaaggagagguggagggcucugcuugaggggugaggcauugggggugggggagaauuaggccagaugggcauuggugacucauguuugugucguccaagcggagagucgggggccgguaagacgguuaacaccaagcgggucauucaguacuuugccaucgucgcugcccugggagacgggccgggcaagaaggccguaagacuugcccacucgggcaugcuccccguugcuucucgcuguuuuucuuuucuuucuuccucucuuuuuuuuuuuucccccuuuuuaaaaauuuuacuccccagaacccugagcccugccugagccucccacccuggugggggacucuggccugagcaaggcuugaccacaaaggcuguggccaccugacgcgccugccuucgccuucccauugguaaacauggagggguggggccacguugccguuucuaaauuuguguaauuuuuaucuuccauugugaccuucauauauugaaagaguuuacuagaugggcugcuuuuacuaagcguuguugucuugguuucccugacaguuaccugcugcugacacauuagacacagagguuggcuggcaugcagggcacugggcauucccagcagccgggguuggcagggcaauuuugugccuugugauuucuguacaguuuuuggaaauuucugaaacaauggggccaaguuuuuuuguuuuuguuuuuaaggcauaacauuucaucccuagccuuggggccaguuguucagagcccuguggcuaccccuagaugggcugccuuuuuccagaagcccgaggccucccuccccacccagucccugcuccugguccuguuaagccuugcuuuauucuggguguuuuucuuguuuuuccccuguuuucuuucuuucuuucuuuucucuuucuuuuuucuuucuuuucuuuucuuuucuuuuuuuuuuuuuuuuuuugccuuuuccuuuuuacccauuugauugucuugauuuuugauuuucauuucaguuuuguuuuguuuuguuuuugcuguugacuuuuugguccuuuuuccuccuucccuuuccugcccugucuuccaaaucccuaaaaaggucucuggggacguaacagaaaguugggugggucaagugacaggaagagaugucagggagaggccagagcuggcagggacacagcuggaagggcagaggagcaccugggcagaaaggagcugggacaguggagcccaggggagagggucgggcaagggaggggugggagaggcugcccgcaggagccauggcugcaggaacuuaaaagauugaucagcuccccuuaccuuggccccaaauuuggccaaacgggcuagagagagcccugcacaaaagcacuggaugggaguguauugggggguuccaccuccccugcccaaugucccuguggguauuuuaacucuugggcucccuggaggugaaugaaugaccacaaaguccguggugguauaucuguucccuccagaauccauuccuucccuucucucccuuucuuccuuggcucccagcauccggaguagggaagagaaggaaaggaaaaggaagggaaagugaggaugaggcuaggauggggagaaggaggaucugcucaauucacuuagucccccugggugacacacaggaccgcuguggcguccaggcggcaggaugcugggcaccugcccugccgcuccugacuugcuguguggccuugagcagauccacucccugcccagagcuaagucuccucauuugcaaauuagggcuaauaaugggcaccuggcagggccuuugugcgcacugguagguauacaggcagacaaacaaugaagacacacccaguugcauuacaaaggagagguguguaaggucauagugggagguuagggcaggaagguucagaccaggaagaggucuauuccagcuuuggagcagccaggaggccuuccuagaggagggggcacuugggcugggcucuggagggcccuagauuuuagucgggaggccccuggggcuuggagcagggccacugcauggagacuagaaaaugaagggaggccagaggccgggcuggggcagaggaggcugcagguggagacucuggcuggggcugugccacucccacuuuccagcauuuugccuccuaacagcugcaggagggucaggccgaggggcugagggugggggccaugcauuccggugacuaacuccaccccccuguccugcugcccgcugccucccgcugauacccugccccaccccgcccuuccccaccggaggccuggcccucuaauguugucugucuucuucccccagcaauuucuggcaacaaagacgggggugaguauggggccaaugucaauggggcagcccuggggguacccccuuccucugcacaacagaggggccacggguggcucuggccucccgguggguaggcaccagaacugacagacccccucacccccaccgccccagggcacccuugaggaucaaaucaucgaggccaacccugccauggaggccuuuggcaacgccaagacccugaggaaugauaacuccucccgcuuugugaguggcugaggugggagggguggcggggaugccguaggccaccagcggcaggucgggcacagguggggacagugcuggcugugccccuuggcugagggcugccccucugcccacagggcaaguucauccgcauucacuuuggucccucugggaagcuggcauccgcggauauugacagcugugagucaacccccugcgggcggugcaggggaaggaggccugagcccggucaccccaacucggccucugucaucacgacuucugggcuccugccugcucugggcacuucucucuacccccuggcugcugcccagcucaggccaccucaccuaucaccagaacaucaccccagccucugccuggucuccagcuuccucuccucuacgcggccauaguuuugcuggucauauccuguuccugcuugaaagcuuucucuagauccugucaccugaggauggagacccaaauccucauuuggccagucaggcuccugugacugcaccccuagcguguccccagucuucucucuggccaccaagagggcaggccuggcccacggcccuccugccccagcugcacagcuacacguagagugccccauccuuccaggcaccccgcugggaagugccccaguaccaccagcugcauagaccccaggcgccuaggccacacucaagggggccagggacacagaggggcccccacguuggccacuccccacauugggcugcauggcuaggucuugacggaugagcgcaggcaggcagugacggggacagggauaggcuguaauucacacccugaccccuacacagacacacacagacacacacggaggcucggccacacacgcacacacgcugacacaccaacagauaaaaaccugcacacgcagacaccacacucaccccacacacacgcaaggacacacacugacccaucuggccagagacacagacacacagguacagacacacggcucgugugaugacgcaggcacaggggagauacccuccccacacaagcuggcaggugcagaugcagccccccugcacacucccugcccaccucucucccuccgcaucgcccccuugggauguccacucuggggaggugugggagauggcaggccagcgucccuucuccccagaucuccuggagaagucgcgggugaucuuccaguugccuggugagcgcagcuaccaugucuacuaccagauccucucagggaggaagccagagcugcagggugaggggcaguacgaugaagggggugggagucagaaccuggaggggcugccuggcgcuuccuggcccccaucaggccaggcccugguggucuuucccucccuguccuggggucuguggccucucuuccuucuugggacuuuugguuacuuuccugcuagggaacaguccucuuagcuccagcaaccugccaacguguuaucgcugccuccaggagccuaagcccuaaaccccacuugcuguccugagacuagagaggucccacccagcaccaaggcggacugaugacugucuaggcccagcucuccucucuggcaagcccguugagggcagagucuggucuucccugugcgccagcaucuagcaugggaucugggccagagggggccaugagcaacagucaaaagaugagugagacgugaggacuguggcucauuccucagagaaccagaaaaagaagccagggucaaagugaaggccaggucagggcccuucacucucagugcccucagccuuggcaggagugaggaugagaaacuuaggccccagacugggagaugagguccucugggagggcccuagacuccugcugggcuugcccccgcaggacccccuaugcugcaauuguuguggggagaauagccgguaagcacugccugacccucccuucucugcccuguguccccagacaugcugcuucugucuaugaaccccuaugacuaccacuucugcagccagggcgucaucaccguggacaacaugaaugauggggaggagcucaucgccaccgacguaugagcucuggugggaggggagcuguguggacgccugugguggaaucgggcagcacugccggugcccccagcugcaugaauggucccggggcagugccuggcuggacccuggaggagcccagaccucucugaacucgcuuucccugcugccccccagcaugccauggacauccuaggcuucagcguggaugagaaaugugccugcuauaagaucgugggcgcccuccugcacuuuggcaacaugaaguucaagcagaagcagcgggaggagcaggcggaggccgauggcacugagagugaggggcccuaaccuggccuucaacuugacccagaccucagcauccuguccaugaugguuaaccccaacucuuguccacaaccuuuaaccucagucuuaccuggcccugccuccucagcuccaaacccuuacccuccugaggcuuuguuugcuagcccugaacuugaccccucuuaacuucccucuccuagccccaggcugaggcaguagagccccugagugcgcauggugguguccuccucccuuaccccacucgugcccugccaggugcugacaaggcugccuaccugaugggggucagcaguggggaccuccucaaaggccuuuugcacccccgggugcguguagggaacgaguacgugaccaagggccagaguguggagcaggugagcugccugcaggccaaacccaugggggacagccgggcaggguccccuccuugccaggucccagcccagccucccugcaccuccaggugguguuugcugugggggcucuggccaaggccaccuaugaccggcuguucagguggcuggugucucggaucaaccagacccuggacacaaagcugccccggcaguucuucaucgggguucuggacaucgcuggguuugagaucuuugaggugaggacaggcccucaccuuggccucuguucucuccaagguagaggacaugggccugugggggggcagaagcccuggccuucugccuggaaguugggggugaacucaugccccuccccgggccucccuuuccccaucugcgagaggucugcugagccaggccccucccucuuguaguucaacagcuucgaacagcugugcaucaacuucaccaaugagaaauugcagcaguucuucaaccagcacauguuugugcuggagcaggaggaguacaagcgggagggcaucgacugggucuucaucgacuucggccuugaccugcagccuugcaucgaccucaucgagaaggugggugccgcggcaaggucacuuugaggaagggaggguguguguggugagcaagcagggauggaugaccauggcuugcauggaagccugcaagugugcauggaagcgugugacugugcguugcaguaagcaugcaugugaguguaguugugacagcguuuaugugcuugugugugaaagggcacgugugugaguggguguguuggaguugaccaugagugagccuuggugagugugugagcagugugaaugcaugcaucccaguacuguggacaacagcuccuccugggugcucagaauucugcagcucacaaggcccuauuugcagccacaauuucacuggaucccuagaacugcccugggugcagggcaggguguguuuccuuguuuuugugauuguggaacauuauguauauuuacccauuguacaaagaauggaagaaagaaaauuugaaaaauuggcaggggaaaaaauguuucuccccauuccuaucacagccagucacaugacacuuagguucauuuccucgaaauccuuuaucccuuuuuuuuuuuuuuuuuuuuugagauggagucucacucugucgcccaggcuggaguacaauggcaccaucucagcucacugcaaccuucgccuccaggguucaagcaauucuuaugccucaaccucccaaguagcugggauuacaggcaugcgccaccacaccuagcuaauuuuuguauuuuuaauagagacauggcuucaccauuuuggccaggcuggucucgaacuccugaccucaagugaucuacccaccuuggccuccuaaagugcugggauuacaggcgugggccacugcgccuggccuauccauuuucuuuuauagacacagauuucauuucauauccuacuuuuucucugaaaauguauuuugaaugcugcucauggcaagaguaguucaugcaguggaugaguuucauacgaugcauuucugcaguccccuacagcugggcguuuaggugauugacagcuuuuuaaauauuaugucagcacugaagacauucaucuucccacucugcagguuagaagacugaggcuuagugaugucggagggccccacagcuagugagugaggaagccaaaaugugaacuugauggcuuuuuuugacuuaccccauguuugugugugacagccauggcuguggcgggggugagaguggguacagagaugccagcuuggguuugccauuguuagaagugaagaugacaccucagugcugcagauuuugcaggaggggacuggagccaagccacaaacuuuucucuguuaggagauggguucuuggaguggguguggugucugaccauccggggagauggcugaagcuggggaucugggaaggcucccagaagggagguggccuggggaaccagggguucaguccuuccaggauggacuggcuugaugguggcuuuucaagcucguucuguucccagccacugggcauccuguccauccuggaggaggaaugcauguuccccaaggccucagacgccagcuuccgggccaagcucuacgacaaccacgcggggaagucacccaauuuccagcagccucggccugacaagaagcgcaaguaccaggcccacuucgaggugguccacuacgcaggcgugguaggugcuugcuggaaccccagcccucggccaggcuccucccgcccugcuccaggucucccacccgggcucagcaccugacuugucucuccaggugccuuacagcauugugggcuggcuggagaaaaacaaggauccccugaaugagaccgugguccccaucuuccagaagucacagaauaggcuccuggcgacucucuaugagaauuaugcgggcuccugcuccagugaguauggagggacaagaucuccacucugacaggggcccacagagcgacauucccuggagugaccaggccccuugucucuauuagcugagccccccaagucuggggugaaagagaagcguaagaaggcagcaucguuccagacggugucccagcugcacaagguaaggccccaucugggagacagacccucccucuuggcagccuccagccccguccuucacccccugcccuguccccugugccuugggcgggcggcuguuaagacuugcagugauguuuaacuccucuccacgugaacaucacagcaagucugugcugcuucccgucccuacgcugccugggcaggguuuguggggaaggggugggagcccuggggcucugggagggacggggauuuggcagggaagugaagacuuuggugguggugaugggagacagcgaagggucucccaucaccagaaugagagugaaagagcaaaagugcagggcacuuagggcccugcucccgucucgguccugaccacugcggcauccaauucugguucucugcccccuuugugccuuucccucacucuuccccacugccaggagaaccucaacaagcugaugaccaaccugcgggccacacagccccacuucguccgcugcauuguccccaacgagaacaaaaccccagguagucacccagggcuggccuggcuggggccgggaggcaucaugggaaggugacagggcagaggccgggaggcugaguacaucuucccccucaccucgcagggucuccacugcugcuuuuucucuggggccugcgggugugccuguugaccucugaccuuuuccccucucacguccaggggucauggaugccuucuuggugcuacaccagcugcgcugcaaugggguccuggaggggauccggaucugccgccaaggguuccccaacagguugcucuacaccgacuuccggcagcggugggugaccccuucccccugccugcugcuccagguggaggccugaggggcugggcaggacacacauaucagagcccaacagacgguccccugucuggagggggaagcagggacugugaggggccuggccagguaucccagcaagacauggggguggcucagaccuggccggggacuuggggagaagugaauaggcuuggggcaaauaguggagguggagccuacaggccucgcugauaagcuggacauggaauucuggaugcagaaaagacgaaugauuucuaguuuugggagugagcaaccugggagcuaccagugguagauuuacugagcuacaaaaacaggguuuuuugauuuggaggagaggugaagggauacugguuugagcucuguuuugcguguaucagguuugaaaugccuccagcagacauccuagaaaagucaugggggagauugggauuaucaaucuggagcucagggcagcgggcagaaaggaugcagauuugggaguugaacgagaaucauguggacgaggcuucaugagacaccuggcacauagcaagcaccugggcagugcugccagcuccuccccguucccucaaugggcaacaagcauccaucguuccuucucccuccagaagucauggugucauccacacuauccuuuguaaacagagguucacacagauaccauacacgcacacacacgcauggugcugugaccuuguuuuuucuaacagucuggccuggagaucguuccuuauccccaggcguaugccugccaucgucauccguuuuucuuggcugugaaacaucucacagucugguggacugcaugcuuuguuuaaugagucccccucaugaggggccuucacagcguggcuguagcccaccugacccacacagcccugugcauguguccacuuagaagugggcaggcugggagcccuggcucuuuugcauuagaauuuccccccaaaugggcugggcgcgguggcuaacgccuguaaucccagcacuuugggaggccgaggcaggcggaucacgaggucaggagaucgagaccauccuggcuaacacggugaaaccccaucucuacuaaaaauauaaaaaaauuagccgggcgugguggcgggagccuguagucccagcuacucgggaggcugaggcaggagaauggccugaacccgggaggcagagcuugcagugagcagagaucgugccacugcacuccagccugggcgacagagcgagacuccgucucaaaaaaaaaaaaaaaaaagaauuuucccccaaauguuucuucagugauaggguacagcaugucaccuucuacuaauauuuuuugccuuuaaaaaaauuuuaaaaauagugcaugccuucuguaaaaagccucuuuaaaaacuuaaugaaugcauuuaaaauccccccaagguuguguuuuuuuuuuuuuuuuugagacggagucuugcucugucacccaggcuggagugcaguggcaggaucuuggcucacugcaaccucugccuucugagguucaagcgauucugcaauucuucugccucagccucccgaguagcugggauuacaggcgcccgccaccaugccccacuaauuuuuguguuuuuaguagagauaggguuucaccauguugcccacgcuggucuugaacuccugggcucaagcaauccacccgccuuggcuucccaaaguguugugauuaugggcgugagccaccgcacccagccaaccccccagggauuuuaaguggagugucccuagugucccaguguggugacgcaucccuggcccccuuguuuggcaugugcccugcuggaaccucugcaccagccucggagaggcccaggaacgaguccccugcuacccacacgagccuccucagucccugacuuccccauucucaguggccugugccccauacccagcccucuccugaccagcucugcccuccuuucccagguaccguauccugaaccccagugccaucccggaugacaccuucauggacagcaggaaggccacagagaaacugcugggcucgcuggacuuggaucacacccaguaccaguuuggccacaccaaggucggggcacugugggaucagggcuggccauggcuguggcggucacacugggcaggguucaugcggaugguuggggguuacccuggcugucuaccucuccgcccccagguguucuucaaggcugggcuucuaggcguccuggaagagcuccgugaccagcgccuggccaaggugcugacgcugcugcaggcgcggagccguggccgccucaugcgccuugaguaccagcgccugcugggaggcaggugggugugggaaggaggcuggggacaggguguguccccugccucucagcucccagacccacuggcucucccaacccuaacaugcugcccuguagucagaucagccccuguggcugguuggggcaagguucuguucugugucccccagccuccauuuccccaccucaaaaaacgggguacggcacuugccucuccauuucaggacaucagcguguggcccggagggguagcgauggcacccagugucuuccaagacucuugcgggccgggccccaggcaagauacuuucucugcauuauccugguuaaagcgcugacgguccugagaaacaggcgcugugauggccuccacucagcagaagggugcccgugucagagauccagagcuagcuggcacgucagcccaggccgcugacuccagagccccguggcuuaacagcccuggugucuuccgggaauugcagaggccaccaggacauggggggcucaugagccccuucacuggaggcaggccugugggacugugggccuccccucacccucaccuauaaagcagagcuauuaggagcuacuccaugaggcugcugggaaggcaaaacaagugaacugugcugagugucaccauuugugacgggcagcacugagccaccuucacagcuuggcugccccucccuagggaugcgcuguucaccauccaguggaacauccgugccuucaaugccgucaagaacuggucauggaugaagcucuuuuucaagaugaagccgcugcugcgcucggcgcaggcugaggaggagcuggcggcccugcgggcagagcugcggggguugcgaggggcgcuggcugcggccgaggccaagcgccaggaacuggaggagacgcacgucagcaucacccaggagaagaaugaccuggcccugcagcugcaggcugugagucaggguuccccuugugaccgggcguccccagccccgaguaccccuggcugcucugagggauaguacagcgagacccauggggcucaggccuuaugucucucuguuccaaagaugccaugagaugaggccuccaugucccagccucaccaccccaaggccucgucuggcacguuuccuggcacucuccccucgugccaccuuggccucccgcuaaagcagaggaaccccagcuccccagcucuccccucccugcaaucccugaaaccaaacagacccaugcucucuucucugguuaagggccaugggaacccagguggcagguaacagggugauagccagagagcacagaucaaaggucuggaaucuccccagguccacagagcaagcuuuccugccuucggcacauggcuuuguguaucaauugugugccaggcucaggcuagugcaggaggaacguuggugggaagacagagauggcccuguggucacaaaacucaccugcuagugcaggagacugugacgcagcuggacaguaaggaaaugggggguaaggauaccugagcccuuccagggacugccuccaggagcccguccguggcugugcagaggcugcugcugcucacccugccccucggaaggccucagcccaacagcggggcagugagcagcgggcuucccucucagaacccuuguuugggccucacucugggccgccccgcacuucuaacuuuccccucuuaaugcucuggugugucccucugcgcuauugcccuuccaugcccaagagcgagucaagacauuccugaguucucagagcacagccaaacuuugcuacagaggcaguuuccucuccagggccuggccuggugucucucugcugguuuaccuggcccucccccaaccuggccccguuccgugugcccuccaggagcaggacaaccuggcagaugccgaggagcgcugccacuugcugaucaaguccaaggugcagcuggaggggaaggugaaggagcugagugagcggcuggaggaugaggaggaggugaacgcugaccuggccgcccgccggcgcaagcuggaggacgagugcacggagcucaagaaggacauugaugaccugaagcugacacuggccaaagcugagaaggagaagcaagccacugagaacaaggugugggccgggccagcuguggggaagggcccugagccaggggccagcuuuggggccagguggcugcaggucccaccccggcucugcuaagccucugcuuucuggcccugggcaugucacugccuuuccugggccucaguuucuuuaucugucaagugggguuagcagcacuuaccccauuaggguagguggugauguguguaauuggccuuuacugagcacacgcuccuaggccuugcacacgguagguguuuagcacaugcuggcaauccucauccaucccggagugcaagccccuugagggcaggaacuccauguccccagcucggcaucccgcaggugacuucugcccuugagcccucgugauggccccugugguucccagugcuggaggagggacuccauuacacaggagggaaagugaggcagggguaggcagcuuagguucucacaggugcucacugaggaagccgggacuaggaggcagcugcccugagcacaugcuaauacugcacauggcuggcaucuguggauuucucaccaggccagguguggugcugagcacugcgggugcauccacucgugaauccucauuacaaccccaugaggaggguccuucccucaggcagaagcgguggaggcucggagucaagugacuugccugagucccauagcuggaaggggcacuugcucugaccugguguggugugguggccgcucagagugcggggaagggcguccccauucuggcccuggcccuggcacaggugaagaaccugacggaagagauggcugcgcuggacgagucaguggcccggcugaccaaggagaagaaggcguugcaggaggcccaccaacaggcccugggugaccugcaggccgaggaggaccgugugagcgcgcugaccaaggccaagcuccggcuggagcaacagguggaggacgugagucagggccaccccgagacuggguggcggggccggggugccggcuggcuugggccauggcugaccccugcugugccugcucugcagcuggaaugcucccuggagcaggagaagaagcugcgcauggacacggagcgggccaagcgcaagcuggagggugaccugaagcugacgcaggagucgguggcugaugcugcucaagacaagcagcagcuggaggagaagcucaagaaguaggugugguggggcagcaggugggggccuucugagccugcaccuggcccuuguucccuucuggauucuugugguuccugcggcauugcagagguuaaggguggggguugacagauggggcacuggggugcagggguagugucuugcccucccuguacugagggcccuagccaggguccagggcugaggccucagggcccagugcagcaggugcauggggugaggucccucagggccugaaggggacuggggggcguuauggggucccaggcgggugggugggaguuaaggccugugcuggccacccacucuguggcucccaggaaggacuccgagcugagccagcugagccugcggguggaagacgagcagcucuugggggcccagaugcagaagaagaucaaggagcugcaggugcguggggaucgggugggugaggccuggggucagaggcccacagaggugacagcugccccacgugcccaccccaggcucgggcggaggagcuggaagaggagcuggaggcagagcgggcagcccgggcccgcguggagaagcagcgugcagaggcggcgcgggagcuggaggagcugagcgagcggcuggaggaggcaggcggcgcauccgcggggcagcgcgagggcugccgcaagcgggaggcggagcuggggaggcugcggcgggagcuggaggaggcggcgcugcggcacgaggccacaguggcggcacugcggcgcaagcaggcggagggcgcggcggagcugggggagcagguggacagccugcagcgggugcggcagaagcuggagaaggagaagagugagcugcgcauggagguggacgaccuggcugccaacguggagacucugacccgcgccaagguguccgugccuuccucaccccauacccacccugacuuuaaaccaaucccgaucccagcagccaauacuguucccacaccagccuccacccaguaccuuauccugagcccugaccucuucaccugguacacaacccucauuucucagccuccuaccaguccugaccuuaagccgugacucccaagcccuguucccugacuccaggucauuucugauccagcaucuacuuccagccucagacccuugaaccagcaguaguugugacccuagcccuugacuccugaacucugacuuaauaccuguccucucuuccuguccugaaccccagcacccuagccuuaaccccugaccuuucuaccacauaauccugacagcugaccucugaccauuguccccaggugacuccgcagcuaccaucccaacucucacccugacccacugcccugggacuggcccagcccugucaguucugacaccuguuaagcccagcaguagaaucucuuucccugacuuugaacuuggggcucugcucucccuuugauuccugggcccacaucuagcuuaccagucucugaucccagauccugccaucugaugcacaaacuuguucugacaucuaacuccugaccccugacucccaaccugggauccuaggccagugcagagaagcugugccggaccuaugaggaucagcuaagcgaggccaagaucaagguggaggagcugcagcggcagcuggcggacgcaagcacgcagcgugggcgacuacagacggaaagcggugaggcuggggcucagcuggccacaccaggcagggcuuuggugcagcccucaccagccugaccuguccgcucgccucuuugccugcaggggagcugagucgccugcuagaggagaaggagugucugaucagucagcugagccguggaaaggcccuggccgcccaaagccuggaagaguugcggcgccagcuagaggaggaaagcaaggugggcuggcaccggugaccauggagugggcaggugggcaccagagccacugggcugcacuaacgcugaggucacuggugucccugcaggccaagagugcccuggcccacgccgugcaggcucugcggcacgacugugaccuccugcgggagcaacacgaggaggaggcugaggcccaggcugagcugcagcggcugcuguccaaggccaaugccgagguggcccaguggaggagcaaguacgaagcagaugccauccagaggaccgaggagcuggaggaggccaagugagugcuuugcuggccaggccacugccaugcagagcuuuaugccugugccugagccccgcugagggugggugaagggagcugcuggggcuguucucccuccuuccaugguccacaccuugucugguuccauggccuagaaaaaagcuggcacugcggcugcaggaggcagaggagggcguggaggcugccaacgccaagugcucaucguuggagaaggccaagcugcggcuacagacagagucagaggauguaacccuggagcuggagcgggcgaccucagcagcugcugcgcuggacaagaagcagcggcacuuggaacgggcacuggaggaacggcggcggcaggaggaggagaugcagcgggagcuggaggcggcacagagggagucccguggccugggcaccgagcucuuccggcugcggcacggccacgaggaggcacuugaagcccuggagacgcucaagcgggagaacaagaaccugcaggguaggaccugccacacgccagggccagggugcugcccuggggucggagcaacuuugaguuaugggggugcccugguggggccacccuggaaucaggggugaguggagugaccugggugggaguacaagccauggggguggccucucagcacccuguccacugcagaggagaucagcgaccucacagaccaggugagucucagugggaagagcauccaggaacuggagaaaaccaagaaggcgcuggaaggcgagaagagugagauccaggcugcacuggaggaggcagaggucaggggcuggcugcagggguggguggacacugaccugcugcuccacuggccaucccccccccccacccuacccugccugcucuguauccacagggggcccuggagcuggaggagaccaagacgcugcggauccagcuggagcucucccaggucaaagcagaaguggaccggaagcuggcagagaaagacgaggagugcgcuaaccugagguguguccauccuucucccguccccaccucccgagagcagaaggggagggaagcaguguguacucugcucucuagucugucccucccaugggacuuugagguccggguugcugucuccauucuagcugugaaccucggagaugcuaaaggacuugcccaaagucacacaguggggguggagccagucaguccaccucugucugccugggccucacucuuguccaugaacuugcucugaugggccacaggcagucacaagagacuuuaaaucggggaggggugacucauuuguucucaaaauggguucguuuccaacgguccuugggcauuuguaaggacagguaugcccuuacgagacccccuuucaugccacccuccucccauaggcgcaaccaccagcgagcuguggagucccugcaggccucccuggaugcagagacacgggcccgcaaugaggcgcugcggcucaagaagaagauggagggugaccucaacgaccuggagcugcagcugggccaugccacccgucaggccacagaggcccaggcugccacgcggcugaugcaggcacagcucaaggaggagcaggcagggcgggacgaggagcagcggcuggcagcugagcuccacgagcaggcgcaggcucuggagcgccgggccucgcugcuggcugcggagcuggaggagcugcgggcugcccuggagcagggcgagcgcagccggcgacuggcagagcaggagcuuuuggaggccaccgagcgccucaaccuucugcauucgcagguggggacaggagucccuggggacagagcaggugcaggccugcuggcuggcuggcucugagacuccucuuccccucagaacacaggccuccuaaaccagaagaagaagcuggaggcggacuuggcccagcugagcggggagguggaggaggcugcacaggagaggcgggaggcugaggagaaggccaaaaaggccaucacugaugugaggcugggcaagggcuguggggagccugggacagaauugcagagggacuucccugaggcugggcaccugaccagcuccuccuccccaacaggcggccaugauggccgaggagcugaagaaggagcaggacacaagugcacaccuggaacggaugaagaagacgcuggagcagacggugcgcgagcuccaggcccgccuugaggaggcagaacaggccgcccuccguggcgggaagaagcaggugcagaagcuggaggccaaggugugugcagccccucuaguccuuggcgcaggcagggugggugacccaggggugggcuuggcaucaggcugucccccugccugcagguacgggagcuggaggcugagcuugaugcagagcagaagaagcacgccgaggcccuuaagggcgugcgcaagcaugagcgccgugucaaggagcucgcauaccaggugggcgacagggucucccuggggaguggcccuggagcuggcccagcccaagcaagcccugagucccccuugcccgcccaggccgaggaggacaggaagaaccuggcucgcaugcaggaccugguggacaagcugcagagcaaggucaagagcuacaagcgccaguuugaggaggcggugagugcgcuggggccuggacaccuggaccgggcaccccagcucugccccagggucuguggccaggugaggcaucagcagcagcuccacccuccaaggucagugacccagagggaagagagaagcuucuaacaucucuggggagaucagaccuagcuccuucucauggaacagaccccaugugcuuuccccuggccaaggcuggggcugccucugagggguggggcaggcacaaaaaggcacaugaaguuggugcgucccaacuuccuuauucccgcugugguauuggugaggauggacaguggcaauaggaacaaaguugagaaccaggaggagcuagcucccuucuuggacuggggcagggaccagaauaagcaucucagucacccaagcggaaccaaggcccugugugugcccccaggagcagcaggccaacaccaaccuggccaaguaucgcaaggcccagcacgagcuggaugaugcggaggagcgggcagacauggcggaaacccaggccaacaagcugcgggcacggacccgggacgcccugggccccaaggugaggaguggcaggggcauugcucucugugcagggggacugugggggcugacagguaguacugcucacucagcuaucccuuucuccucagcacaaggagugacggccugacccccugggcucuaaagaggaaugucugcuguugcacaucuggcugaggccaccugccccgauccugccaucucugcaucgcccccugcugccuucagccuucccugggcccugaauaaacaccacagccaguuuccuucucauucuuuucuuugggguucaggaggaaaaacacaguccuagggacaaaagccagguccacagcagucauuuuuaaaauaaaguuauuuaauagucuccauuuaauugguuuauuugcuguuaauaaauuggcaacacaaggaagggccccauguccaggcucaggcaggagcggcugccucaggcagaggcagggcaggcacagcugccccgugccccaagggauggagggaaaggccccucacuucugggagaacccccuuggaugaacacagcggccaaugagcaaacagaaccagaggagcuacaggaaaaugaggcagaggggcaggcuugggggaaggcagcauucucugguacccaccaccccugcccagggcucagaagccuuugccuggguccaaaggccagggacaagggaggcuuggcucacagauggggggugggggucacccauaucuuccuccccacucugggacugacugacagccaagaaaccggcaggagcucacacagagcuaaugcuaaauguccucuuaccucuggguggcccugggccccaggguucugaaggaaaggugggcaugguacccuguccucauuauggggacugaggcucuccaugaccuagggcccucagacccagggggaccaagggcuucuaggacuucccucccaccaagccuguacccaaagaccuggggcaggcagagagcagcagggaggaacgggaacagggcagggcguguggcaucguacccacgcucacccacacuggcccagcagccucccgaggccuggcccaaggucacuccucagugaagucccugucuauguccauguagggcuccucaauguagcuaacgagagcagagggugacugccgguccggguucaacaggauggacacugucuccuuccaguaugagaagcugaugcaggagcucugggcaaagagggaggggcuggggggcgccuggaggacccaggucaagcccagcaccgggacaccccucugagaggcccuggguccgcggcccacccaucacccccuugaggguggggcacucacguucucuaggcag

SEQ ID NO: 13479 - RNA, 5564 nt, Homo sapiens
cccuguuccugguuccuaggaagcagcccaaggagaagggaaaaggcaggucugggcaggagggagcaaugaagggcggggcagagggagggcaggagggaggccggcccccuaguaggaaaugagacacaguagaaauaacacuuuauaagccucuuccuccucccaucuccuggccuccuuccauccuccucugcccagacuccgccccucccagacgguccucacuucucuuuucccuagacugcagccagcggagcccgcagccggcccgagccaggaacccagguccggagccucaacuucaggauguugacaacauugcugccgauacugcugcugucuggcugggccuuuuguagccaagacgccucagauggugagucgggggcacaucuccugccucaggaugguucuggagaaucucagucuaucugggcacauggcaagaccacaggagagcuuaucucacagcaucugugucugcagcuggcuagaucucucuacagggcaggcagagucuuggggacugguucgugucccaaagccaaggugaguuaguacauuuaagccccugaaaagggggagaugaaagaggcuaggggaaacaggaugacuggaaacaugagaaagaaaccagcagagaggguaggagaaucagccccagggagaggggagaaaggggaacugagggugaugguagauagggguacaucuaggggagacgggaagaggcucagaagagaagagaaauggagggaaugggaagacccugggaaaacugauggaagaagugggggaagaguggggcagagagagguuaggggaggcuagggaaaauggaaggagacuggucgcagcugguggaacuggggagaaagagaugcugugccuaauagaacuuaugggcgaucaggcuacugaaguggcccuguuuaagcagaaaagggaguuauuacccuccauuauaauugcacaggggccuccuuuccccucucucacaauccccguaacuucagucucccccucagagaggcagcaaauaauaaccaguauucaaugagugcucacuaugguuaauacauguauugacccauuuaacuugcacaaaccccuaaagguggguaauauuauuacuaucuccauuuuaugaggaggaaacugggucacagaguaguuaaggaccaugucuaggguuauccauaaauauacuuauucacaucugcagauacaaagcacaacuucucaaaugcaaacacagacaggacccacucacacacacagauuuacaaccccggacucauccaaaugugcucugggcaucaacucugugccagccucuuuucuggguguaggaagcagagauuaccaagcaugguuccauagccuagaggaguccaguguggccuguguguguuuggagacagccagguaguaucccgugagauacacacuaauauaugguggucugggaucacugaaacagacacacugugucucguggggcaucagaaaaaaauuuccaagaagagggcaacugagcugggucuuuuuuucuuugcuuuucuuucuuuuuucuuuuuuuuuuuuuuuuuuuuuuuugagauggagucuugugcugucacccaggcuggaaugcaguggcacaauuucagcuaacuguaaccuccaacucccagguucaggcgauucuccugccucagccuccugaguagcugggacuacaggcauguaccaccacgccuggcuaauauuuguauuuuuaguacagaugggguuucgccauguuggccaggcuggucuugaaucccugaccucaagugauccgcccgccucggccucccaaaguacugggauuacaggcaugagccaccgcgcccagucucugagcugggucuuaaaucaugaauaaacuucgccaggcagaaaaagggaggcagagcaauccugacaugcuauucaugugucagccaaaggcagcaugaggaaucccaacuaguuugauauauaagcagcgggaagcggccagaaaaggcagcaggggccaggucucuagcagccuugaaugccaggcuaaagacucuggacuugauccuguggggaggcaguguagcagaauggcugagugcuggacuugacugccuacgugcaaaccuuggcucugcuacacuaucucugucucaguuucccauguagacugggguuaauaauaguagcuauugcauuaagccacuggggaaaggcacaaagauaauaauguauguaaagcccauugcccagguuauaauaagcacugaaucgacauuggcuaugauuauuuuugauuaaugaaggggaggggguuauggcacuggaagauuuuaaguaggaaaaggacaugaucucaucccugggucagguggaggucggaauagagaacggggagaugaaguagaaaguuacuaccccagucuagaugagacggaugaauccugaaucagggcaguggaagaggagauggagaacaggcgauggaauuggaauuuuauucaggucaggauuuguuaaccauuuguuccguugguuaacaggaaacggggggagggagagccgagggugaaaaaggaggcagaaaggagugucucuuccacugcaggccucaguuuccucaucuguaaaacggagauaauaaucccuguccuguccuccuggcagaguuacugucagcgucaaacgggagaagcggugggagggcacauuauaguuuaugaagggucgagaaggcgggcggccagccucgagguaggggguuauuaucuuccgcugcccgccgcccccucccacgccggcccaggcugaagcugacucugcccgcaggccuccaaagacuucauaugcuccagaucuccuacuuccgcgaccccuaucacgugugguaccagggcaacgcgucgcuggggggacaccuaacgcacgugcuggaaggcccagacaccaacaccacgaucauucagcugcagcccuugcaggagcccgagagcugggcgcgcacgcagaguggccugcaguccuaccugcuccaguuccacggccucgugcgccuggugcaccaggagcggaccuuggccugugaguaggcgcgcagcgggggcggggucugggcggggcuagugggggcggggccuggcgggugggggcggggccuggcggauggaggcgggcugggacuugcagggacccggcagccacuggagcucgguggcgccugggccuuugaagauugcugggugggggcuggagagaggcaguuguccccgcuaagaaagccccgacucgggcggucguccugcuggcauaaccucuugggauagacccuguuggaaggcccugacaccgugacgucgaagguccccagaaaacuccucaccccucgccucacaguccuccaacuccuuuucuucauagaucuccguccuucccuucccacagcccccagcacuucaccccccacccuccagccacuucucauacaagcugaugacuucgcucuuagcuccacucaugacccgaacucuucccccaaagaccccaaguucuucucucaaagccccacuccuuccccgucacaacccuaacuccuucuucucaaagaccccaauuucuuuucucaaagcaccaagcaccacuccgucccccuucccccaccaucauggccuuuaacuccuuucucuccuagucccccaccccaccccccuuuuuuuuuuuuuuuuuuuuuuuugagacggagucuugcucugucguccaggcuggagugcaguggcgcgaucucggcucacugcaacuuccgccucccggguucaagcgauucuccugccucagccucccaagcagcugggacuacaggcacccgccaccacgcccggcuaauuuuuuguauuuuuaguagagacgggguuucgccauguuggccaggcuggucucgaacuccugaccucaggcgauccacaagccuggccucccaaagugcugggauuacaggcgugagcugccgccccugccccagccucacccccuguuuuuuuuuucuauuacaguugaacaaggccugacaauucccuuuuuucaucacagucccuggccccuucuuucuuagccucuaacaggcuaaccccaaaccccuccucacagccccaggcccuucuccccauaguucccugaccuagacuccccucuccucacagcacugacucuugccuucucauguucuuuuccccuuggugggccucgccccacaccuggcacccucucugcacaguccccugacccugacugucuauccacaguuccucugaccauccgcugcuuccugggcugugagcugccucccgagggcucuagagcccaugucuucuucgaaguggcugugaaugggagcuccuuugugaguuuccggccggagagagccuuguggcaggcagacacccaggucaccuccggaguggucaccuucacccugcagcagcucaaugccuacaaccgcacucgguaugaacugcgggaauuccuggaggacaccugugugcaguaugugcagaaacauauuuccgcggaaaacacgaaagguaugaugggacggggcccaggccugcaagcuggggagagggcggguuccagacaaauggauggaccugaaggauggaugccuagagcaacaagaggcccacagcuggggguuugggacagaacacacgcagcuucagucaguugguaaacgggucccuuuccucuggggcagaaacgcuuugggguuugacucaaaucauggacuccuugggggccuauucuucgggcuaacucuuugcauguucugcagggagccaaacaagccgcuccuacacuucgcugguccugggcguccuggugggcaguuucaucauugcugguguggcuguaggcaucuuccugugcacagguggacggcgauguuaauuacucuccagcccccucagaaggggcuggauugauggaggcuggcaagggaaaguuucagcucacugugaagccagacuccccaacugaaacaccagaagguuuggagugacagcuccuuucuucucccacaucugcccacugaagauuugagggaggggagauggagaggagagguggacaaaguacuugguuugcuaagaaccuaagaacguguaugcuuugcugaauuagucugauaagugaauguuuaucuaucuuuguggaaaacagauaauggaguuggggcaggaagccuauggcccauccuccaaagacagacagaaucaccugaggcguucaaaagauauaaccaaauaaacaagucauccacaaucaaaauacaacauucaauacuuccaggugugucagacuugggaugggacgcugauauaauaggguagaaagaaguaacacgaagaagugguggaaauguaaaauccaagucauauggcagugaucaauuauuaaucaauuaauaauauuaauaaauuucuuauauuuaaggcauuguuaucuccuccacuuugcaaaauuucuggaaaaguaaccuauac

SEQ ID NO: 13480 - RNA, 5564 nt, Homo sapiens
guauagguuacuuuuccagaaauuuugcaaaguggaggagauaacaaugccuuaaauauaagaaauuuauuaauauuauuaauugauuaauaauugaucacugccauaugacuuggauuuuacauuuccaccacuucuucguguuacuucuuucuacccuauuauaucagcgucccaucccaagucugacacaccuggaaguauugaauguuguauuuugauuguggaugacuuguuuauuugguuauaucuuuugaacgccucaggugauucugucugucuuuggaggaugggccauaggcuuccugccccaacuccauuaucuguuuuccacaaagauagauaaacauucacuuaucagacuaauucagcaaagcauacacguucuuagguucuuagcaaaccaaguacuuuguccaccucuccucuccaucuccccucccucaaaucuucagugggcagaugugggagaagaaaggagcugucacuccaaaccuucugguguuucaguuggggagucuggcuucacagugagcugaaacuuucccuugccagccuccaucaauccagccccuucugagggggcuggagaguaauuaacaucgccguccaccugugcacaggaagaugccuacagccacaccagcaaugaugaaacugcccaccaggacgcccaggaccagcgaaguguaggagcggcuuguuuggcucccugcagaacaugcaaagaguuagcccgaagaauaggcccccaaggaguccaugauuugagucaaaccccaaagcguuucugccccagaggaaagggacccguuuaccaacugacugaagcugcguguguucugucccaaacccccagcugugggccucuuguugcucuaggcauccauccuucagguccauccauuugucuggaacccgcccucuccccagcuugcaggccugggccccgucccaucauaccuuucguguuuuccgcggaaauauguuucugcacauacugcacacagguguccuccaggaauucccgcaguucauaccgagugcgguuguaggcauugagcugcugcagggugaaggugaccacuccggaggugaccugggugucugccugccacaaggcucucuccggccggaaacucacaaaggagcucccauucacagccacuucgaagaagacaugggcucuagagcccucgggaggcagcucacagcccaggaagcagcggauggucagaggaacuguggauagacagucagggucaggggacugugcagagagggugccagguguggggcgaggcccaccaaggggaaaagaacaugagaaggcaagagucagugcugugaggagaggggagucuaggucagggaacuauggggagaagggccuggggcugugaggagggguuugggguuagccuguuagaggcuaagaaagaaggggccagggacugugaugaaaaaagggaauugucaggccuuguucaacuguaauagaaaaaaaaaacagggggugaggcuggggcaggggcggcagcucacgccuguaaucccagcacuuugggaggccaggcuuguggaucgccugaggucaggaguucgagaccagccuggccaacauggcgaaaccccgucucuacuaaaaauacaaaaaauuagccgggcgugguggcgggugccuguagucccagcugcuugggaggcugaggcaggagaaucgcuugaacccgggaggcggaaguugcagugagccgagaucgcgccacugcacuccagccuggacgacagagcaagacuccgucucaaaaaaaaaaaaaaaaaaaaaaaagggggguggggugggggacuaggagagaaaggaguuaaaggccaugauggugggggaagggggacggaguggugcuuggugcuuugagaaaagaaauuggggucuuugagaagaaggaguuaggguugugacggggaaggaguggggcuuugagagaagaacuuggggucuuugggggaagaguucgggucaugaguggagcuaagagcgaagucaucagcuuguaugagaaguggcuggaggguggggggugaagugcugggggcugugggaagggaaggacggagaucuaugaagaaaaggaguuggaggacugugaggcgaggggugaggaguuuucuggggaccuucgacgucacggugucagggccuuccaacagggucuaucccaagagguuaugccagcaggacgaccgcccgagucggggcuuucuuagcggggacaacugccucucuccagcccccacccagcaaucuucaaaggcccaggcgccaccgagcuccaguggcugccgggucccugcaagucccagcccgccuccauccgccaggccccgcccccacccgccaggccccgcccccacuagccccgcccagaccccgcccccgcugcgcgccuacucacaggccaagguccgcuccuggugcaccaggcgcacgaggccguggaacuggagcagguaggacugcaggccacucugcgugcgcgcccagcucucgggcuccugcaagggcugcagcugaaugaucgugguguuggugucugggccuuccagcacgugcguuagguguccccccagcgacgcguugcccugguaccacacgugauaggggucgcggaaguaggagaucuggagcauaugaagucuuuggaggccugcgggcagagucagcuucagccugggccggcgugggagggggcggcgggcagcggaagauaauaacccccuaccucgaggcuggccgcccgccuucucgacccuucauaaacuauaaugugcccucccaccgcuucucccguuugacgcugacaguaacucugccaggaggacaggacagggauuauuaucuccguuuuacagaugaggaaacugaggccugcaguggaagagacacuccuuucugccuccuuuuucacccucggcucucccuccccccguuuccuguuaaccaacggaacaaaugguuaacaaauccugaccugaauaaaauuccaauuccaucgccuguucuccaucuccucuuccacugcccugauucaggauucauccgucucaucuagacugggguaguaacuuucuacuucaucuccccguucucuauuccgaccuccaccugacccagggaugagaucauguccuuuuccuacuuaaaaucuuccagugccauaacccccuccccuucauuaaucaaaaauaaucauagccaaugucgauucagugcuuauuauaaccugggcaaugggcuuuacauacauuauuaucuuugugccuuuccccaguggcuuaaugcaauagcuacuauuauuaaccccagucuacaugggaaacugagacagagauaguguagcagagccaagguuugcacguaggcagucaaguccagcacucagccauucugcuacacugccuccccacaggaucaaguccagagucuuuagccuggcauucaaggcugcuagagaccuggccccugcugccuuuucuggccgcuucccgcugcuuauauaucaaacuaguugggauuccucaugcugccuuuggcugacacaugaauagcaugucaggauugcucugccucccuuuuucugccuggcgaaguuuauucaugauuuaagacccagcucagagacugggcgcgguggcucaugccuguaaucccaguacuuugggaggccgaggcgggcggaucacuugaggucagggauucaagaccagccuggccaacauggcgaaaccccaucuguacuaaaaauacaaauauuagccaggcguggugguacaugccuguagucccagcuacucaggaggcugaggcaggagaaucgccugaaccugggaguuggagguuacaguuagcugaaauugugccacugcauuccagccugggugacagcacaagacuccaucucaaaaaaaaaaaaaaaaaaaaaaaagaaaaaagaaagaaaagcaaagaaaaaaagacccagcucaguugcccucuucuuggaaauuuuuuucugaugccccacgagacacagugugucuguuucagugaucccagaccaccauauauuaguguguaucucacgggauacuaccuggcugucuccaaacacacacaggccacacuggacuccucuaggcuauggaaccaugcuugguaaucucugcuuccuacacccagaaaagaggcuggcacagaguugaugcccagagcacauuuggaugaguccgggguuguaaaucugugugugugaguggguccugucuguguuugcauuugagaaguugugcuuuguaucugcagaugugaauaaguauauuuauggauaacccuagacaugguccuuaacuacucugugacccaguuuccuccucauaaaauggagauaguaauaauauuacccaccuuuagggguuugugcaaguuaaaugggucaauacauguauuaaccauagugagcacucauugaauacugguuauuauuugcugccucucugagggggagacugaaguuacggggauugugagagaggggaaaggaggccccugugcaauuauaauggaggguaauaacucccuuuucugcuuaaacagggccacuucaguagccugaucgcccauaaguucuauuaggcacagcaucucuuucuccccaguuccaccagcugcgaccagucuccuuccauuuucccuagccuccccuaaccucucucugccccacucuucccccacuucuuccaucaguuuucccagggucuucccauucccuccauuucucuucucuucugagccucuucccgucuccccuagauguaccccuaucuaccaucacccucaguuccccuuucuccccucucccuggggcugauucuccuacccucucugcugguuucuuucucauguuuccagucauccuguuuccccuagccucuuucaucucccccuuuucaggggcuuaaauguacuaacucaccuuggcuuugggacacgaaccaguccccaagacucugccugcccuguagagagaucuagccagcugcagacacagaugcugugagauaagcucuccuguggucuugccaugugcccagauagacugagauucuccagaaccauccugaggcaggagaugugcccccgacucaccaucugaggcgucuuggcuacaaaaggcccagccagacagcagcaguaucggcagcaauguugucaacauccugaaguugaggcuccggaccuggguuccuggcucgggccggcugcgggcuccgcuggcugcagucuagggaaaagagaagugaggaccgucugggaggggcggagucugggcagaggaggauggaaggaggccaggagaugggaggaggaagaggcuuauaaaguguuauuucuacugugucucauuuccuacuagggggccggccucccuccugcccucccucugccccgcccuucauugcucccuccugcccagaccugccuuuucccuucuccuugggcugcuuccuaggaaccaggaacaggg

SEQ ID NO: 13481 - RNA, 1984 nt, Homo sapiens
ucuuugacuaagguggauggagguugcaggucuuuuccugggugggcguggggcggggcagcggguucccagcguccuccuggccugggcgucuuggaggcuguuggggugcauuccguccccuugcgcggggcggggccuugaggcgcuggggcgggauuggcgggggacggucgcggagccccgccccgaagcacagggucgagucccuucuuuccgcuccaacgcacggagggugaggucgguacgcggugguggcgucacggcgccagcuccucccgacgccgagguggguuccgggagacccgcgggucuggcugcgagaggugagggcagagccggggcggggcccuagcggggugucccggcgacccagaccuuaaagggcuucucuucuugcagaccaugggggcucagcuaagcggcggccgcggcgccccggagccugcgcaaacccagccccagccccagccccagccugcggcgccggagggcccggaacagccccggcauccgccccagccccagccccagccccagccccagccccagcccgagcccagcccgugggggccgcuggacgacgugcgcuuccucaucgccugcacuuccugguacugacggcguccuccgcaggaugucgcccgucuguccgccguccccugugguucuugccugccuugucuccucuccccacgucccugcgucucuuacacccccucccacccgaggcuccccagagauagcagagaauucgaagaggucgccggggacuggaaagaagucccggcagggccgccuucgcagucuacaccccagccugcuucccagccuacacccagacccagcucagaccuucgugaccaccccaucccuuucuccggcuggcugggucgggggcaucccucucugucgcuggcuuccagaggcaggacaggccuccugguaagcccgcaaaguugcugaccuccugacuucgucugccuuuuauuaauaucuguauugcugauaaccgugcucuugacuaugugucccaggucaugucccaggucauggagaagcccgugccacagugacccuccccauacuccugggggggcugcucuccauccuggaucguaaggaggcaucaucaggcuguguuccuggaaccccaauaacccugggcccccagggccagccuguuguagagggaggcuaucugaccgccggucuggcagaggagaugggugggcagcucccagacaccccaaaggacccgguucucuucccagagcguccuaagguuacucuuggaaccugaucuuuguucccucaucccagggaaaugacacacucuguauuucuguuuuauuuagaaaugauuuaaaaaacauuauacaaaggcugaucaguuuaaaaugugacugacacugaaaugcugugaugucccccaggcugaggggaagcuaggcucuggggcccccagugcuuugccccucugucugcccuguccuggggugauggacaaacagaugaccacaggcaggagaaucugagauuggaagccucuaggcugagcccucugggccuggccccacaucccucaccucugcagccugggcugccugccuccaucuccuguucauucucagcuggccugccaggagccaauggggagccuggcgggaggcgggggugccuagagcuuucaagaagugagagcaccaaccugaggaguggacagggaccaggaagugggggaagggaggccaggaagagguggauacaggagacacuucucaucucaucucagacccuagagggguccacagauggggacacaagacccagccagcccacuggauggcccgggcaaguaacaaccucucugugcuucaucugagggcacggugagaguuaccgucggccucccagggccuaacacgaguuucaugugaguggacaggugugagcuaauaaagugcuuugcaaaguauaaaac

SEQ ID NO: 13482 - RNA, 6070 nt, Homo sapiens
guguguguguguguguguguguguguguguguacacaagaaucuugagcccagagagugugucugaccuggguuucuagacaccucccuuccccagucugggaccugagcaaguccagagucucgguggacagaggaggggccugcccuugccagugcacccccgaugccaguccuuuggcuaggacucaaagcggcuucggagcugcuugaacuuggacuuguuguacuuagugaugagguccaguuugcugugacccagggucagccguuucucaucccugaccaggucacuguuaccaccauugagauggccacccuugggacccccaggcucaguucccugccuggccccgugcaacugaugauacuuggugaugagguccagcuugcuguggcccaggguuagccguuucucauccccagacccagcuccagccgugcgagcagggcuugauaucgggagaccauugggcccaggccccucaccacggaaugggccgaacuuugugaugagguccagcuggcugugccccagggucugccgccgcucaucuggugcccgucuggcaggucuggcugaggaguugguuucaaggggcacucuggaacccugggccuugggguacugcaucaggaggucugauuggccacggcuuugguuuagggacagccuccuguccuccagggcccgaucaccaggucugagggaacccaacucaggggcacccccaguacccagggcucgggacaggagauccagcuggcugucggccuggcuuggggacaaccuccuguccucuggggccugcucgccaggccgaagggggccugaguuggggguaaccccagagucagggucucccacuucucgggcucuggggaaggggacaaggagauccagcuggccacggcucugacuuggagaugccuucuucuccuucuccuccacugucuccaggguugugccagguacccaucgaccccgcagggggcugggcucuuggcuuccugggagcccauucucugggaaccgggacagagcuggggcaccccgauggaacuggaggaggggccgggagcgaggaagcagaggugaccccacugccaagguuaaggggcugguacuauuaugguugagggcaggggaggacugggaccauggguaugccccuagcuugccgagauuggcccuauagagcccaggaggggagccgugguuagggucugacaguuggcgauguagggagggcuggccacuggccucacggcgggcaggacccagggacgaggacaccacacccguaucacugcaaucaccaccuccugguagagcgagguaggaggagcgacccauaagcggugacugcuugaugcugcugaggcuggugcuggagggcagggacgacguggggcuugggacaucaggccugaaggcuagggccacagggggaggacgcagugcccggggagacagcggguccucaccgccacagaagcccuccacaggcugcgacucagcguacagacagcggaacucccggucaaagucuuccacgaugcggccccucagcugcagcaccaugcuagugugggccuggcugcaaagccaggugaagcugggggcagagggacaggggggucaggaggcaaagugcaggauccugggggucggcaggagucacagccaggggugcauaccugguccagcacgcuagacccaaaccccaccaccacgagggcucacagcgaggggcagagcuccaacuccagagucugugcuugcccuagcccugcuuagugugugaccucauggaggccccaacuuccccaucugucaaauggacuugggggagguucccugaagucacuccaguuccaaugggcauagucauuuucuauaccaaggguauuaaaguaaucauuccccuagagugagcuccuccagggccgaugcccccgacacccuccccugagccuggcaugaugccuggcacauggcagguacucagcccguguccgaaggaaaggaugaguggagggaagcucagagcugccagccagugaugcagccccaggccccccuugccuccucgugccugcucaccuguaacugcccgccaccacuugcucacagucaaugaggacgaacuucuccagggccugccccgugaagcggcggccagccuugcugcaguauguguccccacacgugcuccgcacacgcauguucuagguggaaguagguugggggugaccuugagagagugaggcucaagccaugucucugccccauggggucucuaaccccagacagcuaagggaacccaccccccacucccagugccccccagugcugacuggccacccacuggcuccccugcccucccugacuccccgcccacaccccugguuacugccccugguccucacugaccggcaggugcuccccauugagguccaucuuguagcacaucuccaggaagugccucaggugcuccugggcaaggagcagguacacagggacaccacgccggcuugaggccuccaugaggucacacagaagcuccaugucagugaauauguccaucaccacagccaccaccuggguggggggaggcacacgaaagcucagcgcugcccagggcacuccccacauccagccaaaccuggggcaggaaacugggcgccgggaaaagaguacuggacugaaaaucaggaggccagagccuucaagagcaagugaacaggaagggcacuuagcagugaccuagcccagggcuucuuaacuugggcacaggcagauuugacugucuucuuuuuuuuaagagucagugucugucucacucuguugcccaggcugcagugcaguggcgugaucauagcucucuucugccuagaacucccaggcucaagcaaucuccucccaacucagccucccaaguagcugguauuauaggcaugugccacuaugccuggcuaauuuucuuuucuuuuuuuuuuuugagacagagucucacucuguugcccaggcuggaguguaguggcgugaucucggcucacugcaaccucugccuucuggguucaagcgauucucgugucucagccucucaaguagcuggaauuucaggcauccaccaccaugcccagcuaaucuguauuuuuaauagagauggaguuucaccauguuggccaggcuggucucaaacuccugaccuugugaucugccugccuuggacucccaaagugcugugauuacaggcgugagccaccacgcccagucgcuaguuuuuuuuuaauucuaauuuuuuguagagaugggguucucacaagcuggucuugaaccccuggccucaagcgauccucccaccucagccucccaaagcacugggauuacagucaaaucccagcccagauuugacugucuugaaccccuagcuguuugaaagcauuugugugcauccuucugugcaccgaguguuuauccaucaucagauucucaaagaugacuguggaucagcugugcuaguccaacacucccucugcacugagccccagaugggacagcagugagaaggagaacccagaccccaauucccaggcaaguuccuggcacucccccgacuaacuccagcccagcucugacccagggacugucugucugaggcucccuucuccagggucacagcuacaagccacuuacuggggucuucgcugcccuuucccaguccugccucaguuucccugugaagccacagaggucuggugugaccccuuacacugcagacucccuuacuugcacccaugccaaauggauccaaguuuucugcucaguugagggcugggcuggggcuugugccuccaucccauauaaagggcugccucaaagaggccccugaaaccuucuuggcaccucccagcccccagcuggccuuucuucccauggcauauaucugcuaugagagucuucucucccaggcagggccgagaggcaggagguacagagcauagcacuccagcucuggagucagaaagaacuggguucaaaccuggacucuaucacuuccuggugacacagcuuugggugagucccuucaccucuggaagccucaccuuccucaucuguuaaauggagauaaugauagccaugucucagaguuacagggaauuaaaugugaaaaugcucaagacauaacagagcucuauaaacauugggcugcagggcaacgcagcauuucccaaggucacuaggagucaugacagcccagugcacgaaccuggcuccugacccaggauagaggggucuaaaugggggcugagaaggcgaggcacugggggaugcccuaguucacagcacaggccuggccagggugggggaacaaggacaggcaggaagaucaaagaggcaggggugaggaggacgacagcagcagccucacuaauaaccccauuccugaugccaaucaggccuggccguccccugccuggggcacaggaaggcuugccagggaggcucuggaaguaccggugggaucccagcauccuggcuucccaucucugcagcaggagccuaacucucccucaaacccugccagggaucaucucguccauuccccuggagucggaggccagggcuucagaagggaagcugugcucguguguggccagagccuuucugggugcugaccaccccuaccugcccucccaauucucuuucuccugagcucccgcuccccaucacugagcccagcagccuccucuccuccuuccuccuugguuccaaagcccagcccucaaggccacgccaaagaggcccacacgcuggccccuuccccugcuucaggcccagcugcagauguggugcaggaggguagggggcaacuagggaccugagccagcaaggagggccggacugguccccaggacccaagucagagagccccugucuccccaagcccugagcucuaugucaccauauggaccucccugggcaagucccaagccccucucuggccucaguuucuucuucuauaagugaaggaggugacucagauguuccccaagguuggaguucuuaguguggggaucauaaaacuuuuugagaaucugauuuaaggcaguggagcaucuuccaagguaaagaugcagcgaggacuccucccuccaaccugcaccacuucgugugcauuucaggggauuguggagucccugacacccaugcccuguucuaugcucauccauacuauuccuggguaccaagcaguugccaagguaaauaugggaugucccccuucuaggaguuugcaaucuaauagugccagaggugcugguccucauucugccccuaagucgcuguguggccuugggcuggucccuucccucucuggaccucaguuuccuccucugugagaugagugauggagagaugaggcccuuaccgugugggccuggcugaaaaggaagcgcagcagguccuugauguucuuggccuugucccucuggaaguggaccacagccuggguggggcugaagccuguggccuguggcaccucgggccagcccagguccaggucuggggggucuaugucagaggccauggggaaguaagucccugaggugacuucagagagcaggcugaggcggucuggcccggaggccuccugccccugagccucgcugagcucagggcccccgcgcacauggcuggucauguaguccacauccagggcgcucaggaagggcagcucccgcuccucggagaugacccgcagguaggcagccucaccccgcuccaggagggcgucggccgccagccgagccgccucgcugugccgcagcaccagcggugagcucucccgccaccacggcagcuucagcucuuccacccggccccgcaggggucccgccaugcccugggcucccaggaccccaggccccgggccuccgaacaugccugccacgcggcugccucacccgccggcagggcccauggcccgcacgcugggcuggcugcagcaggaagaggagaccagcagaaccgccuucugcccgcccgcucgcugugugugugg

SEQ ID NO: 13483 - RNA, 15913 nt, Homo sapiens
ccaagauguuccaagagucuuaaacaccuggugcaguuccgagcacaaggcacacgaacggugcuauuagcguuucuaaccccgcagagaacuccucgcaccccaguccucaaaaucccgccccggacagcggaggcccgggcaguagcuuccagacccaauugcccgcgcaagggggcguggcagcaucguugggcggggccgccuguaagagaacgcggcuaaagguggggccaagcgugcgguuugcugcgccugcgugaggaaaaagaggggggcguggcuccaggccggaagagggagucuguaggggcgggccggcuggcguccccuuuccggccgguccccauggaggcgcuggggaagcugaagcaguucgaugccuaccccaagacuuuggaggacuuccgggucaagaccugcgggggcgccaccgguaggccgcagcggggccggggucgcguggaggggggcguccuagagcuuagcccgggcuccuggacucugacuggccugccggugucugagggagcggauucgaggccauucugacccucgccccuuguccugcagugaccauugucaguggccuucucaugcugcuacuguuccuguccgagcugcaguauuaccucaccacggagguaaggggcggggcuuagugcgugggcggggcuuggcauucuaggaguaggaccuuuaggggugggaguggggaaggagagguuuggggcuaagucuuacugagguagcgcugccccaggugcauccugagcucuacguggacaagucgcggggagauaaacugaagaucaacaucgauguacuuuuuccgcacaugccuugugccugugaguaccucaccaugggugggacuggagagacccaggguucucaugugggcugccagauucacaccuccacccuuagguucuggacuggaccccaggacaaccuccuucuccucaucccguucugccccaagacaggcccaguauccccuuccccuccaaaacccacauccccuugucccuagggucccaguaccuuagccugauuuuccugcuuccagaucugaguauugaugccauggauguggccggagaacagcagcuggauguggaacacaaccuguucaagcaacgacuagauaaagauggcauccccgugagcucagaggcugagcggcaugguaaccaggggagggggccgggucucagaucccaaagcuggauguacccaagccuaucugcuagcaagugaacuguggcaggcauagugauacauuaaacaacuaagagcuagagaagucaagugacuugccuagggucccccagcuaguaagagucagagugagcuaaaauccucuauacauaucgagucagguaaucuaccuggcuauuauucucagagguccucaauaccugcagaugguaguuugaauaccagagguuugaagauaggucuuaugugcucuugccuugguagaacugucuagauggacccaggcuucuuugaguguuugcuuucccagcccauuggcuuaauucagcccuuaaugcucuuccccuuuggaaugcaggugguuuaaugagaauuuagguucucaagucagauugccuggguucacaucuagcuuugucuccugcagucugugagcuucagcuagaaagugguaauaaaacaguaguaccaaccacauggaauuguaagaucaaaugaagucauauguguaaaaugccugguacagaguggguacccacuuuuaccuuccuuuccuuuaucuugguggcuucccaauucccuucguuaacucaguuucccaccacagcaaacuguccucaaagcugggauuucuaacaccuuagagauuacucugguggggaguuuuaucauucguuguuucagcagauuaaugcaggacaccaguggaaccaacauaauuugcuauaggacuggauguggaguggaggagagcaaagucaugguuguugauuccaacgcuuucagccugagcaaaugaaugacuugagauggagaugacuggaggagaagguuuuuuuggugggagggaggaguggcuauuggauauccacugcuguguaacaaaguacuccaaaaguuaguaguuugauacaauaaaaauguguuuuuucaguuucccugggucaggaauuuaggaguggcuuguuugggugauucgggauuaggguaucucacgagguugcagucaucuaaggauugauggggcacugaagaaucuacuaucuaucuaucuaucuaucuaucuaucuaucuaucuaucuaucugucuaucuugagacagagucucacuuugucgcccaggcuggagugcaguggcgcgaucuuggcucacugcaaccuccgccucccagguucaagugauucuccugccucaaccucccgaguagcugggauuacaggccugugccaccaugcccagcuaauuuuuuguauuuuuaguagagacgggguugcaccuuguugggccagauggucuugaucucuugaccuugugauccacccgccucagccuuccaaagugcugggauuacaggcaugagccacugcgccuggccuacuuauuuguuguuuaaauuuauuuuuuuucugucaagguguucuuuauuucagagagagggcaggacagggggcucagucuuucuuggcaucagcuuuccucaugauggcugggacauugcucagcuccuccugccuccucuuagugcggaugugcguccccacucuuuucuugaugaacuugagggcccguuuguccuuggagaccuugaguaacaccauggcgugccgcucauacggggcgaaaccacacaccucucggaucaugucccacaugaauuugguguuuggucaggcgcccgcggcggcagcugugccugggcuugcucauguucuuggucaucuuguggcccuugucaaggcacacggccauaguggguagcacagagccauggcugcugcucuccaauggcagcuguggcagaagggcuggugccacgcggggaucuacuuuuuuuuuuuuuuuuuuuuuuuuuuugagucacgcucugucacccaggcuggagugcaauggugcgauuucagcucacugcaaccucugccucccggcuucaagugauucaccugccucagccuucugaguagcugggguuacaggcgccugcccccacacccggcuacuuuuuguauuuuugguagagacaggguuucaccaucguggccaggcuggucucaaacuccugaccucaggugauccacccgccuuggccucccaaaguguugggauuacaggcaugggccaccacgcccagcaggggaucugcuuuuaaagggcucacucauagggcuguuggcaggaugccucagugccucaccacaugggccucucaguaggguugcuuguguguccuuguaucacggcaacuggcuucccccacuuggaucuugcaagugagcugagagaacaaaguagaaaccauaaccuuuggccaggcaugguggcucacgccuguagucccagcacuuuuggaggcugaggcaguuggaucaccugaagucaggaguucaagaccagccuggccaacaugguaaaaccccaucucuacuaaaaaauacaaaaaaaaaaaaauuagccgggugugguggugggcaccuguaauccuagcuacucaggaggcugaggcaggagaaucacuugaaccagagaggcagagguugcagugagccgagaucacgccacugcacuccagcuugggcaacaagagugaaacucugucucaacaacaacaacaaaaaaacguguaaccuuuuuuaugacccagccucagaaguuguacaccaucauuucugcaauauacuagugcuuacacaggucagccuuacucauugugggagaggacuacauaagggugugaauacuaggaaguggggaucauugaggacaucuuggaaacuagcuuccacagaguaaggucaggauuugcaggaaagaggaaucucagguuugggguauguuaaauuugggguuccuauuuuauacucuggugauauuaagaggcaauuagauguaccagucuagaauuuagaggaguuaucagcagguacaggguaguuuaaacaacuggacuaagaaaaccuggggagucaauguagguagaggauaggucuacggccuguacccuggguaucuccaauauuuaaaagucaggacaggaaggaagauugggacggauuagccauugacguagaagaaccaagaggugucccaaaagccaaguggagagaguuucaagaagagagagugagcaguuguaucagaagcuacugauaguccaguaaaaugaggagugagaauugaccauugaaauuagcaacaaagagauuccuggagacuuugaaaggaacaauuuugauacuguugaggaugaaaaucggaucaaagagcaaaaaaggaaguggagacauuaccuauaggugacuugggaguuucacuguaagggagagcugagaaauggagugggaucugaaggagaaaguggugagaugguggguuugguggugagagcaagugaaguucuguugcuucucuuuucuuaguggaaauugaaagcaaggacauuagcuaagugaagaaauaggaggggguuuugggagccuaaggagagaggagaaggucuaagucaccuuagagagugggagagugaacugauuagagaaaugaaguggaauugccaggcaguccuaaaggagcuucaggaaagaaguagguacagagaguugaauggaaccaggguguggguuuugcuggauuuguaaaugaaagacgagaggaacagggaguugugguuaugugcaagagaauaauuacaguggaccaugggauuucaggagggaagugaggacgugauagugucagcagugucaaagaauugguggauuucggguacuaaauagugaacuuggaaaauaaggguaaguaguugaagacucagacacuugaaguugaauuuuggaagauuugcaguuauuggcagugacaggaucuagguaugaguaugaaaauggguagcugaggugagauggcaaaaucaaaagauuaucaugagucgggaggucaguauucauuauugaaaucaccaguuaugauggggugauuagagugaggcaaggagccggugcagagggagaggugugaggagaagcaccauggcaagagguuaguggcauacacguuggaauuagcugaaaucuguuuccucgguugcauugggcaaagucacuucucaucagugagccucaacaucuucucaguaaaacagggauaauuaccgccacccucaaagagucauuguggggaugaaaugagaugaugguugugaaguacagugaucuguacacagcuaauguucaguauuuacuguugacuguuuucuuacuguuucuuuuauuaaaagaauugauauguguguagaagugcuuaaugccugacccguagcauguacuauaugaauauuaguuauuauaacuuuuauuaucccuaagcaaagggcuugugcagacuggagccaccgauuucacugugucuggccccagcugaugccucugcuucuccccuccccuuagagcuugggaaagucgaggugacgguguuugacccugacucccuggacccugaucgcugugagagcugcuauggugcugaggcagaagauaucaagugagcugggggggagcgggagcaggguucccaucaggcgccaucugucagucagccucagccucagucagacuguggcagguggggaggucagaccaagaaucuagagugggcgggguaugugccucugucauugauccuggugcaagcgacugaggcuuuguaaccaggcccuaucugggagcugcagaccuagagaugaagcugaaguggucucugcucuuccaccuagagaaaugguucagagguggucucuggaguccaguuaccuggguucuaccccuguuuccuugggccaagccauguaaccucucuaugugaagagggaugauaauaacaucuucucguaagagucacauauggauuagcuguguacuguguguaaagcacugagguggaaggcccagcccagauuauuagacccucaguaucugauaacugcugcuguuucccagacccugacuucugcaagacugauucagcaggucuggaguggggccugggaauguguacuuaaauuuuuuuuuauugugggaaaauaugugacauaaaauuuaccauuuuaacuauuuuuaagugugcaacucaguggcauuagguaucuucacagugucaugcagucaccacucucuguccuaaaacuugucaucgccucaaacagaaugggaauauguauuuuucacaguccuagucugggcacaauggcuuacaccuguaauccguagcacuuugggaggccgagguaggugaaucacuugagcucaggaguuugagaccagccugggcaacauagcaagacccuaucucuaaaaaaauuuuaaaaauuaaaaaaagaaaacaguccuucugccacugaggaaacacauuuggagaauguuugguggucagggaugaggcuagcagagccuucauuagcaggcagagcugcucgggcucuauuuccccagaugccagcacuggacuuaugccucuuuaacacucucaccgucacucccugcccuacaggugcuguaacaccugugaagaugugcgggaggcauaucgccguagaggcugggccuucaagaacccagauacuauugagcagugccggcgagagggcuucagccagaagaugcaggagcagaagaaugaaggcugccagguguauggcuucuuggaagucaauaagguaucaggagggaucaagacaagauagggccagcugggcugggcaagcuccacugggaaccgagggcccagucaggcccugaguaggcaaaaggaggacacagccagugaaugagagagaauguuccuuacagguggccggaaacuuccacuuugccccugggaagagcuuccagcagucccaugugcacggugagugaucugcacuagcuggggagauuuagaugcuggccaccuucuuggugagcuugagugguccucuucugccugcugcucauuugucuugggcaaccauuuggccagagcaggccuucaucucagggcagcaguuuggcacaguggcuaagagcacaggccgaggagccagacugccugcauucagauaccaguuucagaccuuacuggcugugugacuuugagaagguuucuuaaucuuuuugacuccuguuuucuacuuuauaaaauguugaugagggcacuuaucucacagggugugugugcagguuaaagaugauagcacggagccuggcuugugguagguacuuguugaaaugguagccccccguguccgaugaugaccugugcaugaggcuuugggagaagcagagcuagguuggagcacagguucugccacaccugggcuaugucauauuugggcccuauuuaguugcuucuucuguaaaauggggaugaugauaauaguacccacucacagggcuguuggggugaacaaaugagauuuauucucauucauuuguucauucaugcauucacaaaauauuuaguaaucaccuacuagucuaguugcuaaggguacaguagugaacaaucugugcccucagaacauucuaguaaagaaauagacaauaaguauauaaaauauaaauaguccccaauuaacaaugguucagcuugcaauuuuuaacuucaugauggguauuacaugcauuuuucacuuaacgauauuuucuuuuucuuuuuugagacagagucucacucugucgcccaggcuggagugcaguggcaugaucuugacucacugcaaccuccaccuccuggauucaagugauucuccuaccucagccucuugaguagcuggguguacaggugcgugccaccacgcccagcuaaguuuuguauuuuuaguagagaugggguuucauuauguuggccaggcuggucuugaacuccugaccucaagugaucugcccgccucggccucccaaagugcuaggauuacaggcaugagccaccgcaccuggccgacuuacaauauuuucaacuugcaauggguuuauugggacguaaccccaguguaggucagggagcaucuguauaugguauaucagaugcuguuaagucauauggaccaaaacaaggcaggauaaagaugguaauggggaggggcuaggguagggcagugaggguccuauuuuaaauauggaggucagggaaaaacucuuugaugagguaauauuuuagcaaagaccugaagacagugagggagccagccauguggaugucuggggaggaaguguuacaagcagagagaacagcaaaugcaaauuccuaaggcuagaaugugcuuggcaaguucaagauacaguaagaagguuaggguggcuggagcagaggagcaugcuuagaaaugaagugagagaggccgggugcaguagcucauaccuguaaucccagcacuuugggaggccgaggcggguggaucaccugaggucaggaguucaagaccagccuggccaacauggugaaacccugucucuaccaaaaauacaaaaauuagcugggugugguggcacacgccuguaaucccagcuacucgggaggcugaggcacgagaaucucuugaaccugggagguggagguugcagugagcugaaauugcgccauuguacuccagccuggguaacagagugagacuccauuucaaaaaauaauaauaaauaaagagaggucacagggccguaucaugcagggcuugcaggggcauuguagggacucgggccguuacucugcaugagaugagaagccauuguagggcccugaagaaggugaggcaugaucugacuuaaaagcucuccagcugcucuguggacaagacugggcaggggaaaggacagaaucagagaggcccauuaggaggcaguugcagugaucaauccaggcaaaagaugguggggcacggcccagaguggcaguggaaguggugggaagugacuggcuucuggauguauuuugaagguagagcugagaagaguuccugaugggcaugagggauaaaggaaaaaggagucaaggaugccuccaaaguuuuguaccugaguaguaagaaggauggaguugccuguaauccuagcacuuugggaggccaaggcagguggauugccugagcugaggaguuugagaccagccugggcaacaugaugaaaccuugucucuacuaaaaaaugcaaaaaaucagccgggcguagcggcgugcgccuguagucccagcuacucgggaggcugagguaggagaauugcuugaacccaggaggcggagguugcagggagccgagauugugccauuucacuccagccugagcgacagagugagauuccaucuccauuaaaaaaaaaaaaaaggauagaguugccauuuagcaagaugagggagacucagggcagguuuagauguucggaaaugggaucguacagcugguauucggcuuuugacguguucagaccaauagcaucuggguguccuucuagacacccaaggugucaaguaaguuuuccauucaagccuggaguucagggagaggacuugccuggagaugcagauguuggcaucaucagcauguguauagagcugugggacuggaugaaaucacccuggaggugagggcagauggagaagaagggaagcucaaagggcugggugccaggccucccacauuagaggccaagggugucagggggaauugguaggggagacuggaggaggaguguaagcugggaauguggcauccugccagccacggacggguguuucaaauaccacaucagaugcuucuggaugucaagcgggaauugaccauggcauguacaugcaacagucacuuauagccuugacugagucauuuaagggugugacaggaccacccuagaguggguucgggagggaaugggggaggaguuggagccaguauugacagcucuauaguggaaauugccuaggggaggagagagcaugagcugaagcuagagggaaauguggagucgagggaggcuuuucuaaggagggugauguagcagaauguuaauaugcuguuggaaauuaucgacuaaagagcauaagugaugcuccagagacgagacagugaccggagugaaguccuggagaaggagaaagaagacagaaucuagugccuuacauauguggaaaguccaaacuuagcaccaggaggaagggcaggcucuguagguacagguagggugguagcugguguggcagaaguacauggagagucucuucugagucuucccaucuucuccguguuguaggaaggaagguccucaguugagaaugaggagagagggaaggagguguuggagauuugaaagaagaaaagaugugacuggucacuuggggguggaagagugcguggacuggggagauugaguaggauugaugcagcccuagggccucccuggaguccgcggcugugaaugcaaagagagcggucagcaugguugucugugugggaauggacucagucaacagaacauugcaauugcaugggguuugguguugccaggugccugcaaaggugagggagucaaauauguaaagaacucaucuugauucuggaccacagcauaugagcuaggaaaggaggaaagacaggauguggggaagccagugagggggcaggaggaaaaagggacuacaaguccugaguguagugucaacaaguuauuggaauuggggaacuggaggaaauuagaaagcugguggagcaugaguugcuugaaauugaagucacagaaggggcuuuguuaaugacaaaguuuagggaauggccaacagagcaaguggcuuggguaggcagagcacaagaucagggaggaaaggauguccaggaacugggaggcccggguacuggaaggaucaucuacguggauauggaaaucacuagaacgugugacagagguaguacaggagagagugacaggcaguugcccaagcuguugaaaaauggcaugggaaaacuguucuggagguuccauaucgauaucuaggugacugaaacaagcagggcugcuuugcccugagcuucaaagcuggggauuuuuuuuuuuuuuuuuuuuuuuuuuuuuuuuuuuuuuuuuugaggcuggagugccauggcacaaucuuggcucacugcagccuugaccuccuggacucgagauccucccaccucagccucucaaggagcugagaccacaggcacaugccaccaugccuggcuaauuuuuuuuuuuuuuuuuuuugcagagacagggucuugccauguugcccaggcuccugggcucaagugauccucccgcuuggccccccaaaauguugggauuacagaugugagccauugugcauuuuuaaggcagauaaagggaaagugaucuggaaguggcaguaaggagcaagaaagacuucucuuuaggccagggaagagguuguguauggagagaagauagucgcacguugaggggaugccagggaguuagugccugaaaggaagagccaggcugaagcaagaaagugaagaggaacccagggguugaaggcaggguuggggaaggugggaguuggugucacaguaaaggauggacagagcugcacagugacagagcccaggguaugaagauggccucucaaaaugguugaagugaacaggaagaaagggcccccuggaggguagcucugcuggucuucagggcaaucuguggggguggggcuguguuggggaggggccagugugggggcuggaggacccugcagagcucugggacccccucuucacucuggaggaagcugggagaaaagggucuugcugggagggcaggaagaugaucagugucaagcuguuggcacaaggucuggcgggcacucaguagacacacagccagaguggcagccucuuggccugggacuguuagacuuguggauccccgggccgggggugcucuguauuuggaaggauguauaaaugcaaagguacaguugcccaaggccagagaucuggcugaauugaggccugggagugaguuucuaacauccuuguugauuggggcugggguggguaauaaucucuuacaguguaaaguuuacaaguauuuuuccaucuuagaucccacgugauccuuaggacagcccuuugcaaaggagaacacugaggcccagaaagggcaacugauuugcccaaggccacacagucaggaacuuggcucuuugagcucuaggccucuuguccuucuaggccacuauuuugcuccucucuggccagauuaguucacucucgaggaggggcccagaaggaggcuuguuagcuggggccagacuguguugcugaggcugaauguuccagucuucccuccugcaacauaucuugcucucauaguucucauugugaagcucugaaucuuucuucucucuccucccucccccaugcugcaguacaugcuguggagaguaaguggcccugcccccauggaggccaaaccccuacuucuggggcagccugcccuacuagaauggcggggagguuggauggggcugugauugggucuccucugaccuggcugcugggugacuguaaaaggucugggauguaucuuugaaguaugguuccuugcagcaggagggauugaggcuagagggcaggaauaaauuguucuggaacaguugguacaggguccccaugggauuucuucuggggagcuuugaggguggaggcagggaaaguguggauggcauucucagaucccaccucacuuugagguucagugauuugccaucagcucuaguuagugagagcccauagucgguggguuuuguuucuggagaugcaggcagggccauggugguagucaaggcauagaguucccuguggacgucagggaggaaccagggucuguucuaaagacuccugaggagggcgugaacucucacacaggcccaaggcuugcccuuucuggcuguccuuaagcaggaccaggaggugccaggcuggagaaggaaugaggggcagagaagacaggugguuugcaguccagggggaggaaggaggaggccagugcugcuccuacuaaugacgccuucucccuugccuucucccuucucuccuaguccaugacuugcagagcuuuggccuugacaacguacguaccagauggaaaccauggagggcaggugggggugggaggcuugguugcugccuucauuuccuuguaggaacauccugggaugggguagugcauauggaaaaauacaccacguucugaauggggauccagccugaggguuaagcgagagugacuuuugaacugaacucugagcaggcuaggggcaagauugggguuggauaagagcauccuagacagacagagccucagcgcaaggucagacgggagcauggcccuucuaaggaacugcggggcagguguggaugggugaggcuggagaagucggcagggaccagaccacaccggacucagaggccacgcugaggaaucacaucuuucucaugagaacaguggaaagcuguuggccuucuuuaagcaggaucacgacauaaucagauuugcauuuuaggaaagauccuucuagugucugaggcugauacacaagggagcaggaagggaguguaucuggggguucacagccuccagccuaggccuccaggcaaagccagcaccugcuacucugugugccuaacguacaagugaagcugguauuuuaagaaaucuggaaccuggccaggcaugguggcucaugcuuguaaucccagcuacucaggaggcugaggcaagagaaucgcuugaauaaggcgaggcugcagugagccaagaucaugccacugcucuccagccugggcaacagagugagaccuugucucaaaaaaaaaaaaaaaaaagaaaaaucuggaaccccaggaguuugcaggcuguggaaggaggaguuucuaggcagggaaugggggauucuuaucucggggagguuguccccuuaggaccauagccuccccuuccucccacaucuccgcagacggacccaggugucccugucugcuacugucaucagagcuuuggaugagcucuggaugguguuguuuacagaucaacaugacccacuacauccagcaccugucauuuggggaggacuauccaggcauugugaacccccuggaccacaccaaugucacugcgccccaagguaccagcccgggaggcagcccccagccgcagaaggccggccgggcacccauacccagugcuuuguuuuccccucagccuccaugauguuccaguacuuugugaagguggugcccacuguguacaugaagguggacggagaggugagucagggagcucccuaccagagucuccugcgcggugccaagcacuggaguuccugcauuuuguuccgucagccuggggagugaaagcugccucguccucacauggcgaauaaaagacugaggcacagagagggugggggauuugcccucccaggcagagugcaggccuggggcuguuagauuuaaagcgccugcucuuucugcugcccucaccgcuucuauccguuccuccggugcccaccgucugccugccucacuguucucuguggucugccugggcuggggguuaggcaaggcaagucucuguguacccgcucccaaggcugcccuggccuguggagcagcaucucagcagaguggcaggaugcgaggggcugagggcagaggaagucaggucagccuuggugcgucuuuggagagcugcuucucagccuggacccccgugagaacacccaccaaaugcugccaggauagguaaacuguaaagacuuggcaccuggaggggaaggcugaggccaagacuaggagagggggucuggcgggccaggccuugcagugcaggccacuagcacggugcuguguucucuccuuacacggccaaggcucaacaggaaaggggaaggagcagggguggggcugaugguggcuggagccagguccuagcccuagcccuggcccaggcuccccucccaccccagguacugaggacaaaucaguucucugugaccagacaugagaagguugccaaugggcuguugggcgaccaaggccuucccggagucuucguccucuaugagcucucgcccaugauggugaagcugacggagaagcacaggugaggaugggggcaaagcggccucugggggccugggccugagggaggaggaugccugcugagcccacccucuccuucuaccagguccuucacccacuuccugacaggugugugcgccaucauugggggcauguucacagguaagaggcccagggcgucugugagcugugggguggggaggguaaagccugggugccccagguuugguugggggugaaggggcagaugcuggccuggccaguuaagugacaaggcucucagcgucaaaagccaaggcccccacugggccagugccagcccuugucucucucccaguggcuggacucaucgauucgcucaucuaccacucagcacgagccauccagaagaaaauugaucuagggaagacaacguagucacccucggugcuuccucugucuccucuuucucccuggccugugguugucccccagccucugccacccuccaccuccucggucagccccagccccagguugauaaaucuauugauugauugugauaguacucacu

SEQ ID NO: 13484 - RNA, 1752 nt, Homo sapiens
ugggcgccgcgggcuucggcccuggagccgcugucaccgccacugccgcccgccuccaagcggcucggagcagcauggucccgcuggcagagcccaccuuccgaagccgcugcaguccugggccccaggcucccggaagugcugcccggcgcuccggaagcgauucaucgggccgcgagcgcccuccccgucguuuuccgugagagacguagagcugagcgacccagcccgcgagcgaggugagguaggcgccgggcgacgcggggccggaacgcgaagagggugguggagucgggcuacccacugauuuuccuucccuuacuuccccugagcccuugggcccacuucccagccuaccgcuuccguccccgcccgacucuugggccagcgccugggcccacacuuuccuaucccccgcagaugccgguggccgugggucccuacggacagucccagccaagcugcuucgaccgugucaaaaugggcuucgugauggguugcgccgugggcauggcggccggggcgcucuucggcaccuuuuccugucucaggugaggggcgcgggcggugaucucugggcaggacaaccagaccuuccggcccugccccauucggccuggagccugaacacagccuccuucuuucgacuucccucucuguccccucgcgagccagacucauuccaaaccaccuucaaucuguaaagucagguuggaagcgucagugcuuaagaauuugagcuuuagagucaaaaugcuuucuggcccuuuucuuacugguucggugacuuuaggcaaguuggagacuggguuuccuuaaguguagaaugaagacaguagcaucuaacuuauagaguuguaaaaauucgaucagcacacuuugcacagcaucuggcacauauuaagugcucaguaacuaguuacuacuguugcuuuuauuuuuuuuuccaauugcgcauaaggaaagaaacucguucagcgguuuuacuauucuggauacaggauacagagauaaagcaguuaaacuuuacacucuaaaggucauuuucacauuuagaggcuguuauugccauaucccuagauuguaaauuaucauuuacagagcacuuacucuauguuaagcacugugcuaaauacuguaguuuucaaaauccuguaaauaauguugagaugcccauuuuacacuugacacuauguguaaauuguagagcugacucuugaacccccaccuuacuccaaaaucauuaacaccaagaaacuaaaagacagaugucuuuauugggucuuaaacugcaggcaacaccagucaaaaaagcugguuucucuauguauuuuacacugcaucugcugccucccacaaacugaaggcaguuaauacgacauccaccagaaaaauacccuggagacccagauggaucuuuuuccuucucauuacccaccccagguaguaagauauaauauccaguaaguggaaaaucagauguagggguugcuagacuaguguuagcaaaaaauuggaaaggagcaguuaauacucuuucugauauuuuuguuaccaaauagcuccaucuugguuuccuccucaggaucggaaugcggggucgagagcugaugggcggcauugggaaaaccaugaugcagaguggcggcaccuuuggcacauucauggccauugggaugggcauccgaugcuaaccaugguugccaacuacaucugucccuucccaucaaucccagcccauguacuaauaaa

SEQ ID NO: 13485 - RNA, 1138 nt, Homo sapiens
agugaggcgccuuucacucccccuccgcguaagcacccaaaucucgcgagacagagcgggucucuagggcaaagacaguugguaggcugccugucaaucuuucagagagcucuucgcugaguggagcucagcggucaccucccccucguggcgccuccucacggccaucugaagauuccuccggcacagccgaucgcccccgcuccggccucccacacagauggcugucaaggucgccauaaggcaaccuaguccuuauggcgauaggauaaaacggccauauucagauuauccgcugaggguggagaggaaguggaaaaguguaucagaaggccagaagaagagaucuuuagggguagggggagagggggagauaauaaaaauagauuucccugucauuuggagccaauggcgcggccuccacugucgagcuuugaaacaaccuuggaaauaguggagaaaagcaaaaaaaagguggaaaaaauaaacucuugcuucccuuggcaugggaucaguuuugugccccgaauuuaaucagcucuugugucaggguugcuaccguuccuucaaaaauguuccccuuccugaauauuacuggacgauuuggugaaaaaauaagacacccccccaacaaaaaaaaaaaggcccccuucccccugggaccuggcuccucuccccugaagucuucuagaugccagguaauuagaguaugaauuagccauuuguucuuuggucaguacugugugagguuuccuccuagaugcugggaaaaaaaacuggaaagaagucuucaaagcaaaaaucuuacccucuaaucuuaacagucuaaugauugagggcagaaaagauuggaaaugagacgccuugauuaguguaacuagcugcugcaacacugugugaccuuggacaagcaaauuaaccucucagaggggaucuuucauuuccugauuuaaaagaggacguacuuaguagcuagucuaagcuacuugagacugaggaaggcagguaaugcucaguacugaauuuuuagagguuagcagggcaugucugcccaaguggacccucaguaaauuaaugaaugaaggcucagaagggcuauagugaagauuaaaugauauaaugucuguaaaacgccugg

SEQ ID NO: 13486 - RNA, 1778 nt, Homo sapiens
aaaugcggccaggcacgguggcucacgccuguaaucccagcacuuugggaggccgaggugggcggaucacgaggucaggagaucaagaccauccuggcuaacauggugaaaccccgccucuacuaaaaauacaaaaaauuagcugggcgugguggcgggcgccuguaguuccagcuacuugggaggcugaggcaggagaauggcgugaaccugggagguggagcuugcacugauccgagauugcaccacugcacuccagccugggcgaugagugagacuccgucucaaaaaaaaaaaaaagaaaaagaaaaugcuuccagaauaacaggcagaacauguuuuuuagggcaguaaugggugagaaaauagccuggaagagcaacugaggaugaggguacugagaagggagagagacucugggcugggcuucaggaggucuugaggggagcugaggaagagcaaaguuccugaagccacuaugugacaaaagaacuugagaaggagaaaugucugaagaggacuucaaggaguccucugugcuuuucugugcauugagaaugugucccucuuuggcauuuguuugagaaaccaagugaacauuugaauagaauuauagaauuaggcaguacugcugucucuuugaauccaguaaccaagcagggagugggcagcaagagaugcuuauuauauucagcauaugguguaaagucccuggcaugguaagugcucagcacucgcuaagugucauucacgucuuuuagaccaaggucaauuugaucaucuagaaacucucuucccccuucaguggaauaggaaacugagacuuuggaagucugagcccucauaaucagugauaaaggccaucacugaguggauugggguaggaggagccugaaugacuucucgccuaacccccacacucuuaucuaggugaaggagcucaugggaacaugaacgggcagccucucaggggagaguggagacagggcagcaaaccauaccaagcacugugugggggggguacuguuuggaaaaagaaugagugggacagugaggggaauguagggcagggggaggugggacuugugugugagccuagcuuccaggcugugagcugcagaaugagcgccgguucucaagguucccuuuccccagcacacacacacacacauauacauacacacauauauacacacauacacaugcauacacacauauacacauacacauauacacacauacacauauauacacacauauacauaaauacacauauacacacacgacacacauacacauacacacauacacauacacacauacauacauacacaugcaauaacaugggaucagauucaggcaggauacugggugugcuggcucacgccuguaauccuagcacuuugggaggcugaggcaggaguucaagaccagccugggaaacauagugagacccugucacuacaaaaaauacaaaaauuagccauccaugguggugcaugccuguaguccaagcuacuuaagggagcugaggugggaggauuacuugagccgaagaggucaaggcugcagugagccaugaucaugccacuguacuccagccugggugacagagugaaacucucucucaaaaaaaagggaaaagaaagaaaaaagaaucaggcagugggcaguggaagacaugacaugagcauuuaccugggagaggaguucacucagaaggaguaaauaugauacccccuggcacaaguguuuggaacaaaugacauuuucagugc

SEQ ID NO: 13487 - RNA, 1907 nt, Homo sapiens
cgggaggggaggcaggcccagccgggacgaggcccugccuccagccaacgcuccgcccagaacgaagccccgccccggaacgaagccccgccuccagcaacucucugcccggagagaggcccgacagcugcgacccgacugguucuguccgagcccgacgggccgcgcugacccagcgacugugccugacugaccacaggugccgccaccgccugauaauacgagugugucagcuuccgucugacugaacgcagguuucaugggugccugacagaccaagacugcuggaucugucagccuggccgcagcuggcugacuggcugacuggcuggcugguugacuggcuggcugacuggcugccuggcuggcuggcuggcuggcugcucuugcccggccgccaucugggccugacgggcugcgucugaccgggcggccuaucugccucugccugaccagccuccaucugugcuuggcgagcugugugaccggccgcgacggucugugucugacugagcacaagguuccuagcggccgaucagcugcuugaccccaucucugcugagccggccgacaccgacggauugacucuggcaacgccuggcccgaguggcgcuaccggcuuccagagacuuccugaccccugccgagguugcaccgcucagcgcugcccugugaggcgcugacuguggccgcagcugagugcggcugccccuucacagacagggcgugcagaaugacggucgccuggcugucccucccuaggcgccccuggcuagcucggcuugccuggcagcgucugugucugagggacguguugguggccgccgcuggccgcaucugucccccugcaggugggcaucagguugcccccgugaagugcagcuggggccgagccuggcugaaggacggccaccuucucuccagcuguccagcgagggcuucugagguggugcccuccggggcucuguggccuggaccucuccagccacacacagucagagccuuaggggaucccaagcaagggcacccacagggaagagagccuaagacagaggccaagggacaggcaggcagcaggggugggacuucgggccaggcgaggaacagcuggaagaagcuccggggcugggaggaggccgcaggaccuugaggugccggaguuuagggauccgauucuguaagggaggcagcaccuugaggaguuggguuggugugugggguccucaggacacgaucccugacuuugaauaccuuuuuuugcggguuuuggggaaaucucugucagugccuugcugcucugcagaagggucaucccgcagaccucagaucucuucccgaauuaauuaauuuauuuauuuuuauuuauuuuuuucuuuuuuugagauggagucuugcucugucguccagccuggagugcaguggcccgaucuuggcucacuacaaacuccgccuuccagguucaagcgauucucaugccucaguuucccagguagcugggauuacaggugugcgccaccaugccuggcuaauuucuguauuuuagccggggguuuguagagacaggguuuugccauauugcccaggcuggucucaaacuccuggccucaagugaucugcccaccuuggccucccaaagugcugggguuacagguaugagccacugcacccagccucuuccugaauuuaaaucucucccagccugugugugugugugugugugugugugugugugugugccagccacaccaaccacaugcaauggcuuccccccuggaaggaguuguucuguaccagaauaagggggaaggaaauacuggucagagggauuuauuuuuuuaaagcaagcauggguaugcuaugaguuauugcuauuaauaauaauacaaugaaagcaucagacuaguuua

SEQ ID NO: 13488 - RNA, 364 nt, Homo sapiens
ucuuuuuuguuguuguuguuguuacguaaauuaacccauuuauuacaggccagugaugucucaaagaguagaggagcgucuacuggucuuucaacuccuucaggcuucugauggcggacuuuaccgugauagcggaggugguauuguauguccaggcaccgccagccacugucuucacgcgggaaccacagugccagauccccgcagcucaucucuucaucuugguuuugccacagaaagagcaaguguacuuggccugcuggcugauuucaacuuucuucaccauuuuccagagggaggccccauagcgggucccguauuuaccgacgaucccgacuuucuugguagguuuggccaugucacc

SEQ ID NO: 13489 - RNA, 3825 nt, Homo sapiens
uuuuuuaaaaaagaauaccugggauuauauuagagcaugcccugcacauguaggugcuuaauagaugcuuaauagauauuuguugaaugaaugcauuaaugaauguaaauuuauuuauuuauuuuacuuaaaaauuuuguuuugauauaagaacaucuuauaaagcacauuuguuugauccucacagcagcuguaaggaggacuuagggcaagaauaaugauccccauuuaacagauaaagaaacagaggccuggaaagaugaaaugacuuaccuagggcaauugaauuagaguuuuagagaguugaaauaaguuuuuaugcuaucuucuccagcccuugauucauuaagcaaaccuuaaccaagcacuucuucuauaacugagcuaucccugagaugcugagauacugauaucaaugugacaagaccucucucauuccccaguaguugagagggagacugggaugaagaaccaagcacugacaugacuaaucacacaugacuauggugugauuaguacugaagggaggugggcucaggggcugcaaugcccaaaggggcucuggccagcccuggggagagcagggugacugcccuggaggcugacagcugacuggaccaggaaggaucagaaagauggccaaaagaaagggcaagguguggcugggugugguggcucacgccuguaaucccagcacuuugggaggcugaggugggcagaucgcuggaggucaguaguuugagaacagccuggccaacaugugaaaccccaucuccacuaaaaauacaaaaauuagccagguaugguggugcacgccuguaaucccagcuacucaggaggcugaagcaggagaaucgcuugaaccugguaggguugcagagagucgagauugagccacugcaccccagccugggugacagagcaagacuccaucucgaaagaaagcaagaaagcaggaaggaagggaagggaagcggaggggagaggaggggaggggaggggagaggaggggaagggaggggaagggaaggaaagggacaaggugggcaggguaggguaucuucaugucaguccagggugcccuugaauccugugaugagauuagggcuggcuuugauucagaagaacaggaggagucacugaugaauuuuaagcaggcgaggaacaaugcuagauugcccacugcccuccauccagggcaagcccauuucagcccuuucuucaauaccacucucccugcccgcccuccuccucuguacccucugcgcuggucacacggugagccugauagaggugaacuugagcccagggguccucucucccagaccaagcuaguccuugcuucaucacuccaaguagcccuccucagucugaguccaccccugacauugcuguucuggccuucagcugaucacagcuagaaacugucgguaacauuagcacuaagcgcuaauaaccauuaaaacagaugaccauuuaccaagccccuacucuaagccaggcgugguuauaagugauucauuucuguaucacuuaaagucauuuaauccucauccuaagaaauggguuauaguauaaucccuaguuggcagaucaggaaacugaggcacggaaaggugucauaauuugccuaaguauuggugaagcugggauucaaaaccagaggcugugcugagucuuauccgcuggacuguagagcacacaggaggaaaagggcagucaguccagcugaagacugagugagcaaagagggacugguccggugaacuuggcaaaccacagaagcacacacaggccuugaaguccauacauuccaugugacgggcaaucugccuuuugccuuugaaucuaggauuucugaagcucuaggccaaccgugucccugucuguuugauguagccuggcuggagccugagcccuggacaaccagauucauauuuucucucucaucuguuucucuuucuccuaccgaccaccccagugcuugggccuagaaauggauucugccuccagcugcuccuccacuggguccugauuuaguccgcaaauuuuuauuaaaaacuccaauuuuauuggaguuccuaccauacuccaaacacuguccuauguacugggauacagaggcacacauggcagguaaacacaugcuauggucuggauguuaguguccccuuauaauuuauuuguugagauccuaaccgccaagguaaugguuuuaggagguggggccuuugggaggugaugaggucaugagggcuccaccuucacgaaugggauuaaugucccuauaaaagaucccagagccuuugguaguucaugagcaugaugauuggguguucacgcaugggggugagaugugccgccuucaaaccuuguuacaauguacaaugugaacgcauuaccugucugacaugaaaaaaaaaaaaaagagagcgaucucagagagcuagauuuccuuucuaccauaugaugacuagaaggagccaucucuggaccagaaagcagcccucaguagacacggaaucugcuggcacccugaucuuugacuucucacaaaaaugugagaaacacauuuuuguuguuuaugagccacccaguugaugguguuugguuauagcagcccgaaagcagaacuucauaucguucucuggcauuucccaagggguagugacaaagaugucucuugguucuuccaugggaugcaugauuuugaauuuggaaaaauaccucuguugggggagguagcaugugcugggagcccaugugcugggggucaggcuugggcugugauccuuccucuucuguggccaugcugggugaccuuaggcugguucuugccucucucugguccucuuccuccccaucuaccaaaaggggagaugagaacagucccuggcauuuguggggcauuugccuggccuaugugucaugugcucacaggagcccaggcugauuccaaggucccuuccuuucuaacauuugguuccugggucucacaggcccuggaagugaccacugggcugaguagcucaucagcuuccccacacugaagcccgaggggucuccugcuggcuucugagagcugacggaacagguuccagcaaggcagacccugacacagaagccagaccuguccagcagggaccccauacacugguggguguaaccucuuauuauuuccuuugggcaggaaguggggaaggcuggaguggagguggagugagagcagaccuucaaggccccugaaacuacgcacuuaaccuaguucugccuugugaaggguggugaaaccaaagcccgagaagggcagcuuuccccaagacuuugccaggugucaccaaacuaugcuggaacccagaucuacugaucccugccuggugucgugugcucagcuguuccugggccuugcucacggaguaggggagggcaaaggauagagcgugugugcaccuggccagguggagaguggccacauuuuaucccgaugcuaugguuguggggggagaagugucuccaugucauuugucauguuucccugccuccugucauguuucucagauaaguuccugggucucuugcccaacugacgcaaacagccuauagguugaguguccagaggagggggcgaugcagagggccggccuuugugccaaauggggacaggaggccuggugaguccugcuguacaccauuccuggugguggagccgcucagcugugagcgcccauccuuucucugggcaguggccauguggccuaggcuagcaggcccuggaagagccuuucuguguccuuccugguucuuggugucuaccgccucacccac

SEQ ID NO: 13490 - RNA, 4587 nt, Homo sapiens
ugaggaaguggacacaaggugguuaagaggggaggcugguuugaacccaggcagccugacaccacagcccuauucugccucccgccuuaggaugaaugaaugcauggacagaggacaguugggagcagucccuacacacaaggaacaggcucuucagaccuaagagaaauaaaaaacaggcugggugugguggcucacaccuguaaucucagcacuuugggaggccaagguggguggaucaccugacgucaggaauuugagacuagccuggccaacauggugaaaccccaucuuuacuaaaaauacaaaaauuagccaggcgcgguggcucaugccugaaaucccagcacuuugggaggccgaggcgggcggaucaccagaggccaggaguucaagaccagccugaccaacauagagaaaccccaucucuacuaaaaauacaaaauuagcugggcgugguggcacaugccuguaaccccagcuacucgggaggcugaggcaggagaaucacuugaacccaggaggcagaggcugcagugagccaagauugagccauugcacuccagccugggcaacaagagcaaaauucugucucaaaaaaaaaaaaaaaaauuagccgggugugguggcgggcuccuguaaucccagcuacucaggaggcugagacaggagaaucccuugaacccagaggcagagguuacagugagccgagaucaugccacuguacuccagccugggcaacaagagcaaaacucugucucggggaaaaaaagagagagagagagagagagagagagagaaauuuuuaaaaaucaaauagagagagagagaaaaauaaaaaacaguuccugccauucacccuggaugcuggggguuaaagguuggcauagcaguuuggcaaguuuacugagagccucuaaggcagccacagccuuuuacccagcauucucuuccugggucuucaccccaagagacaucaucaucugaaauacaggaagaacauuuuaugcaauguucauugcacuguuauucauaauagcaaaaacuagaaacagccggaauauccaugagcaggaaaagggaugaguugaucguguauuuaauagaauccucaguaacgacacggaaggcagcuuccgauacaacauuaagagaaaaaugcaggacaguacugaugaugcgguagaaauuaugacugugcaagaaagagcaaaggaaaacuggugaaaggaaacacuccaagcucccaaucauauucaggaguaauuuuuuucugcuuccuguuuucccaaaucuugguacuauguuauuaugguuuuaauuaaaaaaaacaaaaaaaaaaacacugcugggcaagguggcucaugccuguaaucccagcauuuucgaaggccaaggcgagcagaucacuugaggucaggaguucgaaaucagccuggccaauauggagaaauaccgucucuacuaaaaauagaaaaauuaauugggcaugguggcgggugccuguaaucccagcuacuugggaggcugaggcaugagaaucacuugaaccuggggggcggagguugcaguaagcugagaucacgccacugcacuccaggcugagugacagagcaagacuccgucucaaaaaaaaaaaacaaaaaaaaaaaacaaaccugccgggugcaguggcacacucuguaaucccggcuacucuggaggcugaaguaggaggaucccuugagucaaagaguuugaggcugugauugcaccugugaguugccacugcacuccagccuggccaacauaaugagcucucauuuguaauuuuuaaaauaaaugaauaaauugaauuuuuaaaauuaaaaaacgguauuauuuuaaaaacgacaauaacugcaaugcagcccugaggaacccacacacugaacaguuaaggagaggagcagcaacaggcaaaugagggcaggccagagugagaaagccagaaaguggggugugcugucccagagaccaaggagagggagugcuucgggagcagugagccuggggucaggguggccugggacccgcuagugacccaaugcuugcccuuaugccucccaacugcauucauaaugcaaaccaggugccaagaaugaucuaacaaucggcccucacacauuccccaggaaggcgucugaaaaagugcccccaccaugaccaguggcuccaggagcaguauuuacaaugcaaaccaggcuccccccaggagaagcgguaacuuaccacacccguggccauucaccccgcaguccagcccaagcaaaacagaagaggccucacguacaagagccuggucagaauuuucuggugucuucagaauaggacucuugguccauaccauucaccaauucuaccaccuguguuuccacagggacucgcaaaccaaaccacucccaggacccaccccucacccccacccaugcuggcuucuuaggcccaucccucagccucuuugagacaugucccuuagauucugugccuccuccauguaagcuacacaagcuugcccagagagucacaucucauuggcacaaauucacccacccacacacccaccagccuuuuuucuucugagaaugccccuuccucccucucuccacccaccucauccaggaccccaggcaaaccucagcaaaggagggaaggucccccagcaacucaugccugacuucaacaucccaucccugccucccaccacaccugugacagacaguggccaggucuggcugcugccucuagaccccagagguggagagaggcuaggucacaaagcuaaaaacuaaaccaggcucugaaggccaacuaagaaguccucucugacccucaaccuggugagucgacaagaagcagggcugagucacuaccagaugcaaccccaucaccccaugcuaagaaauugacauugcuuacagcccaaaugcacgggucauccuccugggcagccugugguaaugagugucacggggccaaggcagggccaguaccaauuaaggcugcucccuuuccugccagugagcucagucucauuacuuugcuccauuuucagcucaucugaaaaauccucauuugaggucccuggaggaucuuaaaaguguuauuuaaacauuagcucugacacacagccucccccauccacccaaggccaauacuuuuuucucccugcuuuuuggcacugccaggaaugagcagcaucuaaggcccggccuggggcaccucaggucuugcagccuagggccccuccucagucugaacuuuccccaucucccugccuuguuuagaagagagagcagggaagggaacuuggugucuccuguauggcagacaugucaucuuggcaacaagcccugugagguggcauuauuauuccugugugauagauggggagacugcaacugagccacccucccaaggucacauagccagcagguagacaaauuaggccuggaacccaggacugcugagcuccagggcucuuccagcugcccccgcccacccccacaugcuccuuucugcacacugccuagccccacccugcaacagacacaagcacccaucauucguucccccgggcuucugacccuggggcucgguccaggugagacagaugaggacaagagggguugcaggauguagggcuucuaggacaggcuucagggagcacaauuuuuccuacagaaaaccaaaacaaugcucaaggcugguuacaacccccuauucugaccugcaucuuacaagggaaccuacgagagagaaugcagucagaggcacacaagaggcacgaggagggccauggaaggucagagaggggaucugggcuguguggucagggaagucagagcuggaaggaccagaguuuagcccaaugccuucauuuuuacagguagggaaaccgaggcccagggagaagagaccugcccaaggccaagagugagucugccuaugucaggauugguauacaguuuuccugauucuuaggcuagcuuuccuggaccuagaaggaugaaaggccuggggcagaugcugcccaggauuagugaaagacgaaugagcaaggggauccagcacccccagcuaaggagguaggacagagacaccaacacagugcauccauggggacuccagccuuacucgucucucaccucagggaagguguaggcagaagagaggcccuuccauucaccaaagcuuaagcuccagcaggagccaaucagggccuuagaagaaggcagaaacuuugguuccccuggcaacucagacaaaggcaucuccucaucacugcaaucagcugggguggggaugcagacuguauuccgccagacccagacagggcucuccucuccuuuucucauaagaaggggguaccaacccaaucccuuugguuuuagcccugaaacuucagucauaucucugagcucaucucagaugggaggcgggguauggaugagccucacugucagaggcuuaggacaauaauagcugaguccucuccagucugcgggggcccucccgcugccacuaggugugugccucugagaugggccgggggcugugcugauguuc

SEQ ID NO: 13491 - RNA, 8365 nt, Homo sapiens
uguaaggcccggccgccacgccccgcccccgccuggaguccagacccgacggccggcccaguuccacgcacccagcgagcccaagcgccuucuccgcaccaggugggauccggggccccgggggucuugaggacaggccuaacggcccagggcuggagaugagagguggcccgggcccgacccggcugucacggggggcaaaggcgggccccacggacugggacgugguagggucuguugggcacggacugaggggugagcuggggcagcgaguuugcugggggccgacagggacucuggccaggggccgggcagcaggaaggcuguucuggccucugagaagcagugguccugcggcaagggaaggccaucguccaggcccugccccuuugcugaggagcuggagaugccaagcccagagcuccggggggggcuggggagcccggguacaagggugcuggggagaggguugcagucgucaguucccccuggcccaguaaaggcaugugugucacagauggagaaacagcccugugggacuccacgcccccacagcaucuguguccccuccccaucucccaucccuacacccugggccaggggaaagggaccgagaccagggggcccuuccgacacagccagugcuguaugcagggacccgggccuuccccucucugggucaucucgccuguggguggggaaggucugcggagggcccugauggacucaccccuagggggcaggacgaggacuaguggcugggagaaccugaucccugcucuucccagcccuccagcugcucuaaggaggagacucagaugaggugcacugagaaggaggcaucuggccugcccagcuccaggggcuggaggucaugggggcacugcccugugcuggcuucagcccagccuuuucuguuauggugggaaucuggacaccaggaugggggacauggcauccagucacauccaggccaaguaucagugcugaccccuggugucuagggcaccugaagggggaagcgauggccucagaacuaaaggccccacccaugccugccccucgccccuccaccaguucuagaaggcgccucuggauacacagagcccuuucccacuccacugccacaggcccgccugaggacuggggcucccuguuuuguucaagccucgagggcaccagcagccaaguuugcucuccacugacccaaaccuagcccaggaauccugucuuccagguggccccucccccucucaugggcacuccacuccccuucuggggccucuuuuccuagcugcaccaugggggcaccccugccuccgcucaccacuucccacaauugcugggguggacauggcggccuugugcaagcccuuaaguacagugcucccagccacaccacagcagagagugcagaccggguggccaugaaggcagaggggcccagcugggcucagacccagcuguggguggccuggccaugccugcccuagagcuucauagagugugguggggacagugauggccaucacagccucuguugggcacagugcacugccucucugcaugcagccuucugugggcaccaggagucaaaguucccgagaacacuggacucagggaaggacuaggccccucuaaagcacgggagaggagggggccggcaucuggggacaauggcacucccaacuaggucaugggugagaaggaauucugucuaccuuccugaaccaugcaagaaacacugagggcugggugugucgguccgugggacacgggcaaccacugucucaugacuacaggcagugauggcccuggggaccagcuggggcuggccgggaucccaguccaggguugaugaucucaaaggccaaggaccgagaaugacuucaacagagucaugggaggaaggccuggaaacagcucaaguugcaaccacacagcuuggggugaacaacaggcagaggaggcuuccuggaggcccugggcccggggguuugggcagagggaagaggggccgcaguccuggaaccucagccaggcccacugccccagccgagggaaggaggcacugggucuucaggcgcauauccccacaagcuguggcaagcauucagggaaacagucccaggccuggucucaguuuccccaucuguacaguagaagcagcagacuggccguaguugccuucauauagucauucaucaaacaagcaucuguuagcccaacuauggccugggauugguguaaacugggggaucuaugcuggcccacaagggagagagaucuuuaaguguuuacuguggaagcaaggguacagggaacagcucccuaggagaggggggcggucucaagaacugggcuggagaagaaagagcacaggggaggaggggaccacagaggaaagccugggaguguccagggaacugcagaggucagaaggguaggauugugggucacaagagggacaccacgagggcugucagagaggccaggagggacucacacagggccuugaaugccaggaugagggacccagacuugcucugaggggcggcaggaaccuucaagggcuucacaaugauagguguaggucagggucuguaugggacagaagaggccggcuggaggcuaagaagccaggucuaagcaagggugaagaagcugggguucucagcccaagcaagccucacaccccgauaagcaguggggagugagaacaaggagugggacccaggaucagucugugaccacucaccacuggggggcuggucaagcucccugagguggacaggcggggguuugacugcccagagccuccuagaaccucaggcgggcagcagagggauggagugggagagugaggaacggcaggaaugcaggaaugcugauccagcuccuuccugcagggccagggagccuggauggcagcccaggagagcccucacugacucccacgaguggacccaccuugucacuuggaaagagagagggacaguguaaaugcuauuaaggauuaaaggagauaaagcaugguaaugguuggcaccaagcccaauccuaaguguuuuacccaaacagucacagccaaaauagcugauuccaugcccggcacuguuccaggagcucucgggcacugagucaguuaaucccuacugcugggcacuccucaugucuccagucccagaugaagacucucgggcucagagagguagaggaaguuguucagaaucacacagccacacuugucugcuuuugugaagaacuggguggugggagccccaaauccgugggcagccuugaaugccaggccgaagugcuaaaagccagucugggggaggcaggaagauucccuggcccagagucacagggccacccaacccccaccccuuccugcagggaagccccacccaccagaagccaagauguccagcaagcgggccaaagccaagaccaccaagaagcggccacagcgggccacauccaaugucuucgcaauguuugaccagucccagauccaggaguuuaaggaggcuuucaacaugauugaccagaaccgugauggcuucauugacaaggaggaccugcacgacaugcuggccucgcugggugagcugggacagggacaggggugagauggaugaggccaggcaggcucugccaaucauuuacagggcaccuccuguguagugagacgcgugguguccaccuuagagaauaguugccauuaacuuaguccauucaacagggaaacugggccgggcgcgguggcucacgccuguaaucccagcacuuugggaggccaaggcgggcggaucaauaggucaggagaucgagaccauccuggcuaacacggugaaacccugacucuacuaaaaauaccaaaaauuagccgagcgugguggcgggcgccuguagucccagcuacuugggaggcugaggcaggagaauggcgugaacccggaaagcggagguugcagugagccgagaucgccccacugcacuccagccugggcaacagagcgagacuccaucucaaaaaaaaaaaaaaaaacagggaaacugaagcacaaagcagguccaccacagggucugaacguagacaggcugacuccacagugggccugucuuaggcagauuugugcacugggcugccagguaucauuucauuuaaagaaaggggucagcuggccaggcgcuguggcucacgccuguaaucccagcauuuugggaggccaaggcgggcggaucacgaggucagaagaucgagaucauccuggcuaacauggugaaaccccgucucuacuaaaaauacaaaaauuagcugggcgugguggcgggcgccagcuacucgggaggcugaggcaggagaauggugugaaccugggaggcggaguuugcagugagccaagaucacgccacugcacuccagccugggcgacagagcaagacuccgucucaaaacagaaagaaaggaaagaaagaggucagcaucuaaaugaaagugugaacugcaggcugcccacugcacagauggggaaacugaggccuagaggggcggccagaccagcuccccuccuucagaggucacccaucucaggcucucauagccucucuggucccagugacuuccucaggaucaggaccuuagaacuaacaggguacaaaaaucaaguccaauucucuacugcagauggggaaacacaggcccagaggcaaggccuccacagaccaugccccaacccacgggccugccccaacaucccucccaaagugcuggccacagccagccacucucagcccaguucccgcguaccccucaugccgagugacagcauccagaccagacacugccugggggagggagaguccaggaccagaggacacagccccgugacagucaagccucgagcuuugaggccagagagucagucccugguagggcccugugcacuuuccucuuccugugaaauggggccaugacccugacauuuccccacgaggcacugagcaggagaaccaggcaaaccugagugggagaacugacagcacgcugcccccggcccugagcaccaaaccucuccccgcuucuggccaggcucgcuugaaggcucccucccccaggaggucaccuggcaggaaguaaacuccaggguucuuuuuuuuuccccccgagacaaaaucucacucuguugcccaggcuggaguggcaccaucucggcucacugcaaccuccgucucccagguucaagagauucuccugccucagccuccccaguagcugggauuacagacgugcgccaccaugcccggcuaauuuuuguauuuuuaguagagacaggguuucgccauguuggccaggcuggucucaaacuccagagcccaucuuggccucccaaaguacugggauuacaggugugagcuaccacgccuggccaacuccaggguucuuaucuggggcuuucccagcuucguggaaggacugaggccuggugagagaaggggcuggccuuaaguaccccaguguccuggcgucacagcuccucuugggccucagcuuccauggccaucccagggggacacagcaggguaugugaggcucagggacaugaaaacuuccuauuuccaaggccacacccugcacccaggccccugaaccccugagacuucaugacagcccuggguguccacccagaaaaacaugcacuguguuuguagcucauauccgugggucugcaggugagucacacccuuaucuucaaguuaaaaacaagagcagcaaauauaauaauaagaagaagcccugcagguauuaucuuaaaucucaaagcaauccuauugaacagauacaauuauucccacuuuacaaacaaggaaacugaggcucagagagguuaaguaauuuacccaaggucacacagcuaccaaguaguggggcugcaauagaaacccagcaguugauuccaguccauaggccugugccagucauuguuaugagccuuuugcaacuacugucuucacaauuccccuaagagauggggaaaaccaaggugcacagcugggauccaaacccaggccugucugacagcaaagcacugugucuggacuuuggaguuaggcugccuggguucaaaugccaggucuacucaagucuccuccuuacuugcugucugacccuggacaagucaccuggccucucugugccucagcuuccauaccugugaaguggguaagaaugcugacuucacaggguggugaaaguuaaaugcaauaaggcacguggucgaccagccacagcgagcagucugcagaggguuguucuuauuacacuuuagugagcacugccggcugcugacauccaggccacaggaggaaacuggugggagcagccagggacuccgggcgcccacugcuguggcugcgcuagagccaugcuuuccaguucacaaaacccacuaccucccgucucacacggagcggugaagggcaggggugggggacgggggugcaaguugucccagcuggggacagagggcccaggaccacaggcuggaacaccccaccugccacagggaagaaccccacagacgaauaccuggagggcaugaugagcgaggccccggggcccaucaacuucaccauguuccucaccauguuuggggagaagcugaacggcacggaccccgaggaugugauucgcaacgccuuugccugcuucgacgaggaagccucagguccguggcgcccccuaccaccacucugcaugcaaguggaacagggcccaggcauucagugccucugccccuaagggccagaacagacaucacccaucucccagguucugucaccagaacuauaaaagccaggccaccuccuuauugucgccgcaaaggcuaggccagaacagcccaugccccaagacuccugccuucgugaucucccccgcuggcccaaugcacauucuccaucuguuuuagaccuuuccagaaaucaaaccauuucaugccuuucuugccaagaagguauagaaacuggccccccuccucggaucuccuaacggauauuccaucccucagcucauuuuucccagggacaugucagggugaugauggccaugguaacauggccaugggcccgcacgggccugacuaccuucacggucccucacugcaauggcauacguucaucccuguuuucuagauuaaacaggcacacggagguuaaggaccuugcccaaagucacauagcuagggagaaugggaaucagcacugcaacucaggcaguggaacuccagagcucacgcuuaaaacagggcacacccaacaccaucugugugcacagccucaaguuccccaagugacaccucggagacagucccacugcacaacuccuccccucaggacccuggcaccccuucacgugggauccgacaccccuucacgugcacccccacaccccuccugccacguccucauuccucagacugaccagagacuaagauuguaucuucccagccccucuaggucugcaagagcugccagggggcugagggauggggcugcuguguaugucucagcccaaguuccugcucucacccacccugccccugcccgcagguuucauccaugaggaccaccuccgggagcugcucaccaccaugggugaccgcuucacagaugaggaaguggacgagauguaccgggaggcacccauugauaagaaaggcaacuucaacuacguggaguucacccgcauccucaaacauggcgccaaggauaaagacgacuaggccaccccagcccccugacaccccagcccccgccagucaccccuccccgcacacacccguccauaccagcucccugcccaugacccucgcucagggaucccccuuugagggguuagggucccaguucccaguggaagaaacaggccaggagaagugcgugccgagcugaggcagauguucccacagugaccccagagcccugggcuauagucucugaccccuccaaggaaagaccaccuucuggggacaugggcuggagggcaggaccuagaggcaccaagggaaggccccauuccggggcuguuccccgaggaggaagggaaggggcucugugugccccccaggaggaagaggcccugaguccugggaucagacaccccuucacguguauccccacacaaaugcaagcucaccaagguccccucucaguccccuucccuacacccugaccggccacugccgcacacccacccagagcacgccacccgccaugggagugugcucaggagucgcgggcagcguggacaucugucccagagggggcagaaucuccaauagaggacugagcacugcuu

SEQ ID NO: 13492 - RNA, 8365 nt, Homo sapiens
aagcagugcucaguccucuauuggagauucugcccccucugggacagauguccacgcugcccgcgacuccugagcacacucccauggcggguggcgugcucugggugggugugcggcaguggccggucaggguguagggaaggggacugagaggggaccuuggugagcuugcauuuguguggggauacacgugaaggggugucugaucccaggacucagggccucuuccuccuggggggcacacagagccccuucccuuccuccucggggaacagccccggaauggggccuucccuuggugccucuagguccugcccuccagcccauguccccagaagguggucuuuccuuggaggggucagagacuauagcccagggcucuggggucacugugggaacaucugccucagcucggcacgcacuucuccuggccuguuucuuccacugggaacugggacccuaaccccucaaagggggaucccugagcgagggucaugggcagggagcugguauggacgggugugugcggggaggggugacuggcgggggcuggggugucagggggcugggguggccuagucgucuuuauccuuggcgccauguuugaggaugcgggugaacuccacguaguugaaguugccuuucuuaucaaugggugccucccgguacaucucguccacuuccucaucugugaagcggucacccaugguggugagcagcucccggaggugguccucauggaugaaaccugcgggcaggggcagggugggugagagcaggaacuugggcugagacauacacagcagccccaucccucagcccccuggcagcucuugcagaccuagaggggcugggaagauacaaucuuagucucuggucagucugaggaaugaggacguggcaggaggggugugggggugcacgugaaggggugucggaucccacgugaaggggugccaggguccugaggggaggaguugugcagugggacugucuccgaggugucacuuggggaacuugaggcugugcacacagaugguguugggugugcccuguuuuaagcgugagcucuggaguuccacugccugaguugcagugcugauucccauucucccuagcuaugugacuuugggcaagguccuuaaccuccgugugccuguuuaaucuagaaaacagggaugaacguaugccauugcagugagggaccgugaagguagucaggcccgugcgggcccauggccauguuaccauggccaucaucacccugacaugucccugggaaaaaugagcugagggauggaauauccguuaggagauccgaggaggggggccaguuucuauaccuucuuggcaagaaaggcaugaaaugguuugauuucuggaaaggucuaaaacagauggagaaugugcauugggccagcgggggagaucacgaaggcaggagucuuggggcaugggcuguucuggccuagccuuugcggcgacaauaaggagguggccuggcuuuuauaguucuggugacagaaccugggagaugggugaugucuguucuggcccuuaggggcagaggcacugaaugccugggcccuguuccacuugcaugcagaguggugguagggggcgccacggaccugaggcuuccucgucgaagcaggcaaaggcguugcgaaucacauccucgggguccgugccguucagcuucuccccaaacauggugaggaacauggugaaguugaugggccccggggccucgcucaucaugcccuccagguauucgucugugggguucuucccuguggcaggugggguguuccagccugugguccugggcccucuguccccagcugggacaacuugcacccccgucccccaccccugcccuucaccgcuccgugugagacgggagguaguggguuuugugaacuggaaagcauggcucuagcgcagccacagcagugggcgcccggagucccuggcugcucccaccaguuuccuccuguggccuggaugucagcagccggcagugcucacuaaaguguaauaagaacaacccucugcagacugcucgcuguggcuggucgaccacgugccuuauugcauuuaacuuucaccacccugugaagucagcauucuuacccacuucacagguauggaagcugaggcacagagaggccaggugacuuguccagggucagacagcaaguaaggaggagacuugaguagaccuggcauuugaacccaggcagccuaacuccaaaguccagacacagugcuuugcugucagacaggccuggguuuggaucccagcugugcaccuugguuuuccccaucucuuaggggaauugugaagacaguaguugcaaaaggcucauaacaaugacuggcacaggccuauggacuggaaucaacugcuggguuucuauugcagccccacuacuugguagcugugugaccuuggguaaauuacuuaaccucucugagccucaguuuccuuguuuguaaagugggaauaauuguaucuguucaauaggauugcuuugagauuuaagauaauaccugcagggcuucuucuuauuauuauauuugcugcucuuguuuuuaacuugaagauaagggugugacucaccugcagacccacggauaugagcuacaaacacagugcauguuuuucuggguggacacccagggcugucaugaagucucagggguucaggggccugggugcaggguguggccuuggaaauaggaaguuuucaugucccugagccucacauacccugcugugucccccugggauggccauggaagcugaggcccaagaggagcugugacgccaggacacugggguacuuaaggccagccccuucucucaccaggccucaguccuuccacgaagcugggaaagccccagauaagaacccuggaguuggccaggcgugguagcucacaccuguaaucccaguacuuugggaggccaagaugggcucuggaguuugagaccagccuggccaacauggcgaaacccugucucuacuaaaaauacaaaaauuagccgggcaugguggcgcacgucuguaaucccagcuacuggggaggcugaggcaggagaaucucuugaaccugggagacggagguugcagugagccgagauggugccacuccagccugggcaacagagugagauuuugucucggggggaaaaaaaaagaacccuggaguuuacuuccugccaggugaccuccugggggagggagccuucaagcgagccuggccagaagcggggagagguuuggugcucagggccgggggcagcgugcugucaguucucccacucagguuugccugguucuccugcucagugccucguggggaaaugucagggucauggccccauuucacaggaagaggaaagugcacagggcccuaccagggacugacucucuggccucaaagcucgaggcuugacugucacggggcuguguccucugguccuggacucucccucccccaggcagugucuggucuggaugcugucacucggcaugagggguacgcgggaacugggcugagaguggcuggcuguggccagcacuuugggagggauguuggggcaggcccguggguuggggcauggucuguggaggccuugccucugggccuguguuuccccaucugcaguagagaauuggacuugauuuuuguacccuguuaguucuaagguccugauccugaggaagucacugggaccagagaggcuaugagagccugagaugggugaccucugaaggaggggagcuggucuggccgccccucuaggccucaguuuccccaucugugcagugggcagccugcaguucacacuuucauuuagaugcugaccucuuucuuuccuuucuuucuguuuugagacggagucuugcucugucgcccaggcuggagugcaguggcgugaucuuggcucacugcaaacuccgccucccagguucacaccauucuccugccucagccucccgaguagcuggcgcccgccaccacgcccagcuaauuuuuguauuuuuaguagagacgggguuucaccauguuagccaggaugaucucgaucuucugaccucgugauccgcccgccuuggccucccaaaaugcugggauuacaggcgugagccacagcgccuggccagcugaccccuuucuuuaaaugaaaugauaccuggcagcccagugcacaaaucugccuaagacaggcccacuguggagucagccugucuacguucagacccugugguggaccugcuuugugcuucaguuucccuguuuuuuuuuuuuuuuuugagauggagucucgcucuguugcccaggcuggagugcaguggggcgaucucggcucacugcaaccuccgcuuuccggguucacgccauucuccugccucagccucccaaguagcugggacuacaggcgcccgccaccacgcucggcuaauuuuugguauuuuuaguagagucaggguuucaccguguuagccaggauggucucgaucuccugaccuauugauccgcccgccuuggccucccaaagugcugggauuacaggcgugagccaccgcgcccggcccaguuucccuguugaauggacuaaguuaauggcaacuauucucuaagguggacaccacgcgucucacuacacaggaggugcccuguaaaugauuggcagagccugccuggccucauccaucucaccccugucccugucccagcucacccagcgaggccagcaugucgugcagguccuccuugucaaugaagccaucacgguucuggucaaucauguugaaagccuccuuaaacuccuggaucugggacuggucaaacauugcgaagacauuggauguggcccgcuguggccgcuucuugguggucuuggcuuuggcccgcuugcuggacaucuuggcuucugguggguggggcuucccugcaggaagggguggggguuggguggcccugugacucugggccagggaaucuuccugccucccccagacuggcuuuuagcacuucggccuggcauucaaggcugcccacggauuuggggcucccaccacccaguucuucacaaaagcagacaaguguggcugugugauucugaacaacuuccucuaccucucugagcccgagagucuucaucugggacuggagacaugaggagugcccagcaguagggauuaacugacucagugcccgagagcuccuggaacagugccgggcauggaaucagcuauuuuggcugugacuguuuggguaaaacacuuaggauugggcuuggugccaaccauuaccaugcuuuaucuccuuuaauccuuaauagcauuuacacugucccucucucuuuccaagugacaagguggguccacucgugggagucagugagggcucuccugggcugccauccaggcucccuggcccugcaggaaggagcuggaucagcauuccugcauuccugccguuccucacucucccacuccaucccucugcugcccgccugagguucuaggaggcucugggcagucaaacccccgccuguccaccucagggagcuugaccagccccccaguggugaguggucacagacugauccugggucccacuccuuguucucacuccccacugcuuaucggggugugaggcuugcuugggcugagaaccccagcuucuucacccuugcuuagaccuggcuucuuagccuccagccggccucuucugucccauacagacccugaccuacaccuaucauugugaagcccuugaagguuccugccgccccucagagcaagucugggucccucauccuggcauucaaggcccugugugagucccuccuggccucucugacagcccucguggugucccucuugugacccacaauccuacccuucugaccucugcaguucccuggacacucccaggcuuuccucugugguccccuccuccccugugcucuuucuucuccagcccaguucuugagaccgccccccucuccuagggagcuguucccuguacccuugcuuccacaguaaacacuuaaagaucucucucccuugugggccagcauagaucccccaguuuacaccaaucccaggccauaguugggcuaacagaugcuuguuugaugaaugacuauaugaaggcaacuacggccagucugcugcuucuacuguacagauggggaaacugagaccaggccugggacuguuucccugaaugcuugccacagcuuguggggauaugcgccugaagacccagugccuccuucccucggcuggggcagugggccuggcugagguuccaggacugcggccccucuucccucugcccaaacccccgggcccagggccuccaggaagccuccucugccuguuguucaccccaagcugugugguugcaacuugagcuguuuccaggccuuccucccaugacucuguugaagucauucucgguccuuggccuuugagaucaucaacccuggacugggaucccggccagccccagcugguccccagggccaucacugccuguagucaugagacagugguugcccgugucccacggaccgacacacccagcccucaguguuucuugcaugguucaggaagguagacagaauuccuucucacccaugaccuaguugggagugccauuguccccagaugccggcccccuccucucccgugcuuuagaggggccuaguccuucccugaguccaguguucucgggaacuuugacuccuggugcccacagaaggcugcaugcagagaggcagugcacugugcccaacagaggcugugauggccaucacuguccccaccacacucuaugaagcucuagggcaggcauggccaggccacccacagcugggucugagcccagcugggccccucugccuucauggccacccggucugcacucucugcugugguguggcugggagcacuguacuuaagggcuugcacaaggccgccauguccaccccagcaauugugggaaguggugagcggaggcaggggugcccccauggugcagcuaggaaaagaggccccagaaggggaguggagugcccaugagagggggaggggccaccuggaagacaggauuccugggcuagguuugggucaguggagagcaaacuuggcugcuggugcccucgaggcuugaacaaaacagggagccccaguccucaggcgggccuguggcaguggagugggaaagggcucuguguauccagaggcgccuucuagaacugguggaggggcgaggggcaggcauggguggggccuuuaguucugaggccaucgcuucccccuucaggugcccuagacaccaggggucagcacugauacuuggccuggaugugacuggaugccaugucccccauccugguguccagauucccaccauaacagaaaaggcugggcugaagccagcacagggcagugcccccaugaccuccagccccuggagcugggcaggccagaugccuccuucucagugcaccucaucugagucuccuccuuagagcagcuggagggcugggaagagcagggaucagguucucccagccacuaguccucguccugcccccuaggggugaguccaucagggcccuccgcagaccuuccccacccacaggcgagaugacccagagaggggaaggcccgggucccugcauacagcacuggcugugucggaagggcccccuggucucggucccuuuccccuggcccaggguguagggaugggagauggggaggggacacagaugcugugggggcguggagucccacagggcuguuucuccaucugugacacacaugccuuuacugggccagggggaacugacgacugcaacccucuccccagcacccuuguacccgggcuccccagccccccccggagcucugggcuuggcaucuccagcuccucagcaaaggggcagggccuggacgauggccuucccuugccgcaggaccacugcuucucagaggccagaacagccuuccugcugcccggccccuggccagagucccugucggcccccagcaaacucgcugccccagcucaccccucaguccgugcccaacagacccuaccacgucccaguccguggggcccgccuuugccccccgugacagccgggucgggcccgggccaccucucaucuccagcccugggccguuaggccuguccucaagacccccggggccccggaucccaccuggugcggagaaggcgcuugggcucgcugggugcguggaacugggccggccgucgggucuggacuccaggcgggggcggggcguggcggccgggccuuaca

SEQ ID NO: 13493 - RNA, 21768 nt, Homo sapiens
gucgcgcuccgcacaaaguuuguuuucucccuccgggcgggugggggagggcgcagagggcgcggggggaggagaggggaucugacgucaggccgcgaggugcuuuccagccgcgagcugucaggccgagugucaggccgggcagguacgcggcgcgcgcccccggcgccccccgcuccccgccgggacgccccgcgccgagccggaggccgcguggacccgaaagccgcugggaaaagucagugcagggagcagcagagggccagaugggggugggggcgcgcggacaacuuggaaaguuucuuuuucucggccggacggggagggggcgucguccuggcgcgugcgguagggggugugugagcucggggguguuugugagucccgacggcccccgggggguguuugugagucccgacggcgcugcgcuccgggggccggugggggacuguuccagcccccgggaggaagcccgcuuggggcccugguggggggcccagcuucauaggaucccaccccaggagagggccgauccugcaccggaccugagugagcgcgcggggggacggauuuguuugguuucaaaagugcacguugcuaaccgccagcagggcccccccgccgccgagccggacagggggcggccgagagugacagcugggggugggggccgcgggaagggcccggagcgggggggcccuggggagcccgcgcgaguuccccuuuccuuuggaacaaaggaaagucugucuccgaggcaucugucacucccaggcuggccaaggaagcggggcgcguggggccggcgccccggagaaaguuuguucgcgccgggacccucgggcaggccgaaggugauccaagccucccgcgggagaagcgcguagucuccggggcagggggcggccaacauggagucugggcgcagggcugggggggggggggcggcgcggaggugggagcccagcccccuccccucccuuccccuccccucccccuccgggcccaguucggagcacaaagccgagcgcgcacgcuccgccguccccgcgccccgaagagucggccagccccgaacugccggaguaggggugggaaccaaacuuuuuccugccccgggacagacacgugaguuuucuuucuuccagagcccccgucccaccgggauggcgggcccgcgcgggagcuggugcgcggagucggcccgggguguggggacuguggggugcaagcgccccgagcgccggacgauuccucgccgacccaggagccaugugcuccgacucggucugggccgcgggggagguugcgcgcuuugucugaacugcugggaaugcgggcgugagugcgcggcccgggggagugucgggaccagcuaggggaguugucagaaaguucgugcgggaguggcugcagguggcgucgugggagucuguaggaggguguacgggauguugugucgagggguugcugccacaggucacugaggguagaacugauuguuagugugaugacgccuggaguuuucccugucggagagaucggggguggccgggucgguuggaguucgugggugggcggguacagaaguugggcuaguugugugggucacaguuguucgugcuaggccuggggucuguaagcugugcgugugcgugcuguaugcgucggugaaaacccuaggguuuguaaggcuugagcgauggguccgggccaguuauccuagcgcuguugguuaauugccuggcgugagugugucugggugcgguguggggugcauaugugggaagccucccagacuacagauggcccuguguggcggaacaccgagguggagaaguuuguguagacugaggggucauuccccagggcccacccggggaacccugcagacagacuuggcuggcagccaggguggaauuuguacagauaaccuugaguacuucucacagccggccagggcugcaucacugagcccagaucccagcugcccuggccaccuagaaauggcugucugaccucagaaagcagccugcaguggugcucucugaggaguggcacgucuaaccagugccugucucaccuccagguggccugacugaaaggguagacccuucccucgaaagccuggccuagccagcccagagaucugggcucggguccaagaagaggaaacaaaaccugggagaugccagagucuguuggccggccugcuggggagcuguuaaaaggcugagaagggaggagccuugagauccuggcaucagccuggccuagaacuuuugcuuuuaaaaugaaaaucuggcugggcgggguggcucacaccuguaaucccagaucuuugggaggccgaggcgggcagaucaccugaggucaggaguucaagacuagccuggccaacauggcaaaacccugucucuacuaaaaaaaaaaaaauagcuagaugugguggcacacaccuguaaucccagcuguucgggaggcugaggcaggagaauugcuugaaccugggagauggagauugcagugagccaagauugcgccacugcacuccagccuaggcuacagagcgagacuccaucucaaaaaaaaaaaaagaaagaaagaaagaaagaaaaucuuuguugcacgugugaaacagaacuuuguccagggacugagcagcugaguuggguuaucuagggaaaauccuuccuucauuugacaggugaagaggggacucaagcccagaaaggggaggauccuuguccaaguuacagugccaaguggagggugggccuugcucauucaccuggauuuugagugguugagucuaggaccaggcuaaaggggccugacaaaggagaauguccaagaagcaaccaguagagagaugacucaccucucucacugcaagguacacaguaggugcuccuuaaauauuacuuggacugcugcaggaucauggugaucuguaguuuccagaguucucacuggcccuugggagaccuaggaggcaagacaguauacagcucacaagaggggguggggagaggccugguccaaauccgacuucacuauccuaaccugggggugggauuuuuuuccuuuacagcuuuauugagauauaacucacauaccaugcaauucacccauuaaaguauacucaucagcagguuugguauguuugcaaccaucacuauagucaauuuuaggacuuuuuugcggggggauagggggacagggucuugcucugccucucagaugggagggcaguagugugaucucaucucauugcaaccucugccuccgggcucaagcgauucuuccaccucagcccccagaguagcugggaccacagacaugcauuaccgugcucaacuaauuuuuguauuuuuuguagagaugggguuucaccguguugcccaggcuggucuugaacuacugagcucaagcgauccaccugccuuggccucccaaagugccaggaguauaggugugagccacagcacguggcauuuuuuuuuuauuauuuuauuuuugaaaacagguuuuuaauuaugucguccagguugacaugcacuggugcgaucauagcucacuacagccuugaacuccuggguucaagggauccucucaccucagccucucagaauagcugggacuacuggcacaccaucacacugggcuaauuuuuauuuuauuuuauuuuuuuauuuuuuucuuuuguugagacagggaaucacucugucacccaggcuggagugcaaugccaugaucucagcucacugcaaccucugccuucuagguucaagcaguucuccugccucagccucccaaguagcugggauuacaggugugugccaccacaccuagcuaauuuuuuuuuuuuuuugguauuuuuaguagagacgggguuuugccauguuggccaggcuggucucgaacuccugaccucaggugagccacccaccucggccucccaaagugcugggauuacgagcgugagccaccguguccggccuuuguuuguuuuuguuuuuuuuuuuuugagauggagucucgcugugucacuaggcuggagugcgguggcacgauuucggcucacugcaacguccaccucccagguucaagcaauucugccucagccucccgaguagcugggacuacaggcacgcgccaccaugcccagcuaauuuuuguauuuuuaguagaaacaggguuucacccuguuggccaggauggucucaaucucuugaccucgugaucugccugccucggccucccaaagugcuaggauuacaggcaugagccacugugcccggccuuuguuuuuugagaccuuuuuuauuuuguugucacccaggcugaagugcaguggcacaaacacaguucacuacagccuugaccuccugggcucaagcaauucugccucagucccacaaguaggugggcuuacaaaugcacagcaugacaccuggcuuauuuuuguauuuugugugugugugugugagccacugcgcaggccuugggcagcuuucuugaucucuguuaccucaucuauaaaaugaugauaauaauagcuucucccuuauuggggaauuguaaugauuaaaugagauaacauguaaaaugcucaguacaggccaggcaugguggcucacgcuugcaaucccagcacuuugggaggcugaggcugcuagaucucuugaggccagcaguuaagaccagccuggccaauauggugaaacccugugucuaccaaaaaauacagaaagucagccaggcaugguggugcaugccuguaaucccagcuacucagaggcugaggugggagaaucacuugaacccaggagacagaaguugaagugagccaagauggcgccacugcacucuagcaugggcuacagagugagagccucucucaaaaaaaaaaaaaaaagaaaagaaaaaaccaaaugcuuaguaccgaacauggaaaacaguagaccucaguagaagcuguaauuguuuccagccugaguccugcuugugaaugagcugccauucgguagucaccuaccuguuccaugaaguggaggaacuuuggacucaucccuucuagcuugcucggucuguguuacggccugagauucugaauugcaacuaccccauuucuggugucccaggcucaaguaaugcugagcauguuuggagacuaggaaaaggcgguacgugcuaaugauguucccauccccugugucccuugucccagguuuacccaagguccagccuagccccuaggcaccaugucggacagugaucuaggugaggacgaaggccuccucucccuggcgggcaaaaggaagcgcagggggaaccugcccaaggagucggugaagauccuccgggacuggcuguacuugcaccgcuacaacgccuaccccucagagcaggagaagcugagccuuucuggacagaccaaccugucagugcugcaaguaaggaggggaucuggauaaggggguggcaggaggaccuggguucuaguccuauuccagcugugucacugagucacuguggucuugggccacucacuuucacugucugggcuucgguuucuucuuggguuaggggagaacacccacucucccugucucaagggaagacaaugaaauagggucgcugcagucaauuucagacuuuagauaguccuuuuuuuuugagacggagucuugcacugucacccgggcuggagugcagugaugcgaucucggcucacugcaaccuccgccucccggguucgagugauucuccucccucagccucccgacuagcugggauuacaggcgcccgccaccacgcccagcuaauuuuuuguauuuuuaguagagacaggguuucaccauguuggccaggcuggucucgaacuccugaccuugugauucacccgccucagccucccaaagugcugggauuacaggcgugagccaccacgccuggcccagacuuuggauaguucugaagaggcaaggaauuuaauguugucaaagucuaggugucauccuuaacuuuggaggccaagggaagaugagaaggcaucgagcaucuaggauucagcccccagccccaacgcaguauuggacggcgacuugguugaaaggggcagcuguaauuugcagugugguuaagagauggggcaggaucacaguccaggaaagggcagaagucagagguucuguguucauaauccaguucugccucacgucuugauuuccuuaucuguaaaggggcaggggguacacagagucuuccccugccugguggaucuguugugacgaauagauucagaacuggaugugaaagugcuuugcaaaccaugcacaugaacacacucaaaagauagccuuauccccuuuuugucagagugcaaaguacuguccccuuugaaucgcgccuauugcugacccgcaggugucuuuguucugcuuuccuggagcagaggcgggggacccugaaccaccauugcuuugccuccaguuugccucuccccuuccuggagacacacaguaggcccuuagccuaauacaagaggcccagcccugcccugcuggcccccacugcucccuuccugagccagucaaaccucucccacaagcucuccuguuucucuuucccccucuguccuuucauagcuuauuacuccaaccuuugaugcugucucucccuccuucccuuaucccacucugaaccucccacgucuuccuagcuccuaucuuucuuccauguagagacaugguaaguauuuuagcccucagaacuccugucaccugacuuuauacucugggcaaugguuaauccaagucucuguaugagaaaggcucuaaaguuacagauccugacucagauuccaucuucuccacaagaggaaaccuggaccuuggccaggucacugccuucucugugagccucauuauucccucaucugaaaaaagggaggugauuguagcacuuucaugaguguagggagaaagggacgagaagaagaauucaaggcucacuggggcccuucacaguggcucacaccuguaaucccagcacuuuaggagaccaagguaggaggaucgcaugcgcccaggaguuugagaccagccugggcaacauagggagaccccaucuguacaaaacaaaaaaauuagcugggcauggugguacauaccuguagucucagcuacuuggggggcugaagugggaggaaggauuacuugagcccuggagguggaggcugcagugagcugugaucgcaccacugcacuccagacugggcgaaggagugagacauugucucaaaaaaaaaaaaaaaaaaaaaaaaaacaaggccaggcacgguggcucacacuuguaaucccagcacuuugggaggccaaggcggguggaucaccugaggucgggaguucaagaccagccuggccaacauggagaaaccccaucucuacuaaaaauacaaaaaaaauugccaggugugguggugcaugccuguaauccaagcuacucgggaggcugaggcaggagaauugcuugaaccugggaggcggagguugcggugagccgagaugguggcauugcacuccagccugggcaacaagaacaagacucggucucaaaaaaaacaccuacuggucaguguuuggcauacaguggguguuucuacuguuuucagcuucaucucugccuaaggcacaaagucuuuggcugauccugggugcccagcagugcguggcaucucacaguguaccuccucagcauggagcugugcagaguugggaucugagagaggcuccagacacauucuuacccucgaggagugucuggacagccucuuugcgggucucccugccuucagccuucagccuucagccuuguucauuuaauccauuauuuugaacacaaaagcccaaaucugauagggccaggcacuccuggacucuacugcccucaggauagaguccaaacugaucuacagccuagguuuggggcugcugcuuauauucccagugcaccucacccuguccugucaaaccacuugucacacucuauuggaauuacuuuuugucagggacacuuucucaaaccugagaaauauacuaacuccuuuuauuuauuuaucugugugugugugugugauggagucuugcucugucacccaggcuggaagugcaguggugcgaugucagcucacugcaaccucugccucccggguucaagugauucuccugccucagccuccugaguagcugggauuacaggugcaugccccuacgcccagcuaauuuuuguauuuuaaguagagacagggcuucacuaugcuagccaggcuggucuuguacuccuggccucaaguaauccguccaccucagccucccaaagugcugggauuacaggcgugagccaccaugccuggcccaucuuuuuaaagaaaacauuuuucggccgggaaugguggcucaugccuguaaucccaauacuuugcgaggccgaugcgggcggaucaccugaggucaggaguucaagaccagccugaccaacauggugaaaccccaucucuccuaaaaauacaaaguuagccagacgugguggcucaugccuguacucucagcuacucaggaggcugaggcaggagaaucacuuuugaacccgggaggcggagguugcggugagccaagaucaugccauuacacuccaccugggccacaagagcgaaacucggucucaaaaaauaaaaaaauaaagaaaacauuuuucauggacccaucuccccgcaagauguuaaccugaaucauuuuuaucauaucacuuagguaaaacauaaaacuggguauauauauaaaaaaaaaaccacuucuuuuugcuuuuguucuuauaccuaaccuuaaaaucaaacuguuuccaaaguagauaaauguaaaaaccgugacauuccaccugacuguguuaacugaaaaugguggguggugcuuugcugacugcacugcaggaugugguguggcaaaggcacagacucagcagaguagaucuggauggucuuaggccccgaugcuccuacuggugaugaaaauggaaacccaaagccaaacauccuucuagagaacuggcgaaccccucaaggugacacauccacaggucccaccuggagaaauguaaauguaaggaaaggaaacugggcauccccuggagggaggggacccgugguggccaccugcucuagagucaugccgagaguuaagagcaguggggaccacccagcccuccuugauggaaacugaccaugaaucccaugucagccccagcugcacaccugucugguaacuccucccaguuaguucauugcccucagcucauuuggucaauuaccagcuccuguacaaauaccccuuaaauauuucaggguuuuggcuucuuuccuacccucaucuaaaccaucauuaucugaucacaaucauuuaucacuccccaacuuaaaacccuucaggccaggcauggugguucgugccuguaauuccagcacuuugggaggcugaggcaggcaguucgcuugaggccaggccagguguuuugaggccagccugguuaacaugguuaacuucuucaauacuaaaaauacaaaaauagccgggcauggugguacaugccuguaaccccugcuacucaggaggcuaagguacaagagucacuugaaccaggaggacgagacugcagugagaucgcaccacugcacuccagccugggcaacagcaaaacugucucaaaaaaaaaaaacaaacaaacaaacaaaaaaaaccuucaguggucuggcaggguaacucauaccuguaaucccagcacuuugggaggcuaggaugggagacuuucuugagcccaggaguucaaggcuacagugagcuaugaucaugccacugcccuccagccuaggugacagagcaagacccuaucucuaaaaagaaaaaaaaaaaaaaggcugggcacuguggcuuaugccuguaaucccagcacuuugggaggccaaggcggguggauuaccugagguaaggaguuggagaccuaccuggccaacuuggugaaaccuuguccuacuaaaaauaaaaaaaauuaggcugggcgcaguggcucaugccuauaaucccagcacuuugggagguugaggcgggugggucaccugaggucaggaguuugaggccagccuggccaacauggcgaaaccccgucucuacuaaaaauacaaaaauuaaccagguguggugcugugugccuguaaucccagcuacuugggagacugaggcaggauaauugcuugaaccugggaaacggaaguuggaaugagccgagacugagccaccgcacuccagccggggcaacagacugagacucugucucaaaaaagaaaagaaaaaaaaacuagcugggcgugguugcagguaccuguaaucccagcuacuuaggaggcugaggcaagagaauugcuugaacucgggaggcagagguuguagugaguugugauugcaccauugcacuccugccugggcaacagagcaagaguccaucucaaaaaaaaagaaaaaaaaauucaauggcuuuugccagccuaaugacaucaccggcccgugucuacaucuugaaccucaacccugguccccuacauucccacuacauugauccaccuccccagaccauuuuccucccaccccugaccaggaggcucccagucccuaaaggagcuguaugcucucacagcagauagaugaggucacagcacugggacacuaaacuguaauugcuuuuagacugcaccaaauucuagagguguggagagcacugaccuaguguucacaguuacagcccuaguguagcauagugcuugguaucugguagguaggugcucaguaaauaauguugaaguggcagaaaagggcuauaaagugguggaagggucaacaggcaggaccucagaaguaaggaaauguaauggcuccuaaucaugaaaaauagccuaaagccugggagcaucauuuuuuccuguauuuauuaauuaauuuuuuuuuuuuuugagacggagucacucugucgcccaggcuggagugcaguggcgcaaucucaguucacugcaacuucugcugcccagguucaagcaauucuccugccccagccucccgaguagcugggauuacaggcaccugccaccaggcugagcuaauuuuuguaguuuuaguaaagacaggguuucaccauuuuggccaggcuggucucgaacucccgaccucagguggucucacuucagccucccaaagugcugggauuacaggcgugagccacugcucccggccuccuguauuuaauuuuuuaaauuucauuuuccauuaaggacauuuaagaauaucuauaaaagcugaacgcaggcugggcacaguggcucacaccuauaauuccagcacuuugggaggccgaggcaaacggaucaccugggguuggaaguuugggaccagccugaccaacacggagaaaccccaucucuacuaaaaaauagacaauuagcugggcaugguggcgcaugcuuguacucccagcuacucaggaggcugaggcaggagaaucacuuuugaaccuaggagguggagauugccgugagcgagauccugccauugcacuccagccugggcaacaagagugaaacuccaucucaaaaaaaaagagaaaaaagcuaggcacagugucucacgccuguaaucccaacacuuugggaggcugaagcggguguaucacuugaggccaggaguuguagaccagucugaccaauguggugaaaccccgucucuacuaaaaauagucccagcuauucgggaggcugaagcaggagaaucacuugaacccgggggugguggagguugcagggagccaagaucaugccacugcacuccagccuggucuacagaacgggacucugucuuuaaaaaaaaaaaaaaaaaaaaaaacuccacaaaaguaagagaauauaauaaucaaccaccagcaccagucacucggcuugaacaaguaucaacauuuugccaagcuuguuuuaucucucccuggggacaucucuuuugauugucuccuuuaacccucccaggagcgauucauuagcaagucaaugacucaacuaacugguuugcugguacuugccuggggcuaggcaguugggaggguuagggaaaaaaguaguuuguaaaggauuuucacaggucccuucgacauccucuaagcccaauuuauugguuggacuagaucuguggcuaccuggcaggguucugggccccaauccuuuacuguaacaaugguuggggauauaccacgugccaggcccgggacucugugcuggguauacagugguagaauggguaccuucccauuacuuccuggcugucaggacuccuuucauaugcaguuuccugagggaagccuucccaaagcccauaccggggcaggggcagcagucccccuggcgagggcuguugggugagaaaggaaccuggugcagaggcuguaguggucagcugugggggaggaguguccuggccuagcccccagggcagccagggauguaggagcugcucuccucuggcuccaaagcuagcugcccucugauuccucccacaggcaacuucuauuuuuccccaucucaaggccuuucaucuguguguauguuuuuugaacuucuguguaagcuuuuuggcuuaaauaaagggcuuggccugcaaggacaaguaaccaguaggcuaaaccauugguuccuaagccugggcggccagacuuucuggguagcuggucugaaaacacauugccaacuccaccccucacccccacuagaucaauaaagcagagggggaaaucacuaacaguuuuuaaaaaucucucccaggcugggugugguugcucugccuguaaucccagcacuuugggaggccaaagcgggcagaucacuugaggucaggaguuugagaccagccuggccaacacggugaaacccugucucuauuaaaaauacaaaaauuacuugggcauguugucgugugccuguaaucccagguacuugggaggcugaggcaggagaacugcuugaacccgagaggcggagguugcagugaacugagaucgcaccauugcacuccagccugggcaaagaagugagacuccauuuccccccccccaaaaaaaaaaaucuccccuaaggugauucuaauacagagagcugccuucaagagcaccuggauaugguagucucagugugaauggugguaccaugauguuugggaaaggcgccucagugccuuugcuuccuugacacaaaaaugagaggguuucugccugcauucauuagcugcugcucccagcaucacagccuuugucagccuccugguguuccucccacccccauuugccacagugauuccucccuuguuccucagcagccucucagauagagcccuguuuuaugguagagaccggcuuuccgguucccagccuguguuuugccauauacaucacagaguucacuuugaccuucuuccuaccaucuccccaaggaccuugaguggagacaagucacagguucuuuuccugacuuaggcacaggcugggcagcuggaagggcugcagaaggggcacuggcagccacucaguccccccgcguugccuugcccagccccucagcugugcauuuuucugggcuaagaagacaaaacagacagaugcuaggcugccaagugaucuggacaggacagucuugugggggaguguguggagggguguuuuucuguucuugaacccucagccaaagugggaagugccuuuaggggcuaggugcccacacagaugcugagaaaugcccagacugcccuccaugaggcugccugcucaacaacacuccuuacuuugcuugacccaggucacugugaccugcccauuuuuccccugcauccagggcugagguggagaggggcaguguacuccugcagcacagguaugggaggaggcagcugugggagggagggagagaaggacacaggcacugcuccugugcaaggaagacucccucucacucuucagcuggcagugggguggcugcccagaaccaggcugucuggaucaaacccagcuuuugcacuugugaccuucaacaaguuucugaaccucuccgaucuguuucuucaagggagaucaucauauaaccugugugauaggcugagauugaaugaauaauuagauaugaaaugugaauagugccugaggccaggcgugguggcucacaccuguaaucccaacacuuugggaggcugaggugagcagaucauuugaguucaggaguuugacaccagccuggccaacauggggaaaccccaucucuacaaaaaauaccaaaaaaaaaguaccugggcaugguggcacaugucuguggucccagcuacucgggaggcugaggugggagaauuaccuaaacccaggaggucaaggcuacagugaacugugauuccaccacugcacuccagccugggugacagagugagacccugucuuuaaaaaaaaaaaaaaaaagcacagcaaagcaguggaggcccuaaagccaggaggccugguuuuaaaucccagcucugcacugggaagaugugugacuggacaagagcuuucuucucauugagcucaguucucucuaguacuuuggggacacugcccucuacccuccaggcuuguaugcagauuaaacauaaugcaagugagguggcuggcaugauacugcuaucaaagguguuugaguaaguuuguucccuuccuucaucccaccuagcuguugagcccuuccuucuuuuuuuuuuuuuuuuuuuuuuuuuuuugagauggagucuugcuuugucgcgcaggcuggagugcaguggcgcaauuuugacucaccgcaaccucugccuuguggguucaagcaguucucucagccuccugaguagcugagacuacaggcacaugccaccacacccugcuaagcccuuccucucuuuaggguuuucccacagcucuagucaggauucagcucaaccagcguccacugaagccuguugguaugugugugcauuggagcaccauaguggugaagaggggcaaauaaggaccccagagccagggccccuccuggcuggaauggaaugggagagaagggccacagaagcuucuggcucugcccugccuaugagccuuccagcccgacagccuggugcugucuuugagucaccuguggaauagaugcagcugcaguuagcuagguuaggagaaaagacaggaccagaagaaggaccuagagugugaaauuucagucaagccaccguuuagaccacuuaaugguuuuccauggugcucuggccugguugucagcccuguccaccucugagcucaucagcuaccauucaccgguuccuuaagccaacccuuuccugccucaguucaguugcauuggaggaccauagaggugaaggagggcagaugagaaccccacggccagggccuuuccuuggaauugucuagaacauucuuagcuuucuguauggcuagcucuucuaauccuuaugucucagccuuccagaacccuuagcuaugggaguuucucuuaucuuuauaaugcccccuuuauucuuguuucuguugggggcuuguuggugguuauucaccuaaugguuaauagucagucuccaugacuaggugcacuauaagcuccacaggguggagugcaugucuguuuaauucacaaaggcaucccagcacugagaacugggcccaauauaccaggcacucaaauaauauuugaaugagcaagaagccuugaagagcagcaggaaggugagaagcucuaacuugacuuuuuuuuuuuuuuuuaagacggagucucacucuguuacccacgcuggagugcaauggcguggucauggcucacugcaaccucugccucccggguucaagcaguucuccugccucagccccccaaguagcugggacuacaggcgcgugccaccacacccggcuaauuuuuguauuuuuaguagagacgggguuucacuauguuggccaggcuggucucaaacuccugaccucgugaucugcccaccucggccucccaaaaugcugggauuacaggcgugagccaccacgcucgaccgacuuuuuuuuucuuugagacaaggucucacgcugucacccaggcuggaguacaguggcacagucacagcucacugcagccucaaacuccugggcucaauugauccuaucaccucagccucgcaaguagccgagacuacagacacgcaccaccauacccagcuaauuuuuguacuuuuuguagacacaggguuuugccauguugaccaggcuggucuggaacuccugagcgaaagccauccgcccaccuuggccuccuaaaguacugggacugcaggcgugagcugcagcacccagccugacucuccaggcuggagugcacuggcauuaucacggcucacugcagucucugccucccuggccucaggugauccucccaccucagccuccuggguagcuggggcuauagggcacaugccaucacaacagcugauuuuuuuguauuuuuguagagaugugguuucaccauguugcccaggcuggucucgaaucccugggcucaagugaucugcccaccucggccucccaaagugcuggaauuacaggugugagccaccgugcccagccgggggagggucuucauguccgggcucuggagucuggacuugauccuguaggcaguaggagacaaauggcaguuugcaaccuccuccucccagguucaagcaaguuuccugccucagccuccuaaguagcugggauuguaggugccugccaccaugcccagcuaauuuuuguauuuuuaguagagacaggguuucacuauguuggccagguugguguguguucuuauuuaacucugucuucccacuaugaaccucuguguuuucuuccauguucugggguccugagacauaguaagugcuucauagcuguuuguuuugguuuguuuugaaacaguaucuuguucuauugccuagacuggaauccaguggugcgaucauagcucauugcaggcuccaccucuugggcuccagcuaucuuccgaucucaggcucccaaguaguugggaccacaggggugcaccacuacaccuggcuaacuucuuuuguagaaacagggucucccuguguugcccaggcuggucuugaacuccugggcuuaagcaauccucccgccuuggccacccaaaguguugggauuacaggugugagccacugugcccagcccauagcuguuuuagauuaagcaaauugaucggucuuguauauucauuccagauauguaacugguucaucaaugcccggcggcggcuucucccagacaugcuucggaaggauggcaaagacccuaaucaguuuaccauuucccgccgcggggguaaggccucagauguggcccucccccguggcagcagccccucagugcuggcugugucugucccagcccccaccaaugugcucucccugucugugugcuccaugccgcuucacucaggccagggggaaaagccagcagccccuuucccacguggggagcuggagucucccaagccccuggugaccccugguagcacacuuacucugcugaccagggcugaggcuggaagccccacagguggacucuucaacacgccaccacccacacccccagagcaggacaaagaggacuucagcagcuuccagcugcugguggagguggcgcuacagagggcugcugagauggagcuucagaagcagcaggacccaucacucccauuacugcacacucccaucccuuuagucucugaaaauccccaguaggcaucugccaagaagggugcugaaggcuccagccagcuguccuggguuuccguuuugguucccuuucauacagaggguuuucuauggaucacugccaaacauugggaucaucuccucuguccagaggucuucaacaggaagaugccagcuggcaccacugcacugugaugggggcccucuccucugcugacucugccguuucuccaggccuccgcucagugaugagaccaagagaucggagacaagcauggugcugcugcuucugcugcuucuccagaaaaucccugggacaccuuuguuccagccugguuuccugggcugggcucaggaaagcugccaaauucaguccuauguuggguccaagcugccccugugcuguuucugucaagccagguguggacauuccaaguucauaugcgugaacaaaagaaaagaggaacccaguggauguaacagaaccgacuccaguugaauguuuagauuuuugcuaaacuguuuucuuuuucccuuuuuugcugugguuugcauucacggcaguaguuagcccagguguggggaacgagagugcacugcaugauagcguucuggugagcugggaaggacccaccacugccacugaggauuguuuuggaagaaaggaauauuuuuaucuuggggaccagcuaagucucugcaguagugugaaauuccaaaugguuguuuuaucauugguuugguuuaccaaaaaaaaggcagggaaaaaaaaaaaaaacaaccguaugagcgcauuggcuugucugccgcaggcacagaaggguagaaagccacagcagggggcaguccagcagacucugacucaacuuucuaggcaccuagcagagaaagauaagaucaaaagguguuugguuuuucuuuuaauuuuuauuguaguuuuuuugggugggugggggaaguaaacuagacugaagcgauggauuuuuuuuuucuuuuuuuucuuuaguguuuuucccuuuguucuugaacacuuuugcccugcagccucaguuuugaauucuuuuagcaacuuggauuagaggggcccauaugucagaagcucccagcaccuccuacuugggagaaaagugagccaucugcuggucaggaaguccuccagagaggcagcuuuucccacaaugguggcaggaaacuuuggggaaagcaggaaugguguccacugcugcggaggaacugccuucagagaagguggggcuggaaaaggguuagaagccuccuagcugggauugucuuuguuucaccuuucuuuaaauuagaauuacagaagccccugcccagugaacagauaacgauuggucuuaugcuccucccuuucccccauuuuuucuuuugcuguuuuguuuuuuguuuuuuguuuguuuguuuguuuuuuugagacagagucaugcucugucacccgggcuggagugcaguggugcgaucucagcucacuguaaccuccgccucccggguucaagcaauuauuugccucagccucccgaguagcugggauuauaggcacccgccaccaugucuggcuuuuaguagagacgggguuucaccaucuuggccaggcuggucuuggaacuccugaccucgugagccaccacgcccagccucuuuugcuguuucauugcugacaguguucaacaauaugccccaucuuuauauauccuaagaaacacuaauccuagguuauugcuagccaaaauauuuuuguccugaguagugucacugggccaaaagauagaucaggacgacagccuuuaguuuuccugaaaucaccaggucaggcacaaggagaaaagguuccuggauacugacuaacuuggguggguggaucuagccaggagaaagacaguaacauguguucuguacuuucugggaagaucccugaagccaucacagaggcuccccaacuucugagucgcccaucuguugcugugggagugugaacggaucgcugaaggagagggagcuuugcucucucuaggugggcaaguuuccugggcucucuguguugccucccucuggcuucuuccucccgugcccucuccccgugugccccagggggaucagggauccucacccuccugaggcccaguggggaagaaugaacauggcuucauccagguuaacugaugcugccauuugcccagccucuuccaucccagcccugucagugagcccaggucuggugcaacugcugcaggaugccuguaguagggaacucuggaaguguauugggcugaggugggauuuucccuccccacagugcacugagcaauggaggguggugagggagccaugcugcugaauucugguuggcauuuccccauuauguaaaaugggguguuggguagggcagacucugcuuggguuugguuguaagauaaaccuggaggagaagcacaguugucccauugaauuauuugagcaaaaacuacuguaaauaacuuuuuugucuuuugucaaauaaaauuuuuuuuuguuuuuuuaagcagaaacaggguucuugauugauccaccagggcucagggcccaggcuugaagacaaagcagucacuggcuucuuauuuugcuuuacaucuuuuacucucccucuaguagccagcugugaguucugugcacgcuguacccccauucccuuucaccagcuccauucuguaucccauucaacucaggguaaagggggcauuugcaucucacauugggccagucuucccuggaaucaacaguuaagcucugggguugcuaaguggugaggauguaaccuugaggaacuggcaacuuuguccucccccucucucgguaagaaacaagcaugacugcagugugaacccggcacagagagaagcagcuaugagauggaagcuccagucaugucugaaaccaggaccaccuguaaacuucucuauuauguaagcuagugaauuccccuuuuugcuuaaacuagcuguuaauacguuucugccauacugaaaugacaauacacuaacugcagcccaaacuauaaaaaccaaggucugcaacagugggaaacugaguuugguugagugugccugggucugggucugugcuauguucagucucuuuuuuuuuuuuuuuuuuuugaaacggagucucucucucuugcuaggcuggagugcaguggcacaaucuuggcucacugcaaccuccgccucccagguucaagugauucuccuaccucagccucccaaauagcugggacuacaggagugcgccaccaugcccggcuaauuuuuuguauuuuuuaguagagacgggguuucaccguguuggccaggaugaucucgaucuccugaccucgugauccacccaccucggccucccaaagugcugcaauuacaggcgugagucacugugcccagccccaauuucuuaauuuuuguacacacacacaugaaagugagaugcccuagguaaagaaacugagugggcuguggcuugugccuacagucccagcuacuccaaggcugaggcuggaggaucacuuaagccugggaguuugaggcugcaaugagcugugauuggaccacugcacuccagccugggugacugaaugagaccccaagaccccaucguuuuuuuaauuuuuuuuuauucuaaaaaaaaagagaaacugaguagggauuucagauacuugccugaacucauauagcccauauaaauauggagcucgaauucaaauucaagucuguuuuccuucagggucacucaggucugcccagaaccuaccugaaguaauauaguggucacuuacuaacauaguaucaucuagcugucuagaacagugcugugggcucagcac

SEQ ID NO: 13494 - RNA, 22015 nt, Homo sapiens
ccuuucuugucaugaauccaggauuuaggucaacucaauaugaaaaacugaagcacacuacagacaacaggacauagagaaugagugguauuuccuucaaauugaacaucuugugaagugacauauguaucccaaugaugcaaauaaugcucaaaacuuuuuuuuucauuuuuuuacaauuuuuaauuuuuuuuaagacagugucucacucugucgcucaggcuggagugcaguggcgcaauuagaacucacugcagccucaaccuccugggcucaaacaauccucccaccucagccuucugaguagcuagcacuacaggcacacgccaccacacccagcuaacuuuuuguauuuuuuguagacaggguuucaccuuauuucucaggcuggucuucaacuucugggcucaagcaauccacccgccucagucacccaaaaugcuaggauuacaggcgugagccauugcgcccagccucaaaacucuucuaccuaaaaucaccuucagagccaugcuagaaaauuaguaucauuccuuuacaaucggaauccaacuuggccacuaaaauguuuccuuagacuugguccuaaaugauuuuuggauuguuucaaaaccugaaaaacaccuucacaggauaaagauaaaagaaugggccacuggaucugaagaucauuucaaaaaagaaguuugaacuuucaagcauuuugcacauuccugggaaaauugucuauacaauauucauuuggauguacaaauuccaucacuuuuugaaaaaagucaaaguguucuacagucaguccugccaguuaucuucaaaggcaacgagcagaaaucacgcagucaccacgugcuggggcacucuucccauuccucuccucuugggcaccuuguggcagaaacucucauaaagucacugacaagauccagauccagauccauguauggcagguggguucuguagcugaagcuucaacaguuuucgagcuggugagggaucuaauuguugcaugcuucucuuuccugcagagaaaagaggccaaaaaauaaauuucaauugaaauaacguaacauuuauugaaaacuuaauguagggacauugugacacacauggaagggcauuacaaagacaaauaagagagucucuggccucaaggagaugacaauuugguaagaaugccagccacagcugggcaugguggcucacgccuguaaucccagcacuuugggagaccaaggcgggacgauuccuugagcccaggaguuugagacuagccugggcaacacaguaagaccuugucucuacaaaaaaaaaaaaaacaauuagccuagcaugguccuagcacgauccuccaacuacaugggaggcaagaggaucaccugggagcccagaaaguugaggcugcaaugagucaugacugcgccccuguauuccacccugggcaacagagcaagacccugucuaaaaaaaaaaaaaaaaaggguggcucaugccuguaaucccuguaaucccaacacuuuggaaagccaacaugggcagaucacuugcggucagaaguucaagaccagccugaccaacauggugaaaccccaucucuacuaaaaauacaaaaauuagccaggcaugguggcacaugccuguaaucccagcuacucaggcagcugaggugggagaauaucuugaacuccagaggcagagguugcagugagccaagaucaugccacugcacucuagccugggcaacagagcgagacugucucaaaaaaaaaaaaaaaaaagaaaaagaaagaaagaaagaaagccagccaccacuacaaucacaauacaaugugaucaauaagaagauggaggcugggagcaguggcucaugccuguaaucccagcacuuugggaggccaaggcagguggaucaccugaagucaggaguucgagaccagccugaccaacauggagaaaccccgucucuacuaaaaauauaaaauuagccgggcaugguggagcaugccuguaaucccagcuacucgggaggcugaggcagaagaaucccuugaacccgggaagcagagguugcagugagccgagaucgcaccauugcacucuagccugggcaacaagagugaaacuccgucucaaaaaaaaaaacaaacaaaaaaacccaaaaaaacaagauggucaggugcaguggcucacacuuguaaucccagcacuuugggaggcugaggcaggaugaucacuugagcccaggaguugaagaccagccuggacaaacagggggaccccaucucuacaaaaaaauuaaaaauuuagcugggugugguggugguggugcaugcuuuuagucccagcuacucugggagccugaggugaaaggacugcuugagccuaucagguugaggcugcagugagcugugcagucauugugccauucacuccaaccuggaugacaaagcgagagacuuugcccccccagcccaaaaaaaaaguagaagaagaaagaaaaugaagguauguauagccaauaauuuagggcuggaaggaggucaggaaaagcuagggaggaguaaugucagugucacuuagugaauucuugagaaaugaagagggaaaaagcaauggguggguauuucuuaagucuuggauuuaccaaaacaacaacauauuucauggggauuuaauucucagucuacugugcuucuguagaauuuacaucuagaaauuuccuaucaacucugaguacccauaacauacuauuuauuguggggagaaaaacaaaucaccucauauaggucuuacccucuuggaccauaggcuuugaagggcaguuuguaucccaaaggcuaucauggaaaacagccugaacucugguccccucaagagacaagcuuaccgagcuguacugacaccuucuggaagcacuggguacuuucauccauaaaggccugcagcuguuucacugauccuugcaguucauccaucuguagaaaaaagacagcugugagcuguaaagguccauggcuucuuggauguuccucaaaccugacaagcaagcucuugcucaggagcucugggcuugcuguucuuucagccuggaaugcuuaugccagauaauucuguuuguuccuccaaagucacaccacauucuucuccaggcugcucuaugcuccaggaggcugacccauguaaccucuaccaacaggaugccuaagugggaaggagcugaacgagucaucuugaguuggcucaacucagcuaaccaugugacuuucucccauuagaugccacaguaacugcuacucccuccucccuuugaguccuaggaggaguaagagcucuacugccuauaagccccagguuacuccacuaacccuugugguucuccaauacccauaccuuucuauuuagccuuucugaaaauaaacucuccuugaauuguccuuucaaaugccaucugcuugcuauuaauaccugguuugacacaacacuacucccucaaacguccucauggcucauuuccuucaagucuguugaaauggcaccucagaggagccuucaauaaccuugcuauauaaaauagcaacccaccaaccucccuauacugucugucucucuuacccugcuucaucagcauuuaccacuauauauucauuuguuuauuauuuuuuaauugucucuccauguuuuccuaagguagaguugaauauacauauucaacuuacacuuauacauuucuccaggucuuuuaauuuccaaggauuacaagguggcaaagcuggauaacucaacuaaauaaacaugagcccacuuaccaccaacuccauacagucaaagacuuugcucugguucuguaauauuuucugguagucagguuuuguauuaagaacuucauucugagaagacccaagauaugucauagguuccacuuugaccucaguaauuuuggccucaguugauccucuaaaaacaaaacacaagagcuuuugagagauucuguaauuauuuucuggaagagauaccaaagauuauccuauaaagcugaaucaguauuccuccacucuacgcuagcuauaggcucacuucuuaacagaaagguuuuuuuuuguuuguuuguuuguuuuugagauggagucucacucuguugcccaggauggagugcaguggugcggucucaggucucggcucacugcaaccucugccucccggguucaagcaauuuuccugccucagccuccugaguagcugggauuucaggcaccugccaccaugcccagcuaauuuuuuguauuuuuaguagagacgagguuucaccauguuggccaggcuggucucgaacuccugaacuugugaucugcccgcuucggccucccaaagugcuggaauuacaggcgugagccaccgcgccuggccuuaacaagaaguucugaaacaauugucuaguauucaugucuuuauaccuccggacuccaggaaaugcuggaagcuuccagucaguugaauccacuuaauaguaagguccauauaccagaaggacuauacuugggagagagugaagccaaagcuuacuauccuaaagucagugucuauaauuguuuaccaaaacaugcuggccuacuucaauuaucuaaaauaacugaacaggacugagaguucaugaaaacugaugaacaacaacuuuaauaacaacaacuacuacaauuuacugagugcuaaguauaugccagauauuacugggcacuuuacauuuaaccuaauuugacacaauaacccaaugaggaagguacuaauaucauccccauuuucaaaugaggaaccucaggcucauucaagacuaagugacuugcccaaggucacaaaacuaaggaacaguuagagucugaacagacagucugcuuccagaaccauuccucuuaaccuacaagcuuugccacaaaagauuuuaucugaaacuagcaucuuacacauuaucuaucuucauaaauacaguauguaaggggugaauaaaguaacugauaaccaucauuaccuggauuggggaaauuuuucaaaccaugcuccucaaagccccucucuacugagaggccacuuuuguaauuaggguuuugacuaacauuuuguaguugggauucuagcugauucuaucucaaaaaaaagcuuaaaaccaugguuuaaauguucaacuaaaucaaaaucuagcauuuucuggccaggugcuguggcuuacaccuguaaucucaacacauugggaggccaagaugggcagaucacuugaggccaggaguucacgaccagccuggccaacauggcaaaacccugucucuacuaaaaauacaaaaauuaguggggugugguggagcaugccuguaaucccagcuacucgggaggcugaggcaggagaaucgccugaacuagggaguuggaggcugcagugagccgagaucgugccacugcauuccagccugggcgacagagcaaaaaaacaaacaaaaaaacaacaaaaaaacacccagcccagccuggccaacauggugaaauccugucucuacuaaaaauacaaaaauuagccacgcaucauggcagacaccuguagucccagcuacucaggaggcugaggcaggaaaauugcuugaacccgggaggcagagugagcucagauggcgccaugcacuccagccuuggcaacagagcgagagucugucuccaaaacaaaacaaaacaaaacaaaacaacaccuagcacuuuccuacuuuuccucuaccuucaagacccaaagauccucucuuuccucaaucuuccucaucacccacuuucaugucuuucugucuccaagaaggcccuggccaagggcaucccccaaaccugcagcucauaggccaugugcucacugaagccccuugguuacuguucuuggcccaaccccaggcugccagauacaaugcagagaugugucugucucccccaggauaugaaauguuagccaaggacacagaacagaaacaauuguguucuuggacugaaaauagugacaccaacucuuccuuccucucacucacuucccguuucuggucagagagugcuaauacacacuacagaauuugaugagcuuauuggcccgugagaaaggauucaucuuucaauuugugcuaacagaacugaaauaaacaccaaucaaacuccauaagauuuuuaaagaguuuuuacaguucauagaucuaaccuggacaauaucucuuuagccuccugcugguagugaagcaagagcugaucccaagucugacguucuaaagaaaaccuguaagaaucaggaaaaaaaguucaguuaauuuuuauaaucuuauucugaaucacucacaguaacaauaaguaugugagguguacaaucuggauguaaaaugugaguugacaggucauuacaggguuagaaagccugaccaauucagagaauauuuaaucauaucaaaccugaguucuucaagucaaauuaauauuuguauucucuagacuccauucuaugaaauugaucauuaguagaguccauaaaaaucucaauaugcagccuucuaacuucuaguauugaugcacuaaugcugacucuccaaauacaaugcuuacuauucauuuuuuccaaguuaguuaauuuccccagaugggagaacgaauuuagauuuucuaacaaagguuaacuuacuuuguuauguauuccuucaucucagccacagaugcuuccaaagaaaaaucugaugcuuuucuggaaaacagauaggauuaugacauaaaucuuucaagaaauauuugcuuuaauauaaucgcuuauaaauuaguuauuuauuuauuucagacggaguuucccucuuguugcccaggcuggagugcaauggcacaaucuuggcucucugcaaccucugccucccugguucaacagauucuccugccuuagccuccagaguagcuggaauuauaggcaugugccaccacgcccggcuaauuuuguauuuucaguagaggugggguuucuccauguuggucaggcuggucucaaacucccgaccucaggugauccgcccgccucaaccucccaaagugcugggauuacaggcaugagcaacagcacccagcuauuuauuuauuuuugagacggagucucgcuuugucacccaggcuggaguacaguggcauaaucucggcuugcugcaaccucugccucccggguucaagugauuuuccugccucagccuccagaguagccgggacuacaagugcccaugaccaucccuagcuaauuuuuguauuuuuaguagagacgggguuucacuauguuggccaggcuggucucaaacuccugaccucaugauccauccaccucagccucccaaagugcugggauuacaggcgugagccaccacacccagccuuuuauuuauuuacuuuuaguagagauggagucucgccauguugcccaggucucaaacuccugggcucaagugauccucccaccuuggucucccaaaaugcucagauuacaggugggagccaccaugcccagaaucccuuacauaauuuuugucuuucaaaaaauacuuaauguuggacucuauuucacuuuuccacuagguaauaacuuucuuuuuuuuugagauggagucucacucugucacccaggcuggagugcaguggcgcaaucuuggcucacugcaagcuucaccuccuagguuuaugccauucuccugccucagccucccgaguagcugggacuacaggcgcccgccaccacacccggcugauuuuuuguauuuuuaguagagacgggguuucacuguguuagccaggaugguuucgaucuccugaccucgugauccgcccgccucggccucccaaacugcugggauuacaagcaugagccacugugccgggcuugcacuagguaauagcuuucuaagcuguagguaauaaauagcuagguaauagcuuucuaaguggucucuuuauauucuguuucucuuaucaauuccaauucacaucauggccagauuaaccuuucuuaaaauauuucucuaauuucuuuuucucguugcuuaaaaacucugugacucucagccaggcgugguggcucacgaccguaaucccagcagucuaggagaccgaggcaggcggauuaccugaggucaggaguugaagaccagccuggccaacauggugaaaccccgucucuacuaaaaauacaaaaauuagccaggcaugguggcacacaccuguaaucccagcuacuagggaggcugaggcaggagaauugcuugagcccaggagguggagguugcagugagcugagaucgugccacugcacuccagccuggccaacagagcgagacucugccucaaaaaaaaacaaaaacaaaaacaaaaaaacaacucugugacucucuacugcauacagaagaaaagucaaaacuccuuaaccuggcacuuaaggcucucuguguucugguaccguccagcuuaccaacuuugauuccuacuguuacccaauggcuuaaaugagugggguaauuaauucuuaugaaaaagaagcaggccugaaaaugccaaaauauuuuauauguacuugguauucuaccucgcaaaaacaaauuauuugugccaccauucagguuuuuuucuagaaaagccugagacacacagccauuaccaccucuggcuaagaaacacuagccugugcuaaaauauacugcauuaaaaauaggcccgguguggugguucacgccucuaauccuagcacuuugggaggccaggaaggguggaucaccugagguuaggaguucgagaccagucuagacaauacggugaaacccugccucuacuaaaaauacaaaaauuaguugggcgugguggcaggugccuguaauccuagcuacucggguuaggcugaggcaggagaaucacuugaacuugggaggcagagguugcagugaguagagauugcgccauuacacuccagccugggugacgagagcaaaauuccaucucaaaaaacaaacaaaaaaagagaugcuacuuuaaacuaaaauguuuuucauuuccugucuagcaaugucaauccuaaagaccuuugugaagucaaaaccuaaaguucaugauguaagcccaagugaagugacuuguugcuggguggaaauuaggguguuaaggauguuagucucaccccuacagaggaaguaccaguuuuggggguaguuuuaaauuucugcuaauauucaagagccauguucuuuggcucuuggcaagguagcaaagaugugaauuauguuuuuccccucaucuuuucauggcugguuccuucucaccauucauaucuuacagguuucaagcccaaggucaaaucauuagaggucucugaacacuccagcuaaaguugcccacccccucaagucaugauuauauuuacugaccuagauuaucgcugagucauuauuucccauauauuuguuuauugugucuucuauuauaauguaugacaaaagagaccuugcuucacuugucauuauaucaccagcaucuaaaagagccugguacauaagacgcugaauccgcugggugugggggcucauggcuguaaucccagcacuuugggaggcagaggcaggaggaucgcuugagcccaggaguucuaaaggccucaguaacauagggagaccccgccuuuaaaauuaaaaauaggccggcgcgguggcucaugccuguaaucccagcacuuugggaggcugaggcaggcagaucaccugagguuaggaguucaagaccaaccuggccaacauggugaaacuucaucucuagaaaaauacaaaaaauaagaacaggcaggauggcucacaccuauaaucucagcacuuugggaggcuaaguagggcgaauuacuugaggucaggagcucgagaccagccuggccagcauggugaaacccccaucucccccaucccuacuaaaaauacaaaaaaauuagccaggcaugguggcgcaugccuguagucccagcuaccugggaggcugaggcaggagacugguuugaacccgggagauggagguugcaguaagccaagauugcaccauugcacuccagccugggguacagagcaagacuccgaaucaaaaaauaaauaaauaaauaaaaagagaagaugcugaauaaauguuuguuggugaaugaacaacuaucuaauuacaacaaaaguccuaauucuuuuuuuuuuuuuuuuuuuuuugugagacagagucucucucugucacccaggcuggagugcaggggcgcgaucuuggcucauugcaagcuccgcauaccggguucaugccauucuccugccucagccucccgaguaguugggacuacaggcgccugccaccacgccuggcuaauuuuuuauuuuuauuuuuaguagagaugggguuucaccguguuagccaggauggccuugaucuccugaccucguaauccgcccaccucggccucccaaagugcugggauuacaggccugagccaccaacgcccggccuaaaguccuaauucaaucauaauuuaggacagaaggggaacugcucuuacccauuugaaucuucaaaacauuuuuguagaguuccaucaguuuccaguccgucugcaaaauguuucaauucuucagaaagagaagaugcuagacagcacaaauuuacgugucauaaaauaaaggaaauauacguuuucauagugagaugcugacaaagguauauuaagguagucucagcucuagguacuguuacauguugguccucaagcccacccaaaaguguggaguuaaguauguagaaagauuuuaucuuuuuuuucugguagguauagauaaaaugaaagacaacucauuuuuaucuauuuauuuagacagacucucgcuccgucaccuaggcuggagugcaguggugugaucucagcucacugcaaccuccaccuccugggcucaagcaauauaacccccgccucagccucccuauuugcugggaauauaggcagcaccaccaugcccagcuaaauuuuguauuuucuguggaaaugggguuuuaccauguugucuaggcuggucuccaguuccuuggcuccagcgauucgccugccucagcuucccaaaguccugggauuguaggcguaagccacugugcccagccuuuaugacauuuaugauaaauguuucuauaaaugaacugugaaaaagcaguuuaaaagguauaucugaggcugggcgggguggcucacaccugcaaucccagcacuuugggaggccaaggcaggcauaucacuugaggucaggaguuugagaccagccaggccaacaugaugaaacccugucucuacuaaaaauacaaaaauauaccugggcguggugguacacgccuguaaucccggcuacucgggaggcugaggcaggggaaucgcuugaaccugagaggcagagguugcagugagcugagacggugccacugcacaccagcccgggcaagaaugagacucugucucaaaaaaagaaaaaaaaaaaaaaaaaaaaaaagaagucaggcaauaggcaagaggguaauaagaaacacggaggcaaauaaaaaauuaugggcauagccgggcauagugcuuguaguuccagcuacuuaggaggauugcuugagcccagcacagcuugagcaacauagugaaaccccaucucuuuauuagaaaaaaagaaaaccaggcugggcgcaguggcucaugccuauaaucccagcacuuugggaggccaaggcgggcagaucacgaggucaagagaucaacaccauccuggccaacauggugaaaccccaucucuacuaaaaauacaaaaauuagcugggcgugguugcgcaugccuguugucccagcuacucaggaggcugaggcaggagaaucacuugaaccugggaggcggagguugcagugagccgagauugcaccacugcacuccagccuggcaacagagcaaaacucugucucaaaaaaaaaaaaaaaaaaaaaaaaaagaaagacagaaaaccaaaaaggccaggcauagugccucacugcuauaaucccagaacuuugggaugcugaggugagaguuucacuugagcccaggaguucaagaccagccugagcaacacagcaagaccccaugucuacaaaaaaauuuuuuuuagaaaguuagcugggugugguggcacaugccuauaguuccagcuacuugggaggcugaggaaggagaaaugcuugagccuaggagaucaaggcuacaguuaacugugaucaugccaguguacuccagccugggcaacagagcgagauccugucucaaaaaaaaaaaaaaauuaugggcguaagguuaaaaacaggccucugcuagacuugaagaguccacuacuacauucaggugaagaacacuaaggggaaaggcuauguuaauuaguuaucaggauaauccuagcauaucuacuuuaauuaaggugaugguacaauucugagauaaacaauuuuaacuggcaaguaagcccaaguucauguauuuucuagaucuuuuaaguggguaaacuugaguauuucugacccuggauaaguguauauuuacacuauuagcagaauagguacuuccuagaaaguucaaucauuaguauuuuauuucacagacaacuagcuaacugccucguaauaugaagaguuccuaccaaucaauguaaaagagccaccauccuaaguuuuaaaaacgaacaugaggcugagccaugguggcucgcgccuauaaucccaacacuuugggaagcugaggugggugaaucaccugaggucaagaguuugagaccagccuggccaacauggcgaaacccugucucuacuagaaauacaaaauuagccaggcaugguggugcaugccuguaaucccagcuacuccagaggcugaggcagaagacucgcuugaacccaggagguggagguugcagugagccaagaucgcaccacuguacuccacccuaggagacagagugagacuccaucucaaaaaaaaaaaaagaaagaaaguacaaauggcucuaaaaauaugaaaaaagaaaaaaugcuuaucuucuucaaaagaaaaaggaacacagauuaaaacuacaaaauaucuucuaucaccuaucauauaguaagaaaaucuaaaaggcuuuuuuauuggugagaguguaagaaaacaagucccuacauguauugcuggugagagaauaaauugauaccacuugucugggaagcaaucugguaauucccauaauuucauuugaacuaguuaauuccaauucuaagaauuuaucuucuuuuuacuugcauacgugccaaaaggcuuguguuaaaaaaaaaaaaaaaaaaaaaaaaaaggccagaugcaguggcucaugccuguaaucccagcacuuugggaggccaaggugggcggaucaccugaggucgggaguucgagaccagccugaccaacauggagaaaccccgucucuacuaaaaauacaaaauuagcccggcgugguggcacaugccugaaaucccagcuacuagggaggcugaggcaggagaauugcuugagccugggaggcagagguugcagugagccaagauugcaccacugcacuccagccugggcaacaagguggcucacgccuguaauccuagcacuuuggaaggcggaggcaggcggaucaugaggucaggagaucgagaccauggugaaaccccggcucuacaaaaaauacaaaaaauuagccgggcgcaguggccgacgccuguagucccagcuauucgggaggcugaggcaggagaauggcaugaacccgggaggcggagcuugcagugagccgagaucccgccacuacacuccagccugggcgacagagcgagagucugucucaaaaaaaaaaaaaaauucauuacauuauuuacuguaguagcaaaagacuaaaaaaaaaaaaaaaaacaaaaaacaacacuuaaagccuauuaguaaagaacuaguuaaauccaggccgggcacaguggcuuguaccuguaaucccagcacuuuaggaggccaaggcgggcggaucaccuaaggucaggaauuagaaaccagccuggccaacauggcgaaaccccgucucuacuaaguauacaaaaaauuagcugagcgugguggugggugucuguaaucccagcuacucaggaggcugaggcaggagaaucgcuugaacccaggaggcagaggaugcagugagccaagacugugccacuguauuccagccugggugacagagccgcgacuccaucucaaaaaaaaaaaaaaaaaagaaaaaaaaagcaauaaauauuucugcaaggauacacaagaaacugguggccauagcuaccuuuggggagaggaacuuagacugggggccagaauggaagggaagauuauuuuccacuuucacacuuccuuagcuucauaagcauguauucuugcaauuuaaaaaaaguagggggcugggcacaguggcucaugccuguaaucccagcacuuugggaggccaaggugggcagaucacugaggucaggaguucaagaucagccuggccaacauggugaaaccucuucccuacuaaaaauacaaaaauuagccaggugugguggcucccagcuacucggggggcucaggcaggagaauugguugaacccaggaggcagaggcugcagugagccaagaucacccuacugcacuccagucugggcaagagugagacucugucuaaaaaacaaaaggugggggagcuaguuuuauaagggagcagcuucuguaaauggggaugcugugagcaaagcuuugacugcccagggucaaagcucacucaucuguuagcaacuuaccuuuggcucuaaaacuuucaagacugaagcccuuagugucccuuaggaaagguucaaguuucugaauagagaacuaaauaaagaaaagcauuuuuaguacaaccaccaaaaacuuccaggccaguccuaaauuuaugucauuuuaugauguuuaauaaauaugaaacuaaauacuaaauaugauguaauuuuuacacauaagacuuuucacagaaacaaauaaauagauaagggaaaaaaaaaaaacucuuuguugaccaggcacaguggcuuacgucuguaaucccagcacuuugggaggcugagacaggcggauaauaaggucaggagauggagaccauccuggccaacauggugaaaccccaucucuacuaaaaauacaaaaaaaauuagcggggcaugguggcgcgugccuguagucccagcuacucgggaggcugaggcgguagaaucgcuugaaccugggaggcggagguugcagugagccgagauugugccacugcacuccagccuggugacagagcaagacuccgucucaaaaaaacaacaaaaaacaaacaaagaaaaaacaaaagacuuuuuguugcuuggacuacagauuuugacuuucgguucaggaaaaaaaaaagguuauuuaauucacacaaauuaccugcuuaucuaaauugauguaagcaccugguagccacauaauacacaauacaccuuaaaaaaaggcugggcacgguggcucacaccuguaauccuagcacuuugggaggccaagguggguggacugccugagcucaggcauucaagaccagccugggcaacauggugaaaccccgucucaacuaaaaugcaaaaaauuaagggcuggaugcgguggcucaugccuguaaucccagcacuuugggaggccgaggcaggcggaucaggaggucaggagaucgagacaauucuggcagacauggugaaacccugucucuacuaaaaguacaaaaauuagcggggcgugguggcaugugccuguagucucagcuacucgggaggcugaggcaggagaaucacuugaaccugggaggcggagguugcagugagucaagaucauaccacugcacuccagccugggugacagagucaggcuccaucuaaaaacaaaagauugucacaauagcaguuaacaaacacaaaaacauuuccuaguuauaagaaccuuaccuggaaacuggaaagcaggagacagccaagccguuugcuuucugcuaaaucgacacugauagaccggcugagcucuaacauaaaacauagccacauuuaaggagcuggauaguuacauaguuagcaacuaacaaaacugaaaaauguccucccucuugauaaauccaacuuaaggcaagaacagccuucuuuaguuaaagacagaauucuaauuuuugcaggaucacugaggaaugaaguuuacccauuuguucaucuaaacuuaaaaaaaaaaaaguuauaagaaucuuuguauugggcagguacgaugcucaugccuauagucccaacacucuggggccgaggcaugggaucacuugagaccacgagcuggagacuagucuggacaacauggugaaaucccgucucuacuaaaaacagaaaaauuagccaggagugguggcaugcgccuguaaucccagcuacuccagaggcugaggcaugagaaucaaaagggcucaggaggcggaggcugcagugagccaagagguugcaguagcugagauuacaggcaugcgccaccacacccagguaauuuuuuguauuuuuaguagagacaggguuuccccauguuggccaggcuggucuugaacuccuggccucaagugaucugccugccuuggccuuccaaagugcugggauuacaggugggagccacugugccuggccacaucugagcuuuuuuauaggacaggcacugcaaugugcuuuaaacacucuguacuguauacuauaagaagaguacuauuauaaaguuccauuuuacaaaugggaaaacugcagcucugaggggaaaugacuugcuugaggccagaaacuggaaaucgguggagccagaauucaaacccaagucucucaccgauaucuguguuuuucccucuauuaccacacugccucucuauaaugaccucauaauagcauuaauaacuaacauuuguugaacacuugcuauauaaaaagcauuuuaugaaaugcuauauacguauuucauuaaaccuugaggcaaguauccuaugaauuccauucagauaacagauaaugacacaggcacaaaguaauaggucacuugcccaaggucauagagugaguuauuagacugaauugggugagcauuuuacauaauuaugcaacugaaucccuaaccaaucgcaagauguagauaccguuuuuuaaaauuauguccacuuguaaacaauuacuacauagcaaaggaauuuugcuuugugaauuaugagagcuacaugucuuuuugcccucuagcuucagcugguuguguuuuuaaaguucuugucucuuaauugucacugcuguuagucaagaaaaacaggauacuuucugccuauaaccaaggaaaccugacagguugccagaaauaaccaggcaagaaccaaucuuauuacacugaugcuuuucuguuuaagucuaaauacuccggcauagagcuaaagguagggcuaaucuugggaugcacugauguuuucucagcacauuuagggacuaaaguacaugggccuuguggcagcaauuuucugaugugcuaagugccuaucuuuacccagauuuccuucugugcaucagaccacuuggaaauaggacgauaccuuaaaacuaaucacaguagcuuaacauuucagggcuuacuaugucccaaguacuguguuauguaagauagguacuauuucaucuccaaguugcugaugaggaccuuaagacaaagaagguuaaguaauuuacucaacaucacagagcuaguauagucuuccugaaauaugcaagcuuuuccacguuauguucuguacuuugaugcuaagauauaguuacuauuguaaauucacacaaaaugacacaaaucacguucuguauagcaucccuaaaaacuguuuuucacuguagauacacacacacacacacacacacacacacacacacacacagagagagagagacagagagagaaagaaagugaggcggggguggguggggugcagggagggaagagggaagggagagggguggggugcagggagggaggagggaagagagaggggauagggaaaaagagacaaaguuuuuuagagacaggggucuuacuuugucacccaggauagauugaguggcgcaaucauagcucacugccuucuugaauuccugggcccaagugauccucuugccucagccucucuccaguagcugggacuacagguacgugccaccaugcccugcuauuuuuuuaaaaacuuuuuguagagaugggguuuugccaucuugccuagguuguccucaaacuccuggacucaagcaauccuccugccucccaaagugcugggauuauaggcaugaggcaccgugccuggcccacucuagauauuuguaugugcaucuucccucugagguauuuccaguuauaaaggcuaaaaucagguaucaacccaacuaucuucugcuccacuuuaggguaugagacagaaaaccacagaaagaaaucuuuaauguuucucacccuagcagaggugaguauugaacaauuagaaauuuauuuguggcagcuaauaauauaauauaaguaguaagccaggugcaguggcucacgccuguagucccagcuacuugggaggcugaagugggaggauugcuugagcccagaaguucaaguccagccuagacaaaacagcaacauccugucucuuaaaaagaaauagcaguaauacugaacauuuacuagguguuugacaucaguacuuauaaaguagcaagucaugucuauucucccacacuuucugccauaccucacugccucuuaucugagcuggaaccugucucuuaucugagcuggaaccucacugucuuguguacacagcaccccaccugugaugcccuggugaaugggaugcagcgacuuccgccgguucguuucuuucauacuugcucgccgccaggauugccuccugucuugauaacuggcagauuguucuugaggagacaaaugaagggacuucgacugaagucuuuccugguggcugagaucacaauuucccccuuuuuuagggcuagagccaaggugaauucuuuccucugaaacgccuugauucaucuccagggaggcagauguuuuagcaaacacuuccacaggacugagacuugauuccaauugaugaucaugagucuuagacaucacugguccuuuuucuaguauuuguuauaaaaaagucaaaauacaagaucaagcccgccacaacuauuugugcaaaaaaguggaaaaaguaaauguaugccccuagaucguggaaacauaaagaaagcaucucugcaaauaaugaguaugugauuccaaaucuaccaggagccaggaaagauuuggguauagcucagaagccugaacccaagguaagagguacugaauuucacuacaauacuuaccaucuaugaucucugaucuagucacugaagucauccuaggugguaaacucugaaaauaggaaaauggaagugaucuguucuucacguuucacugcagucucaauggggcuuuacagccccagaauaaauaggccgugugcuuuccagccucucugagcuacccuuauccaccucccugacagagaauaucagcaggggccaucaccuccucuucugaauuucuauacacuuuauugcuagaaauauucaaaucucccugaacacauacccuaccuuacuucccaguuacuuuguguuuaacuagucccuaauuccauugaugacauuauggucuaccuggucuuccaaacuagaaaaaccacaucauccauuacuucuuauucuuaguucuccagauccaaaguccuaacuguuuuauaaacagucucuaaaucuuuucuccauucucacuguuacuaguuuauuuauuauuuugagacagggucuugcucuguugcccaggcuggaguacaguagcacaaucuuggcucacugcaaccuccuccuccccaguucaggugauucuccugccucagccuccugaguagcugggauuacaggaaugcaccaccauaccuggcuaauuuuugcauuuuuaguagagaugggguuuccccauguuggccaggcuggucucaaacuccuggccucaagugauccaccagccuaggccucccaaagucugggauuacaggcgugagccaccacgcccagccucacuguuacuaguuuaguucaggucucauaauuucuggucccucccacuaucuuaauagucucuccacuaguuuuucuaccuccaacggcccgucuccagucuauucuuuguuuuuguuuuuuuuugagguggaaucucacucugucgccaaggcuggagugcaguggcgcagucucggcucacugcaacuuucaccucccagguucaagcaauucuccugccucagcuuccugaguagcugggauuacaggugccugccaccacaccuggcuaauuuuuguauuuuuaguagcgaugggguuuccccauauuggccaggcuggucucgaacucuugaccucaggugauccgcccggccucagccucccaaagugcugggauuacaggccugagccaccacacccggcccagucuauucuucagacaguugccgggacuuuuccaaaguguagucaacaccucagguaaacuagucccaauuuacccauuccugcucucuccucccaguccuauucccuguacuacuucugaaucuuugcacauaucuguccuucuaccuguuaaacuuauucauccuucccaaccuggcucaaauaugaagcuuucacaucacuuaucuuuggcagaguuggugguuaugccccuuggccuucguagcauuggcuauaaaaucuguuuacaugucugucuccccagccaggcuguauuuguauuccuagugacugucaggaacaacugccuggaaggcagggaugucaccuaggcaucucuucaucguccccucccucccagcagaaaucugucuguggggggugcuaaguaaaaagauaugaauauaugcagagggacaaaaaggaaaagauaacaaggagggcucggucaaggaucugaaucccccacgguccuuaugacaauaucacacaaauccaggcuuggauaauaacgacuguaucacacagauccaggcuuagaaaagcaacaacugucaacuguuaaacgcuuauucugugcuaggaccugugcuauguaagcgcuuuacuugcaucguuauuccacuuaaucccuuccacaacuccguaagcaccauuaacuccacuuugcagacaggggaacugagguucagaggggcaaaaagccuggcccaagcuugugacacagccagccugggggcacaggggcaauucgaaccccagcccucuacccaguccucaccccuguuucuggagccuagaccccuggcacggcagauacgucucuaauggggucgguaagggggacugcccucggguuucauuucacccgggaggaggucgcagcgcccucggggacccccaguguccacggucggggccggggcugcggcgggucgagcugggccgacggguacgacgccgaagagauuagugcggcggcgggcggggccacaucagaggacaagucugugacuuccugacgcccguccaguccggaaccuccguaccugaaacacaaggccacgggucgcucuccacagccccaggucacuccuggacgccuugcgcacccgcagccgauacucccugaucagggugaagcggucuccaccuucuacgucacggucaccgccuccgaaacucccgccaaccaagggcgcaugcgcggccgucaguuucucgggcacgcgcgcgcagaacgccugccuccggcgaugcacaugcguacaccgccgcccg

SEQ ID NO: 13495 - RNA, 15877 nt, Homo sapiens
uacaaguugguucuaaagaguggugagucagaagagacgucaggcagcaagcgacuugggccauggccucugaccuagacuucucaccuccggaggugcccgagcccacuuuccuggagaaccugcuacgguacggacucuuccugggagccaucuuccagcucaucugugugcuggccaucaucguacccauucccaagucccacgaggcggugaguuuuucccugggagccucagcuccucugagugccaggcuggguucugaguacuaacaguaggugccaccacaacugagaucagcagggucuacauugggccuuuuugauuuagugugccucugaauuuccaccugguggguugaaccacauagcuaauacuuuauuuguucauguacccauuaaggagauuuuuauuuagugccuacuacauuucagacucugcugaagauguagugucugcaccugaggagcaucuaguccuugggaggaaggcagauaacaaaaacauaccuccaugugcucccaugagaaguacagaguccagugaggcuauauaacaagggggagagagaccugaucuuacccugggcugugggcccugccgaggaggcaguguuugagcugagacugaaggaaugagcaggcuucugccaggugaaagugggcaaggggcgaggacaacauuccagggagagggcacugcacgugcaagggacucaauaaaggaaggggcuaauucaaggaacugaaugaaggugacuguggccagagcacagagggggcaugaugaguggugcagccagaggugugggcaggggccagaggguuuuaagugugagaaugacauggucaaauuggcuuuuuuguuguuguuuugacucuucuucuguaaguaucuuuauaacuauacacccuccuucuacccacuuucuugcccacucccauuugcucgugacauugauuuauuggagaaagcaggucguuugucaugugggauaccuacaucccaggaauuggcuauugcuucucuguggugucauuuaacguguuucucuguucccuguguuuccugucaacaggaguuccauguagaggccugauuccauuccagucagguuauuggguacgaauaccucagagcuggugcuauguacucccuacuguguggcaucaacaagcagguggugucuggcugcugcacauuuagagauucuuggauugaucgguggguuuaggugguaucagcugaucccuccauuauaaaaauccggucagucuuucaccuaagcgguuuuagcauccauugauggucguugcuuagauccauuauuuccuucugcaucuguuagcuggaauucuuuaacaaagaccuuuuccuuaucacuuguaugauuacucugaauugcucuucauaaugaaaagcaggaaaaaugcuugguucuuucccuuuauuuaucaauuuucaaaguugugaguucagacucuagcaacuuccaaugaugaccaaugaagcuuugguuuucauagcauucugaacauauuuuuaauauauuuaauauguuuuaguuuuuuuuuuuugagggcacuuaucugccauuaauuuguuuuuuauguucagugggagccccuuuaaguugaugucuuuguucuuugucauacuucauuagucuuugauagcuuccuugcuucaugguucaauaagaugucacaggcucuuuuuugugugugugcgagacagggucuugucuguugcccaggcuggagugcaguggcacaaucacagcucacugcaaucucugucucccaaguucaagcaauucuccugcuucagccucccaaguagcugggacuacaggugugccaccauggcuggcuaauuuuuguauuuuuaguagagacacgguuuugccauguugcccaggcuggucacaaacucuugggcucaagccauccacuugccuugagcucccaaagugcuggaauuauaggcaugagccacugcgccuggccccaggcucauuuuguacauuuccugccccagucuuggaaucagucauuucucuaaaaugcucugguucuuuuuagcuagaaaauaguaucuagaggcuacaguugggacauuagaaguuuucagugcuacugagcugugauugcaucuaggccuuucaauaaacagaaauagaaaauaaacauuuuuuaagaaaugaaaaaguugugaguucauacugguauuuccaauucaaauguaaggugauaguguuucuauuuauuugauuuuauacuagugucuuguaacucuuuaucuuaugcuggaaaucuuguucucaauaacauuaacaaaaugauguaucugcuagauccuacugaaucugagguccccaggaccaccccagguucagugaugcacuaggacucucagcuguggcagugaaaggauaccagguauggcggcacagggaaaagguacauggggcagagacuggaggaaacaggcgcaggcgucugagugcucucccauuggauacccacaggaaggauuuguggcaaugugugugaaguguuaucuagcagggaagugaguuagagacucagugcccacaucucuuacugaggacugguuacagaagcacccuuggccuagcauguaccaaaauuccagacuuccagaaagcaagcagguguucagcaugaaccuuauuguuuacacaguauaggcguggugagccacucuuaucauuucugggaauugugagaaccaccuggaauccaaguucccagaugccagucaagggccaaccuugcaagcaugcuucucuaagauuagcaauuuauauuaacuuuauucugcucaucuacaauauaccaguuacacuuuuaaaauaacuauauuuuuuacuacuaagacucagaaugaaauuuaagacuucuuugugauucuuuuuuggccuuaaaauaugucuuuguggagauacaaggucaaaauguuguguuuaguaacuauuuuucucuguguaggucucccaucaugagauauaguuugguuaauuugcuucaaucuguuuuuaauuuuuagagauuuuuaaaauuuugauuuaauuuguuguuuuaauuauauaaaacauuuauauacaauauuucucaaagucaaaacuauauaacaagguacauuuacagaaguuuccuuuaaucucauucuccuccacccuauucccuuccuucccacauaguuaacaguuguuauuaguuuaucuuuccuuuguuucuuuuugaaaacaguaacaaaugcauauauauguguaugguguguacauauauauuuauauuccccccuucauuaaauaaaagauagcauacuauuaaacacaguuuugcaacuuucuuuuuucacuuaacauacgcaauauguucuggagauccauauaucuuggauaucacuguuccuggagaugcugcuucuguagcugggaggaugauggggaauuacugauacaauguggaaccuauugaugcaguggagaacuauggugaaggaacaggcuuagggugggugcagggaaggaacaugccaaguucaguuuuaaacagauacuuuaacaugucugggugguucugucaaaaaagccgguggauuuacaaggucucuagcaggaggagugcaugggcugaguguugaccagcaugugggaguugauacgaugucauuugaagccacggcaggggacagggucuccuaaggagagaauguggagggagaugagaagaggaccuaggccagagcuggaggggcuccagcauagagggcacaggcaggggaggagcagccagcaagggugggaaaaccuuggugaacagggauggguucguggccucuagguugucuuguccaucucuuauucugguaucuugagaaggagaucacuauuggcguucuuccacccacaauuguaucgcauuuuaaaaacaucaccucugugcuccugggcucugucccugcagacguggcaugcuauucgguauuauaaauaacaaaugugguuguugguggcugaugaggccugcuaagagucccgagggagggaggugaugagccuucuuguuuuauaggcagagguguguggcuguuuggagagcagggaggcugcucaccuccuguuguguuugaagcccuuagaaguaagccacagaagccuggguuaguucagcaaacuucagaaaaggagccccuuuauuguucucuuuaagauuuucagugggauagugcguuaaagucuuuugaggcagggaguugaugaaggguucaaaaauaugccaucauaccccccuacccacugccauuuagagguuacuuuuggacaacaaccucauguuuuuaaauuuaaauauaguacaugacaucucucauuuuuauuaaucuugcauuuagggaaacaaggcucacacaaguaaauugucuucauaacugaagcuuacuguuuuaacuuuuuuuuuuuuuuuuuagcuuuucaauggaucaguagcaaaaaaauacaguacuguugaucuaacuuuuuacuggcgcaucaggggagcaaauggccccagguuauacaggggguucugucgcuagcucucugugugucuccauaaggcagccuuucucacuuccgaaacuccuaacuagauagaaaggaaacacagcauucugugcauaaacaggauuacaaagagaggguggaugcugagacugugcugcuuagagguugucccuaauagcugagauuuggaaggaguuuggaggggaaagaaggggguuuuaacauggggacgggguacucuuagggagaaagggagcccaugggagugggggcagcuuguaagacacuaggcagccagagggcaguugggagauaccuggaaguggaggguggcaggagguaggagagggggcagaagugagggugggaggacccagagaacagucuugcccucuuugccguuuugcucagggcaaaaucuucccucuugcuuagccuauagaaacaggguuuauuaguggcuuuuugggucagaagauaauauuuuuggcuccagaugaugggaaagccuuugaaaagcaaaagaauguuuccuguucuaguaagccgauuuuuugcaacuugcuuaugacuucaguauuucaauacuuagcagauuauuugaaagcucuuuugggguuaaucagggaggaaaagagggaacacauacaaaugcuucccaccccacccccuuccuuuucauaguaggagcaagagucaauuuguaaaaucaaaaaccaagucccuagaaucguaagccaaaugaaaagguuuucucauuggcaacucauuaaacucagaccuaagaaaacaaacauuuguuugagccugauggaggcgugggccacacuuaauccaagcauuuucuuguaggcuggauucuaaaauagaagauaguagguccuaguaccauuuccaucuaguccagguuagcugguaaguuucaucucucaugccaagucugaucaauugcuugguggccauggugaaaaggauucugggggcugcugcuuugcucuggaggaaagaaauugaucaaugaugucuguuugcugugagcugggauuagagaaugacagugccgguccuuggacuggccaaugauucuccacaaggcugcacauagaaccaucuggggaacuuucaaaggccuagaccacacccagagauucugauucaguuguucucugaagccuuggaucaguauuuucuuuuuauuuauguuuuugagacagggucuugcucuauugccuaggcuggagugcaguggcacaaucguagcucacugcagucucgaccuggacucaagugauccucccguccucugccuccucaguagcugggacuacaggugugcuccaccacaccuggcuaauuuuuaaauaauuuuuuuguagagacacgguuucacuauguugcccaggcuggucuugaacuccugggcucaggugauucucucaccuuggccucccaaagugaugggauuacaggcaugagccagugugcccggcuuggaucaguauuuuuuuaaaguguccaggugauuguaauaugcagccacuacucaagucuuuagauaauuucccucaaacacaaaccaauuuuaggaggacaggauauguucaguucuuagauguguuaaguuugaaauaauagcaaaauguuccgugugggaaaggaaaggcgagcaagaaguugggaauagagaccugacaauuauuuuauuaacagagcauuaugaugccuguaaacccagcacgugggaggcugaggugggcggaucacuugaggucaggaguucaagaccagccuggccaacauggugaaacccugucucuacuaaaaaugcaaaaacuagccaggcgugguaguguguacuuauaaucccaguugcuagagaggcugaggcaggagaaucccuugaacccgggagauggagguugcagugagcugagauugugccacugcacuccagccugggcgacagagcgagacuccaucucaaaaaaaaaaaaaaggaaaccaaacaaauacagcauuauuacuugaaacccaagaaugaguugcugaguuuugcaagggaaaugaagauccaggaaagacgugaacuuggagcauacccaaccuguugaaguaguuuccgugcaauguagauagacugagaaggugcgggugcuguccuagaacccaagagcaggagcgccgcagggccuccggaaguggugggaacugggacuuacugcuccucacuggcaugcccucugccucccuuccugucucccuccugucuuuugcuuuucuaacuaggacccugcuucucugcuugcuggcccuguggugagaugcagcacagccacuaaacacaaccaugccuuccugcuggucucaguuccagcauccccagggaaggaacuguggcugacccagcuugggacagcuguggccaguggaggggaggggaggguucuguggagugaccucugagugaggaugggaagguccauucccacagggggacugcuaggcagacaaagcuggggucucccuuucucucccucucucaagugacaggcagagcagugggcaggagaccaggagaguguggccucccugaaguccaccgagugguucauggagagcacaugugacaccaguucccuggagaggauuggggaaagccagccuagucugacaccaccacuguguuccagcugccguccuucagaguuggguuucaguagaagaaaguucucaauagggaguuccuggcuuucuagggaaguccugggauagguuugaggggucugugaucccccucaaauuguguacaagaaugugagguuuuauaugccuaggcacauuuucugggggagaugguccauagccucucuacauggagugcagugggaagugggggacagguuucuucucaagguggggagccugucuuccuccuccccauaacccuccuccaagccucuuccggaucgauuucuacacagaguguugauucagccagauaaggugcacgaagguaacuaagcaaguggguguagacuuugaguucagcaacuuguguggcagauagucagucauacacgguagugaaucagaaacucuccuaguuucaguguugacuauucucaucuguucauaugcuuauagugcaucucgucagcucacagccagcugccugcuucuagaaggcagguccuuucacuucuacucugccauguuuguugauugccaccgucucauauuaguggggacucuuccuguugcaaguucagaaacagcuccagcagcuuccccgaauggaaacaguauuggcucuuggaacugggaauuucaaaggacagcuggauuuagggguucaaggggucuccagggcuucaugugucucucucucuccuggcuuuccugggagugcuggcuuccuuccuaggcccuuguucuguguugggaaagauggcugcagcagccacagucagugcccuuaucagucgggauugacaggugagagaagccauuucucugccucuccucaccuucugagucucauggaaggccucuccuuggccacauacaccuugucucacaggugggaagcaggaaugagugcugucucuggccaggccacauuuagcugccuacucuugugaccccagugacugagagucccccagacccccaugggauagggaaagggcaggguccccauggaaaagaggugcugggaagacagacagccgguggccagcauugcgaucuaguggaggacucgccacgggcgauggugagagugguggcuuucaauaugaugcccguggagacuucacaaccaaccagaaagcccugcaguguuuagaccccugaugauguuuuggcucaucaguauggugagccaccugcaccuacugcaccacagguggcucauuccuguggugcaguaggacaguggccuagaaggucaggacucuucuggaaaauuuugcacaagggucuugauuuuaaacgaggccgcuaguugccagugaggccugccguaaauaaauaaugagccccaggcaagcauccacccauucucaacaccucaggacacagacucacagaagcaacugugcauuucugcucugugugguuuuaaagcuugggaggagguugcaguugaauugagaggcaggcuguuuuuuacuuaaugacccguucuggagagauugccgugugaugaggguauaaacaugcuuccaccagccuguggucuggagauguguaccgaccgguucuugggagagacggcuggacacacaaggagccacagagcagccaguggggagggccagcauagucgugcugaauugugucuggaaugagcucccaaggcuguucuuucuaaucacaguucuccccgccugccaagcgcauccuggacuccgugucuccguuugccuuguugaguccacauggauggccuuccuugcucucuguuucagccaguccuaucuuuccucaaggccacugcuaguuucaucucugcgaggccuucucagcucccacccugucucaggcccucauggcccgcugggaugggcagcaccuucagcguuaagcagacuggucugagugcugaccugcuuuuagucugccuccgucaucagaagaggauauuccugccuaacuccauuguucuuagagggucaugcaagauaaggugcacgaagaugccugaguauagcaccugggccauuuucaaggaaagaguggccugcguagaaugacauuuuguccugauuuacaggacuaaauccacauugaacuguagaguggaaaucauaaaauucaaugcacuuuucaugcuggaagggauaugauguauuguggcacacauuugauuauuuggaucugaugaauagcagcaauuuucuggccugguaagcgcugcagagcugcuucauuauugauggggccuguguccacagaggacgccacugugaacccaggagccaccuggccucgggaguuuucuuuuauaugugacagugugauugcugaggaaacuugaggcucgcuugagaggaggcgcagugcucccagauuuaaaggcagggcugucggcuuuguagucugccgucuguguggcugguacgggcagcguacauuugaggagaaaugaaaaggcagcccuuaauugagagucauucuugucagugaagaacuuggagcuacaggcccuguguggcugggaccccagggcccaggucaugugggucacggccgccuuugcuucccugcagcuugcauggggccgucaccuggccucagggagccugaguggccuugccaguggaguguggcucgugguggcuggcucaccagggcgauggagaggcucggugagcauccacauggcacacagccacuaagugugcguucucaucuucauuccccguggcacagugcccacauguacugggugcagguagagauacagaggaggaaagggagcagaguacugggagacacuggcuggccaguaucucagggugacaagaguaggcugcacgacggggccugccuggagacaggggccaagaccgagcaagaggccuggagccccugcugggugucuuggaauuuaucucacacaaaggggaaccagcaaaguuuuugaaggaggaaacagacacgauugggauuguuguugucauuguuuuuuuuauuuguuuguuuguuuuuguuuugagcgaaacuuuuuuugaguuuugcucuuguugcccaggcuggagugcaauggcaugaucucggcucacggcagcccccaccuccuggguucaagugauucuccugccucagccuccugaguagcugggauuacaggcaugcaccaccacgccuggcuaauuuuguauuuuuaauagagauggcauuucuccauguuggucaggcuggucuugaacucccgaccucaggugauccaccugccuuggcuucccaaagugcugggauuacgggcgugagccaccgcgcccggccuguugucauuguuuuaggaaaaucgacucugaaaggaacguaaaguaaacucugacgagcauggggagguagaggcacgggcaggagagucugugggaggcagaugcaaccaguggggccggcaggggaccugggucugaucugggcaguggaguguguccagaggggacuggcugggucuagagcccguuggaaagcggaauggacagaccuuggggacagguuggaugcugagaacucauaaaugacuuggagguaucuagcuuggguaacugggugcgugacggcucuaaaagcugagguagggaagagaggaggaggucuggggugaggaggagacagaucaagcauucagaugacucgauaacuguaauauguacacacacccacagaagacucccuucagcuguaaaaaaucaagcgugaucuggagcacaaacccacuuuucugauugcuguagggacuuuagucacaaacaagggguuguaggugacccauugacagauagguucucagaggagcuguacuuaccauuccagaggcaccuugugguucugggggcugcuaaguagagaguagauuucauaguuaacucagauucaacuuauuccuaccccugagggccccaggaaaccugggagaggcuggaccguguacccaugaagagguuaguuucaaaucuugggucugcuacucaccagcuaaggccuuaggcaagucauaugaccugagugucuguuccuuuguuuauaaauugggccucauuauggcacuuugugaggccgucauguccagacacauaacacagggucuggcauauuauaaacaauaaauaauuagcagcuguuguggcucuuguuuuuuagagagggaaucucucucuguugcccaggcuggaguguaguagcuauuuacagacacagucauagcgcacuacagccucaaauucuugggcuuuagugauccuccugucucaaccucucgaguagcugggaggacaagcaugugccaccacgcccagcuguuguuauuauuggcagcuaugcuuaaggcauaauuuaggccaggguauguauauucgguuuuaagucuguucauauccucugugaucauggaaaagugaggccugguuuuaagugcuguauuuucaugggaauaaacaagaaugaaguucucaugguuacugggagaccuuggcuguucuuucauuucauucauucauucacucauucauugauucagcaacaguugaagcuaucccaaagugcucaugggcuaauaggggagacuaacaugaaaacauguaacuggcugggcgcgguggcucacgccuguaaucccagcacuuugggaggccgaaucgggcagaucacgaggucaggagaucgagaccaucuuggcuaacauggugaaaccccgucucuacuaaaaacauaaaaauuagccaguagcgggugccuguagccccagcuacucgggaggcugaggcaggagaauggcaugaacccaggaggcggaacuugcaaugagccgagaucgagccacugcacuccagccugggcgacagagcgagacuccgucucaaaaaaaaacaaagaaaacauguaacuaugggaaaauaauaguggcauuaugggcugggcgcaguggcucacgccuguaaucccagcacugugggaggcugaggcggguggaucacuggagguuaggaguuugagaccagcuuggccaacaugauaaaaccccaucucuacuaaaaauauaaaaaauuagcugugcgugguggcgggugccuguaauucuagcuacucaggaggcugaggcaggagaaucacuugaaccuggaaggcggagguugcaaugagcuaauaucgagccacugcacuccagccugggcaaaagagugagaccuugucuuaaaaagaaugguggcauuauaagguuccugggugccuaggggcccgaggagggaggaggggcugcccccagcuggaaggaggagcagggaaggaaggcuagacagugaguaggaguguauucauggacagggccaaaccaugggagcaguuugccggguggccaaggaaacagguauuccuguugaugaaggugaccagcggaagcucuggggccugacucagugugagggaugaagaggagcccaugugaggcuggagagguggccuuucuuagaugccauuccagagacagccacuggaagcuuuaagguggaaggugcaguggucagaccugcacuuuagaauaguuccuuucgugggugcaugaggaauggacagagacagcaggcacuuugcuuagcugugggcggaacugaagggggaauuggaugcuggagagaguagcagaaucaagagguagagggggucaugucagcaggacauggugacccacuggacaguggggagcagagagagggugagguuaccgggucucugguugcuccaccagugggaggagggccgggccuucugggucugggacaguuaaguuggaggugccuuggagaugccaguccugauugucuggcagacagcuggaucaagggagaggucugggaggugccagaaugguugaggcucuagagacagggccuguggagugagggaggcacuggggcggcaacugggucucacugucccuguggucucugaacugagccccacugaaacuggaggagcccccagccuugagcucagaaggcagacuccuuccuagagauccaggcaggccuugcaaauuuuguuuuguuuuguuuuggccaaguuacauaaacagaguagggggaccuucagaucauuuugauuuuuggugggaggaggcucagcaggccgaaggaauccagcacugcagugagaggccuggcuggggaggggaagcccuccaguuaucuugggacaaucacuccuugggggccugggaccuggcuggcucuucauaucugguuaucucgccuggcugaugggagacgauguuggccgauaggagggagcugacaggccucuggaucagauccgaggcagggacugcccuucccugcaugggcccuccucuucuguagggugggcugaggcuugggccacgggccaauggggcaagcagggaaggucagggaguaaagugagcuggaagccgggguugggaaaugaaacacagagggguauuuuucucaucuggaaguguccccccucccaggagucuuagucugcuucuuauuuucccauuucucaauaaagaacaugggcacugagaaacauuucccaaucauagugcugggggcggcagggugugggggccacggucggcaccugaaaaggggcagcgccuccucagccccucacugccaugagggaaugcagggccauugucaccggaugguuaguuucaagagaaucuaggaauccagauuucaugggaaaucucccaauuggcuuaaauuuuuaaauaaacacugccggccagaugaagucuguggccuggacgaggccugugggcugugguuggcguucucugggcuagcccggccucucugacguccguccuuucuggccacggcacacugcaaguuaucacccagaggaggagaggacacuagauaggagcacacugagccuauuccagauacuucucugacaugagccugaguggcugggccaagcugugucccuucccuggagucucccuuccuuaucagcacaaugaacgccagggcuagaucuguggguuucaaccuuucguuccuuagcagcagaacuuuguuucauuucaaucuuacaagggacaaaucacaguguaugaaauagauugaaaaucagagcugcuccugucgcccagggagucuggaauucugccccgaggcugccucugcccucccccacagaggcaccucugacaggcuccgcagaacacagugugggacugcccaccugccggcuggcccucugcaccccucccaguccuggcauucuguggguugaaugggaggacaagaauggcagccagaggagggcaagccacagugggucugccccauagccagcuccucgcccacauuuuguccagucccuggcacgaggugaucggccagucacugggugcagcuggcacuuccugggugcuuuccacguaguuuugccuccucacaucagcccuguaaggcggguguggcuauuuccauuucacaggugaguaaaccaagacacagaaaggggaagugaguuucacacaaggucaguuggcuggaaagggaaggaucccagguucuaccugggcgucugagaccccacaagcugcucccuccccguggggcuuccuuuauucuucacugagagccacgaugcuccggggcagucccacauccgugugggugguaggucccgggaaugacaguuuccaucucuuguguuucuguggcaugcuucuuugcuuucagaugugaucuccuuuugcuggcgucaggcuugauccaucuaagcaggacucuccuuuuuaucaccucacaggaggcugaaccgucugagcccagaagugcugaggugacgaggaagcccaaggcugcuguuccuucugugaacaagaggcccaagaaagagacuaagaagaagcgguagaagaggaggccugaggagcugggcgggcagggagagggucuuggggacagcccuccugggaaucuacauuguguucccccgcauuccaggcucagggucugaggaggcugugacgcccuaugaccgcagagaucuagacagucguaacaguccccaggcuccagcugggcaauccaccacuuccucuuccuucugcuucugugacgguuuagagucaagggggcugaaacacacugugagcauagacuguauuagguuuguucagaagccgggucagcucacagagucacauuuucuugcuuagucaugugucccuccuugaguugcccccuccuuguggguuuacacuacauuugggagucauugucuaaugcugacaagcacacccucucccauuauuugugcacuacagaucuccuccugaucagucaccuuuguugcugcuguguagacagagccaggccucaccuguuuguuuaggccaagaugccauggacaugcagcguuagugaucccacuagcugugacagccaggcccagaaaaugccuggcgugagagccagcagacagccaggccaggguaggcagugccugcuucugcuccaucaggugcaggggauuuggcugaaggcgugcauauuuccugggcacaaacuuccugag

SEQ ID NO: 13496 - RNA, 1576 nt, Homo sapiens
gucuuauugaaacaagacuggaagccuuuuaauagucgaucaauaagcaacaacuaaauaaaucauagcacaaucaguucugguugccagcggccagcugaaaggggcaguggagccagcugcggcaggugacacgcgacaugaggagagucccguaaggugcccugagcucaggagcagcaccuccaguguguacaccaccacaucuaugcaagcaaacaaaagcaacaauagaacacaggacauguuucaaugcgcauaggagaacauuuuggaucaacagcaaaugccuaacagcagcugccucuaaaguggggaaggggccugaggucaggcuggggaggccaguagagacuucuuuaccuaaaaugcucuaauuuuauuuaaaggaaaauguauucauguauuacuuguauaauuaaaauuuaauucaaaaauucuaauucauuuucagccaauuagcucugauuuacaugugugcuguguuuucauuugugugcccagggacaaagcacauuugcugugugugugucugugaaugaagcauagugauuaguaaacugauuaaaauuuggaaagcaaaaugaaaaaagggaaaguuuuuccacucacaaaagcaacaaaacuaauaagguuuucaggaauaaaccuauuaagaacugugaaaaaucuuuaugacaaaagcaaccaaccuuuauuaaaaggcauuaaaaacaaaacaaaacaaaacaaauacaauucugauuaaaaagagacagacaccauguccacagaugggaagaacuuauauucuaaagauguuaauuuccccuucaaugcaauucuucucaaacuuccaacagacauuuuguucacagaacuuugacaagcugauuauaaaauguaccugaaaaaguaaaugugcaauaugaccaagacaauuuuaaaaaagaauaaggggcugcgcacgguggcucaugccuauaaucccagcaccuugggaggccgagauggguggaucacuugaggucaggaguuugagacuagccuggccaacauggugaaacccuaucugcaccaaaaaauacaaaaauuagccgggcaugguggcgcgugccuguagucccagcuacucaggaggcugaggcaggagaaucacuugaaccugggaggcggagguugcagugagcggagacugcaccacugaaccccagccugggcggcagagcaagacuccgucucaaaaagaaaaaaaaggaauaaaggccuugggggaaggguggagugcuuaucuuaucaagccauaagacacuuuauuaagcuuugcucauuaauauguacuauuggcucagaaauagacaaauagaucaacagaaccggagucuagacagggaauugagagaaaagaugguguuggaacaauaaauggugcuuagcaaacuggauaucugcaaaaagagcaaauuagagcucugugucacaccauacaugaaaacacaucucagauggguuaaagauuuaaacauuucaaacaacuauagacguuuuagaugcaaacacacaauguauauacacugcgguggggaccugcuuucau

SEQ ID NO: 13497 - RNA, 15507 nt, Homo sapiens
aagguacucuggcgccaaagacucagccccuccaugcuucccccugccccccaccaacuccgaaauccaacaccacgacccaaauggacugcagccacauaaaaccacaaaguaaaguuuauaaagcuuuauuaaacauuucaaacagcugugcaacgaacacaccaaauaaaagcucuagaauagcaguccagacguuucacaaguauggccucacagucccauucccuagauggacugccuccaguucuguucucugccuggcccaucucucuuuccccucaggcaagagagagauggauggaucagacugaaaggacaggcaugcugaucuccagcaggcaggggccaggagaaagucucguuugccaacacuuguuacugaagcgcagaaaaagcagcaagugacagucacaaagucuuccuggguauucuucauaauguacagucuauaugcgcaggaacgaagaagcuccuggcgggaggaugauggccacugcuccccucugucuugucugaaccaccucggaguccagugugcuggucacucugcaauccccaugcuaaauaaaaacuguagcggcaccuaccauauauagcuagcuauugcuaaaccucaaaaucagaccacguucgauaaagcuucuuuaaaaggaauauacacauguauuuguacacacacacacacagggcacaccaaaaaauauccaaacaucuaucaaggggaucaaggccguuacgaaacacacagguacucucccacucacucagcuggggacugcuagaacuacgugaacacaccauacuucaaugcugcagagcaugcacgggagacacaaugaggcccccuccuugggacaguugagaaaggcaggaggaagggcaaaggaagugaggcugggcgggaaagcuugagcccagacacccaggugaaagagcaacaucuaucuguugcuuccuuucuuaaaaaugaaguggagaaaauacugaagauuuguggacaacuaacagucaagacauguuucugucuagccugcugaacaaggaaagaaggaugaaaaagcgaggcucucgggcgucagcaaucucuucaaauucgagauaagugcaaaaaugagcccugucuuggacagguacuccccaaaaaaggaaaaggguagaagagaaauaaagggaaaccagaagagggacugaggagucaguaacauucugggaaggaaggagacccugacaaggaggggucacagaggugacaaugagacuggcauuuuaucugccccaggucacauuggggcagcugaccaggauggacccagacuccucacaguaaugaggcgagagggguggucaugcggccagccaggaccuagauggggacagaacacacacaaccacaagaccacccacgacuauaggacuuuacaauaaaagcaccggucagugccauuauucacauuguaaggauaaaacaucacaggccaaaaaggcgccgucaggaaugugacacccgcgaggcugcgggauuugaaacuccaaugcuuuaugaccuaugucaaugccuccccucccgucuucugcuuccuuggaaagcuaacagggcaggccguuaggugcccacaacgccgggaucaugcgccgauucuggaagcggggaaucggagcagugguacaggaaacaguuuccccagcagcuauagcagauaaggaacagggcugccaggaaaaccaaggcacaaauugugcaaggcuuccguuccaggaggaagcugagcagguagaagcccaugaacauggaguggcugaaccacagggcgggguugaggggcuuggggaugaggaggacgggcagcagccacuggaggcaauacaugaucucugccgggcagggccuucaccaaggcugccgggcaccgcugcaggaaccgaccuaaugggagccagcgggcgcaggcggcugcccuccgcuuucuucaacccucacucuccaggagcugagccgcugugcucucuggcugucagcccgggaucaccaaggcagcagggauccugaagagaaaagucaacacaacagacaaacagacaaagaacagacagacagacaaaaaaaaaaaaaaaaaaagaaaaaaaaaaaaaaaacaggaacagaauguauacuuauuugggaaaauggaucaugguuaacaacagcaaaugugaaaugcccuuuccucccugcccacccgugaaaguucuacuccucuccaagucacuaauucgggaagcuuccugggaugucuccccggggcuucuccugggggaucggggagagggcucuuuggcacgguuucacacagugggcuggcuuugccugggcccugcccagcagagaucauguaucgccuccuggggcugcagcccguccucaaggggcccagaccucacaauaccgcccagugguugccaaaggacgaccaagggcucccugcugugcccccacgugguaaggacaggguucuguaucuagcaucucucacagccauaggugcucaggcacuaagugcagaguuaaagcuguuagcggggcacugccggccaccagaccacaggcaaaggauccugaggcagcuacagccucgaaauauuuuaagauggcagccuaggcuaagcuugccuuuuucaaacagcccagcgucacuuugccagaaucugccaacuucuccgaaagucaauguagaaaaaaagucacuaugcuacuuuguccaaacugaacucguuuggaucauuacaccuccaucugcugcuggcacuguauagaaccugaccucugggagcuuuuaaugaaaauuaauuuucuauccacauaggggcaaaugccaguuggucccugggccaggcagcuugcuggaaagaggugcuuucggcuggcuaccggugcgcggggaccacacucacaaaccgcauuccggucuucccgcccgaaaauccgcgcugugcgagggacccacaagacuggcggucuaaaagggacccgccucacuuggaaacggggcugcgguagccacaacccuccgguagcgguagcguaaccccguucggugauccagccgcacagcgcaacggguacaaagaaccccacuggcuaaggccgaccuaccagggcuugggggaggggagcggaagacugaggucgaaacgaccuguccagcagaaaacuauccccaagcauauuccaaccacuucuccguagagcucauuccuuccgugcauacgaagggcgccaauccuuccuguaucccuccuacagauaccgggugacuacugcuuuugcgcccaaagcgcagugcucuggcucagcucccuacaguagcgaccuccaccgcagauucucaucuccucgcuaccguaagagagauguaaagaaucagacggguuacgcgcucaggcacccucaugaagcagaggaccugggcuuaaaacucauucaguaucaggaaaagagcgccgagcacgggccuauuaugccaaagcuucugaaaggggcaccacguuuuuugcucuauggggcagaugaccccucccuaauuucgguuuuccauccauccccaagguaggcuuuggaguggcaccggagacugagcucaaauuugcaggccagggacuggggagaagggcgccacacuaagagaccugcacccccauucucgcccuguacucuacccagagucgugguaccccuccauuuuaaagcaaaauccaaaagcaagcacggcggaaucuucuggaagggggcuaagauggaacucaggaggcgggggucgguauggaaagagcagauggauuauuuuuuuccucuccuggcgaaugaggagcgcccccagccaccccuccucauaaacaccccccaaggcgcgcaugcgcacuuagguggcgggcggguacuuaaggcgcggccaccgcggcugcggcagugcgcccaacagcggacuccgagaccagcggaucucggcaaacccucuuucucgaccacccaccuaccauucuuggaaccauggcggcaguggcggcggccucggcugaacugcucaucaucggcugguacaucuuccgcgugcugcugcagguaagucugacgggguuucgggugggagaggguucccaacucgcgccccuagaacccgcaagacugcgucgcgauugccgcuucccggacccguccuauuccgauugccgcgauccuugccugcccaagugccgcugccggcaccgcgcgcccccugcccauucccugcgccguccuccucgcgcugacccucccuagugcgcccgcgccugccagggaacaaagacucggggcgcggcgggcgaccgcugcggacgaucacccaggcauuuagcgaccuacgcgguaagaaaaacccgcuacacccggacucgaccccaggagggaggcggggcacuacuguguugaaagacuuuacagcucgcagagugaaaauuuuccaccuuaaaaaauugcgcauugcggagaaauuuuauuuaaaaaaacauauagcgcuugcggggguggaacaaaaaauaaguuagaaaaaggcacuucucagaaaaaauaaaaauuacuucgcaaaaaaaaaaaacccuacaacgaauuagagaaaaaguaguucacaggaaaacagaaaaacgcgcauugcaggaaaaauaaaucggagaaaagcacuuggcagaaaaaaaugcauuagauuaaaaacgcacugcagaaaaaaauuagacaagggagcuaacggaaaaaaauggaucgggcaaaaacgcuuuaaagaaaaaaauuagaggaaaaagccccucgagagaaaaauagaaggggaaaaaaagcacuuccaaaaaaggacaauugcuuuacaaaaaaaaaaauaauaauaaaaaaaauaaaaaagaggcaaaagcgcuugguguaaaaagagauaaaucagaagaaagcgcuuugcccauaaaaucauuuacccuaaaagcucccuuugcaggaagaauucccugcuaaaggaauccuuugccaaaggaaucgcauauuuccuucaagguguuccuggaaugcugcauuuacuggguaggauucgcuuuucgaaauccuccagggacacagcccauugcgagaagugagguauaccuaaguuguggguccaaucagcuugccgccaugcagcucucagcacaguuggaaaagcuccagcugcccugacucguggacaagcugcgcccgcgcccgccucuccagccuacgcuggaugggcgggcggggcaggggguggggcgggggugggcacggcagcaccacagacaugcugugggugcucuccacuaaggguggguccuggguuucucgucgcagguguucagguacucccugcagaagcuggcauacacggugucgcggaccgggcggcagguguugggggagcgcaggcagcgagcccccaacugaggccccagcucccagcccugggcggccguaucaucaggugcuccugugcaucucggccagcacgggagccagugccgcgcaggaaugugggguccccuguguucccucgccagaggagcacuuggcaaggucagugaggggccaguagacccccggagaagcaguaccgacaaugacgaagauaccagaucccuucccaaccccuuugcaccggucccacuaaggggcagggucgagagaggaggggggauagggggagcagaccccugagaucugggcauaggcaccgcauucugaucuggacaaagucgggacagcaccaucccagccccgaagccagggccaugccagcaggccccaccauggaaaucaaaacaccgcaccagccagcagaauggacauucugacaucgccagccgacgcccugaaucuuggugcagcaccaaccgcgugccuguguggcgggacuggagggcacaguugaggaaggagggugguuaagaaauacaguggggcccucucgcugucccuugcccagggcacuugcauuccagccucgcugcauuugcucucucgauuccccuuuccuccucacugccucccaagcccacccuacuccaaaauaaugugucacuugauuuggaacuauucaagcaguaaaaguaaaugaaucccaccuuuacuaaaacacuuucucugaaccccccuugccccucacugaucuugcuuuucccuggucucaugcaguuguggucaauauugugguaaucgcuaauuguacugauuguuuaagugugcauuaguugugucuccccagcuagauuguaagcuccuggaggacagggaccaccucuacaaaaaauaaaaaaaguaccuccccugucucgcacagugucccaggacccugcggugcaguagaggcgcaccaaaacuuugucucuugugauuucuuuagcggcaucaacauacacuucuaagacucagcugaugugcccacuguggaacaggcacacugcuugggggagggaggaaaaggagggccaucaaaauugcaauaagcugggccccucacacacccaaccccaucucaaugcuguccugugauaaaggaccaucucccccucuccccaaagagaaaggcugacaucuucacuugugguccuggaauaagggaccacuucccccuccccaaagggauaggugcuuuacuuguggucuuaggauaaggggccaaagcaaguaucacuuugggaaagaugagaggaggggaaaaaggugggaguagcccuccaaagagguacuagggaccaagggggugauuucagaacacaaagccuuacuucaggucuccauccaggagccccaaagaaaugaguagugggcaggguggacaguggcuuagacaaugaguaugggauaagaggugcagcguggcgccuucuucacccagcuuaaugcugcaggccccacauccaccaggaccacuacaaagacaaucugccuggccuugcuacucugcagggucuccuggccccaccucaccccagaaaccucucuccccaauacuggguuucugcuuuucccagcaccagccuccguauucuuaggaaugcuuaccagguccguggcccugggcucuccccugccaucacgucagggugggcagugcucggccucggacuugucuuccucucccacuccccagugagucagggcucuuucuacacggggucagcugacugucucaccaaauggcccugccgccuguucagccuugucucuggcuuuaugugucccugucacuacacaccuguugcugggucaacaccaagggagggaguuggagggccauaaaucucucuuccugccacuucuucgaaucccuuagucacagcugucacaaauacuucugaagcacaaaguaccuugcccccuuaagccugaucauguuucccuccccuaagcaagcccuuaaguuucuuagcccaaucaccagcaccucuaaaggcaucuaaaacuucauucgguaucagagaauuauagggguggggaggugcagaucccgguucuggucuugacuuugccaucaaucagccuagggaaccuggacaugucaccuuguacccuucaucuccaguuucccucucgaagagggccuuugagaugccagugaacccuaacacgcuagaaacugccauagcaguggcaaucaggacucaucaggacuugaagaggaugugcaaucugagacuucaucuuucuuaggcuggguggcuauagcugcuaccauagccugaaggugaggcaggucuccucucgccccagugugacucaucagcaggcaaugcccacaccuccucccuucugaaccccauaucuuggcaggccucaaaacugggaguuucugugguuuuccacacuaaacccacagaaucaugaacauaccaacauguguucuccaugaaggcugacccucccuucggagcuuuugagggguaugcccauagccccacugcccuucuugaugcucuaaccucagcccaagugacaagguagcagauuucagggagguaggccaaagcagcaugguaagagcuggcugcucuggacacagcaccucuugugcccccacuuagaggacaagaggcuccugguagccccagagcuuuccauaucaucuuggcaaagcccuuuuccuccauccguccaucagcagggcugugaguguggcaaggugagaugacagauuuccaggcaagggcugcccugguggccugcaccugcacgugugggcuucaaugugcaauguccacuccccauuugcauccuccacccacaaaacuucauguucuggcagcaaacuuaacccaccagagaagacagugcauucacuuuccauccagugcaaugccaugcaaugccuagaugguccaaacacaccuuguuuauaaaauuuuuuccacaaacuauaccauuaaacauuuuauucugauagagagcaaugcgaagaauugaaaaugacuaguguuuuacugcacagcccuuagucacagugcugaacguccccuuugccuaaaccaucauugcucccagaagacuuugcccccacaaggccaaggacagagcagaucgguugggaaggaauugggaauagcucugugggacuccagcaacaggugagagacccuugagacuaauacuccaggauguuaguuucuuagccuaacgaacugaaguuaaguccagagguguuuagguaccaugacuuuuaggggugcagggugcuaugugacacuguuaccuuuaucuguggaauauuugaauugucacugaaggaagggaugucugcugucagggaagggcaggggcaaguuccuugagcuugggcaacggauuacuguuggaucggggagcagguuugcugugagccauuuacuagauaucuauuuugaaauguguaucuccucaggagccaacaccccaaagggagauucugaauuugcaguuaacuucccccccccaccgcccccacccccccucagagauuuaaacgugugcacucaugcacauacacaaaacacuagucaaacaacaaucucuuuuccccccgguaaccucugacuuccucuauaugccccagagacacguugucaccaucuucccugggagugauccuguuuauccuccccuccccgacuugcccucccacagggcccaugcaugccccagcaggauccagauuccugagcauuuccagagcaggaagucagagaggcaggcaacgcgugguucuugguauaucgcacagggacaggcuugaaauggaaugcauguguuucaaagauaggagaacaacaacaaaaaaagacagucuaacccagauuccucuuugaaacaacauauuacagauuaaagguuaaacuguuuuuggcagcaacucuaacaagacuaauuucagauauggaauugaccuggucacuggaaaccgaccaggcuucccgugaucaaaucuuuuaacagauuugcuugacauuaauuagucucugauuuaaaacaaacaagcaaacaagaucuaacacuuggcauuagcacuuaagcuggaacuuuuuuuuggucccagcuuugguguugccguccagaaggcugacgggaugacuggaccaugucaggcagggcagagaagccguccccaacacaccaguucccugaaagggauagacgauccaaaccuauaaacagaaaggcuguuucuuuccgaggacagaccccagucucccaacauucggcgaugaaaugggacacggaggccuggaaggaaacuaaaggagauuuggaaaggggaaggaaaaaacaacugucccccaucccccaugcuuccuuuccaggccauuagugcgccaggcauuccguuccuucagcugcccuugagggccacuccccacgucuauagaaggaaagggaagggauguccacccuugauguaaaguuggagggaguaagaagcgcccgcgacucuuagcagagcgucagccuaucaccccagacaccgaagcggagccucaggagacccucucuccccucacccccacguccccccaccucccccccaaaaaagcaacuaaagcaacgcaacuaaacugauggggacagaaugacaggccucucacaagcugggcacccugccguggaacccggggcugcagagaugguggucgcgcucccagccccgugcccccggcucugccugucucauccugcaagggcgcugaccuuggacaaggccagagccagcacccaggaguacuaugacccaccuccgggcugggaagggaccccccaaggcccaggcuagguccaaucacggcaaucaccugaagccggacaggggcgcccugccuucccgggguaugcggaaggaaaaccccagugacggggacccggcgacgccuaaggugacccagaagggacaauauggcggcgcggccgcauggagggccucucaucccgccccaagcagguugacgccacgguaccugcaagcccugccauggcgccgccgccacugucgccgucugccgcagccugccuccaccucagcucgccaccgacgccgcaggaagccggggagacgcccccuuagucuucuagucgagccggccgaggacccauccugggaucgggcugucuaccgcaaacgccugaucacaagguccgaagugggggcucauccucgccccauuucccguaaauaucagccacagaccaccuuugaggacuuuguaugcacuuuuacaaaacucugggagccccgagaucuucaagcccgaauaauuuuuaucaggcgcaguguggacagccccgaagcgcggccggguccccucaugcauaugcagcagauugugauccuuacuccgugagcgcugggcgggccggguuguguucauguuggugaacccgcuucguucuugcccgcguggaugguccguggacuccgggaaaaccuucucguggcucaaaguccacccccucccuagcguuucaucaugcagccaaggcucaggagcugaaagguccgggcucagaacuugggacugccuugggucaggccucggcucccccacuugccccguaccuugggccagcgagccccucgcccaccccgacccggcuucuguugaaaugcccaccuuagggcuuuuaugaggcuugaaugaguccguguagucauuuauuagcuaauuaagcauauuccuugggcgcuuacuguacccaagcgcagugcuaagggcagguagagucgguaaccugggucugucccugaccucaaggcacugccagucuaauggcggguaggcggggagacagucauauaaucacuguauauuagugacuuuaaucaauacauaauuacacaucaugggaagugcugugagaagaaguagagaguguuaggagaaauuaauggaguacuaauguagggaaaggguggaaccuccuugggaagauggcauuuagguugagaaacaaaggacgauuaggguaagagugagaggggaaauguucuaggcagaaagaacauuugucccagaucuggagcugggaagcggcagaguuggggugaggugagcacagaagaaaacaggucagcuacauacugaauuuggcuuuucucuugagagucagggaagccauuuucaucaggaagaggauagcaaauuaggauuucugaaaggccacccaggccgcauggcuuggaaagcacucaggaguggguguaggcagaccaguuaggaggugguugcagcuuuccagacaaaagccaaugcugacucagacagggugguagcuuggggaggugaagggaaggguggaagauuggacuuggguggauguggaggcauuggcaauaacuccucgcuagguuuuagccuugaguaaaugaaaggguaaaagauuccuugaccaagacaauaaagccugaaagaggaacggacugagggggaagaucaaguucggcuuugagaaguuaaguuugaaaugucggggcaacaugcaggcagagagggugaguaggcagguuuaugugacacagaagcugcgaacggaggcuggggcaggagauacauauuugggggccaucaauacaaaggucauggugcugggugagaacgcaagugaaagaagguggagagaaaagaagaggaggauccgggaaaggagacuaagaagcaguggccagugggguagaaagaggaccaagugaguguggguccuagagaggagguuucaggaaggagggagugcucaguggggcugaugcuguugagaacagaaauggagccguugggguuugggaauaaagaagguugguggacuguaucuuuuauguugcaaguuaaacacacaacuacaucaaguggcuuaaaaaaauaaguagccugccacucaguggcuaggcagugucaucaaggacugagguucauuuuaucuucuguccuugugcugguuuaugcucauggccacaagauggcuauccaguuccugaggucacauccaaagcaaggagauguccauuucuccuccagcugagacucaaaacaggccugaauguggccucccaccauccugcugcuuacaggcuaaaggaucaaugcauccauggcagccacacccaguauccaacacugaaugacaagaggagucuuguaguggaagcucuuguuuagaaaaagagagagcuggcuuugcagaugccgcugggauccccauacuaucagccauggucagccccaccuuguucuuugacaucacugucgaugacgcgcccuuaggccccuacuccuucgagcuguuugcagacaagauuccaaagacagcagaaaacuuucgugcugugagcacuggagagaaaggauuugguuaaaagguuuccugcuuucacagaauuauuccaggauuuauaugucaggguggugacuucacaugccauaauggcacugguggcaaguccaucuguggggagaaaucugaugaugagaacuucauccuaaagcauacagguccuggcaucuuguccgugguaaaugcuggacccaacacaaacgguucccaguuugucaucugcacugccaagacugagugguuggauggcaagcauguagucuuuggcaaggugaaagaagaaagaaggcaugaagaucguggaggccauggagcgcuuuggguccaggaauggcaagaccagcaagaagaucaccauugcugacuguagacaacuccaauaaguuugacuuguguuuuaucuucaccaccagaccauuccuucuguagcucaggagagcacccuuccaccccauuugcucccaguauccuagaaucuuugugcucucgcugcaguucccuuuggguuucauguuuuccuuguucccuuccaugcccagguggauugcagaguuuaugauuaugaaauaaaaacuaacaaaaaaagaaaaagagagcugaauguugagaggcuguggagcaacaaauucuugcagugcugacggcagagcaaauugguacagccacuuuggaaaaccagcaucuacaaaaucuaaacauacaccuaugcugugaucuagaauuuccacuccuagguauguacccgagagaaaugagugccuauguuuacauggagacuugugcaagaauguucauagcagacuuauucauagcucaaauuggaaauaguucaauguccaucacuggagaauggauaaauuguggcauguucaugcaauggaauacuguguuuuacauauaaaagaacaaacuacuguuacauguaauagcaccaguuaaucucacauauaguauguggacuaaaagaagccagauacaaaacaguacauaccauaugaauccauucauauaaagcucaacuaaucuauaggguuagaaaucaaaaugguaguuaccugggucaggucaggaguagggaugggaaaggagcaagaggagcuuuucugggaugcuggaaggauuauaucuucuucuggcuggugauuauguaagugaaaauucaucaaguaaaaauucaccauaagacuaggggacuucgggaggcagaggcugcagugagccaagaucgugccacugcucuccagucugggcgacagaaugagacccuguuucgggggaaaaagaaagaaagaaagaaaaaagacugggggcuuuauauacuuuacguauguuauaccucaagaaaaauagaagaaaggggcugggugugguggcucacgccuguaaucccaacacuuugggaggccaaggcagguggaucaugagaucgggaauuugagaccagccuggccaacauggugaaacccugucucuacuaaaaauauaaaaauuagcugggugugguggcacgcgccuguaaucccagcuacccgggaggcugaggcaggagaaucacuugaaccugggagguggagguugcagugagccaagauggcaccacugcacuccagccugggcgacagagcgagauuccaucucaaaaacagaaacaagaaaaauggaagaaaggaagggguccugccaucccauggaaugugacaugcugcuaaacaaggaucaggucuguuuugcgggauaccaccuuccaguaacuucaggcugaguguuagcauguacaaggccucaguggccagcccuuucucccuggggcccagaaaacuggggaagcugaggcagggcuucuaaugcacauggaacucgcuccugcucagcuggacccuuuccccucuguccucaagauugcuccaccuucccagcucaguuccaggcuguggaaacaccaucaacaccggcuuugacuugagagaccuggaaggucauucugcccuaaaauuuugcugagccaaacucaacuuccuaccaaggcuuccccaacuugcucccacccaccagacaccuggagucacccaugacuccugcucccucuugcuccauacuccucaacucuugcccauugcuccugaauuuccuuuaggccuuuucuguccccacugccaaaguuugguccaggccaccaucccuucuccccugaacccugcagcaaccuccucacuggucucucugcugccugucucacccagaaccuucaucuuccacccaggaugauuuuuucuuuuuuuuuuuugagacggagucuuacuuuguagcccaggcuggagugcaguggugcgaucucagcucacugugaccucugccucccagguucaaacgauccucccaccucagcuuccccaaguagcugggaguucaggugcacaccaccaagcccagcuaauuuuuguauuuuuaguagagguggguuucaccauguuggacgggcuggucucaaacuccugaccucaggugaucagccugccuggccucccaaagugcugggauuacaggaaugagccaccaugccuggcccaggaugaucuuuguaaaaugaccuugucacucuucuugaggugguguccccuguccccuguccucaucugucaagaucuucccca

SEQ ID NO: 13498 - RNA, 6020 nt, Homo sapiens
cgggcggguacuuaaggcgcggccaccgcggcugcggcagugcgcccaacagcggacuccgagaccagcggaucucggcaaacccucuuucucgaccacccaccuaccauucuuggaaccauggcggcaguggcggcggccucggcugaacugcucaucaucggcugguacaucuuccgcgugcugcugcagguaagucugacgggguuucgggugggagaggguucccaacucgcgccccuagaacccgcaagacugcgucgcgauugccgcuucccggacccguccuauuccgauugccgcgauccuugccugcccaagugccgcugccggcaccgcgcgcccccugcccauucccugcgccguccuccucgcgcugacccucccuagugcgcccgcgccugccagggaacaaagacucggggcgcggcgggcgaccgcugcggacgaucacccaggcauuuagcgaccuacgcgguaagaaaaacccgcuacacccggacucgaccccaggagggaggcggggcacuacuguguugaaagacuuuacagcucgcagagugaaaauuuuccaccuuaaaaaauugcgcauugcggagaaauuuuauuuaaaaaaacauauagcgcuugcggggguggaacaaaaaauaaguuagaaaaaggcacuucucagaaaaaauaaaaauuacuucgcaaaaaaaaaaaacccuacaacgaauuagagaaaaaguaguucacaggaaaacagaaaaacgcgcauugcaggaaaaauaaaucggagaaaagcacuuggcagaaaaaaaugcauuagauuaaaaacgcacugcagaaaaaaauuagacaagggagcuaacggaaaaaaauggaucgggcaaaaacgcuuuaaagaaaaaaauuagaggaaaaagccccucgagagaaaaauagaaggggaaaaaaagcacuuccaaaaaaggacaauugcuuuacaaaaaaaaaaauaauaauaaaaaaaauaaaaaagaggcaaaagcgcuugguguaaaaagagauaaaucagaagaaagcgcuuugcccauaaaaucauuuacccuaaaagcucccuuugcaggaagaauucccugcuaaaggaauccuuugccaaaggaaucgcauauuuccuucaagguguuccuggaaugcugcauuuacuggguaggauucgcuuuucgaaauccuccagggacacagcccauugcgagaagugagguauaccuaaguuguggguccaaucagcuugccgccaugcagcucucagcacaguuggaaaagcuccagcugcccugacucguggacaagcugcgcccgcgcccgccucuccagccuacgcuggaugggcgggcggggcaggggguggggcgggggugggcacggcagcaccacagacaugcugugggugcucuccacuaaggguggguccuggguuucucgucgcagguguucagguacucccugcagaagcuggcauacacggugucgcggaccgggcggcagguguugggggagcgcaggcagcgagcccccaacugaggccccagcucccagcccugggcggccguaucaucaggugcuccugugcaucucggccagcacgggagccagugccgcgcaggaaugugggguccccuguguucccucgccagaggagcacuuggcaaggucagugaggggccaguagacccccggagaagcaguaccgacaaugacgaagauaccagaucccuucccaaccccuuugcaccggucccacuaaggggcagggucgagagaggaggggggauagggggagcagaccccugagaucugggcauaggcaccgcauucugaucuggacaaagucgggacagcaccaucccagccccgaagccagggccaugccagcaggccccaccauggaaaucaaaacaccgcaccagccagcagaauggacauucugacaucgccagccgacgcccugaaucuuggugcagcaccaaccgcgugccuguguggcgggacuggagggcacaguugaggaaggagggugguuaagaaauacaguggggcccucucgcugucccuugcccagggcacuugcauuccagccucgcugcauuugcucucucgauuccccuuuccuccucacugccucccaagcccacccuacuccaaaauaaugugucacuugauuuggaacuauucaagcaguaaaaguaaaugaaucccaccuuuacuaaaacacuuucucugaaccccccuugccccucacugaucuugcuuuucccuggucucaugcaguuguggucaauauugugguaaucgcuaauuguacugauuguuuaagugugcauuaguugugucuccccagcuagauuguaagcuccuggaggacagggaccaccucuacaaaaaauaaaaaaaguaccuccccugucucgcacagugucccaggacccugcggugcaguagaggcgcaccaaaacuuugucucuugugauuucuuuagcggcaucaacauacacuucuaagacucagcugaugugcccacuguggaacaggcacacugcuugggggagggaggaaaaggagggccaucaaaauugcaauaagcugggccccucacacacccaaccccaucucaaugcuguccugugauaaaggaccaucucccccucuccccaaagagaaaggcugacaucuucacuugugguccuggaauaagggaccacuucccccuccccaaagggauaggugcuuuacuuguggucuuaggauaaggggccaaagcaaguaucacuuugggaaagaugagaggaggggaaaaaggugggaguagcccuccaaagagguacuagggaccaagggggugauuucagaacacaaagccuuacuucaggucuccauccaggagccccaaagaaaugaguagugggcaggguggacaguggcuuagacaaugaguaugggauaagaggugcagcguggcgccuucuucacccagcuuaaugcugcaggccccacauccaccaggaccacuacaaagacaaucugccuggccuugcuacucugcagggucuccuggccccaccucaccccagaaaccucucuccccaauacuggguuucugcuuuucccagcaccagccuccguauucuuaggaaugcuuaccagguccguggcccugggcucuccccugccaucacgucagggugggcagugcucggccucggacuugucuuccucucccacuccccagugagucagggcucuuucuacacggggucagcugacugucucaccaaauggcccugccgccuguucagccuugucucuggcuuuaugugucccugucacuacacaccuguugcugggucaacaccaagggagggaguuggagggccauaaaucucucuuccugccacuucuucgaaucccuuagucacagcugucacaaauacuucugaagcacaaaguaccuugcccccuuaagccugaucauguuucccuccccuaagcaagcccuuaaguuucuuagcccaaucaccagcaccucuaaaggcaucuaaaacuucauucgguaucagagaauuauagggguggggaggugcagaucccgguucuggucuugacuuugccaucaaucagccuagggaaccuggacaugucaccuuguacccuucaucuccaguuucccucucgaagagggccuuugagaugccagugaacccuaacacgcuagaaacugccauagcaguggcaaucaggacucaucaggacuugaagaggaugugcaaucugagacuucaucuuucuuaggcuggguggcuauagcugcuaccauagccugaaggugaggcaggucuccucucgccccagugugacucaucagcaggcaaugcccacaccuccucccuucugaaccccauaucuuggcaggccucaaaacugggaguuucugugguuuuccacacuaaacccacagaaucaugaacauaccaacauguguucuccaugaaggcugacccucccuucggagcuuuugagggguaugcccauagccccacugcccuucuugaugcucuaaccucagcccaagugacaagguagcagauuucagggagguaggccaaagcagcaugguaagagcuggcugcucuggacacagcaccucuugugcccccacuuagaggacaagaggcuccugguagccccagagcuuuccauaucaucuuggcaaagcccuuuuccuccauccguccaucagcagggcugugaguguggcaaggugagaugacagauuuccaggcaagggcugcccugguggccugcaccugcacgugugggcuucaaugugcaauguccacuccccauuugcauccuccacccacaaaacuucauguucuggcagcaaacuuaacccaccagagaagacagugcauucacuuuccauccagugcaaugccaugcaaugccuagaugguccaaacacaccuuguuuauaaaauuuuuuccacaaacuauaccauuaaacauuuuauucugauagagagcaaugcgaagaauugaaaaugacuaguguuuuacugcacagcccuuagucacagugcugaacguccccuuugccuaaaccaucauugcucccagaagacuuugcccccacaaggccaaggacagagcagaucgguugggaaggaauugggaauagcucugugggacuccagcaacaggugagagacccuugagacuaauacuccaggauguuaguuucuuagccuaacgaacugaaguuaaguccagagguguuuagguaccaugacuuuuaggggugcagggugcuaugugacacuguuaccuuuaucuguggaauauuugaauugucacugaaggaagggaugucugcugucagggaagggcaggggcaaguuccuugagcuugggcaacggauuacuguuggaucggggagcagguuugcugugagccauuuacuagauaucuauuuugaaauguguaucuccucaggagccaacaccccaaagggagauucugaauuugcaguuaacuucccccccccaccgcccccacccccccucagagauuuaaacgugugcacucaugcacauacacaaaacacuagucaaacaacaaucucuuuuccccccgguaaccucugacuuccucuauaugccccagagacacguugucaccaucuucccugggagugauccuguuuauccuccccuccccgacuugcccucccacagggcccaugcaugccccagcaggauccagauuccugagcauuuccagagcaggaagucagagaggcaggcaacgcgugguucuugguauaucgcacagggacaggcuugaaauggaaugcauguguuucaaagauaggagaacaacaacaaaaaaagacagucuaacccagauuccucuuugaaacaacauauuacagauuaaagguuaaacuguuuuuggcagcaacucuaacaagacuaauuucagauauggaauugaccuggucacuggaaaccgaccaggcuucccgugaucaaaucuuuuaacagauuugcuugacauuaauuagucucugauuuaaaacaaacaagcaaacaagaucuaacacuuggcauuagcacuuaagcuggaacuuuuuuuuggucccagcuuugguguugccguccagaaggcugacgggaugacuggaccaugucaggcagggcagagaagccguccccaacacaccaguucccugaaagggauagacgauccaaaccuauaaacagaaaggcuguuucuuuccgaggacagaccccagucucccaacauucggcgaugaaaugggacacggaggccuggaaggaaacuaaaggagauuuggaaaggggaaggaaaaaacaacugucccccaucccccaugcuuccuuuccaggccauuagugcgccaggcauuccguuccuucagcugcccuugagggccacuccccacgucuauagaaggaaagggaagggaugucca

SEQ ID NO: 13499 - RNA, 925 nt, Homo sapiens
caggagacauaaaauccccauaagaagaaaacccagauaaucaggauggaaaagcccuccagaaacagagaagccuggcuguguccagggcccucuccuccccagggaggcacccgaggguucucuuuguuucuuucuggguagcccuuggccccugacaggugccugcggcaggaggaauggaggugugaguucaugaagguugcuucaccuugggacaggcaaacaaacgcagaugggcuuucuuccuaagaagccaagaagaaggcauuuuguaagaaagcuuagggaacugcagcaugccuuggugggaggugucugccucagcgugcaguaggagcuuaaguccucccucaaaaggaauggaagagaucagcucugauggacccccuacccuaagccaggccccgugccaggcuucccaggaugccacagaucaggccccugcccucagggagccugcaguccccaggagagacacacaugccagagacugcuauaggaacaauggcugggauugaaccuggacugccauguacaguuguucagaaugugcacuguucauauggccaugaaucauagugcugcccaggguuaugcagggcaaacugcauguuggagcuauggaaggaggugcagguucuagaagauccuaggagaaagauaggcucgugucugccuggagagucaggggagguuaccaggagaaggggacuugcuuggaccugaaggcugacugagguuugcacagucagaggggacucagaacagaaaagggcauaccagagaggggucucccaagcccagccuuuuagcugccaucaccauuuccacagggucccuguaccacaugcaccauuauuuacuuaauauuuauuuucaaagcaucuuuccccuuuuacuuaaauaaauucagguuaaaaga

SEQ ID NO: 13500 - RNA, 1694 nt, Homo sapiens
caccacucacucauucacuuuaauagguauuuaaugaaugccuaccaccaggcaccauguuuuucuguugguuuguuuguuuguuuguuuguuuguuuugagauggagucuagcucugucacccaggcuggagugcaguggcucgaucuuggcucacugcaaccuccuucucccagguucaagcgauuuuccugccucagucucccaaguagcugggauuacaugcaccugccaccaugccuggauaauuuuuuuguauuuugaguagagacaggguuuuacuauguuagccaggcuggugucaaacuccugaccucaagugaucugcccaccucagccucucaaagcgcugggauuacaggcgugagccaccgcaccuggcccaccauguauuaagagaauuauagacuagccaugaaaagaacagacagaggcccugcucuuaagagcucacaguccugaggaagaccuggauauaaagcagauagucacgaaucaaagaucaaguuacaaacuguauuagguuucauaagaaaugcagggaacaaugugucuggaagccaaggaagcuggugucaucugggagcgaggugaggcuuccaggcacagaaaacugcacaguaaagguccugcagcaaggagcagagccuggccaaggaucuggaagaaggucgggggcugaugugcagccaucauuccuaggguacaggaaacagccugagaccucaagagcuuccuuguuggcauuggcacaagggacccucagacugucaucuucagcaaguaucugauccagcuccuccuugaacagaugggagcacuaagacucagaaaagagaagggacuugccuuaggccacauggcagaaaagaggccauggaauugaacucaggauacccauaauuaucauauaauaauugugauucuuacaugauaggcaucauuaucauauguaaucauacaauguccauaauccaucuugacucaaaaucuuccccucacagcaggcuccuguccccaucugucaccacucauucccuugccuucgcagucuccauucugaugcccagaagaaaggggccucgcagcggggugcaccccuggcugagccucaccacgugcccuccagcuaccucuccccagccccugggugcuggacucugucacuggcuccagcucucucaggaggguccuuaugcugcuucuccccagcaggaccaaaaaucagugaggacugcccuuuccagggcugggggccaugcacaguuguuggucuugauguuuccagaagaaaaaggcaguaguuuuuuuuuucucucucucuguuuuacagccauagguccauggagucagccaacauccuccucuaugaaguuggagggaauaucaguaaguuccacugugggaaacaggaacagagcccgggucccugggaguucuucgaccucaaaggcucacugggcccuucugugggaggccagaguaggccugcagaugagcccucccuucaggucucugucuucaaugaaaccagguggaguccugcuguaagguuaaagguuagccugugcaagucuuaggagccuauccuggaguuuggauuuugccuagagcuggccucaggcuugcagagagaugcagaagauuuguuuagugugaagguucacaguagcaccagugaaaccgacgccucu

SEQ ID NO: 13501 - RNA, 1165 nt, Homo sapiens
accagcacuccacuucauguguguguuauaacauucgaucuucagagcaaacuuggugaggcccucgcgguaaucauucccauuuuccagauggagaaagugaggcguagugagguaaaccagcuuaccuagggccacacagcuauugugugggacagcugguguccaaacccaggcaggcugauuccagaucccaccucugugcuuccuuuaagcugaccacagcaggaggcuggaugaggccaggccagcucaggcuggccauucucagugccagaugguggcugccaggcauggcuggagcgguguuuacccuguggccauucugccucugcccauugagagggcagcccucucaaucaucauaaaccgaggcugaaccaagauagcaaauccgcauccuccauccccugucacuggacacccuguauucaaucacccacauauucauuucuucuaaucuuucucucuugacugugauaaagucacuuuuauagugcugagaacgugcaguucauuugaauuaagucugcuggaguagauuaguuugugugggaaaaucagggcuauaaaagaaggcauauuucaaugguucuuuuaacugauuaugcucuagggucuuauuguaagaaucucauuugggguguggggugugugugugugagagagagagagagagaauugcacacucacuucuagaacccuggagugcugaggaagaccaccuagaagccucccuauaggaagggucugggcuucccuuagagaaaugaugaagggaacucugcuauuaucuccaucaggugguggcugcccaaccucuggggaauggggcagauaauucacucucauguaggagggcccuaaaagacuugggugcagcugaagaugaucagcucaugcccaacagagugcaauggcaaagaaaaguggacugauuugaaugccuccagagccccaucugggaggagaggguaggcagacauugccaaucugaggguuauuaugcaguuacugucugccuuuccugggagcucuuugaagauaguccuguucaucacugucugcccagugccugacccuuuggaggcccucaguaaacauuuggugaaugaaaggauggagagaaugaggagagcuggccaucaacaccagcugucuaccu

SEQ ID NO: 13502 - RNA, 1165 nt, Homo sapiens
agguagacagcugguguugauggccagcucuccucauucucuccauccuuucauucaccaaauguuuacugagggccuccaaagggucaggcacugggcagacagugaugaacaggacuaucuucaaagagcucccaggaaaggcagacaguaacugcauaauaacccucagauuggcaaugucugccuacccucuccucccagauggggcucuggaggcauucaaaucaguccacuuuucuuugccauugcacucuguugggcaugagcugaucaucuucagcugcacccaagucuuuuagggcccuccuacaugagagugaauuaucugccccauuccccagagguugggcagccaccaccugauggagauaauagcagaguucccuucaucauuucucuaagggaagcccagacccuuccuauagggaggcuucuagguggucuuccucagcacuccaggguucuagaagugagugugcaauucucucucucucucucucacacacacacaccccacaccccaaaugagauucuuacaauaagacccuagagcauaaucaguuaaaagaaccauugaaauaugccuucuuuuauagcccugauuuucccacacaaacuaaucuacuccagcagacuuaauucaaaugaacugcacguucucagcacuauaaaagugacuuuaucacagucaagagagaaagauuagaagaaaugaauaugugggugauugaauacaggguguccagugacaggggauggaggaugcggauuugcuaucuugguucagccucgguuuaugaugauugagagggcugcccucucaaugggcagaggcagaauggccacaggguaaacaccgcuccagccaugccuggcagccaccaucuggcacugagaauggccagccugagcuggccuggccucauccagccuccugcuguggucagcuuaaaggaagcacagaggugggaucuggaaucagccugccuggguuuggacaccagcugucccacacaauagcuguguggcccuagguaagcugguuuaccucacuacgccucacuuucuccaucuggaaaaugggaaugauuaccgcgagggccucaccaaguuugcucugaagaucgaauguuauaacacacacaugaaguggagugcuggu

SEQ ID NO: 13503 - RNA, 77439 nt, Homo sapiens
uucgggggccacgcccuccgggcccugggggccuagcgcgcgacggugggguggagcuagccucgugaccuuuuaccccaacauggcugcgcccgugggaccggugaaguucuggcgacccgguaaggcccuugguggaacgcugggcagaugcggcggccugacuucggucuuggcgccgcggccggcgcccuggggccagcagaccugcucgcaggccugaccucggcgagcugggcgcugccgccucugugcggggggagcucuggcucaggcuccccaguggucccgagggauuugggggugcuccccuagcgugagcagaaacucuuugugaccuuguuaaagugguccagccuccucaggccucgucuuccucguuacugaugcuuguccugcccaccccgcgagauggggaauccuaaagcucccucucgugucucguuagcgcccugggguugcgcuguggcccgacagacaaugcugcucgcugcuggaggcuugcaagcccaaguuauggagucagacuguccggguucgaauuuucgucucugccuuguaguagggugaccuugggcgagucacuuaaugccucugagccaugacuucuuuaccuguaaagugggcagaacaauagcuucuaugcugugggcuuaaaugacaagcagaacgcguugucagacuuagaauaaaugcucaaaaaaagggaaaguguguuauuuucuuuuaggauaauuguuguccacuccgaaugucuacuagaaaagggaacaguccuucauauuggcugccagccacuuccucucuuacagacuaacacgaaucacaaucacaaaaugcuuuacuuguuuugucuugauauuuacucauuaaucagguuuuuacugaaugugcauaugccagaccguacuagaugcauuacuuccucucugcaaacaguuucuuguaaaaaacaaaaguuuuuaaauuacagcuaccagcuugauuuuuuucuaccaccugcaccccugcaggucuggaugugcaaaguauauugcagcaaaaaugaaaugacaccaagaauguaauauaagcaaagcuuuuaauuuuucagugguucucugaaauucugaccaugcauauaagugaugugagagauaaacccaagcaagagauauguuuaaugcuuuuuaaaaauuuguagucugucacuugacaguuuuaugguucagcauuucaagucaucagccaauuauccauccugaguuuuauuugcauccaaaacuaggaacuuacuaaguaaugaauacuuuuaauuuauucacgcuuuuaguaacaggugaaaguguuagguauaauaaagagcugaauuaauuguuugaaaucagaccaggguacuauuuugguuaaagaacguggaauuacucuuaagaguucuauuucauuauuuaguucauccauugaggguacacuuauugaaaaccuaauccuguguucaggagacaaauacagaugcucagggcucugcucucaaguuacugucucucucuuaauugaauauaaaguuagauguccucuagaagagauuuuacaaugagacagaguaagguggugguaaagaagaugagcucuagagucagacugcagugcccaucaugucuaccacuuacuaaguugaugacuugauagucacuuaaauucucaaagucucaguuacuccaucuguaaauuggguauaauaccuacccuacccaaaguaguguugugagguuuaaaugagaauaacacacaacaggaucuuggcacuagauagguuacuauuauaauuauauggaaguauggaagagggagggaaaguugaauguauggauaagaaauacuucauuaaggugguauuuuuggagugaacauuaaaggaugaauaagguuuuguuucauagagaaauggaacucgaagcaaagggugcagcaugaacaaaggcagaaugggauuugugccuuuagaauguccagaaagccaaaauaacagagcagugugauaguguuaagugcuaggguauauuuugggguaugacaggagaugaagcuagaaaaguagguaagggccucauugugaaaggucuucaugacaaguuaaaaaguuuagacuucacuguuuuuuuguuuucuuucuuuuuuuuuuuugagauggagucuggcucagccgcccaggcuggagugcaguggcgcaaucucggcucacuggaacuuccaccucccagguucaagcgauucuccugccucagccuccugaguagcugggacuacaggugugugccaccacaccuagcuaauuuuuguauuuuuaguagagauggaguuucagcaugguggccaggaugaucucaaucuuuugaucccgugaucugcccaccucggccucccaaaguguugggauuacaggcgugagccacugggccuggccugacuucaguguuuuuaagcaggaacaaaucagguuuacuuuagaaagauaacacuggcaguggaguagagaguggauggaggaggaaauuagagaagguacuagugaaauccaggagggauguuaaaaaccuuaauucugaccugggagcuuagaggaggugccuguuggagagacauuuuagaggaagaugugggagaagaugaagucaguaauaacucagauuucugggcugggugacugucuagguuagugauucucuaauuuugcuuuauaguugaaucacuugggaagcucugaaaaguccugaugugcacuugcaccucacaccaauaaauuagaacuuuggaggccuaggagccaggcaucaguguuuuuuaaagucucuaaggaauuccagcaugcaucaaaauuugggaaccacuggucuagguaaauuguguugucauuaguugacaugggaauagcuuuaguacacaguuauugggccguugcuuuguguuagucacuuucauuuacacaucuuauuaaacagucacaguaucucugugaugacaguaauacucuuauuuuagugaggaaauucaagauaugaaguagguugugggaaaugcaaggugaaagucagggaagcugauauaaggcuagacauucaaaucaugaacauauccuguaggccugagccugugauuacagaggucuuucagacagucuaagugagugaaguugcuuacuggagguaauagggagugguggggacuguggcagagugugcauacacuggauaguauguacaguggagaucuacaguagagcuuacauaugcuuucuaaaauagggaguuguacucagguccaccuaauuguuaucauauggguucagaguugcccaauuuuuuuuuuaagaagccuaauauccagaucugaaugggaaaauuuuauguguuguuuuaaaugaaugauuuaaaacauuuuaacaauagcaugucuggguaccuuaagauacccauuuguggugucuaccuuaggagugugacuuaagggccuuguaugaccugccugagaguuuucuacaaaaaucuuuuacuuaauuugcaaguacacguggauccgaagggccugcccauuuucguuugcucauuugauaaauauuucaugauuguugaccaugugcaugacgaaaacuuuacaauagguuuuaagcuuuuuuugacuugacccacaguaagauauagcacacauacacaacugaagaaaaaguuguucauaaacaguauugcuuucuggaaugugcucugaugcuuucuauucuauuucauuauuuaaaaagugcugguaugacauacuacauugauuucauaacccacuaaugggucaccaguaaaauuuuuaaaaaccaaguuaaagggaaugaggaauuagggauaucagccuuguuaagauagggaaaugaagauguucauaguuugcaaaaguuauaaaguuguuacucccuuaagcauagagcguacgcucaaggaaaaaucaaucauaggcagccacagagggguguuuauagagggaaagcagcccugauguucugguuugguugaaggaagucuuuuaugaggagaagguauacuguuuaucaacugacauagcuguucuuauaaaagagcucagcugggcgugguggcucaugccuauaauccuagcacuucgggaggucgagguggguggaucaccagaggucagaaguucgacaccagccuggcuaacauggugugacccugucucuacuaaaaauacaaaaugagcugggugcgguggugcgugccuguaaucccagcuacucgggaugcccaggcaggagagucgcuugaaccuggaaggcggagguugcagugagcuggcaucucgccacugcacuccagccugagcaacagagacuccaucuccaaaaacaaaagcugauaauagaagagauagauuggggcuguagguuagagacaagggaggaauacgguaguacaaaagacauguuaaaauauuccagagaggauaugaagguuuaaaacaugauuugaaaaggcaggaauucaggacaaaaacacagcagaaaaggauaagguauucuuugucauuguuuucuugaguaacaauuacaaggaauuauuaagauguagugacaagaagggaaggaaagaaagccugucucuuugaggacaggcauuguuccagguccuguuccaucuuuugucuuguugaaaggaaggucaacauuuuggcaaaagcaacaugacagugccccacuuaccugauuuuuggccaucuugaaccucugaaacacaacucuguuccuggaaguaaauggaaaagggucagagaucuaaagcagugauucuaaacuuagcucuagggggucuacggacccccccgaauuuuauauucugguaaauucugguguguuuuuuaggagagggaguucauagccuuuaucagauuguugaagcaaucugagaacccuaaaaaguguaaaaguaagucacugagcugaauauucuuguuacaaagcuccugugcuuucacuuagcaucacagauucugaguucagaagaccuaggagaugaugguuauugguuauuaucacuguagugccccagcaggaggcuguauagcauguguuugaucuagggaggauuuuuauucauuuacaaggcagcaaacuccagugcugaaaagugugaccuuuuggaaauaucuuccuuacauugaguugaauucugaacccugugucauuuacuuauuacuccuaguucuguccuagaguuacagcagcaaaucagcaugaaaaguuauggaagcugcucacaaaauuuaaaguuauguuucuccugaguuguuuuucuguuugagcuaaaacuguauggaaccuucaacagguuuucaugaugggauauggcuucccuauucuucaccaucaugaucaccaguuugucauuguuauuagcaagaagccggggugaagaucucuuguuuaaucugcccagcauggcgguuacugagaauagcauuucccaucuauccacucccgauuccaugguuccaauggggacugucauuuaccucaucccauuccacuggccaugguugauuguauugggguggggauuggaccuaagcugggagaagucagucccugucuguccaguauaaaagagccucccccaccccccauuacaacacauaccugggacucccagucccccuuacguugucuuuauuucucuccauagcacuuaugaccacuucaugcaccaaguuacuuuccacugagaggaagaauuaaaaaagcaagugagcuccgugaggguagggcuggcaucuguauuguucacugcaguguuucuagugcuuagagugguacgugacauggagugggcccuugguccauccuugcugguccuugcuggaccacgaugaaugauugguagaggaguuguaagcgugaacccuggcacugccggcagccgucuuuccagcuccuguacaguagccaaccuaaggggcuggaaggaaccugcaagacgugccaagaugagagaaggagaaagccauggcugcuuugagugcccaguuucugucaucucugagccuuauugccauccuacaguaacaagauucauccuuuuaccucagcuaauucccacuggguuucuuucacuucuguuaagaauucaguaauaacauggacauggaggccagaaguaaagacacugugcucuguaauacacaguucugaguggccaauuuggagcccagugggacugccaucucguuucuuuuuucuuuuuuuuuggagacagagucuugcucugucgcccaggcuggagugcaggggcccgaucuuggcucacugcaaccccugccuccuggauucaagcaauucuccugccucagccucccgaguagcugggacuacagacacacaccgccaugcacgccuggcuaauuuuuuguauuuuaguacaggugggguuucaccuuguugcccagacuggucucuaaccccugagcucaggcaauccgcccgccucggccucccaaagugcugggauuacaggcgugagccacugcaccuaacccugucuuguuuguuuuugacacugcagugaagcuuuuagggaagauuuuuaguuccucguaggcacuuuucuggauucuuuccuaaaguuaagguugaauaccuuugaguaguuugagauaaaaaguauugcuucuucuguauaucuucaucuuugaaaguuuauaaacuuaacaccuuuuucuguucauuguaucagagaaucugaaaaaaaaacauuucugcugcagguacagaggggccagguguaagcaucucugaagagagacaaagucuggcugaaaacucugggacaacgguuguuuacaacccuuaugcugcccuuuccauagagcagcagaggcagaagcugccgguauucaagguacgucaaauaaucauguucaaccugugggcuugaaucgugugucugcauuagcuuuaugcucagcacugaagggaaugauggccucuuucuagaacacagugagcucagagaaacccuuacuguaagggaugacuuuucauacuguguauuuuuuaguuaaccuuauaaaucuugaaaguccuuaagauuuuuucaguugcaucguacauacuggaaaacuggaggaauuagaaugacuuuuguuuuccccuuuauuccuuucagcuguggacaauuucagauauacagaaaaguagagaaaauagcaguuaauuucuauauaacagauuaccaacauauggccaauuuuugcuuuauuuuuaaagucacuccuuuaaacaaguuuaauugggaauaugagguuguuucugcugaagacaucaguuaauacucugacuuccucugagacagugacaggauuuugguaugguuacuacuuaccaagugcacauccagacacucaguuuuauuagcgcucacgaaacagaugugugcucagcuacaagagaccaaagugcaaacuagaauucauucagaacuguucauuuauggcuagcaauaauucuccaguacagauggacacaguugacauauacacuuugucccuguuggcacauccacaugggaagccaaauuguaaucaggaaguacagagccaagacagguuacagaaaugucauacagccccugaugaggggugaauucucccugcuccacaggaugcccuuggaaugacccgaguagguguggccaccagcaucugugucucuuucuuucuccuggacggugcugggugaaaguugcuguguucuaucuaucugucugucugucugucugucugucuaucuaucagacagggucuuccuauauuguucaggcuggucacgaaccccugagcucaagcaguucuccugccucggccucccaaagugcugggauuacaggugugagcagccaaaaggugccaaguucuuauacucauggaguucuuuugacuagacugugcugauaauuccucuucuauuaauguguucuuucuccaaacagauaggcaacagcagccuucuuaauuuagccagauugccuuacuuggaguuuuauguggcucccaauauuuuagucacaagugaacugacugucucuggguuucuuccucaagugacuaacacauucacuauguaugaauguuagcaaguuugacuuucaggagaugaaaugauagguuuacuauugcuuucucaccacugagggacaguuugagcugugaugaaguguccggacucuggagcuagacuucaggguucaaacccaagcuucaccauuugugugcugugugaccucacuucuccauucugagcuucuuuucuuuaucugugauguaggacuacaggagcaccuaccucauaggacuguuaugaggaccagaugagaucauccaugcagagcauuuagcaagauaccugacauguaguaaaugcucaaguacaagggaaauuacuguuuacucaaguauuuaaauuuuggccuuuucuugacuauucuuugucucccaacuguacuuacaagauaacauaaaugaaacagcaaaugaaaaaaaaaaaagcaacaagaaguuaagaaauguuuaugaaauuaaaaugguaagaagaaggguguaaguuacugauauaaagcaaagcagaguuuaaguacaguugagaucuuauaagauguugaagaugaaucgagacaaaaaggaaaacaaguuaccucuacgccauccuuuuucccuuucaaacaaaaaguaaaaguagcuuuaaaaacagaaauuggaggcucggugugguggcuuacggcuguaauccuauaggcuuugggaggcugaggcggguggaucacuugagacaaggaguucgagaccaaccuggcaaacauggugaaaccccaucucuacuaaaaauauaaaaaauuagccgggcgugguggcacauguuuguaaucccagcuacuugggaggcugaggcaggagaacucuugaacccgggagguggggguugcagugagccaagauugcaccacugcacuccugccugggcaacagagcgagacuccaucucaaaaaacaaaacaaaacaaaacaauguuggaacuaaagcaucaagagauuguuaaagaucacugccucuuccccagcaccauuaugaggccaccuguucccuugucugccuucuuuaggcugcuguauagacaauagugacucuaucuuggaugcaagucugccauguucacuucuguuuagacccagucuuauaaaugccuccugauuucugcuuuguauauuguccuuaguguaagaacaugucaaccucucugggggcagcacuauugacagcuucuuguuuuguuuuguuuuuccccaaaaacagucuacgcauaaacaaguagauacguguuugcccuaagaagaaugcaguuacuaggguauuauucacacuguucuacaucucacuuccuuuucuuaacauaucuuauaguucauuccauaucaguacaaguagauauuuccucuucuuaauaacuacaaauuauuccauuauuggaauauuuuaugacugauuuaaccaaacuuuuguugaucaacauuuaggcuguuugaauuuuuggcuauuauaaacaacucugcaaugaguaugcuuguauuuaugucuuuguacacauauaguauguagcaguaugucuauaauuucuuguuuuuuuuguuuuguuuuguuuuuuuuuuuuuuuuuuuuuugagacagagucucacccuguugcucaggcugaagugcaguggcauggucucgccucacugcagccuccccccgccuggguucaagcaauucugcugccuuagcguccugaguagcuaguauuacaggcacuuuccacugcgcccagcuaauuuuuguauuuuuaguagagacaggguuucaccauguuggccaggcuggucuugaacuccugaccucaugauccacccccggcccuggccucccaaagugcugggauugcaggcgugagccaccucacccggccuauaauuucuuauaagugaaaauguaaagggcguaugcauuauguauuuugauaaguguuaacacgauugcaguuguauucgcucauacugagaggaacaguaccugaggguuagaaauacauuuugauaguucuacuuaaaauucacuuuccuuugaaaacagcucauuucacaauguuuaaauaucguuguuuaggucuuuugagacaauguauggcuauuugcaagguguguuauucuuuuucagcuuaggaaucauauuuuauacuugauagaaaauuaucagacaguggugauuguuggugaaacaggaugugggaagagcacacagauuccucaggugaguacauauuuaauaagugucuuuacacuucgauuuggcuggaagaauuuuguaacuugagagcucucuuuacuaucauuuacauuuuuaaggucuccuuucaggaaauguucacuucaacuagauauuuuuuauuaaacuuuuagggcuuauaauuucuuuggugaguacuaaaguaacaguuugucuucgauuuauuauaauuccaaaauaguaauggaauggccaucuucugaaaguuacaauggagauuuauucaaagaugugaaauauagaguuuuuauccuuaaauaguuacaguugaaggggugggguaaaaugaauuuugcuguaguuguaaauaaaaauuggcuguuauaguauuaugcagugcuauggaagaacccuuucuuacuaggaaaaauccuaugugauguggauaggaguagaaagaaggaucaagaaaggccuuguaaaggaauuggcauuugaaauugaccuugacugggagcugacugagaagauauuccaagccagugaauauugugguuagaaauacugggguggagaaguguagggugaguucagagugugucuuaagaaccuuaacuugaagagugaagacugacugagcuugagagaccuugcagguucuuacuuccuuuuuuaauguuaauuuucuugagguaugacauauauguaggaaaguaccuauaucauaauuguacaccuugauacauuucugcaaguggaauacaucuguguuaccagcacccagaucaagaagcagaacauuaccaaaaccucaagaacucuucuucuguguucuguucucaucucuaacugccaugucugcuuaccccuacaaucaugaacacaaggguagcucuuauucuggcuacuaaccucauaaauuaguuuugcguauauuuggaauuuuauaaaggaauaauauagcugcuuuuguccaacguuaugugugagucuuccuugguguugaauuaguugcaguuuguucauucucauuacugcauagcaggguucggcaagucacagccagugugccagaugcagcccgcugccuguuuuguagagaaaucuuugcuggcacacagccacuccuacuuguugauauauugccgguggcuccuuucaggcuaccacacaggguugaacaguuuugacagagacccuacgauccucaaaaccuaaaaauuaccaucuggcccuuuacagaaauguaaaauguaaugcuaaccccugcuaguuaguauuccacucuaugaguauucugugguuuguuuauuuuuccuguuguuacugacauuugagucauuccuaguuuuuaguuauggauagugcugcugugaacauucaugugcuugucuuuggugaacguaugugcacauucuccugcugggcucuaccuaagaguagcauugcuggauccuguguucaacuuuaguaaauaaugucuaagauauucaaagugguuguguccuuguaggguuugcaagcaaguaaacaauaugacaagcugagcuuuagauaaaugauuauauugagauauaaggugacuuagaaacuggaggaggcaggccauagaaagcuauugcaguggucuagagaaggaugguguaacgggguccucaaccaagaggugauagugggauaaucuggugaggaugggaaggagaacaauuuacaauuuuagcguuagggucuguagacauuagaaacuuagguuggugcuuuugcaccaaucuaauagauggauauuugugaugacaaaggggaagggacaaaggugcacagugacugaucacgacuugcugccuuggcgaacagugcuaguauuaaaugugauagaaaaguaaagauuguuuuuuugaggggaaauuaauguguguguuuuuaaacauauuuauuuuuuccuauauuauugauggccuuugaugacauuagcaggaaguuuggaaugggaaucugaagcuuggcagaggucagacguagaagguguggacauagggauugaacauccugauacaugcaggaaggagauggaacagaaauaacugagaagaggauuaaggacaaaguccauggagcaucaacauucaggagucaggagcagaaaggagauagaauggcagccagggaaaugacagaggaaccagcagacucuucaugguuagagaaagcaaagacagagugagguuucuggagagguggguagguggcaguuucagccaacagagcggccagggagcaggagaacugguucaguccuggguuauucaucuuggagauagcacguccagugguaggguuuuaggguuaagggugucuaaggguaagaugauaaaaaucccuuugcauauuugaauauguuaacaauguguuguugacuguuugguccagacuuguggucaugccaggaucuguguagaucuuuuuuuuugucugcuccccaacuccauuuugaauaauggguuuauaaauagguugggacccagauguagguauuuuuuuaaaguuucccaauagacagcuagggaaagguagacagaccuaguaaagguagaugaccuaguaaaggacaacuugaaaugcaugcagcagaggaaaugguggccuggaggaaaaagauaaccguauaugcagauggaauugagagccuaguaaguuacucauuucuuacaggaagaaacaggagaaagguuaaauuacugugugauugucauuuagagaguaauauaacaauaguauaacaaguaauaacaguaauaagugcuacauaaagugauuuuacacauguugaucuguuuaauccucaaugacccuaugaagcaaauaccauuauuaucuucauuuuauaggugaggacacuguagagaguaaugagguuauggaauauagaacagagguaaaagaccacaugauguuccagaauuguuugggaauuagucugugacguuauguagucagcuuaggauaaacuauguucugguaacaaagaaccugaaaaucucaguggcuuaaaaacacaaagguuuauuucuugcucauacugugugguuaucuuggguuggcuuugagauucuaucacaucaucauugggccuuaggcugaugguacugcucuuaugaggcacuuguugaucuugugguagauggcagaaucaugagacagcucuuaaaacuucugaccaaaagugggccuucuguucacauuucauuggucaaagcaaguuauauggccaggccugauagcaacggggugacaguguauauaauccucccauagggauggguggcagguauuuggaacaaugauaaauauaucacagugauuuggccauuuacuccugcaaggcuuagcugccagggaacagagagggccugcuguguuacuaaguccagggaaagcuggugggaaggagaaagagcagaggcugaggaucuaggcuggguaaugugggcaaacaaagguaguuuuuuuuucuuuuaauuuuaagauuugaauauuuuuaauauuuuugaacauuaauagguucacaugauuuaaaauucaaaaggcacaaagggacauacaaagauuuccuucugcccugucuuccugguacccauuuccuuugugcaguuauaaucaguauuaugaguuucuugguagaaauuuuuucaugcauuuacagagaagugucuguguguguguguguguguguaugcacauauaugcccuauuuuaaacaugaaacaucuauacauguuuuaguaugccuugacuuuuuuuuuuuuuuuuacuuauucuuucauuuuaaaaaaaaacuguuuugaauugacacauaacugugcauauuuaugggauuuaguguaauguuuugauauauguauauguuguauaaugaucaaaucugggucauuaucauauccaucaccucaaacauuuaucauuucuuuguggugagaaccuucaaaaucucccuuagcuauuuugaagucuauggcacauuauuguuaacuauagucacucugcugugcaguagaacaccagaacuuauuccuccuauauaacuauaacucugugcuuguugaccaaccuuuuauucucccuacucccuguuccccucuucccucugcagccccuaguauccacuguucuauucucuacuuuuguaagaucaacuuuuuuagauuccacaugugagugagcucaugcaguauuuguccuucugugcuuggcuuauuucacuuaauaucauguccucuagguucaucuguguuggcgcaaaugacaggauuucauucuuuuuuaugacugaauaguauucuauuguguauauauaucacauuuuaaaaaccaguucaucuguuguuggacaccuaggcugauuccaugucucggcuguugugaauagugaugggaguguacaugucucuuugauguucugguuuccuuuccugggaauaaauacccaguagugggauugcugcaucauaugguaguucuguuuuuaauuuuucgagaaaccuccauauuguuguccauaguggcuguacuaguuuacauugucaccaacagugugcaagaguucccuuuucuccacauucuugucaacauuugcugucguucaucuuuuugauaguagccauucuaucuggggugaggugguaucucauugugguuuugauuugcauuuuccugaugauuagugauguugagcauuauuucguauauaugaaauaauacacugugcaucuucuuuugagaaaugucuauucaggucuuuugcccaucuuuuuuuuaacuuuauuaaaauacugaguuuuauuucacauuuauuuuacauauuuuugucuccccaccauuuccaugucugaccaccacuacuauuauguccuaucaugacauuccauacauaccuaaaaccaagcaaaggguggaguuccaucuuuaaaaaugaaacaggcauuuuggacaacgcagucuuggcaauggaaccuggacaacauuuaucaaacacgguagggaaaguucucacucugcauuauaaaaagaacagccagauaucaacuguugcugcuugcauuuuugcuuuaguguuuucuacagaacuuuugauauuuuaggaauuuuuuucuuguuuuuugaaggauucuuguccuuuugaucuugguguuggugguauugagucuuuuccauucugauuugacuuuugugcauuuuuuggcuggaguaucuuguauagcuuucuuuacuggggcuuuuucuucaguuuccucaucaucaaaaucaucaucauuagcagcagcagcaaguuuuacuuuuuucucuggaacguugcuaccaccuccaggggcagaucaccuuccagauauacuuaagaauuucacaucuucuuccucuucaucuucugacucugcaucuuccucuacagcuacuaagugcuguccacuaauaugcacuggcccugagccacacuucaacuguaagaccaccggugguauuauuucaaagccccuaagggaaaucauuggcuguacagacauuuucaaaguugccaguguuacuuuaauuggacugccuucguaauucauugccucugcuucaacaaugugcaauucauccuuugcaccagccccugagcugaccguucuuaaagauaacuggugcucaucuucaucauuauccaccuuaaagugaucaucuuugauggccuuuaguucacaaccaaaaagauaguucuggggccucacagggcucauguccguguccaucacaucuuucauggggugguggcacguacuuaggugggagagaaggcggauggagauaaaugaccccugcuccagagaacagcugugcagggcggaaucacacccuuuugcucauuuuaaauuggauuuuuaguuuuuugcuauugaauuguuugagcaccuuauauauucuagauauuaacucuuuaucagauaauaguuugcauuuauuuucucccauucuguagguuuucucuucacucuguugauuguuuucauugcugaacagaagcuuuuuaauuugaugcaaucccguuugucuauuuuugcguuuuguugccuauguuuuugaggucauauccaaaaaauccuugcccagaccagugucaugaaguguuucccuucucuuuuguucugguaguuucauaacuuugguccuuucauuuaagucuuuuauccauuuugauuugauuuuuauauguggugagaguuagggaacugguuucauuuuucugcgugugauuaucuaguuuucccagcaccauuuauuaaauagauuguccuuucccuaagauguguucuuggugcuuuuguugaaaaucacuugacuuuaaauguguggauuuacuucuggauuuucuguucuguuccauuggucugugugucuguuuuuaugugaggaccaugcuguuuuguuuauagcuuuguaacguuuuuugaagucagguaaugccuucacacuuggucuuuuuuuucacauaauguauuguugguuuuuuuuuccaguuccauagaugcuaguaugugaacauaauuuaccaauccccaauugauagacauuuagguuguuuacaguuuuguauuaucacaaugaugcaguggagucaguuugcacauaaaucauuuugcacacauauagauauuuuuauagaauaaauaaaauacuuaugggguugcuggcucaaaacacaugugcauuugaauugaauuauuuuaaggaauugcauuuuauuauaaacuuuuuaaaaauaggaaauacauuuacauaguacaaaauucaaaaagaacaaaggaauaaauggugaaaaguuaaucuccuaagcuuugcuguugaaaaugacuagaucauuguaauagauuguauuauugguccaaauaucugcuaccccucuuauggaguauucccuuuucuccuagccacucaguuccccguaccugagacagucacuguuuccaacuuauugugaagcuaaauuugggcuaugaucuaggaaaauuggaauggcugaggaacuaaagguuacagcaaggauacggagcagguuuuucucucuuguuagauuuauauaguaccuuuccuugggaaaaaacaaugugcaaaagcacuggauacuuaauaauuuugaaauucuacaaacuauauguagaaccuagaugauuuuuuuuuuuuuuacuagaguucuguaaaaaaaaaaaacaaaaauaagggcuaugaacacaagcucuucuuaaguacaauuuuuauuaguacuguuauugguggaguucuuccuaauucuguccuuuagccagaagcccagauuuggugauccuuaaaaagaguggagaacucagauggacuucagcuacguuuuagugaucucccuccgugacucuccacugccucuugacguuagcacuacaccugcuuuuucaguagcuuuaaauuuccaccucucagcaaucauaagcaugccauagaagucugaaucacacaggguauugaggugacuagcuuuauggacaggcuuauuuuuauggaaauuguuuuucuuucacuuaacacuacugcuaagagauuggcuauguguguuugaaguaggauaauauguuguguucuguuuaugugucaugacuuugguuugcugagcuugaaguccaggauacagauuuuuauuuguuuccuuggacaaauuauguggccucuuuguuuccucaucuguguauuguugaugaugauguuaccuuccuuauagaauuuguuuugaggauuaaaugggucaaugcauauaaggcacucaguacaguuccuggcacuuaauaagguacucauugacucuuagcuauuauucuuauaguucuguuuuuuuuuuuuuuguauuuguguugauuggggugguugguaguauuuuguauauguauuuaauacaagauaaacuuuauaguuuuuauagcaaaaacccuacauuaucuucaacccuuuguuucuuacagucauuuucuaaacuuuauuuuuaacuacuuuuagacuaauagaaaaauugcaaaaaacaauacagaauucccuuauacucuucacuacuagugcagagaucgaaagcaggccauuaacauugguacaauaauaguaauuagacuauaggccuuauuuaaaucucaucaguuuucuuacuaagguucuuuuuuaguucuaggauccuacauugcauuuaguuguuguuucucccuaaucuuuucuagguugugcgaauuccucaauaugucuucaucuuucaugaacuugacacuuuaaaagacuaaugggauuuacuuuguagaauguuccucaguuuggguuuaugucauguuuucucaugauuagaaggagcuuauguauuuuuggcaagaauacuacagaaaugauauuguauccuuagugcaucauuucaaggguucauaauguugauaugucuugucacugguaauagcaacuuuggucacuugguuaagguuccagcuuuugccugugaaacuacugucuuucccuuuuuaguugauauguaucuugggggacauauuuucacacugcaaauagucuacuuuucuuccaacucucaccuacuaaguuuaguaucccccucaguggaucuugucuguagcagugaugauuuucuuuucuccucuuucccucuaucuuuauuaaauguaauuuucuguaaggaagaacugugcuuucuuccucacuuauuucuuagauuauuugcguguaucaauauggauucauagauacuuauuuuuuucuauguguuaaagcccaauacugucauuauuuauuguguugcucagauuguuucaucuuugaacauuagaagcuccuucauuuuggcuccuguuuucuuucuaaagcuuucauuuuuuugaccgcuuccuuacuuucuaguacuacaagauguuucaggcuugucuuauauuuuuuccuacacaagcccugguuccuuuuauuggagaaugauguuuagaaaucaugaucuggggccgggcgugguggcucacaccuguaaucccagcacuuugggcggccaaaguggguggaucaccugaggucaggaguuugagaccagccuggccaacauggcaaaaccuggucucuacuaaaaauacaaaaaauuagccgggcaugguguugcauacuuguaaucccaucuacuagggaggcugaggcaggagaauugcuuaaacccagaagucggagguugcagugagccgagaucacgccauugcacuccagccugggcaacagagcgagacucugucucaaaaaaaaaaaaaaaaaaaagaaaucaugauccggaugcuagagugcucauugcuacgagaugucauugcugagucucagugagcagacuuaggaaauauauguaugaauauuaagccauacauuauaaaaacaucuagcuaucuguaucugucuauccaucuauauuuuaaacaccaugaguuuaugcaaaugcuucugauuccaaucuaauaccauagggcucuuuugagccuuucuuuauuuauaacuucucugcaacaaugagaagcuuaguccuuaucaucuacaguauauuuguggauucauuaaaauaguuucagaauugcuaacuuguaaccuuguuuggauauuuacuaacuagauuacagcauuuauguacaguucuuucugucuuuagccuuacaacauacagucaagauauauuuuuccaucauuccuuagguaaguucuuuucuucuccacccccugcagugugguuauguuauucauuuguaguauagaaagggucaucuguuaguguuuauauuuccuuuagguuucccuccacauccugguugguuuuauuugucuucuggguguuuaaaaaguaugugaaacaugcauggcugugauucucagagucagagcuacacaaaaagaucuauugagagcauugacacgcccucuuuaucccuguuccccucccuccauuuccccuucuuucuacaccuuucccacccauucccuguagacaaccauuucuuaguaucuauauuauccuuccuuuauuucuuuugaacacaugagcagguacacgcaguaacuuuuaaaaucuuuuuucuauuguagaaguaauacauguucauuguaaaacuauuagauguuagaaaaacauguaacugauaaccacuguuauccguauuggauuuuaagugcauauaaucaaauaaauacauagauauuaaauaaguagguaacucagauaaauacacuuaaucaaauuuuuuuuuuuuuuuuuugagacagaaucucucucugucacccaggcuggagugcaguggcaggaucuuggcucacugcaaccuccaccucccagguucaagcgauucuccugccucagccuccugaguagucacgauuacaggcaugugccaccacacccaccuacguuuuuauauuuuugguagagacgggguuucaccauguuggccaggcuggucuugacgucaagugaucugccuaccucagccucccaaagugcugggauuaccggcaugagccgccgugccuguucaaucaaauuuuauauauguguacuaaucuaaugguguauagucauauauauaaaauccaguuguuuuauuuaauauggcugaaauguguugugugguugauauuuauguugagccaucucuauaugugcuuaaaaauucuuuguucuacagaguuagcacuguuuugagugaccuguggauaauuuuuuguucccugaggcaucuguaguacauggugauuuuccaggacuggggugucagaaugcuggaauugcgccuuaguucuucuguugaucagcuuugaugugaacuuaaguaaaucaccuaacauuaccaagccucagauccuccaucuguaaaauaauucccaaaguucugcugggacaagaacuguacuuuuuccuuucuuagugauuuuaacacaauacgggagcaucuugggggagauugcucugcaaaagugguaucauauguauacuuagaugugauuuuguuuguaguaccuugcagaagccggcuggacagcugaaggaagagugguaggagugacccagccucgaagaguggcugcuguuacagugaguuucuuuuuguguuggaaagauucuaucuguguugucuacauuugugauuuguuuacauuuccuaaaggcuuuaaaugaauagaaguugcuccuuaagaguuuaggucuucaguuuuuauguuuuuuuuauuuuuauuuuuuuccucagacagagucucacucuguugcccaggcuggggugcaauggagcuaucucaacucacugcaaccuccgccuccuggguucaagcaauucuccugccucagccucccgaguagcugggauuacaggcaugugccacuacgccuggcuaauuuuuuuauauuuuuaguagagacgggguuucaccauguuggccaggcuguucucaaacuccugaucuugugaucugccugccucagccucccaaaaugcugggauuacaggcaugagccacugugccuggccaggucuucuguuuuaaaagaauuaugauuugaauauuuuuguuaaauugauccugcacauuaugaacguuuuaaacaauaaagugcugaggaaauaaaaaaacaauauauuuuuaaaaccccaaauuucaccauccaacauaaacaaugugaacauuugugaacaucauuccaagcuucuccuaaagaugaagaugaaugguugacuggcuggauagaaauaauuuuauaaaaaugagaucauauuuaauauuuauuuuuuauugaauuuaacaaaauaggaaacuuuagugaaauaggaguagcgacuguacuuuggauaaauguucaccgcaagauaauuuauuaaagcuugaaaaguaagaaaaaagaguacaaaaaaauucaagauguuaccuauauuucaaauuacgccuuauaguuuccuguuaugaaagaagaggaaauuagcacauguauucuucuuuccaccuucccuuucuccauuuguuguagauacaguccugucauuuucauuucaagauuuauaauauacauguucuuaaucauaauucucacagguguuuaaccuuaauucuagcuugaauggauucauuacucaucauuaguuauuuucuaugguuuugcuaaccuugaauugcuuguuuugcuuuuauuucuuguauuggcugaauuuuaucauucagcuuuuuuuuuuuuuuaauaugcuugagaauguucaguugugguuuuuguugauauaaaauucuugauucacacugucccugcaaacugcagacuuugcucacugccuuuuggcguugaggaucacuguguagaagucugagccaccauaaguuuuuuguugauaguauguuugaauucuuuuguuguuuuuaaauuagcucugagagauugggugugguggcuaaugccuguauucccagcacauugggaggccgaggcaagaggauugcuugagccuaggaguuugagaacagccugggcaacauagcaagacccugucucuacaaaacaauuuuuaaaaaaauuagcugggcaugcuggcaccugccuguggucccagcuacuucggaggcugagccagaaggaucucuugagcccaggaguuaagguugcggugaguuaugaucgugucauuguacuccaaccuuuacccuaucuccaaaaaaaaaaaaaaaaaaaaaggcuuaaagaaaaggaaguagggccuuuaguuuguggccuuuaccuggacaaacaauuaauucuauuuccccaaguuauuuuuguucuguacugaguuuuaauuauugugucguuguuuugcccaaaguucauuuucuaaugguguucaauuaagaaguuauacaguuuuagaaguuauguguguguguguguuguguuuuuguaugaaaauggggcuaacaguuuggaaaccaaguugcaaaugcugcuggaguuaaucuuuuuugucacuaaaagaugacucaguuaccuaaaauuagaacaauuuuuccuguuugugguuuggaaucccagcucuuaaucaguuugcaucuuaguuccaaauuuguagccauggauaacuuccaugaaaccacagcuuucucuugaaagagcaaagagcauguaauauauuaauagagcugucaaguuugaaaugcuacaucucagaaaguacuuuaugugcagacuaaaaucugcaaacaaucucagagccuaaaaacagauugcauaagcuguugcuugaucucugugagaggcaauuaguagugaguaugcuuguugaacucauguggucuggguuugacuucaagaccagguagguccucccugaccugugauucagaauaagcucuaacaccugucuuauuucaguuuccucauuuguaaauacaacagugucucgucuaccucaugggcugugugucuauuuaaugagauacaaauuugugaaagcuuagagcacagcacuugccaguaguaggugcucagugauuuuuuuuuuuuuuuuggucuuuuaccucccuuuccuuuuggucugucaaaaagauaguauuuguccagucuaguugaugagguuauugggagcagaacuaaagugauagagauaaaaaucuauuaaaaagccaagagaauauaaccuugugugauuauaaauaauaaaaauuuaaaaauagaguuugaaaauaaaaauacauacuuuuuauagcaaauguauucaaauagugaaggaguaagaauaaacagguuuggcuuuuaccuuauagacccauaaaaugauuauauuuuuacagagauuuguuaauuuaugcucauuuuuuuaaauuuaaaauuuuuguggguacaucguagguguauauauauuuauguaugcucauucuuauaagccuauuuucuccauaaguuccuaguaucucuaugcacacauucucuaccuguaccauauucugagauuuauaauauaacgacauguaggguugaaauuggaacaguaacaauaacaaaucuguccuggugaaaugcuggucauugggaaauacaaccaccagaggcagagcaauguaggauaacuuucugguuucauaagacguuuugaaagccuacaugauauagaccagcugccagaugauugauuugguuuuggccuccccauucuauaauuucaagucaccaggcagagcugcuucugauccucaucugcucuucagugucuuaaacacugaugggcaggaaacgccugggugugccuagcucagaagcugagggcagggagccucugcccuccugagccuggggcugcugggguggaaaggcuggagcaguaagcucugucucaggacaccacaugugccagccauguucuaaagucaggacuugggaacugcgugggugcuggggagguugucucaccugugaaagagggagacugaacuccuuccuucuguggggauuggugugcugggcccugggaaaucucuauuaauauugcuucccuuugguucuuuucauuuagguaguuuaugugguggugaauacuaaacuuucuuuucuuucuuuuuuuguuuuuugacacagucucuuugucaccgaggcuggaguguaguggugugaccucggcucauugcaaccuccaccuccccggguucaagugauucuccugccucagccuccugcgaguagcugggauuacaggcgcaugccaccaugcccaacuaacuuuuuguauuuuuaguagagaugggguuucaccaugucggccaggcuggucuugaacuccugaccucaggugauuugccucccaaagugcugggauuguaggugugaaccaccgcguccgguccuauuuucuuuuaaauuaaacuaaaugauauucauuauugcucuuccacuuuuaugcuuguucauucuuuuaaauauuuucuauuaauaaguuaacuuuugaauagccuucuugggggaaugcagagaucuugcuguuggauucauuuuucucuuuccugcauucauuuuuuauuuguuauguuuugauggaugaaauuuugucuauaguuuauggucuucauaauguauuacauauuuugucuuucacuuuauuaugcuaccuuggauuuuuuauugaucuucucauccacucaucugcccccuuuguuuuaaaccugaguuugucuguauuuccccucucaguggcuuuggcagcugggacacaguugugaacuguuucagguaucucauucuugaaacuuagcuuuuugccuucgaugagaaaaugaaacuggcccagcuuugaauaugguaauuccuguucugccuucauggucccgggggauggguuuucuuuucgagcguggagaugaaaaguugucccugguuagugugcccuuuguuuaggaacagggugaaucuugucauuucuuuuacuuuccuuuuugcuuuggccaccaaauuuagagcugaauuuguggcucaacuugaauaauuuuggcauaucuauguuuaacauuuucucauuggcuuugaucuuuugaaauuuuuucuguaauuuuuuggaucuugauccguaacauuuuuaugugauuuuguuuuucauuguguauguucuuauaaguugccccaagaccauuauagaaugaagugagauacauaaguuaauaauuggcugggugugguggcucacgccuguaaucccuguacuuugagaggcugaggcgggcaaauugcuugaggucaggaguuuaagaccagccuggccaacauggcgaaaccccaucuccacuaaaaauacaaaaauuagcugggccugguggcgcuugccuguaaucccagcuacuuaggagguugaggcaggaggauugcuugaacuugggagguggagguugcagugagccgagauugugccacugcccuccagccugggugacagagugagacucugucucaauaauaauaauaauaaaaauugcaaaaguuauuaugcuuguucucuaauaacuugucucuuuucauuuuucauuguguucacauacuauuuaaaauauaaaugaccuuuagauuuuccauaguaugugcgcugugcaguaauuucuaugucucuauuuucagcaugaucuuucuucccaaagguugcagggagaguagcugaagaaaggggugcagugcugggccacgaggugggcuacugcauccgcuuugaugacugcaccgaccagcuggccacgagaauuaagguaaagugcucaagcugcuuuuccuaguggaaauaaggaagaagguuauuuugggagaauuaaaaacauguaguccuugcugcuguacaggacauugauaccauggcagaaagugaagaaaaguauccugacauucagagacuuuagucagcuaggagacagagagcucuuccuuuuuucuuuuuuuuuuuuuuuuuugagacagagucucucucugucacccaggcuggagugcgguggcacgaucucugcuugcugcaagcuccgccuccuggguucacgccauucuccuuccucagccucccgaguagcugggacuacaggcgaccgucaccacacccggcuaaguuuuuuuuuuuuuuuuuuuuuuguauuuuuaguagagacgggguuucacuguguuagccaggauggucucaaucuccugacucgugauccaccugccucagccucccaaagugcugggauuacaggcgugagccacugugcccggccgacacagggcucuuucaaagaguccugcaaucuuaucccagaaaggagcuuggaagucagguuuaguccuugauuccaaagaugaagagguuaagggcuuggaagguugaaugacuugccugauauuauaugccaaucagugauaggaccaagacucaaagcugucuuuucuuauguguauuuuauuguauuuucacugacucaaauagcaaucgaaauauagaaacaagccuguaaaaggcuuaaaaauagaguaguauaaguugaugaaguguagaauucaugaauguuguuucacuaauuaguacuuuuccauuuucauaugaaaauggauuuuacauguguguucuuuggccuuguugcuaauguuaaaauaauuaguaucaauaguaaucaguguauaaucaacucaacaggguguguacuaccuaccaccgugcuagaaucaaagucuaaucagacagugcaauaaaacagugaaugaaaauaaucugaugaaaugaaaauugauuauuagaaucucaguuaccucuuaauuugcaacagaggaaaauugaaaaucagaugagcugaaugaccaauguagugauuuguaaaaauguagaccuuauuuuccagauugccauauuuuguuauauucauuuugcuaggugaagggaauauuuuucuguaccaucaaauauauuugaacuagcuaauuuucagugguuugcauaaccaugaaaaccuuugagccguccauaaaaaccuuuuguauuccauuuggucacaauuucaaggugcucaguucucgacuggugauuugucauugguggaaguucucacuacguauguauguggcagcuaguaccagguccaagaaaaauaugauggcaaugcauccugcucuuaaaacaaaaaaaguaaaaaacaccuaagauacagcaugcaagggagaugguuuaaccugaaaacaaauucaguacguuaagaaggcuguuacuguaugugucugaagcauuuuauaaagauucauuaaucugaaauaauauuagcugacuuuucuuaaacacuacucuguccuagguccuaugcuaaacgcuuuacauguacagucaguccucugcauccugcggguucugcaucuguggauucaaccaaccuugaauugcuaauauuacaaaauaaaaauaaaaaauaauguaaauuuaaaaaaauacaguauaacaacuauuuacauaacauuuacauuguuuuagucauucuaaauaaucuagagaugauuuaaaauauaugggaggguaugcauagguuacaugcaaauacuaugccaucuuauauaauggacuugagcaucugcagauuuugguguggguuggggggguuucuagaaccaaccccacaaggauaccgaggaacuacuauacuaucuuauuuauuuuucacauuaacuuggugagguaaauacuuugauuaccucauuuuacaaaugagcaaucagggacagagaagaugaguaacuuguccaagguucacacagcuuaguaagagguagagccaggaucugaacucccagcagucugacaccauagcccaugugcuuaaccaugauccuaucuagagucuguaaaauaauauuaauugaaguuuaaguuaauaaccucaagaacugcaaucuauagucuuugggacauuugaagagcaauuaucuuacacuuaggguguuucuuugggcagauaccaguuagucuucacugccucuuuaucgauaguacugguggugcaagcccagaggaaauggggcauagcugauguucccauaauaaaggcaagugaaauucugcucaaagauuugcaacuccagcugaggacccuguguuuaaagccuuuugugaacaauuacauugcuugauaacgaaaauaugggggcauuuucucacaguccuuugugggaauuuacuuguacacaugcuggcaaagagguugcacuugaacuuaaaaaauaccauuaauauguaguguaagugaauuauuucuaaagcuuuguguuuuuauuuuuuaguuucuuacugauggaaugcuggucagggaaaugaugguugauccguuguuaacaaaauauagguaaauguguuuuucuuaugauagcuuuccuaguuuccaaaguccccagguagacggagaagcagguguguuaguagcugggauucacgucuguguucagcugccccaaagcuuuucucuugaccuuggcuguugggacccuugguguuuuucucagaauuuaaauaguauggcccuuuacagacacucaaaaaugggcacauuaaaauuccuaucauuacuuagucuggugacuuguccuuuuuauuuugccuugucacacuccaguauugauggugacugcagagaacuaacugcccuguguuaaauguaauauacagaguccaaauaauuuuuuaucacuucccccucuuugucuaucugucugucacucacagcauuaaagcuguccuaccuaggcucugguguucucgaggagagugucacauuugacccccuggcccacgugugucacaacuguagucagcuaccucuuugacuguuguuauagcuuaacagucuucagaugguugggcuuuguucugauuuuuauguguucugugggguuauagguugguuauguuuucauuuaaaaucagauauuaaauucuguuggaauucaguguggaugguaaaacgcuuaaagauaacaauaguacacuuuuuaaaauucagguauguuaaugucaccguuuuuauuaaccuaagaauugccucauugucaaagaagagugacuuagguuuacuuuugaugcaaagugauuguaugaggacuaaauacccagaagcucuuugauggucuagaugagaugauguguggcuuuuuuagaggcucacugagagcuucucuuugauucuuagugucaucaugcuggaugaagcccacgagaggaccuuguacacugacauugccauuggcuugcuaaaaaagguaugacuucacugccagcuuuucauuguguguguuuauuuuauugccuaauuacaaaagcaacuguagcaacuuggaaaguacaacaaaauaccaaggaagaaaauuaaaaucauccauaauccuacccauucagagaauaucagugguagaauguugguauauuuucuucucuuuucugugugugugugugugugugugagugaguguguguguacuuggaucuguuuuggcauacuagggauugauugaauuauauauacuaauuuguaucuugcauauuucccuuaacauuacauuaggaucauuuuucugugucauuuaaauauucucugaagauauuauuuuuaauggcuauuuaaucacaucucuaucauaaaguauuuaacuuccccuacuguuagcaauuuauauggcuugcagauuuuaaauauuauaaauacuguuguagcaagcacccuuguaauugaaucugcugcauuucuguuuauuuucuuuaacuuuuuauuauuaagguuucauacauaucccaaagaaguguauaaugacccccauguacccuucaucuggcuucaacaauuacaacucacagccaaucuuguuucaaucuuaaccuccacucucuccucccuucccauauuuucugauuguuuucuuuggacagauucccaauuagagucuagaaagaagugguagaacagggugauuaagagcauaggcauugagucagacuaccuggguucaaauucuggcuuugcugaguuuacucaucucuaaaauggggaaaauaguagucucuauaucugugcugguauacuuuccuuuaugguagccacuagccaccuguagcuauugagauaaaaguuaauuaaaauagaagaaaguaaaaaaauucagguucucagucacguuggcuauuuuucuuuucuucucucuuuuuuuucuuuuuuugagacggaguuuugcccuuguugcccaggcgggaauacaauggcgugaucuuggcucaccgcaaccucugccucccagguucaagcgauucuucugccucagccuucccgaguagcugggauuacaggcauuugccaccaugccuggcuaauuuuguauuuuuaguagagaugggguuugguuccuccauguuagucaggcuggucuugaacucccaaccucaggugaucugccugccucggccucccaaaguguugggauuacaggcgugagccacugugcccggccacauuggcuauuuuucuuuucuuuuuuuuuuuuuuucacguuggcuauuuuucaagggcucuauagccacagguggcuaguggcuuaugcaucggacaguacaaauaaggaaaguuuucaucauugcagagaguucuuuuagacauagguacuguauauugugauuuguuaugaagcuuaaguaagauagcaaaaaacuuuuagguuggugccuggcauagggucacagcuagacugugagguucuuuugugcaaauuagaaaaagauguucccucugggaggaugucuagagcuaggugggaggcagguggaccggauugcugaagccccuagcccccucagccaggcaucuuugcacaguggguacacuguguaccuguaugcagggccucugggcuagcacauaaguuagucuguauuaguuguuauuauuauuauuuucauuguuauuuuauuccauugccaaagauuuagauuuuuugauacuuuaagggaauuauuguaccauguuauuaccuuuuucaggaacgguauaauaagagggccgauuucacugaaucuuugccaacacugaguauuagccuuaaaaaaauaaauccuugccaaugggauagauggggaaaaaaaaaucucauuguuauuauauaucuuagcuguagcucauuuggucacuucuccaaugccuguugauuauguguuucuuugaguaacuguuaauaucuuuuaucucuuuuuuuuuugccauauuucugucuugguguuaucauuuauuguuuguuugcuuuuaauauacuuuuucauacauagauucaaacuaucuugagacccaggugucaggaaaaaaugguuuuauucucaguaaauucaaauuugggucuuaaagcuucuuuauaguuuuuauaauuuaaaaaaauuuacuuuggaaaauugcauacauuuacaaaauuggaaguaauaguguaaugaccccccccccccuuuauugacaauuauuaauuuguagucaguccuuucaucuguaagcucccuuaccuccuccucaggcaaaaaagaaaaaaaaagacacugaauuuuugaaauacauuucagauaucaaaugaucucauccauaaguguugcacuauuaucauuauuuccaaaugucuucuuuuuuagauucagaaaaagcgaggggaucuucgauugauuguagcuucagccacucuggaugcagacguaagagccuugccuccccuuuccuccucuccucacaaacacuuuuguccuauauauccuugggaaguuaccucuagcaagagcuuaucuuuggcagaaugcccuaucuucuuuaugggaccaucugauguccuagauuucauauaaucagagguuacuccuuuucagcuugugaaauuagacuguaauuaauugagcucauaauuaccuaccugucuuguuuaucuacauacugucuuucuccccacuuacacagcuucuuuuuguuguuuuuucaguauaagccuguauuucuugaauuuguuuauuuaugacuauacuguauagauuuagauuuuucugugcaauugaaguuucuccugggcugggcacgguggcucacaccuguaaucccagcacuuugggaggcugagguggguggaucacuugaggucaggaguuugaggccagccuggccaacauggugaaaccccgucucuacuaaaaaugcaaaauuagcugggcguaguaguacaugccuauaaucccagcuacuugggaggcugaggcaggagaauugcuugaaacugggaggcagagguugcagugagcugagaucgcuccauugcacuccagcuugggcaacaagagcaaaacuucaucucaaaaaaaaaaaaaaguuucuccuguauauauaauaauuuccauguuaaaguuuucuguggcuagguuuacauuauuuuucucucuuguggaccuauaguuuaaacagcagcucaacucaacaaauacuuuugaccacuuacuauauuuacaugcagaaauagauguuugcaguucaguguguucaaaguucugaggcagcuaaggagggagcccuuaacuccagccagcugggggguguccagaaacuuucgcagagguggugaccuaccagcugugcuugaaagauggacagccguuuuccagauggaugaagguggggaagggcacccuaaauauaagugaaaucacagggacaugaccaugaguucauggagcuucgagucuuaucuuaccugccaggcccucaugggugaauuacccuugaacucccucucugacuuuaucuucuuccacuuucuccagugcucccuacauuucagccucacuggucuccuugcuguuccucaaaacaacccaggcaugcuucugcucuggaggaacccucuuuuuagaccauuccuuccccggacagccuaagguucucuccuaauuucauuccaguuuugagcauuuauuaucuccucagagaggcgcucucuaaaacagcaccccaguugcucuuuauucccuuauucugauuuuuuuuauguuucucacuugucuaucacuauuuaacauuauaugcauuguuuauugugugucuccugucacuaaaauauaagcuccaugaagaucaggacuuugucuuauuuuaucucuuccaccuaaaacaaugucuagcacagaguaggcacuuggguugaaugaauuuugacugacugggaaguaauggaagauuaaaauggggagguuggggucagaugacggaaagccuuagaggcucagccagagaggaugaacuccauccuguaucugguugggagccaugggaacaugugagagagggcagugacuucaucauguuugagcucuauaaagaucauucugagugcuguguauaggagaugagaguagauauggagucucuaguaaggaggccaguucugaaauccaggugagauguggucccuggcuccuggcuccuagucucccuguggcuucugggauacagaacaacuuggagagagagaaagcuuaccauagcgaagguaaauguccaacgugucccgagacugguuucucagaccuuuccacaggcuguaggagucuguuguuuuaggucugcccaugguaacuuuuggguuaaagcuccucuguugcccuguuuaauugucaucucccucacccaugguaucugcuggcaugcuauuuuguggacuguggcugacuucaccucuaguuagcuccucuguggcuacauuacacagaacaucuguaucucuuuuucaccccccaccuuaaaaauuauuaaauuaaguuaaaaauuauuccaguuuuuauuauguugaaaacuauaauguccaagucuuuucuuagauucauuuuauuuauuuauuuauuuauuuauuuauuuauuuauuuuuugacaccaagucucacugucuugcccaggcuggaguacaguggugugaucucagcucacugcaaccucugcuucccagguucaagugauucucgugcuucagccucccaaguagcugggacugcaggcaugagccaccaugccugguuaauuuuuguauuuuuaguagagauggggucucaucauguuggccaggcuggucucaaacuccggaccucaggugauccucccgccuuggacucccaaagugcuggauuuacaggcaugaaccaccacgccuggccagauucauuguuaauuaauacuuacuaauuguucacaauugccuuuuauugucuugguggaacacagagaugaaaaaaauagcuucuuucaguucugucuaugguaguugauauagaugacuuucuggaagcaauuuuguaagcgggaagacagcauguaggaacuuugucaugccuugcucugcugugguacgggacaugcuggaccucugguaagcugggccauuccuucuuauccuguccuugcugcucagccagugccuccugugugaggggaacggugguuucuaagugucugugaaugggggaucugugugugugagucaucucuguguggguuguggguccgugugugaggggccuacgugagguaugggaugugaguucguaugugagugaaagaaagaaagaggauauaagugggcgaaagagggcaagaaugaggacuaugugggaguggcagggggguuggguguggcuuaggaaacauuuugaucuagaggcguagggaaguccagaacucauccccugccccccagcggcugggucugugggugacagacuaauuucaaaccuccuagagcuagggcugcugauaggccaccugccgugguuucucucagggacugggguggcccagccugcagacaaagacagcaguggcugcagccgggaggcagagaccugcagagcaugauggggcugaucgaauagcugcuuugguugcuuuaucugcuuucuuaauguaagcccaauuaaacgaacaauuauauaacaugacuggauauaauuaugaaguauuuauugauccuguaucacgugaugauauugcuuuucuuuuauuugcguccaacugcauggcagaauauaugguugcugguagcucccauaguuuuuuugucauaaguccagcuacuugaagagagacuaauuucucuuuccagauucuuagagaaggaacuuagcaucagcuggggucaggucuccacccuggaccagucuacaugggccaaggcuguuggccaaucauggguguguuggguagacauagcugcuuaucggccacuccaguggguuaggaaggagcagguaccagggaaggagccuauggugagcuagaagacaacccugcagauggccauaucauuuacauuccauuucauagacuguccccugccuuuuuaugauguaugcuucuuaccaugucuguaugucaaugugaccccaccucuuucaaaccugacucaaauucuucuuuucuggguguguugaacuuauuuuacucuucuuguuccuugauucugccucaagauucuugcauuguugguacuauauuuauuuacuuuuuuauguauuuuguauuuccaaauaaagauacaagauaaagaucuuaaaggucuugugccuucucaguaaaugcugagucuuaauucuuuuuguuuugagacagaguuucacucuuguugcccaggcuggugugcaauggagugaucucggcccacugcagccuccgccucgcagguucaaacgauucuccugccucagccuuccuaguagcugggauuacaggcgccugccaccacgcucagccaauuuuuuuguauuuuuaguagagaugggguuucacuauguuggccaggcugguuuugaacuccugaccucaggccauccacccgccuuggccucccaaagugccaccgcaugagccaccgcauccggccgagucuuaauucuugaaagaguaacucuuuacuuuucaguaccacauaguccuuaacgguaagguuuaggcaucuacucuaacaaaauugucaaggcaucaucuucuuccuuguucugcuugcuuuuuugguaacauucacccuuguccaagcccuuugguaaaaucuuccuccuucuccuuccauagcuccuggagcccugcugacuucccucuccuaccuccuuguuggcuuccucuugggccccuucucugucugcucuuccuucucaaggcugcacaccccuguggucccugguucagcugagccuucgugcuuguggcagucuugacugugugcuugcacaccagccuuagcugucugacagcuggcuagccacagacauccuaaacucauaaacuugugacucucugauucuccaucucagucucuuucucaugaucauagucauuuaggccaagaccuccauugcuuuaagaaguuuuuauccccggucgaguaagagucacucuagccuucuuuccaaugugcacgugugugcacguucacucacugauugccaguucccaccagcuguaucucuggaaugcuuugcccagguucacacuuugucuccccugcacuauuaugauagcuucauuaauuaguuuguuugccucgaaucucuuauuuccucugcccuccuccaaaauggccacuggagucugggauucagcucacaggucugauaauaucaugcccauccucacugcccuugucuugcccaucgaauaaagugccagugcagcugaucacuugggucccuucagaguuauggcugacaucacuuauugagugccauucuaggcuagaugugugucacaacuaucccacauaguuuauuugaaccucacagcaaccuugcaggguggauagcaguuuguccauuuugcagaugagagagcugacucagagaugaggaggccuagaccuugccucuguccucccuuagggaccccuuuacauuuuaguccauacugugcuauuguccugggaagggaugucucccccuucccagccaguaauaauccuccuuagccuuuacagugcaggcaagggauacugcuuucuccaugaagcucucccugaaagccgguaguucuuaacuuuuccuucuaucagauugcaaucugcagcucuuuccuggucacagggucaucugccucagggauuauuuuaugaucaacucuuugcacgucugccuucugugaacuguuuacucuuuuggggcauggggugucuguucccacuuguuuguaugucacuucuaguguaccugugcugugcaugucauagggaugcaggaaggcugaagcaacuugaagggaauuuacccaaaagaaagugaacaggaguacuguguggaauucugcauagcaaaacauaguuuuguugacaugaggcacuuugaugucugugcuuauucuucucaauuuugagguuaauauauaacaucccuguauuuugugguuaaauccaguuuacucuuuuaaaaguaccccucagagccccuucacuuagcguuugaugccauucguuagcacagcuccugggcuccuggguuuccuggagcaggaugggcauguuuuguaaagguacauagggaaauaaagacaagcuuuguaguuauguagccaggccucagggaaaugaguagagguggggaauggaaagggcacccagauucaaauaauggagcacuccacccgacgggauauccaugcccccucugcagugggcaccagcugcuucccaucuggugcucacuugccugccugcauggucacuuagcucuucucagucucagcuucucuuuguaccuuagggucacauuccccaagagaggaucuuugguggcguuuccuucccccaucauuggcuggagcccucaagacaggucuccuugugggcugcaagugguggucaaguaccauuaaauaggauguggacaccuguuuggcagaaacugccaagagacacuucucccaacaggguacugcacgaguguuggggaaguacaugauugauggccuaccccauacaaagccucgcacucacuacuguagggcguguaaagauggagaagacacuaucccugccaucaaguggccuaaaaccaguaacaauggggccggaaacacaccuacuguucacagaaggaaaaguuuccuaucaaaugaucauaucuguguuuuccagauagaguuacccaccaaccucaucuaaccuguacugaacuugagucacaccuuugaccuaauuuuugcuuaaaugaaauacagaggauaggaauaauauaaauaauacuaaagcuacauguuaacucagaugcuaugcugaaugcaguuuugaaaucuaaccuuuauuauuuuuauuaaaacuuuaguaaagacacugucauugaaaugugauuccccacaauuacaguuagaaaaaugugaauuuaaaaaauguauuuugcaacccauaaucuguauugcacauauauaaucuugcuacucaccugucuuuggcaaguuuuauauuauuuuuucuuuccaugaaucgcuacgaaccuuuuuuucuaagagaaaugaagaauuaauuuuuuucuuuuuagaaauuccgggauuucuuuaaucaaaaugaaaccagugauccagcaagggauacaugugugauccuuacaguggaagggagaacauuuccgguggauaucuuuuaucuacaaagguuugaugaugcuugaauucuggaugaugguguuuagaaaacucagccucugauguagaaugucagaacugcauuugcucacaacucuaaaggauggggaggagcauguuuugugucccuagucauuggucuagaauguucuuacccugcuccggaucacugcugaauuuaguuuaaacuguucacacugacaugcaaguuuccguaagucuguggccaguagcucagccagagagagcaaaaguggugaaagguuuuggggagggaagcuugauaguuuucagaacugggguuuacaaggcugccugucagcaggggcaguauuggugauuugaaucauuuggcucucaguucucuacaucccuagcgagaaggcccaguuggcauuuuuaggaguagccuacuuggacaaggaaggggccauccuaauuccuguacuagucacuggacaaaaaaagaccaggagccuguuccaguggcugauaaauccagagucguggacuugauuucugaaucguuuuguuggagagcucauccaucagggccauccagccgacccauagaugcugcuauugguuaggagggaaaaugggcugggaagagcgugggcuucagcacugggaccacagcuuccgauuuucacuggucugaugucuuugcauacuaaagauagcacaucuauuuguauggguauaucauguuauuucuuuccaaauaaagcuaaaaaucauaguugacauauaauuauggauuauucuugaauauuagauuugaaaaaaaugaauauuuauuuuguuuauccuguacuaauuaccuacugggcaggcccaaacucacuuugaugagcuuugcugccagauuauuaggguaauugaucuguaauuaaugagcauauucuagugaugaauucaucccauuugucuuuucaguccuguuccagauuauaucaaaucaacugucgaaacuguggugaaaauucaccagacagagggagacggagacguuuuagcauuucuuacuggccagguaaugccacuguacuucucugaugaauagacauguuaagacagcaccaaaaguaauacagagccuuguuacuuuacucagucauguauuucauguuuuguuguauuuugugguuccauaauuguguagaaaauugauuugaugucauucaucuaccaucuagauugucagggacucguuagccccugccuguucugucugcagaggguuaaauguuuuuuuaaauguauuagcugauuccaaaauaaacuagguaguugagugagggcuauuuuguuugccagaauuggauacuacauuagguccauguccugcacacauguugcugcuguguaccucuuuuuccagugacaccuuuacagcucauccuggaggugauaaguggccauauuacugguaaaacaacugaacagacccaagugcucgcugacgguggccagcacuauucagaccugcccuccaacuguaaucuuuuccacugccaaacacuuuccaugguucaguaaucuuuuuuggagaaagcuuacagugauuuuauaugcugcaacuugucuauaugcaugagaugcuuguuugacaccguauauguaugcugaguaaaauagucaucguuuuuauuuauugggaacucuuccauucauugcagaucauaccgaguuuuuaguaacuaauaguguaguugcaaaauuucacccauugucaucauuguguauuagcauuuaauuaaauaccaucccagaguggaacaugacggcacugaaauucuugaaucugaccaaaauuaaaguccagaucccaacuuuuauuuucuuucaguaugauaaaauagcaugcuuuaaauugaucucgguuucuuugguuccugguucaacgucuuuaggaagagguagaaacuguugugucgaugcucaucgagcaggcucgagcacuagcucgcacugggaugaagagacaccuccgaguucuccccauguaugcaggacugccuuccuuugagcaaaugaaaguguuugaaagggugucacgcagugucagaaaggugagacuauccugaugaccaaggguguuggcagccgucuauaaucauaaugaugcuccuuuacuuguuuugaaacuugcuaaacacaaggcagacuucuagguccauauuucuguguaguagaucuaaaagcacacaauaaauaauacauugugaagauuucuuuuuuuuuugagauggagucucgcucuguugcccaggcuggagugcaguggcgcgaucucagcucacugcaagcucugccucccggguucacgccauucuccugccucagccuccugaguagcugggacuacaggcgcccgccaccacacccggcuaauuuuuuuuuguauuuuuaguagagacgggguuucacuaaguuagccaggauggucucgaucuccugaccuugugauccgcccaccuuggccucccaaagugcugggauuacaggcgucagccaccgugcccggccuguugugaagauucuaaaccugucccacugaaggaucacuuugacaguaguuaucagaucaggugacuucucuuuucuucucuucugccuuccuaauauuucccacgacacaugcuuacuuuggcuuaagggauuguuuagggggauugaggucagucaggagcaauagaaaaauugguacacaugguuucuaaauaauuuguuuuaaguaucagcuugccuauuuuaaagggccaaguuuaaaucaauuaauucaagguguggcuuaaaaauguuuagccuugaagugagagugaggaagggugugguggaaagcauugguuugaaggagcuggcaggcagccaguccaccugggccugacucugccuuuuccuuucauuagaugaggacugcacagaaccagcccgaggacagcuuuuacuguaguagcuauuuaucaacagauggcagagaauagagcaggugagggauggucugaggauccacucccaauuucagaccaccuggaagagggugcucagccccuugaccauugggauggagcaacaugagucugcccugucaaacauuaauugcagccagccaaucaggagaccuggauucugccccugagcuacuaugugccuugggacaacugacuuaaccucgaaucugaguuuuugcagcuguaaaacguaaauaauaauaacuuucagauaggugguuuuauagcauaacaucuuaaucccaacuacauaaaaauauuagaaagauuauuuuauaaaaugaucauuuauaaaauaauuuuuauaaaaugauuuauaaaauguaaagugccugaaaaaaguucuaacugcuauauauauguguccccugcuacuuaaacccuucaggggcagcucccaauguacugggaauaaaauucaaauaccucaugguggcccagagaccacauaugauugcauaucugccucccucugcaaccucaucuuguacuuuguauuuuggcugcacuggcuguuucuccuuccuuugaacuguuucuuauucuuggaucucuauaggguuggcugcugcuuguuacucaggucucugcucaaaaucuuucacagaggcucugccuggccaacaaaaguaaaguagcaugcccuauuauuacaauaauauauaauauacauguuauauacuacaucauaucauauugccucauuguguuaauauuuucuuuauaguauuuguuguucucugaaauuaucuucuuguuuauguucagcaugucuucacccuaaacacucaaacuagaauguaaacucuggcagagcaggggccuugucugucuuguuuauccuacaucccagcaccuugaacagugcuuggcaaagugcacacccucagaaaguaaucaugauaugaaugaauaaaugacuauaccugcgcaagauggagggugauuuacuuugguuaugccaaagggaaaaacuaacaaaugcuaggcucugaucacuuuauauauuaauuguauauagucccuucaguagcccuaggggaggugguaaaucuuauuauguagaugaggaaacagguucaggagguugaguaacuuguccagggucacaugauuagggagaauucaaacccagggcacccccugacuuggaaacucacagucuuucuaguauauuaaacugccucucacagauucugcaauguuggaaauguuaaaucuuuuaggauuuuuacgaguuuguuaaaagcaaaaagaauaaaaugaguuuuauucuucuuucuguggggaacguaggugauaguggccaccaauguggcagaaaccucuaucacaaucagcggcauuguguaugugaucgacuguggcuuugugaaacuccgagccuacaaucccaggacagcuauugaaugcuuggugguggugccagucucccaggcaucagcuaaucagcgagcaggacgugguggucguagucgcucgggaaaauguuaucgccuuuauacagguuaguguggcuuucccuaaggguuuuugacuuucuuauagucagccugggcaacagaguguagcaaauguuuacuccuaaugguagaacuuaacauaaaauacaggccuuccucacaaggcccuguguaaucagauccccacugcuuuccucacucuaaauaugguguuucuuuguuacuaguccccauuggccaaagcuggccugugagugacugcuuauuugcuauccuguucuaaccuaacaucugggcacaggccuguguagccauuugucccuagggugugggcuguguguccuggagccugucuuucuugccuuucuuucuugacuuaaugugcuguuuuuguauuccaagaucccugagucuugcggagccucacauuggguuccccuuuuacuucugguucagagcaucuuugccaagugaaaauggaaggucuguccggagacucauucauagaaaacaaauaguuggugagcuccuccucugugcugugcaucaugcuaggcucugagggaacagaaggcaauuuuaauacugucucagccuuucuggagcuuucuauccagcuugaagacagccuuaccuauagacagugauggacccagagcugcucuuucucugcacuucucuucuguggggaaugcugcugacauuuuccccaguuguccagacucaauuuccaagucauuguuaauucucuucuuuauccaguauccaucugcauucacuuaaccaggcccaggguuuuuuauuuuguuuuguuucuucugguguggcugccccuaaagaagguccagggguuuuagcucugccauuugucucuucuuuuccuuucugguuauuauuguccuuguucagucuuugauguugaucuuucuuuuagcagauguuugcagagcaccugcuguaugcuggccacggugcuagagcuuggagaucuggggcuaguaaccauggucuguggccacagugacugacagucuggugguggagguagaccucaaaacagaucagcauauuaugguaugauagggagccauaaagaaucgggagccuuggaagcagagagcagaggcuuuuccuugggcuguuuucccugcccagcagaucuuccuuaucuuucaaauccucucucagauggcaguucccucaugaagcuaccuuagaugccuucuccuagaagcugguguuauccuucuggggauuuggggaguacuucacaaccaggguguuguuugagccugaucuuacuggcaauacaguccuuaucuaggcgaagaggugauuggggagauucaauuucagcgcaccaggcagagggaauggaagguacaaguacuugcagggaaggaaguggguuuggaacauucacagaagggagggaauaggcagaacccagggccugaggaccaagggcaaccacugaagaugcuaagaaggaaugacuagaguggaaaagggagagccaggacugaaagggauucugacaugcagagaagguuucaagacauuuuucucuucaaaaauuauuuauuggggugaaauuuacauaacacaacauuaaacacauuaaagugaacaauuuauuauauucacaauguugugugaccacugccuccaucuaguuucagaacauuucagccacuccagaauaaaaucccuuaugcuuuaagcaguuucuccccauucuuucuggcuaccagucccuggaaaucaccaaccuguguucuucucaauggauuucucucuuuuggauauuucauauaaaaagucauacaauaugugaccuuuugugucuggcuucuuuuagcauaaugguuuugaggcuuaucuacauuguagcauguacuucauuccuuuuuauuacugacuaauauucuguuguauagauaaaccacacuuuguuuauucauuuauuaguuguggacauuugggcuguuuuugccuuuuggcuauugugaauagugcugguaugaaccugcauguacauguacuugaguagguguuuuuaauucguuuuggcuauuacaggguuauauguaauuuuguuuaacuuuuaaggagcucaaguuacuuuuaaagaggccagcauuaucucaugugccaagaaaucauggacuaaagauaggcagguggauuugggugaaaagucacugaaucccuuugcaugagcaguuuaguggaagugggguuggggagggccccugacuguaaugagugcauugguguccagccucuaggccuccacaggagccuccagaaaguauugcuuugaacaggguaccaccugcucagacccuccacauuuucucaaaccauccaggauuuuuccucagcuuaucuucuccuacuaaccacuacaaauugcuucucagcugaacuacuacacgacaugcucucugcaugagaaacgcuuagauaccuuuuccuugagcuguuuccucuuugcccaacagauccuccuuguccuucaaauccucccucaaauggcaacaugcagcuucccuggaggccuucuuccagccacccugcuuccuccuucccugagccuccauuucucuuugggaggaccacuccuugggacuuuuccuauuucuccuugagggucaacuguuucugguccaggucccaggccccugcauaucacugaagcuuuucaaggggauuggcugugacuccuacagcuucuggccccaugcuucacacacuugaguccucaggagagcuugccugucauugaacuuuuaggaaacacccacuuccugugagcuuuucagcagggugguccucuuauguguuaacuuuguuucuccuuugguuaguagugugcuuggaaaaugggguuauccuaucaagaagcuguaccccaaauucucuugaaacuaaaggaaguagcucauuuggaacuuccugcuguuggccgucauccagaaccuucuaguuagacccaauuuguaucaauuaguccacagaauauugguugucuguuuucucaaagaaaaccuuucugaaguuuuucggggauagugguauuucuucauggcacuuuuuuuuuuuuccucuaguuaacuaaagcuuuaugaucuaaauggaaguugggucacccuuguauuguuuaagaaggguguacaucaguuacaauguugacugaugugggagguuuugguggguggagcauucucuauauaauccuuaagcuuucugaauauacaugaaaaugaguuaaucucuuccucuuuuuuccccacccuuccugccuagcuuuuauaaaaaggccuucuuccaaagucucuucuccuucccccucccuuucugcccuuccugucuugggaucucugugucuuaggaugcuuuuuccuguguaaggucaccucuucuuccugguagggcauguaaacauucauuucuugguuuggggcagcauuggauucugggaaugauauuguguaccuggcuuguugauuuaaaaauuugauuuggacaauuuuugcucuuuauaagauuuggucauuuguuguauuuuggugauuuaucuugaaauuguucuuugcuuguaugugaagcucuugcuuccuugacuuauuccaaacagagaugguggcaacugggaacugauagugauucagcaaguacuuguugguuugauuuaauguuuugcugacaaaaaacauuaaaaaacagaauuuuagauaaaguuuuauaaagguguauucaaauauauuuaucuaaggcauuuuaaaaauagaauggucuuuccuaaguauaaaaauaacuuuauaucaugguaucaugugcaucugcuucuagaauccuagagacccuuguucaagauagagaagaaaauuugucccuuggcauagugauugcauuugauugugacauuuggucccaaacaguucugauuuccuauccucagaggaagccuuugacaaguugccucagucuacgguuccugagaugcagcguaguaauuuggcaccugucauccugcagcugaaagcacuaggaauugacaauguccucagguuccacuucaugucgguaaguccugccugcugucuggggccauagggaggcuagggagcucacagggggaugucaggacauugucguagggcaugccaucuuuccuuuuuuucccuacucaggucauguguugugugucugcuuugcaaccaggcccugugcaggacguaggggaaaacagccagacaagguagccucaauuccuauucuuacauaguuccuguucuugucugcuggggaauagagacaaguaaguggguaauuacagagcagugugcccagggcucugagagacaaaggaagggccucccaggugaaaccugaaacccaaauagaaucucaccagguuaggaguggagaguuccaggacagcuagucuuuguagaggccuagaugcaggaguaccaugauugggggauccuuccugcagcuuuagauagagcugcaggaagacccuugugccugauugcuuccugagaugauuucuaggaguagaaugacugggucaaagggccguuguccuguuuaggguccuguuacauggccagauugcuuuaccaaugucaacucuagcagugccugaaugcccaccuugugguacuuccauugugccauguuaucuucuuuggguuugcugauuugauuggccagagagaggaaaucaccuuuauuauaauuauuuuuaaauuuuucauaagauagauuuuuauaaaaacauuuauuagucaguuuuuauuucuucugaguuguuaagcuauuuaucuguuagaauuugugucaguuagugauuuucaagaguccuuugaauauuaaagacauuaauuuuuauaauauuucuuacaaauauuuucuauuuauauuuuacuguuuuuuuuuuaauguguggacauucuaaacauauucacaguaaucuauuuuugccuuuaugauuucuuuggcuauucuuuuuuucuuucuuuauuuucugagacagucucacucuguagcccaggcuggagugcaguggugccaucuuggcucacugcaaccucugccucccaggcucaagugauucuugugcuucagccucuugaguggcugggauuacaggugugugccaccacgccuggcuaauuuuuuauauuuuuaguagagacaagguuuugccuuguugaccaggcuggucucaaacuccugagcaggucaggugauccaccccgucugggccucccgaagugcuaggauuauaggcgugagccaccacccccggccucuuugguuauucuugcccuuaugaaguacuucuuauauuugggucaguuaauacauauucucucauauuuucuucuagaauuuuuaugauuugagaacuuuguuuuuucccaacuguauaugauaugacaagucuggaaagucuggauucuuggauaguaaagucccuaaugucauaugugaugguaaacuaggugaaugaaagaauagaacauacaaauaucaacucccccaaagaaaauuguguacuuaccauaaguauagggaaaauggacccuuugauuauugguguagaguagaagauauuauaaagaaaagauaaacaggcugagcgugguggcuuaugccuguaaucccagcacuuugggaggccgaggcagguggaucacuugagguccggacuucaagaccagccuggccaacauggugaaaccccgucucuacuaaaaauacaaaaauuagccaggcaugguggcaugcgccuguagucccagcuacuugggaggcuugaggcaggagaaacgcuugaacccgggagguggagguugcagugagcugagauugugccacugcacuccagccugggcaauagggugagacucuuucuuaaaaaaaaagaaaagauaaacaguaugugcugauuugaaagcuuaugaaaagccccgcauguaaaauuaaagaaaaacauacagugacagaaaugacagaucaguaucucaaaaaauaugaagaguuuuuauaugcacaucauuuacaguaaauauucacuaaauaaagcuaaaggaaaaaaacagcacaaauucaaauuucaacuaucauuaggacauguugagcuucucuaggagagaggugacugcacguugauauagcuauaaaggaugacuuuacacuaauuuuuuuuuuuuuugagacagagucucucucugucacccaggcuggagugcaguugugcgaucucagcucauugcaaccucugccucuuggguucaagugauucucguaucucagccucccaaguagcugggacuacaggaaagagccaccaugcucgguuaauuuuuuguauuuuuaguagagacgggguuuugccauguuggccaggauggucuugaacgccugaccucaggugaucugcccaccuuggccucccaaagugcugggauuacaggugugagccacugugcgcaguugacuuuacacuaauuaaaugauugaguauaaacaaaaauggugaaaucgaaaacugccacaauuugggaaaguaaauuccucccauguuauaccguuucuguccccauggaggacuuucugacaacauuuaaugagccguagaaaugucugcuauuucuucucauaaaaauuucuccugaaaaaauaauucagaagaagaaaaaaagcuuacauaugugauaaugcuuauagcauuuauauuacauuuaaaaauauaaauaaugaaaauuaucguaaaacuuuuggacaguugaaaaaugaaaaaaaaaauacaaauuuaucuucacauauuuccuucugguuauuauccccugaaauugugguuuuuaugauugaaauuacagaguacauauaauuuuguauauuuagcaauguuauuuacaauggugaaaaacuggaacaauuuaauugcccagcaauaagaaaauugacuuuuuuauggaguaugauugucauagaguauuaugcagccaucccaaguaguuacugugaaguuuguaugggugcaagaaacaaugaaaacagaaaaacauguagugagaagaccacacuaaaacuauacauaaacaguaauuccagauauguuaaaacaguguuucuguauuaucccaaaucaguugaggucacagagaaauacuagugaaugugauuagaugaaaauacuauggauaagauuuuuguggagagggggauaaguuuuuuuuguuaauugacuggaaaucgggccaggaauugagucagagcugaccuuguuagcuuuuucuguaauuguuaaaagccuaguucagagauugcuauuccuguuaccucauccacucucaguauaaaagaucccacaggguuuaagcuccuucauuuaaguguugcccauuuugcuucuuuguagagaaagauguuguaagcaccaaggaagggcuaguggaucauuuacaugauuugcucaauggugauuuguugaauccucucuguguaaugaauccaauagguuuaguuccugcccucguguguucaccuguguguacggucacuacaacuuuuaaaaaaguuuaacuuuggucuuuggcaaacaaaguagggaagguagacugggaaaaaugaggccugaguucagcuuugccaccaacugccuauaugaccuuguucagcugucuuuuccuuauugcaguucaguuuccucaucuguaaaacugagcuaaaacaaugugaugaauaaaauacauuuguuaugugaaugcauuuagaaaaaaaugcuaugugaauuuagaaaaaaugcauuuagaaaacauccuaugcaguuuaaaaauguacuguaauuuuauuaccuggguuauuagaaaccacauaauuuagagagaaaaaauaugaugccuggcacuuaggugcucagucaagauuuguagaaggaaaggagguaaagaucuggaaaaucagacugaggcucacuacaucagcuuugcuuaugaacuuuaaggucucuagagcuauuauuuuuugaaauucagauucgacauauguuguaguuuccagacagggauuaagaaaaaacaaauucagcguauguuauuuacccaccacggggccuggagugggucuaugggggaugcaaagauaaaucauccccgagcccugagugcugcaguguccuggggccccggugugguagaagguugagucugugaaguaaaaauuagaaaugucucaggaggguuuaaggaaaaugaagagguaguuuaagauagggaccuaucacgucugauggaggggaggaugagggagcacuucaaagggaaauguuucaucaagcugagccuuaaaggccaagcaguacaagggugccuagaaggacaggaaggacauuucaagaggugccaacagcaagaacagaaacauggaggcugggaagaauggggcauguuagaggggagaauggauuugaaaaggaaacagccacauuuuaauguuuguugcccaaauaaauugauucaggaagauuuuuauguuuuuuccagcccccuccagcacagucgaugguucaagccuuggaguuacuguaugcucugggagguaugccaguuucucucaucauucucucuuauuauguguugucuuuugugauauuagugaggucauauucacuuuagggauuuuaguaucuucaggaaugggauugguucuccccauauauauaaucccccuaaugauacuuuauugaaauaggaaguugggaccauaauuagacacaugaaagcuaauuaugacagccaguauauaaaacaugccaguucgucagaagcuauuaguaagaaucaccagggcuacacuccuaagagaugucuagagaucagcaguucccuaccaggaugucagaucuuaccuccccagaccuuuuuucuccacccaacaaccacauccuuaaaaaucguggcucaguauucucucccuaaauccucuucauuucauuccuggaguugcuuguggagaauuggggacauuaucagcuucuaacaccauguuacgggggaacuucuauucaguugucgauugaagauguuauuagguuggugcaaaaauaauugugguuuuugccauugaaaguaauggcaaaacccgcaauugcuuuugucccaaccuuaauagcguuuaucuugacauagagaaaaucauagucugaauucaccgcuuuggggaguacuguuucuucugugauugguaccacaaaugaauauaauuuccaauuuugaauuaaguuuuaguggagauuuugcuuuuugagauuuauuuugaguguuacuuuuuuuuuaaguagcuguauugaaguauaguuuauguacuauacaauucacucguuuacaguguacaaauucagaggcuuuuagcauauuuucaggguugugcaaccaucaccacagucuaauuguagagcauauucaucacccaaaaaagaaaucuuuacccauuagcgccgaacuucucauucucuuucccccuagucccccagcccaaggcaaccacucucugguucagucucuauagagaguuuuuaucucuauaggugugccuuuucuggacauuucauguaaauggaauuguauaauauguggucuuuugugauuggcuucuguuucagucugucugcuguugcuauaacagaaugccagaggcuggguaauuucuaaagagguuuauuugggucacgauucagguggcugaaagcuccaagauuaggcagcuguauuugaggagggccucagccugcuuccacucaagguggaaagcaaaaggagagugggcgggugcagagaucacauggcaagagaggaagccaggaagagaaacagaggaagccaggcucuuuuaagaaccugcugucaugggaacuaauccauuacucacccuggguaagggcauuaaucuguucaugagggaucacccucaugacccauacacuucccaguaggccccaucucccaacacugucacguuggggaucaaauuucaacaugagcuuugguggggacaaacuacauccaaaccauagcagcuucuuucauuuaguaucauguuucacagguuccuucauguuguaacguauauucauaccuuauccccuuuuaucacugaauaauauucuguuguauggauauaccacauauuuuuuauccauucauuaguugauagacauuuggguuguuuccacuuuuuggcugauauaaauaaugcugcuauaaauauuagcauauaaaugugguuuugguggacauucccaccagcaauguaugagaguuccaguuuuuccacauuguugccaaugcuuguaauugucuuuuguguuauagccauccuagugggugugaaaugguaucucuugguuuugauuugcguuucccugaugagucaugauguugagcaccuuuucgugugcuugcugcccauuuguaaaucuucuuuggagaaaagucuguucaaauccuuugcccauuuuuaugugugcuguugucuuuuuuuuuuuuuuuuuuuaaauugaguugaaguucuucauacauucugggcacauauucuuaucagauaugugguuuguaaauauuucucccauuuuuguguuuuggcuuuuuacuuacauguacuuacuuuuuacuuauuaguauuguuugcaguacaaaaauuuuaaguuuuugugugguuccauuuaucuguauuuuucuuuuguuacgugugcccuuggugucaugucuaagaaacuugccuaacuuguagucauuaagauauucuccuagguuuuauaguuuuggcccuuacauuaggucugauccauuuuaaguuacuuuuuugguauggagugagguagggguccaucuucauucauuauguugauuuuacuucucugugaauagccaauuacugauuuaaaagaucuccagugauuuaaaagaccuucagcuggauuuacauaagaucagccuggagugaauguguguuggagaagguuuccacccccuucuucucaagcauguaaugggaacucgaaagcacauuuccugggcugaucuguagugaggaugagagaauguugacagcauaggaguuuuuauuugggcugguuuuucuccagucaaacagaaugaaauuuaagauauuuccuauuucuucaauacccuaaauaagcuggaaaagauagagggaccccccgccuccccccgccagcuucauuugauuucaagcugaauuaccaccuuuaaagagaugucuuacugagcucugccuuacugugagaucuugcagcguuuaaguaguaaaacaguagucuauaucuugggaauccaauaccuggauauuggcaagguauugccaauagagggcaagaagggcagguggggaguugaaagagucagcccaguucagcaaaauguucaggaggcaguugcaugaacagggcugguguuggcaccagagggaucuggguuaguguuuagauuccaaguugcuggcccuguaguugcucauuguuguucucauuguggcuaauaaagagauacucaagaccggguaauuuauaaaggaaagguuuaauggacucacaguuccacauggcuggggaggccucacagucauggaagagcaaaggcaugucuuauauggcagcaggcaagagaacuugugcaggggaacucccauuuacaaagcuaucagaucuugugagacuuauuaucacgauaacaguaugggggagacugccccugugauucaguuaccuccacucggccccgcccuugacauguuuacaauucaaggugagauuugggugggaacacagccaaaccauaucacucauuuaguaugagaagggcacaggacacgggaugccaucgauaccauccuggcacaucuguggccuguccgguccuggaggugguagaaaguccagacagugagggggcaauggagauggcagagaaccaggagaguugggggccgggagcuggcgaagaguaguuccaagaagcagcggccagcagagccgagugcugcugaggccaucaggaagaugccuugcguuuggugcuacccaguuguuagguucuugggaagaguggucucuucggaguagugggaacaggugaggcucuuguggauugaggagaggguacaagcaggagaaggcugcagggggauuuccuuauaauuaaguccuugaauagaagucuuuagaaguaucaguuuuuuaaaaaauuggguauucaagagcucaguggagaucuuuucuucuuuuaagguaauggcacucuagugucaaauggaguuugguguagugcaugaaucaucuuuuggauacuuucuucuuuuuagcauacauuaucuuuuauucucucagcaacugugugccuuccaacacaaugguaccugccuucugauuucuuuuguuguucuuauggcaggucuggacaaagacugucgccuaacugaaccgcuuggcaugagaauugcagaguuuccuuugaaucccauguuugccaaaaugcugcuugaaucagguggguagagccugauagcuugaauugauuuuauuuugacugucagagguguuguuugccugaauucugagcacccuggggaagaggguacaauaugguaaagaaguauauauauaucuguaacauaacauuuauuguuuuaaccauuuuauguguguaguucugugauacaaaguacguucacauuguugugcaaccaucagcaccauccauuucuagaacuuuuuccaucuuuuccauugaaacuccauacuugguaaacacaaauuccuuauucucuccucugccccgccccuggcaaccaccacuacuuucugucucuaugaauuugacugcucugagaacccucagaagugcaaucacacaguauuuguccuugugacucucuuguuucuguuagcauaaugucuuccagguucauccauguuguaguauguguuaaaauuuucuucauuuuuaaggcggaauaguauuuuauuguauaucuauaccauguuuuguuuguuuaucuguugacagacacuuugguugcuucuaacuuuuggcuauugugaauaaugcugcuaugaacauggauacacaaauaucauuuugagucccugcuuuuauguuuauuggguauauagccagaaguggaauuacuaaaucaugauaauucuuuaauuuuuaaaaauguauuuuuaauugacaaauaauaauuguauauauuuaugagauagagugugauguuuuaaucuauguacacauuguagauucagucaagcaaauuaacauauucaccaacucaccaacuuaucauuuuuuuugugcuaagaauuugugcuaagaauguuaaaauucuauucucuuagcaauuuugaaauauacgauacauuauuauuaacuguggucaccaugcagugcaauagaucacuaaaaccuauuccuccagucuaacugaaacuuuguacccuuugaucaacaccuccucuuucuccauucacccccugacccaggggaucucccagccucugguaaccaccuuucuacucucuguuucuaugagauugacuuuuuuagauuccauauaugagugagaucauaugguguuugucuuucugugccugccuuauuucacuuggcauaauguccuccaguuccauuuaugcugucaugaaugacaguguucucuucuuuuuuaaggcugcauguuauuucauuguguguguacauauuuauauaaaccacauuuucuuucuucauucauccagugaauggacacuuggauugcuuccaaauuguggcuguuguaaauaaugcugaaaugaauaugggaaugcagauaucuccuugaaauaccaguuucaguuccuuugcauauauaccuagaagugugauugucagagcauauaaguccauuuuuaguuuuuugagguagugcccuacuauuuuccauuaauagguguaccauuuugcauuucugccagcaguacacgaggguuccaauuucuuugacuucuucagauuuuugugaggacauggguucuagguuaaaagaucuggaagucuucucguaauuagaaaucaaagucaucuagaaaguauaauuuguuuuuuuaccucugggaaagacaguuuaauuuuuucuugguuuugucuaacuuuuaugucaacuagcaauuuaugaagauguacuuuagacccaguauggggaaagcuaacuaauuauguuuuggaacaaccacuuguucucagccuuccauuuagaaacaggauucuuuuuuuuuuuuuuuuuuuugagacagugucucacucugucgccuagacuagagugcaguggcgcaaucucagcucacuacaaccucugccuccuggguucaguucaagcaauucuugugccucagccuccugaguagcugggauuacaggcaugugccaccaugcccagcuaauuuuguauuuuuaguagagaugggguuucacuauguuggccaggcugguuuugaacuccugaccucaggucaucugcccgccuuggccucccaaagugcugggauuacaggugugagcuaccacaccuggccgagaaacaggauucuaaguguggacuggggaagugcaucauucaugagaugggagguaguggggagaugggacgagcaguguaguguacucugccuugugcccuggaguggugauugcuggugacuguuuccaggcguuccagcagcccccagcgugcuuugcuggucuaguugugccuugggcuucccagcugagaugaacccuuuugagaaggaagccacuucauagaaggggucaggagcagagaaacagcagaaggggcacaagccgcucauucccuguccccucucggacuuccugccaggauuccagauguucccacaggaggguagggagcaggugcggagcugaccugcccuuagugauggggccagucuugaccuuggcuuauagucagaguccccuauauuucagcugcagagggcaguaacaccuccuuuuuuggaguccuucaaggcuacuauucaucuggguuacauaugggacuucacauuuggcugagugaaauauuuuuauuuuauaaacuucauuuuuuuguuuuuauuuuucugagagagggucuugugcugucacccuggcuggaaugcaguggcgugaacuuggcucacugcagccuugaccucccagcuuuaagcaauccuccugaguagcuggaccacaggcacauaccaccaugccuggcuaauuguuuaauuuuuuguagagaugggguuuugccaugcugcccaggcuuauauacuauacacuuuaaaaauuaagcucuagaaaaaauaugaucuuagucuucaguguggugcaaggaaaguaucagaaaaugucuuucacuucuuguuggcacauuauaugguugaaaccaaacaugcuuuuuguuuuacaggaaacuucggcuguucucaggaaauucuaagcaucgcugccaugaugcagauccagaauaucuuugugguccccccaaaccagaagucucacgcaguaagucagcucuguccccaggcugucuguaccagucucuuuugcuuugagcuuucguugucaaaacuguacucaggaacugcugaagacagagcuguacaaaugugaucugcucauguuuugaguguuuauuccgugcuugauguugugucagguguuuugcaggcaucauuccacuuuaucuucauuauaagccugggaaguagauauuauuaucauauuuuauuuauuuauuuauuuauugagaggaagucucgcucuguugcucaggcuggaaugcaguggcgugaucucagcccacugcaacugcacucugccucccagguucaagugaugcuccugccucccauguagcuaggauuacaagcgugcuccaccacgcccggcuaauuuuuguauuuuuaguagagaugggguuucaccauauuggccaggccggucucgaacuccugaccucaggugauccgcccuugaccucccaaagugcugguauuacaagcgugagccaccgugcccggccuauuaucauauuuuaaagauggaggcauagagagguuagguaacucauucacaguugcacagccagaauuguuggcucuggauucacaguccagagccccacaccuuaaccauugaacuaccaacuucuaguuucugucagggaaauugucauucagacugcucugcuagaaaccuuggugggcacauuagugacauaagaagucaggugccaggguauagcaggcugauucugggcaccacacgacaucauggucauguugcaggugggccauuauaagcuagagagauccaauccccaccuaaggugcaggcaucagcaaugacuaauugagugaacacuggaaagacggaaggacaaguuuugauacugaagagauagauacucagaaguaagguguguugauagagguaggucagagaugaguucaaagucaguuccuguuugaaagucagagaauuagcagccuuaugcauggaggggcugaauuuguauguguaaugaggaggagagagacuuucuuagggauuguugggauccuccuugucaguuguauaacuauagauuacaaaguuuuucugccucugugcccagaugcuuaugucuguuuuuguuuaguuuuguuuuuaauuaaccuggaggaggagagagacaagaacacuaacauuuuaucaaauuucuuugccagauaccuuguaauaaauuaucuuaauccacagcaaucuugauagguuuaguuuccugauuuuacagauaaggaaaucaaggcugagagagguuaaguaaccaagcugaguucuuucaagauauggcagagcuagaaugcugcaaacuaggucuuucugaauccauaacccacacgcuauucaccaugcaauauuacuuccagugcaaaagucaauuucuuucuuucuuucuuuuuuucuuuuuugagacagggucucgcccuguugccuugguuggagcgcaguggugcaaacauggcuccugggcucaagcgauccuuccaccucagccuaguagcuggggcuuagaggcauacaccaccaugcccugcugauuuuuuuuuuuagcuuuuguagacaugggguuuaccuauguugcccaggcuggucucgaacuucuggguucaggcaauccucccaccuuagccucaccaaaugcugggauuauaggugugagccaccacacccagcaaagagugaaauucugaauguugcuucauucuuuccagauucgagugcaccguaaauuugcuguggaggagggcgaccaccucacuaugcucaauauauaugaagcauuuaucaaaguaagcacaacuacugcucgaagugccgccucaacacaccacccucuggaggugaucuaggagggaggaucccagaaguucaguucguaaaggaauguccaagagagcccuugauuuuccuguuagauuuauugccaguacuucuaacuggugggucgggcuuucugccugaguuuguggugagguauugcugagaagaacacaggaaucauucauugcuuucccuugcuuggagauaugguacacuaguggcaggccaguggcccagccucacgucaucucacauccacugugcaguagacagaaaggcaacauuugaauaggaaguucuguuacauuuucugccaggugaaugaggcugagagcaacuuguaguccuggguugaaucuucaaagcugucccagcugccaugagaagacauuuaguugagaucugugcauauucacauaucccacccauauuuagcuauaagugauguuaauuuuuuauuguuaauauucuuuaaaacuaagcaaauaauacagcuuaaaguucucaugaaaaauuguuaauaaaggugaugaaaaugaugaaaaaaguaaccuuacauaaaagaaaggguauaauacuucagauuuuuaauacucauuucuuaaauacucuuuuagaagugaagaaauacuaaauuuuuguuuaccagugauuugaggaagauuauucaguuggugaaaaguuuucagaaaaaagaaauucacucuuuuugagacuuacggcuuaaaucaguuaaaauucauuuguacaggcacaauguaucaucugcagucugaagcuuucucuaccacuagaaaguggguauaggucuacauuguauuauucuaugguugccuucuuggaauaucuucuauuaauuacauuuucuuuuuuaaagcacuuuaacuuacaauagaauuucagagguacauuuccacagcaauaauuuacucuaagacauaaugaucauacuuaugaaugcagaaaaaauuaaauacuguugauagaaaaaucaugcuuuggggacaaauaauaguaauuuguaaauuauuucuacauuggcaagugucauauuguuggcuucuaguauaauaaagugauacauucaagcaugccaaagaagaaaaguugauuuacaaagaaccacguggagaaaugguucuuucugauaguucacaucucaugaagguauguaagauugaaaccguuucugcgugucauuaaguucucauuugcccuuuaguguaaagagugagguugcagagcagucagaugugugcaagguuguuaacaucuguuuugagagauggggcaaaaaagggccaguucccaucuuuagaucuuaugccguugaacagcacaugggggaagagagaagaaugaucuuuacaacauagccuuagucgagaacauaucuguuuucuaacucccucucucuggguuguucuguagcacaauaaggacucuaaauggugucaggaacauuuccugaauuacaagggucuugucagagcugcgacuguaagagaacaauugaaaaagcuucuugucaaguuucaagugcccaggaagucuagugaaggugagaagaaaccgucccagcuggugaccucccuugcuucauucuguugaguugucuuccuaaaguucucaugcugggcuggugcgaggcaguguggcgugcucuguaccaacacuggguuuuauauuuugaguugccugcaucugugaaaagcugaaggucaaguugcguauuuuuuccaaggaggucuauuuuucuuucugaugggcauucuuacuaaaggaauuucauagcccaugacaauacuuaagaaucacuaacagucacaucagugcacaucaugucauugauuuucccauguaggcuuugcaagaaaaauuacuuuuugaucagugauauuaguagcuauuacauaaaaauuaaauuuuauauucaaagacaaguauuauuaaagcaagugcuggauauuuagccuaggcagccacuaaagguaagacagaaaaguacuauguaagacguagucucuggccucuagcagugacagugacuacuauuaaucagggacacaguagguuacgcuguggcagggguucuccaaauauucucuugcucaaucucgcacucugugaggugucgguaauguuauccucauuuuacaauuagucguaagauccuagggagaagguagauuaaauucaggaccacgcaacugguaaggaggagagccagaucuguauguggcucagaagucuacgcuuuuaaggaagugacacacccgccucagcagucagccugaaagccuagugugccagguacucagccacauccucagcaccauuaguacuugguaacauuuccugagugcuuauaaguggcuagacagugcacugaguguuccauguguuuauuaauuuaaugcucacaacaacgcugugaaacgugugcucuuuuccccaucuuauaggugagaaaagcguggcuaagagguaaaauguaacuugcugaaguuacacagugaggguaugauggagucagaaccugagcccaggcgguuccauuuaagucuucuuuugucuuuauacuaagagcaagugauuaaacaaugacggagucuuggcuuuuacucuaagggaacaguguaaugaagggagagauucauauggauagacaaaguacuaagauuaucaguccucuucgaaguuaaaguaguagauacuuuaguaaucauagaagacgugcuggcagauguggaaggaaugccgggaagaaggaauccagagagggcuagcuugggaagucuuucagcuuccuugagguguggugggaguccggucaagcuuuggggucugguugaauuagaaaaugguggcaaagagcacucuagggaaggaggacuggagacaagugcuuggagugaggaguauaugagacgcucagagaauauuugaugggugaauacacucacgagagagggaagaguugaaaccugggccauugagccauguuggagucauugauagaaacaggaugcuuacaaggagcaccuaguuggagagcagcucgucaaacgccugucacccagcagguagaugacagccuuacuucagcaauugguguucuucaccuguguuucauuaucagaccccugcccaggagaaaaguuaaauuuaaauucuacccagccugagaaauuaaauacuaaggaauaagauuuuguaggguaggauugagcuuuggagggcuaccggccauuguagugucuaagaugcuccccucccccugccuccaagaaccaguuuccaccccuuuggaagugauaucaccccuguuuagagugcauauuuuacauggaaauuucuuauggacaauaggagagaagagacuggauaucggauuagaucauauuuagacauguagauuugagauuuuaucagcucagugcuuaggaaaaauacagaaaaucauggagacuaaauaaauuacaugcaaauuuaaaacaucuaaggguuaaaaaauagaaagcaauuagugaaagauacuuucagcagucaugagauaaaugauaaagauuaaaaacuuuauuauagaaugauuuuauuuaauauauuuaggaaaaaacaguuuucagguugauaaaugggcuaaggauuagaacaaaaaauucacaaaagaagaaauaugccgauaguaaucaaauaaauguaauauaaaagaagguaacagaagguaacacuuuuugccaaaacauugcuaguaagaaugcagugaaacugccauuuuuauauauuguugauggcuuuggaaauaguaccaccuuuauggaacuuacuuaccaacaugcuuuauuccauuggaucuaagauaccaucauguguaagaaacaucguuauuuuaugugucaccaaagaaaaaaaaugcugccaguuaucauuguaaaaugcuguccuaauuucagugaauuaaaguuagaaaaagagcgagucuuaaaauugaugagaugugauaugucauuaaccauaaaaauaacauuagccuuuugcacaacaauuuggaauguauccuauggacaucaucuaauaguggggaagcuuuauucauggaagauguuagcuguagcaauagaaacaccaguuaaaauggaacauuugaaaaauuugaagaauuacuucaauuuucaaacacuagcucauaaccacagaaguaacguuguauacuaucuccaguuuguguuuuauagaaagaacauuguugccauaugacacucuuuuacaaaggaguucugaggucacugaccagccugcagagcagcacucuuagguucuggugcccagccaugguccagucaucuguggcuuaggggagguuggaggggucccagguucaaggagcagaccagcauuguugucagcagcaguuguggggagugggaccuccuuagauggugcuggggcaggcauccagcauugggaaggguagggcuggagccauuucaggagaggguuuccaggugucuugaagcagccugggguggugcugggaguggauccugugcauuagagcacacggagccuagggcaggcaaggguuucacccgccucucuguuggcugccuauguaggugacccggaucugguucugaggugcauugucuccggcuucuucgccaaugcagcgagguuucauucuacuggagcuuauagguaacaugauacuuggugaagucauuuguuaaaggaacaaucuuacaaaugacccaaaccccacagaaagcugugcagagauaguaauugcauaauuauuuguaauuucuaccaugucuccuuccaaaacugaguugagguuagcgacauagcuuuaagcaaaauaucuugacuuucuaaaaaugauucucacauauucagcucaucuauauguuguauguuuuagaaggaugacaauuauacaucuugaggcugguaauauuucaauucuaaugacagaauaauaugaccugaagaaacuauuaaaaauaauguuucucagagaaguuauuuuacaauuggcuaguuuauuaugucuuuagagaucugcacgacugaaguccccucccacccugguauaguguggccacgucuggugucuuuggagguagccagguguuucucaugugcuggaugugccuccugcuacauaaccugauucuuccaguuccauuuucuaggcauaggaaaucacucauugaugccuuccuaauggucuuuacuauauucaaaugcagugaaaacuaagcauagcuuaggcauacuguagccugucaguaucaugauucuccaaacuaaucauuccagugcuuugaauuguuacuuuuauucugucuuuucugucuuuggcucauuuuaguuucauaaccucaguguagccuccuaaaaguguagcuaucaucauuuucuguucuuuaauaagagaacacuccaaagaauuucuccccagcucuucuauguauuauuuugucauuaauuuuuuuucccagagaaaauauuacugcccuguuaucuugaggucagccaagauaucccuuguccugggcuccuguuaaugaguccagaguugcacugagccuuuuuuaauuuugacagccagaucugcuccaucuaguauccuaguagccgacuguuggaacugcaggauagcacuuuacaaugaucucuaguauguucucuuuguuacuccaggcauguuguagccugucaguauugugauucauuugcccauuguaugagcucaccuccccacccugaguugucuguauuugaggcaacuuguccauguggaggcgacccccacgguggcccgagaucuucccuaaggagugcugccagcuugucaucuugauugcuccuacucuccuggagaguuagcaauuuugacuagcguuuggaaaauucuuuuaucaguguccuuagcaacaaugugggcuaccuaagagguuccaggcuaaucauuccuuugagacaacauuuaguguugaucagcucaccacccccugguaggacagcccaggaccccaggacgcuggcuuuauuacaaugccgacgaggcauuccgucacagcacuugaagcacuucccccaagaaacagaucauucuacugaguuggaauuggaaguacuauuucagagaaauuaauaguccaguauugagcuuuuuuuuuuuuuuuugagauggaguuucgcucuuguugcccaugcuagagugcaauggggugaucuuggcucaucgcaaccuuugccucccaguuucaagcgauucuccugccucagccuccggaguagcugggauuacaggcaugugacaccacacccaacuaauuuuguauuuuuaguagagacaggguuucuccauguuggccaggcuggucuugaacucccgaccucaagugaucugcucgccuuggccucccaaagugcugggauuacaggcaugagccaccaugccuggcugugagcuuucuuuuuucauuaucguuacgucccccuauagucauuaucuuuaguauuuaacuuugcuuuuuagauuauagaagaaaucacauguauuauuuccauuccaaaggaaauuguuuugaaagagcaccugcagaagauacacauaaacauaggcagagcauuuuauuccuaaauguuuuuucuaaguguccgcguguugcuuuucuccucuucgcuuuuuccacgugauuuauucuugacuucugggguggcagccaggagagggaucaagaaagguugcaagagaagauggagauaauuguuuugcuugugacgaguucagucugcaugcuuuuuugguaauauuaaaaauaucugugggaaagucuugcuauaaguauuuaaaaugugcuucagacaaaauucuucuauguuccaaggaccauccgugaugaccaugagcugcacauacacccugcgucaguccucuaugcagagaagccgccucgcugguaagcucauccugcugcuuagccugugccugcuuugaacagggccauguucuuguuuuucuccuguacauguuucuugacaucgccucuagaauugcugcucugggccgggcgugguggcucacgccuguaaucccagcacuuugggaggccaauguaggcaggucaccugaggucaggaguucaagaccagccuggccaacauggugaaaccucaucucuacuaaaaauacaaaaauuagccaggcgugaugggcacgucuguaaucugagcuacucgggaggcugaggcaggagaauugcuugaaccugggaggcagagguugcagugagcugagaucacaccacugcacucuagccugggugacagagugagauuccaugucaaaaaaaaaaaagagaauuucugcucuggcaaagagcuucuuaagcaaacagugauauuugucuacucacucauccacucagcaaacguucauuuucaaccacugacuggaugcuuagcccugcaugaggcacagcuaugcagagaugaauugggaucccagcucacgguucuuuuuuuuuuuuuuuuuugagacagaguuucgcucugucgcccaggcuggagugcagugacggcgcuaucuuggcucacugcaaccucugccucccagguccacgugauucuccugccucagccaccugaguagcugagacuauagaugugugcaaucacgccuggcuaauuuuuguauuuuuaguggagaugggguuucacuguguuggccaggcuggucuccaacuccugaccucaggugauccacccaccucggccucccaaagcucugggauuacaggcaugagccacuguacccggccccagcccacaguuuugacauagggacagacacagagucaacuaccuuaggggaagggcuuuacuagcagcauggaugaagugcugggcucagcacaucaugugccagugagagucagggcaggcuucauggaggagauaacauucauucugaaccuggaaacaagaguguucagucagaaaggacccggaggguauucuagguagagaaguagcaggggcagagccauggaacauaaaggaaccucaugcguuugggaaguggggaaucauugguauggguggcccaugcaauggugcugcucuguaacacugccuaggaagaaagagguaagcacagaagucuagaguaggccuuuagacaucuuuauaacauuucaaugguuaaguuuauguuuguccaauuuaauaauaaaaauugggggcuuauauuuuucuuguuuacaauuucauuuuucuagaauucauuuauauuguauuuuaccaauaaaaaguacugauuaaaaguacugaucaaccauggauuggauuuuguuuuuuugagacagugucucacucuguguuuuugagacagugucucaaucuguugcccaguggugugaucuuggcucacuucaaucuccaccuucgggguucaagugauucuccugccucagccuccugaguagcugggauuacaggugcaugcaaccaugcccagcuaauuuuuguauuuuuaguagagacgggguuuugccguguuggccaggcuggucucaaacuccugaccucaggugaucugcccaccucagccucccaaagugcugggauuacaggcgugagccacugugccuggcccagauuggaaauuuuaaagacgacaacaacuuguccuucuccaauuggaagauggagaagcccugggaaaaaggguggggugugugugaagagagggagagaagauagcgguagauuugaaggcaagaaagucuguggucaaacacuuuguacccuagaauugcagcuuucaaaauguggucuccagcccagcaucaguaucaccuggaaacuuguacgaaaugcagcuucucaggccaugccaagucccauucaaucagaaacuggacuagggccuaggacuccauuuuaacaagcccuccagauguuucuuuugggcaguaaaguuugaguucuguuucccuagaccaaggaaucggauuuauccuguagccacugcagaccuagaaguugcuuagguugaaagcaccuuggucgguucuggguuuagaaauguuacccagugaccacacuaauguggucaggauacgcacacucgugugcaggauaauuugaagagugcccacgccugucaucucagcacuuuugagaggcugaggccagaggauugcuugaggucaggaguucaauaccagccugggugccauagccagaccucaacucucaaaaaaaaaaugagccaggcaugguggcacguggcuguaguacuagcuacucaggagacugagacaggaggaucgcuugagcccaggagauucaggcuucagugagccaugauugcaccacugcacucuagccugggugacagagcgagacccugccuuuaaaaaauuuuuuuuuuuaaaucaagagagaugcaaaaccucaauuuuagauccuuuuuuugcugacuuuugggugguuaaauuugggaguugcuuaaaggagaaaggcuuuucuuuuucuugcuucauuccuaaggagcucugaagggcaaagaaagguuggggaaauagagccagccugaagccaugccauaccauucagguggcaaagaaagugccccccagucacggccucuuugcagggggggcccuucuuuuuccuuugaucagcugagauucacuuacugguuuuugagggguggggaaccacaguauggcugguauguuuauaacaugggaagcccugaauuaacacuuuggauguuucagaaacugauaucuacucauaugcacaccuaaaaucaggggacuggauguuaugcucuuggcucuucgguugucuauuaccugagccuuagaaacauuuuuucccuuaaauaaagguauaauuuauuuacagugcaagaugaguuuugacaaauguguauacccauguaaccuggacccacauaaauuauacaauauuguuaucauuuuagaaaauuccuuugugucucuuuacagucaguucccagccucuuucagaaucaggcaagucuuugccuccauuucugcauuuucuaauaaagucauuaggcucaguucagaguucuguaaaugcagaugaaggauccagaaagguccuucgcggauaacugagauguuccagaagucauugaggauuuagagucucaucugaaaaauggacacaccauuacccagcacuuaggucuugaggcuguggugagcaacauaaaugcauguguuuagcacagugucuggcacauagaguagaaccuguuaaagguuaaaggaaacagcaugucuaccugugguuccugacugucaucacaagagggggaaauuagcucauguuucuuucucauuucagggucaucuauaacgaaguuauacagaccuccaaguacuacaugagagaugugacugccauugaaucggccuggcuguuggagcuggcuccacacuuuuaucaacaaggaacgguaggaaugaacugagucugugccccagccaccuguucacagccucuccauguuuuuaaauguacuuuuuuucuccaauuuaaugcccuauguguguucccccuaggggugcauaggguggaaaggccauuaccauauccccaaaacauucugggaaagcacucuagcguuuaauucauagugaagugcaauuaaaaauaaaucccccuaaucucauaagaaaaaaaagguaucgcuuucucgcuuucuuucuccuuuugcucuuccaaacuauuuuuuuuuuuuuuuuugagacagucucacucugccgcccaggcuggagugcaguggcacgaucauggcucacugcaagcuccguuucccggauucaagcaauucuccugccuuagcccccauguagcugggauuacaggugugugccaccacgucuggcucauuuuuuucuuuuucuuuuuucuuuuuuuuuuuuuuguauuuuuaauagagacaacgguuucaccauguuggccaggcugguuacaaacuccuggccucaagugauccacccaccucagccucccaaagugcugggauuacagguaugagccagcaggccuggccugagcuaauuaaaaaaaauuuuuuuagggaugggguuucacuauguugcccaggcuagucucgaauaacugggcucaaguggugcuccugccuuggucucccaaauugcugggauuacaggugugagccaccaugccaccaguucguuuuuuauuuuuauuuauuuauuuuugggacagagucuugcccugucauccuggcuggaaugcaguggcacaaucucagcucacugcaaccucugcuucccagguucaagugauacuccugccucagccucucuaauagcugggauuacaggcgugcgccaccaugcccggcuaauuuuuguauuuuuaguagagacaggguuuugccauauuggccaggcuggucuugaacuccugaccucuggugauccgcccgccuuggucucccaaaguguugggauuacaggugugagccaccacgcccagcuccuuuuuuaaaaggguuacagcccugugcuguuuguggccugaaaauacuugcuuuacauauuuugcccaaguuuacuguuguuuacagcagaagagaaagucugaaaccuuuuucuccauuagggccagaauuggacuacacaauguuuccaaagcgauauuugaauugauugccacauugaaaaauugggagauuucauauuaaacaugaauuucugguuucucuugaaagacauguuuagucuggcaacacuaggcuugcguuccuacgugguggcaucacaggggcuuagggguggcugccugcuguuagugacaucgccaggugccguagucccaugucacuugcuuacuugccugcugcacucuuggagacauuugaauuugugacccuguaaauggaaggaucuccucaucucuccugcuccagcaaagucaagggacauugcccucucaaaauuuuauaauauuuaauuuuuauguaaucaaacaaaaaccauuucacaccuuuauaguucuucacacaucccaauucagauauuucagcuggaaagcagaucagccugcagggacugauaaaaaugcaguguguguugucuuugcugaauuagguugauaagaauaaaccuggugaaagaaaggcuuuuccuucaaaaccucucagguggaaagcagcagacuucaggagucaagagaagggaucagaaagguaaacuagagguugaaagaggaauggugcaguggucaaaaugccuguuaaaguaagaagaugcagacagccagagaaggauaagccugaaauugucuuggauucauuuagacucuuggaaacagaauuagcccagaagcugagucauuuucccuucucagcucaaaauuccaguuucuuuaggucaaacccacaaaguuaaagagcaaauagcuucagaaauuugaagaaaauaacaagcccaaauuucuucauuugucucuucucuccaaauggcuuuuuuauuuuuaagcucaucaccuccacugucaucggaguauuuuuagagaggcugggacagaccuuuagaaaucaccuagugcggccgagcacgguggcucacgccuguaaucccagcacuuugggaggcugagguggguggaacacaugaggacaggaguucgagaccagccuggccaacauggugaaaccccgucucuacuaaaaauacaaaaauuagccgggcaugguggcaugugccuguaaucccagcuacuugggaggcugaggcaggagaaucacuugaaccuaggagguggaggcugcagugagccgagaucacaccacugcacuccagccuaggcgacagagcaagacuguccccccaaaaaaaaaaaaaaaaaaaaaaaaaagaaaucaccuaauacaacaaccucauuguauaacgaugguccccaaaccacagagaaacuuguguuguuucuuaacuguauaguccaagggcacuucuacuauuaacuuguccaaagcagauugauuucucaaagaaccuccagaucuacagggguugcccauguaugguagauguuccuuuacugaacacagugcagcaccucacaaccuuccacagcccacagaucauucacggcucuguuccuggcaccuuuggagacuuuccaucaccacuguuuuucggaauguugcucucacccuguguggaggccugaaaugguucagagucagcuuuguuuauauucaacauucuucccagaaaaaagcaccaaaaauggccccacaggcacaauggcgucaucucccauccccaagcuaaggccguggauaucuaacauuagcuguagggguuauaucaggugacguguagagagagaauucagagaaauucagcaagaccuacagcuagacaggggaagaacggggugaccuauucagagauuugccuucuggcuuuuaaauuauuuuuccuuauucucagagauaucuucauuauuagggaaaacccuuuuaacgaggccuuugcaagagccuguaguaguccucccucagguguaagcagauggaaagucugaguucuuguagcucauuuauacccggguccuguucgcucuguugucucucacgucauaccugguggugcgcugugucuucguucacgcccuccauuuuuucagggccugcaguucucucugggggcgaugcggcuugauguuguggggccauguggcugugcuaaguagugggcacaccagcuccggagcagucagggugggcauucucaugugaggcucccacuguguguuaguuggcacggcuuagggaucucuugguuauugaugauuaguaaugggcugucggguauaucccaguugaugaguggagggaggucuuucauuaaaagcuuguauuuacacacucugccucaaaggcauauuuaaggauuucugccacuuuuggcuuugcuuuagaauguaaaaaauacuucauuuuccaauccuauuaucugaugccuaugauuagaauauugugcuucguguuauucauaaugguagaaagugacauuucuggggaaaaaaaaaagugucacuaggagguguccuuucuguuuucccagcaagcuuguacccuccaugugggcagaggccauaucuuuaucuccauccuugagcauggguaccugguguguugagacgcuugguaaauugacuuccuugguccuaaagagaggauaauuuuucuugacuauugucaggaacuucuuggagauuugagaucacuuccagacugagcccagucuccugagcacaguugucuggcugcggugcuguccucuaggcuggggcagagggagagucgugucucaaaaagaaaaccuuuccuugacagcuuccgcagagcccuguauaaccagcuucagccgcuguggcuugggccucggguugcuggcggcugaauucaggucggcuucuucauuggccacuugggcuuuuuccuuccaggcuguuucaugaacagcucagcauuuacugggaagguguggaccagauggaagauuugauguggucauucauauggggauuauguugcagucugguuucuuugucuaaucaaccccaacuguagugucuucucuucuguugcagcaccugucucugaaagccaaaagggccaagguccaggacccgugagaggagcccacagcuacagcugcagggacugcuggcguccucuccuccaugcugcugccccuggucccagguggggugagcuggcaccagcuccuguggaauguuugguugcucugaagugggcugcggccuguucauuaguccuuucuucccgcugcccacagcauuugcauccuugcugggauccuggaggacuuugugcaugggcaggcauccuucugugcugcagcgggcagagugggaguuggcucacucagcacgcucacuaacccagcaugccacuuccagcaggcaugcaguccuggcccagcucuaugggaaacaaggaggaaaguuagccacugaaggccaaaacaccaugugggguggacagaggguuugcugggcuggcuuugcuuucccugcuggggccacagcuguguuaaccaaugaggucugcugccaggugugaacaagcaugucucuacgaaugaacgaaacauuggggaucucugccgaaaccaccaaagggcaugucugaugggcacagggucucccaaacccaguggcuucugucuguccucagcccuugucccuguuuaucugcagccaggagacuugcaagggauuggugauugacagagaggacucgugcgcuguuuuguguuagcagaggauuuguguuucacagguaggcuuagcguccucucagaguguagugccagguccuggugccacgcuagcugagcacucaggagaguucaucagcucagaucccacagggccuccucuuuagcaggaauucacaacaguuuggaugcccuaaacuucuguagcucaggaacaucacugguguauuuguuuuuuuguuuguuugcuuggguucuugcaagagcgcguggggacaguucuuccagcaggcacugguuuuguugccccagggcugcuuugcugugaugaugauugcauuucaacacaugccagaugcagauuuuuucccccuuacuguuucaaugaccuuuauuuuaaaaacacauagcuugaaaauuuauuuuuauacugauauuaguuuggaugugccacuuuuggcaccaaacguguaugucauuuuuauuuccauuuuauaaacauguaaauaauagugauaacuuguuaauaauaguaaaccuuuauaccuaaaguaaaugucuucccucccacac

SEQ ID NO: 13504 - RNA, 1943 nt, Homo sapiens
uagcacuguccuugcuggcugucagauuugggcauagguccuuuccuccuugagccucaguuucuucuccugugaaaugggcuguacuaaucaugucacucuaagcagcgcgguuauugcaagcaccaaauuaaaaguuuucgugaaaccacuagacaagcaccuugucuggaagacucuagaagcauaaauaacguugaccaaaucuacuucagcauuuggucuugccuuucuucaucuuagaucccggggucccgaaccucccuguuuuucuaccugggcccucaccacacuccacuuccauccccacuccccaauccauccucugugaucacugucccucucaucuccaacucugcccacgccuucaggcaaucagcacauagacuaaguccuuacuggggucugcacagacagaaccaaaggcuuggacacaugaagaguggagaucagggaaaaggcuuuccugggcucuaagagaugagcuuggaaaagggaugucccuaaaggcauguuacuaaguggaagaagccaaucugaaauggguacacacuguaugguuccaacuauguaacauucuggaaaagacaaaacuauggagacaaaacaauaaaaagaccagagguugccagagagggaugaauaacagagcauggaagauuuuuagggcagugaaacuauugcauaugguacuauaauggugauacaagucaucagacauuugucaaaacccauagaauagccaacaccaagagugaacccucguguaaacuaugggcccugggugauacugaugugucaagguagguucgcugauugugacaaaugucccacucccagcaggauguugaucgugagggagcuucuggguaaggguggggguaggggaaugugggaacucuguacuuuccacuuaauuuugcuauggaccugaaaaugcucuaaaagaauaaagucuucuuuaaaaaaaaagauggaacugacuuucaguaccuugguccagugaagaugccaacagcaguaaccaguuagaggauggacgagccaucauuuggggggcaagugaaaaagacacauuccaaggcucaauaaaaaauacauuuuuuuaagaaugcaaaagaaaagauccugccagaguggaagggagcagcacuuagcuuagaucuguggcacccaggaugcccugggacccuccuguucuuagccacaccccagccugacccuacaaagucaagccuugcaggguagaaccuucauaaucuuccagccaucauagccccugugccugacacuuucauuucucuuuauuugcucauucucuuccuuccaccacaccaugcucaaaucauccaaaacuuucccuuuaucacugagccucccuaauuaagcuaacauuauuagaagguugggaaaaaaagaaaaagaaaacccucccaaauucucuuugcguuucaguagcucuuuaauaugcgaggcaacgagagaugagcugcuccuaauugccagucccuggaguagccagucagaaaaugaauugaugcguuuuuuccuuaugaacaaugcauguagcacaaauugcaguggccgucaccagagauuuaauuacaaaauaucauuacuuucacacaucauuucagauuuggccugaucaaaucaaaguuagggcgagagggagagaaaacugcacucuuagcagggacauucauucagggguggcugcaacgcgggugggaauuggcauugucgaaacuuccucggggccauugcaggggaagcagcugccagagaugucuaugcaaagggacguuucugggauucaggguuucagcagaguggaggcugugggccugcaggaggggccccagggcgugaggagcaucccucaaggaagaaaucaggcugcagagagucuuaggacccugcaauucaaaggagcuacagaa

SEQ ID NO: 13505 - RNA, 1943 nt, Homo sapiens
uucuguagcuccuuugaauugcaggguccuaagacucucugcagccugauuucuuccuugagggaugcuccucacgcccuggggccccuccugcaggcccacagccuccacucugcugaaacccugaaucccagaaacgucccuuugcauagacaucucuggcagcugcuuccccugcaauggccccgaggaaguuucgacaaugccaauucccacccgcguugcagccaccccugaaugaaugucccugcuaagagugcaguuuucucucccucucgcccuaacuuugauuugaucaggccaaaucugaaaugaugugugaaaguaaugauauuuuguaauuaaaucucuggugacggccacugcaauuugugcuacaugcauuguucauaaggaaaaaacgcaucaauucauuuucugacuggcuacuccagggacuggcaauuaggagcagcucaucucucguugccucgcauauuaaagagcuacugaaacgcaaagagaauuugggaggguuuucuuuuucuuuuuuucccaaccuucuaauaauguuagcuuaauuagggaggcucagugauaaagggaaaguuuuggaugauuugagcauggugugguggaaggaagagaaugagcaaauaaagagaaaugaaagugucaggcacaggggcuaugauggcuggaagauuaugaagguucuacccugcaaggcuugacuuuguagggucaggcugggguguggcuaagaacaggagggucccagggcauccugggugccacagaucuaagcuaagugcugcucccuuccacucuggcaggaucuuuucuuuugcauucuuaaaaaaauguauuuuuuauugagccuuggaaugugucuuuuucacuugccccccaaaugauggcucguccauccucuaacugguuacugcuguuggcaucuucacuggaccaagguacugaaagucaguuccaucuuuuuuuuuaaagaagacuuuauucuuuuagagcauuuucagguccauagcaaaauuaaguggaaaguacagaguucccacauuccccuacccccacccuuacccagaagcucccucacgaucaacauccugcugggagugggacauuugucacaaucagcgaaccuaccuugacacaucaguaucacccagggcccauaguuuacacgaggguucacucuugguguuggcuauucuauggguuuugacaaaugucugaugacuuguaucaccauuauaguaccauaugcaauaguuucacugcccuaaaaaucuuccaugcucuguuauucaucccucucuggcaaccucuggucuuuuuauuguuuugucuccauaguuuugucuuuuccagaauguuacauaguuggaaccauacaguguguacccauuucagauuggcuucuuccacuuaguaacaugccuuuagggacaucccuuuuccaagcucaucucuuagagcccaggaaagccuuuucccugaucuccacucuucauguguccaagccuuugguucugucugugcagaccccaguaaggacuuagucuaugugcugauugccugaaggcgugggcagaguuggagaugagagggacagugaucacagaggauggauuggggaguggggauggaaguggaguguggugagggcccagguagaaaaacagggagguucgggaccccgggaucuaagaugaagaaaggcaagaccaaaugcugaaguagauuuggucaacguuauuuaugcuucuagagucuuccagacaaggugcuugucuagugguuucacgaaaacuuuuaauuuggugcuugcaauaaccgcgcugcuuagagugacaugauuaguacagcccauuucacaggagaagaaacugaggcucaaggaggaaaggaccuaugcccaaaucugacagccagcaaggacagugcua

SEQ ID NO: 13506 - RNA, 95758 nt, Homo sapiens
guuuccauuaaguuguaggaauuuauuuuaaauaaccuacaguugauuaaaagggaauucaugauaaaaauagaagauacuugaggaaagaugugggaaauggacucugcacacacacuaaacuaacaaugccucuaaaacuaaugauuauagcaaaaaaugucuucacauuaaaauucugcuuuuuauguuuuuuuccauuuuuuacacaauuacaaaagaaaaaauaaaagcccuaaaaucuugauuauuuuuccuuuuuuuggaccaaauacucauuuuccucuaaguuuauugaccugugaaacuuuuuauacaauaaaaucuuucaagugaaagauuaggguuaaaaagaaaaagauggauaucuuaaaggguacagcgaaugcucagaacaaaggaugaugggaaaaugguuucagucacugauuauuucauuauccuuagauucacucgcccuucaucccuccccaaccccaaucuacacgaucuuuaagaucaagaaaaagguuuaaauauuuuaaaauaauuaaaaagaaauaaaaauucacauuuaaaaaggaacacucaagucaggaaauauuuucccaucaugcuuuuucugugaacaggugucugaaccaaaacacugccaaagccacgacugcuucaaguuuaaugaaaauugauccccaugacaauagagagugacgacucuaacaggugcgcuggguuuuuuguucuacuuaauuuuaaauuccugaaaugggagagagggaagggaguuuaggaauuuauuucuauuaaaauauagaaguuauugcaaaacccuaacuguaaaaacgcaccaauauaaucggacuuugcauacaguagcuaagagaauccaaacauuucagugaaacagugaauuugccugguagaacgcugacaaauucccauccacuugcccucuugaaaauaaaaacaaaauucaaaacaaaucauacagcuagaauuuugauaucugaaauauuuuuaaauaaguuguccauaggacaacuggcucagcucucccuuauaauaucuccagguuuaucuuuucgcaaagauguugguuuguuaagacuugcugccucucucccccaggcacgagggcaagugaggcucaguuuauccaucuuucccaaaccacacuguuccucuucacagaacucugccucuugagacuggcuaaaacucauagucuucaucagccaugucaauggcccaggcaaacuucucccgcuggguuuuguuguaaaucuucucaauugggacaccccacuucuugcaccugcaaacaaaggagaaauaagggggggauuagggugacucagcaauggcccauaucugaggcccagggucagauguuccaucuucucuuucacaucugucuagugaggaugcaaauuaauagugcaccaagcauguucuaaagguuuuaugugaucaacucauuuaaucuuggcagugaucucuaaaguaggugcuucugcagauguacaagugaaaaacguacagaugaaacugaggcagagacguuagguaauuuacugauuuucucacacagcuagcugguaagugaccugaaauuugaacccaagcaguuuuucuccauguucuuaaccacuauacuauauugccuuuuaagagcuaaccaaaucucuagcaccaaacaaggcaaaacgagcagaaagagguacaaaagaccuagauggaaacuuuagcccggacuagcaagugccauaggggaggauaucuccaccuaugcucagaacuuaacagcucaaacuaaacaucuuccauaacaaagccacuuguuucagauguuaugugacacugugugugacacacagagaaaccuaguauuuaucugcuuuuguuaaaggucccucugccucucuguguaaguugcucagaucuguauucucaucuuuaucucuuguuccuaccuucaacugcaaaaaaauucaacgaaaaguuuuguugaaguguagagauggaugggcucuuuccuauucuuccagaagcuaagaguuuccauuccuguccuaaaguuccauuaggaauagggauggcaccugccucuuaaaaauauacacuacaaggcaguguaacagcacugaccauuuaggagcaaccagaauguugcaaugcauuuacagacaagguucagcaaccagaguaacuuguacacagcugaagccagaaguuuccccagaggacuaaaguguguagcuuaggaauggcaugugaaggccaccagugcucucggaacccccuccaccuuucuuaagcuagcagcaggagcucaaggagggcucaacacuuaccaagccacugugauccuaggguccagauaauugaguuuggagguucccagggcaaucuguuuauuuuccucucggucuguggcuugaacuuccagcuucaucaacuguuccuccagucucugaacagccuucuucuuugacucuacuacccuagaagaauagcaaaguccucaagaaccaggccugggcucuagacaagagcacacuguacccauccugccacuuugagucaauaaaagcccuaguauagagauuuccaaaagacauuucucagaaaccaucgaaaagccagggccccaggggcccugacagaugcugcacacuuuucucuaccagccccaacuuucacaauaccagguacauacuucuucgucuuugcauccuucaugaccuuggcaucagccuuagcacuuuucaggucucuccgggcaucugcuagcuguuccuucuuggcaucaaucuaggggaaauaauagugguaagguuaugagcuguagaggaaaaauggcuccaccugagaaggugaaaccaagauguuaucuggaccaggcugucucugucagugguuugucagauaaaaaaaaacaaggguggcuucaugaaggcagggagaagaugcacaaggacuagugaauucaacuauuuguucuucagugaucuggaaagaaacaaggguuuuacagggcaguaaccuaggggcucagggaaaggaacccgcuggggcugggaaucugggugcugaucuuuccaucagagaacacucugcugucauacaucugggaggauggcuacaaaugacagcuguuuaucaaauagauccugugccaguucuuagcuuucauucuaagaacacuguaggagcuccucuuuaggaaacugaagcaggauacuugcaucuacugggcaaccccagcucguuccucagaucccaccaguacucugggaaggcggugccagcuucucaaggaaaauggaugcacugaagagaguacucaaggggcuacaaacuggcaauuaaaagacacccaggaagccaaacagcucagccagucugucccaaaccaggacauggcagggcuuagcuuuggcauucuguuuuuaaaaggagagcggucaccaggcgcggugucucacgccuguaaucccagcacuuuggggaggcugaggagggcggaucacaaggucaggagaucaagaccauccuggcuaacacggugaaaccccgucucuacuaaaaauacaaaaaauuagccaggcgugguggugggugccuguagucccagcuacucgggaggcugaggcaguagaauggcaugaacccgggaggcagagcuugcagugagccgagaucaugccccugcacuccagccugggcaacagagcgagacuccgucucaaaaaaaaaggagagaagucugaggugggaaggaccuuaguugucacucaauggaugugaaaacacuuuuagcuguggagcuuuuuuccccaugugaacucucauggaauccauaucuauaagggaagagacaagggcaguuucagccuuucuugcuuguuagaaucuuugaagcaccccuggugaaucuaaguucuucucagauuccugcuuagagacagcaguggauaacaacauggagcuagagccccugucacugagcucacgcuacucagagggcaggagaaccccauaccuauggucaucuaugugaggugaagacaaccucuacggaguaaauaacaugucugacacacacugggcugcucacugaaccuggaauuguuuguuguuagauacacacagcccaagauuggaaacagaggccaccauugugagaggaucacuaaauauguuuuacuaugaauggcuuacuuccaacaucuauguuguccaaagccaaacugaggggacugauucuauauacaaaagcaucacagacaccacuagccagauucuuuuuaggauagaaauguagcaaaccaugaucuuuuaaccauuucugugaaugcuaaauuggcaggcuaugucaaauucucucaaagcaucaaagacuccauugauucacuuggcaaacaggggcguguguuugcuuugugggcacacaggagaggaauccuggguuuggagggcucaucuggcaggcagccugggcugcccaaacccgguuccagagcgagagcaacaaaagaccuccucaugcuccugggagggguuuuccugaauuagguaaacagcaccugaauauucaugcuuuuauuucuggcuuguaaugauaacaugaggagaauaaacaauuccagaugaccagcauuuaacagaguggcagcaaaugugagcugcuaggaugggccgucuauagaguucuuugccugccaaucauaugauccaaggaaucaaaggucuauggauguauacucauucacuguggacauguacgucucuucaagaaagccagauggcaucuguagcauaaauuauaaguuguguguaccuuuugaaccagcuauauuacucauggguacuuaucuuaaggaaaucucaacaaauggaaaauauucugggccuuaaaaugcagucucauuccacaguaguaguucuuaaacuccaguuguacaaguauagaauuccaugaacuuggaugagaaaaaaucuauaauuucaauaaccucuuuuuggaacuuauuuauauuuauuuuuaaauuuuuaauacagacagggucucacuauguugcccagguuggucuugaauuacucagcucaagugauucucccaccucaaccucccaaaaugcugagauuacaggugugagccacugcacccagcuucuagcugaaauuuaguauuucuucuucaguuaugaauauggggaacaaaccauaguaauagcagcagcacuuaugacuuuaucaucaauagauguuagacaucuucauuucauauuugaauugcugcagaaaucuuaaaguaucauugauauuaauuaauuacuaccuugaaauuuacuacaggccaccucaagaccuuaauaaggaagcacaucuauuaucggacuuuaaaauguauuuugauaacuguauuucaauauaauuuguuuccuuuuuaacccuguguaucuguucuauaaugaaauaucugcaaauucucacuguggaccaccauguuaggaugaauuaguuaugaagucacugcuaacacaaaaauguucaucaucaaauguuaagugccuuaugguuuaaaagcucaguaccaggcggaguuaggaggaggaaagaggcucagggacaaggaauagcaccuauuugcacaccagucuuucccuuuagggcagcaaguugucuggcacacggccaguauucaacagauguuugaugaugaacuauauaaaaauaugauucauguggaaugcguaaaaauaaaaauagcuaugcuaggauuugaaagacuuuaaauauauaauuguuucaucaucuuuucaauuugaaacaaucuaauuuggaaauggcuguauuucugggcuguagcaaggaauuaugaagacucucuuuaaauccacuuuccucauguacaauaaggacaguaauuagcaauuagaauguacaccaaaguuaguuuuucaaaauagggaguggccaguauagaacuucuaugcguagaauaaagauuucuugaauaauggauacucugauauucaguaucuugaucagagauuaacuacuaucauauuuccauuuguuuaucuuuagcauagaccuucuacaacagacccagcacuggccugcugauaucucagcccugaauccucucauucgcagauaaucugcccacagcagacacaguucccuucauuuuauccaagauaccuuaguuugcaaguucaucauagacuucucaaaaguuuuugguggugcccucugaugguuacaaagaauugcaacagcucgauuggcacgguuauaagaaaggaucuucgcugggauguucucauccgcuguaaagaaaggaacaugguagcaagagggucaguuuguacaccaaaagugaacacacaguaugucuucccccagugccucguccccaugauuuugcuggcucuuaucuuacucagaugauuaauucaaauugcccccaaggacuaaggucaaaauuugagucaacagucuuaagaaaaugauaguaggaaguuuauauguaagcuuggccuggguaaauuccuaucacaagaggaacucugagucuagguaauauaauaaaaucuacaccuuucuuuuuacucagggaacuuggcuagggacccuucaucuccuugcuuccuccccacccauaugcucaucauaggugcugcugauauuacuaugguuuguugcccauauucauaaguucuauacuggccacuuccuaccuccccaccucuccacccaauguagccagaacagaacgaggaauugaagggacguuaaaaguuuaaaaauuuuggccgggcgcgguggcucacaccuguaaucccagcacuuugggaggccgaggcgggcggaucacaaggucaggagaucgagaccauccuggcuaacacggugaacccugucucuacuaaaaauacaaaaaauuagccgggcgacauggcgggcaccuguagucccagcuacucgggaggcugaggcaggagaauggcgugaaccccaggaggcggagcuugcagugagccgagaucgcgccacugcacuccaaccugggugacagcaagacuccgucucaaaaaaaaaaaaaaaaaaaaaaaaauuaagccacaguugguaguauuauuaugguuauuauuauuauuuuagagauagcgucucacccugucacccaagcuggagugcggugguauggucguagcucauuacagcccuaaacuccugggcucagccucccagguagcugggaugacaggugcacaccgccacaccugccuaauuuuuagaaauuuuaguagagacaaggucucacuacauugcccaggcuggucuggaacuccuggguucaagugauucuccugccucggcuacccaaguguugggauuacaggugugagccacugcacauggccugguaguaucuuauuuaaaaagaaaaauuaaaaaugccauccaaaaaaauuguuuuuauuuguauaguguggcauucuuuauaccaccuuaaaauacugacccucaacauaccuaccucuggcuuuucugguucauauucuaaggccaucugauguauuuacagagggcaguggaaauucaauagugacugggcuccaggaaaaaaaaagcccguggaucuuggugauaauauucuaaaaaucagcuauagaaaguaucuacucucuuaugggaaaaaaaugacagaaaccucaaggaaaggacuuguuccuguauuuuucugguaaccaugacaacuuuacucucuccaauuuaacagaacaucacagcacugucuucacucugugggcuuuuaaguaauauauguauaaaacacaaaugcaggcauuuuuguagcaggugaaaagcugucagcauuccaugaaauuaaucuugaaguuggggugggaagggggaaacagcauugauccuauguuuauacaacaaagcauuaucucgcuacuagaggucuaaagggaaaaagugucugaccacaaugguagggaaaaaaaguagaacugacucuaggccuuagauaagcaaggucaccggauaccauuaguaggggugugggcccuaucuggccaagcaauacuuacgggcugucaguucuuuuagcugcugcuguagcgugauggaggcauuguauguacggaauaccuuggcugucaagcccuccaugagauccugaagaugcuuauucagaauaccagucuggaggagacaaagcaacagauuuaggucaaagcuauacuaccugcuccuucuggcagcccuaggaguaauuuaugccagugcagucacaaucuugucaaguuuauggcccuacaagugggaaguuagggaaagaggaaaagaauuccagaauacaggguuacaugaugccucucuaugaaguauuucaaucuuuguguguguguaugacagggucucacucugacacccagccuggagugcagugguacaaucucgguucacugcugccuccaccucccgggcucaugcaauccuucugaggcuccuaagcagcugggacuacagguguggacuaccacaccuggauaaugguuuugccauguugcccaggcuggucucaaacuccugaccucaagggaucugcccuacuugaccucucaaagugcugggauaacaggcguaagccaccaagccuggcccagguuggugggcuuaacaaaccaauaaagcaaauuuuuccuucccuauuaagauaucagggacagguuuugggucuccagcagggguggcugggcauucagugaagggaaagcucugcaggagcagggaaggauaaaagguagggcucaucuaccccccacccugagugcuuuagcaguuguucugcagcagaugugucuucucuugacuacagauucaccguggacucagagggaggaagagagaguguaugggaugccacagagcaggccaggcuaaagggagagcccaagucaucugccagcaacccuccccuuuagguacugugaggcucuggcugggacucccuucaacauugugugcuucaucuacucacauugagucuaucaaaaagaucauccucgggcugcuuguucuccauaaauaguuguagguucuuaaaaaccuaaaagauauaagugaauccuaauuauuacucuugaaaaaaauccuaacuuuagaaauaaccccaaacuuaaagaaacuugcaaagaaaaaggcacaaggaacacgcauacauccgucaccgagauucacuguuaacauuuuaccccauucaucauuugcacagugugcauguaugcucacucucuccauguguauauuuacagauauauauacauaauuguuuguucugagccauuuauaagcacuuacuuauaauaugguccuaaaguacauuuauaaguacuuacuuauaauaugguccuaaaguacauuuauaaguacuuacuuauaauaugguccuaaacauuucaguguguauguucuaaaaauagauauucccuuacauuuacacaguaucagcuucaaaaauuuacauugauacauacuguuaucuaaucuguccagaguacuuccacagccagcaaaaccugauuacugauuaugguguccuuaugagaagaggugucuuuauaagaagaggacugcuggugggcuggauuauuaggauccugcacacuguaagucucugguucaagcccaauacuauggaaaagauuagguugggacuacagagcuauaguacccucuucagugaugggcucagagaucuggggacuaacauuaaccuuucacucagucaggaguuggagaaaggcugagcaaagaugaaaagugacaaauguaccacaugaccaggggauacuaagauauaguuaaaucauaugcugaguuugcucuaagggccuauucuacagcaugcuccauugaauacugcuauaggagaaggccacuccuuaccaggaagguagcacagggcggaacagugacuaaaaggagguacacaagauaucaaauaauaccucuccccucuuucaagucauuuauuuuuauuuauuuuaauaugagaggcaaggucucacuauuuugcccaggcuggaguacaguggcuauucacaggugugaucacagcacacuacagccucaaacuuuuggucuccagugauccuccugucucagccuucugaauagcugggucuacaggcaugugccauguugccugucucaagucacuuuugcuggugcccagcaaagugcaaagcacacaaaaaagcagucaacccaugcuuguugaauaauggaaaacaagucagacaguacagguacauuaacuuacucguuucucaacagggaccuuguuauaguaucugauggaguccuucccgaggaagucaaacucuaccacauauuccugaccauccaacucuggguguagauugaugugcuccacacgaagugagcagcagcccacaguguccgcuguuucuccuuccuccuuuucauugccugcucucagagcaagcugcccaggaaagaaagaaaagaugagcaugaauggaagagacaugauccuuacacaauuucguucuguguuuuuuuuuuuuuuuuuuuugagacagucucgcucugucgccaggcuagagugcaauggcgcaauuuuggcucacugcaagcuccgucucccggguucaugccauucuccugccucagccuccgaaguagcugggacuacaggcgcccgccaccacgccaauuuuuauuuuuuuuuuuuuuuuuguauuuuuaguagagaugggguuucaccacauuggccaggauggucucuugaccucguguuccaccugccuuggccucccaaagugcugggauuacaggcgugagccacugcgcccagccuuuugacccuuaugcaauuucuaggcauccaaaacagaagccucccaauucuguuugaagccacagcaucagucagcauggccugggaacucuggauucugcaguguuacuuccucccccacucacuaugaaaucuauagggauguuaaauauucaugcuccuuuucuuucuauucuguccucugaaauagggauggagaaaaggaaaaaaaaaauuaaauaaggcagcaaaugagggagugcugcuacucugggcaaucaaacucaaaaagcuagugugaauuuugagacaauucagaacuuauguuaaaauacaagacugggggaaaaacaugaacuuuuuuuucuucucgugaguaccaagaaauugaucuccucuagagcguggucuuuaaaacuauauaauggugauaccugcaugguuuauuuaaacaauuuuauaaguuauaaccaacuuucuaaaggaaugaaauagaguuaaaaaaagaucagaaucuacugcucacaguaaggcuaagcauuguuuugugcaacuuuugauucaguuuuacauacaaauauauguauguugaguugugauauacaguauguggcacagggccuggggcagagcagaaacucccuuuguuaagcucaacacuagacaaugccgaugggaagaugcucucaccuugucgaugaaguacagggcuacagcucucugccggacuuucaucucuuuggacuuccagucuucucgauacugguuccggaucuuguccacacauuuuuucagccgccgagcagucucguauuucugccaguccuucucacccuguaaagacccaaacccaaauguagauuacuuugggacaguguaguaaagacagacuuugaauauagccaggcaagguggcgcaagccuauaaucccagcuagcuaauagggaggcuaagacacaagaauugcuugaacgcaggaggcagagguugcagugagccaagaucacgccacugcacuccaccaugggugacaaagcaagacuuugaacaaaagagcaggaacuugaccuuaagcaaacguaaaaaagaauaguacugaagagagaguuuggcacauuuaaccuguuaagaaugcacauugucccaucucacugccaagcacaacugacuucuaaggcuuucccagaagaaaguuucuagcucuaauucucuaaaauguuuauguuccugggaaaaacccacaugggaugucccaaaaacuaacuucugucaacacaaagcacauaaucacccccauucccacaucaauuucacagccuugcugccaacucugugacccaauagcaguuuucuaccaggacugaauuccauuaaaucuaagugaauuccauuaaauuacagugugguggagcugucaaagaagcagaaccaaagacuacaacauguaauuacuaaggacacaaugacuuccaggaacagccauaauuauucaccauuuucuaacuucugcauuuaaaagcauuucuugaugagauugagagaaacuauguuucugggaagccuuuaaaaaaauaagagcuuuugguggaaggguuaaaaguugauucuaaacccaaugaaggguuacuaaaaccaugugaaaacugaaucuaaacaauagugaagaagacuucugcuaccaagcugaaugaaaauagacucacaagcaagagccaauuaugacaagugagaaggggaaaaaaauucaagaaauccagaagcagggaauuacauaaaacagcauaaaacagacuagaugacauaaacauagagaaggaauuuaagaauccaagaaucucugcucuuaauuuccccacccgcaacaaaggaaagugguagugauuucugcccacacaugccugguuccugacuaugacguggacccgugguccuugagacauaagaccuguggugaagauaaccagccuuucagccugggcaacagagcaugacccuaucaaaaaaaaaaaaaagggggcgggggguggggugggggcgcaaccagccuucugggugugcagaagcaugagauaccuagagcaagaaugucuuccacuucucaauccuaaaaguacucagaaauuaaaagcuuacacaguuaagcuaaggagucaucugcacucucacaucauguguaccaguguuaugcacuuguuuggcuacaagaguuucaguaacuaccugcuaucaugggugggugauuuaguaguuggugacacagaaaaaauaccuaagucuuaguacauuuugacauuuaacagggugaauaagaaaaggugagauauaagcuguccucaugcacaagucaguaguaaaucuccaugacaacuguucuuacacaugcacggaaaaauuggacacaaaaggcucaccuucaacaguagaguacccaacucuggaguggccucuuuccccucacucuagugcacauggacuaccaaagccugucucaaaguccccuaggguuacguuugcucaguuccuuagucacaccacuggaauguaagguaggagucagguaaacgagauuuagaaaaacccaacccgcacgucauucacaggauacuaccagaccaacuuuucuucacaggcuggcugggcuucugcaccaaggaucuaggauucucucaaauaagcugagauggagguggaggcagaagccaccccgcuuagauccagcaggagauggcuggccuccaagaaguaugcuugucccugcaguguucaaugcccugaacaagcuuucuugacuacuuuuagaaaauaaacuauccaccuaggucuuccaggcaaggucucacaaaaccaucucaagaagacaaggaauccacuggagaaggcugccuuugaccaccucuccucuuucccuaauucaaucacacuucaguaauggguaaaaaucuaauuuaacugauuguagaugacauucuuuggaugacuuuuuaaaacuaguaggcccacuauauugucucucuaauauagcugcuauccauucagcagagugguuggguggaaucaggaucuggauucaagauuacaaaguugggggugagaaggcaaauuggauucuguuuucuaguaacuuucucagacguuuguaauggggaagaggacauuugccaguauucuuacaugacuauuucccuucucagucaauuuccaccaagcaaccacugauccuucaaucugauuacuaucaucauggauaaauuuugccuagucuagauuauauaaauagaaucauacaauauagacuccucugucugccuuuuuaacuuuuuuuuuucccucugagacagcgucucgcucugucaccaggcuggaguacagugaugcaaucucggcucagugcaaccucuaccccucagguucaagcgauucccaugucucagccuccugaauagcugagauuacaggugugcgccacccucggcuaauuuuuguauuuuuuuguagagacgguguuucgccauguuggccaggcuggucucgaacuccugaccugaagugauccacccgccuuggccucccagagugcuuggauuacaggcaugcaccaaccgcaccuggcccuuaaccauguuuuuaagauucauccauguuguugaauacauaaguaguucccuucuuaacugcugauaaauauaguauauucuaugacuauaccauaauguguuaucuauucugggauguuuccaguuuugcacucuuaugaauagagcacugcuaugaacauucuuguacaaguuuuuucauggauaaauguuuuuauuucacuugagguaaaaauaccuagaacuggaauucguaucucccugugguuaaaucuucacuccacugauaauuagugaugucgagcacucuuucauuugcuuauuuauugaccauuccuguaucuucuuuuguauaguauauguucaagucuuuugcucuuuuuauuaugcggaugggaugucuguuuuuuuauuauggagcuacaggaauucuuuguauagucuggauauaagcccuuucagauaaacauguugcaaauauuuucuuuuagucuguaaauucuguauuuauuuuagcagugucuuuuguugaacauaaauuuuuaauuuuaaugaaguccauuuagucaauuguuucucuuguugguguuuuucuguccuaaggaaucuacucuaaggucauauucaaccaugauaucaccuacaagcuuuaauauuuuagucuucacacuuaggucuauguuagucuuacuaauaaauagauuuaaaacguuuugaauuuuauaccaagaugccaggcucagaauauauauauauuuuuaaugagcuugugucuuauuuucucuaauagaacucaccaaaaugagagcuucccaagaugaauauuguaaagauacuuuccuucacauuuagcccuuuaaucccuaggugguuacauauaaaagguuguaagcacauacauuuuuggaaccccacagaauucuagacucuaaagagaaaaaaggcagaaguguguauuuggcacugagaguauuuuaacaggacuaaacgcaauacgaugucaacauugauccuaaaguuugcuguacugcauuugaaagaaaaaucaugaugauaaauucuguuuguaagguuaaggcugguuugaaaaaaccugaauuuuacuaagggcuacuuucccuggguugugagagcagguaaugcuuccaaacuuggcaguggauuguacuuagcagugaguacccauaagcagccuuuuuguaaacuccuagauuaugcaggauaagaaacuccuggguuaucuggaaucagaguuucuuugguugaaacugcagguuccagaaggcuagcugucauuccaaugcuauuucagauccuacgggcaccaggcacagagugggagagaaagaauggaaauaugcuugcaagaugucuguguaaucaaaauccuggggggaaaagcaaaaacaaacugggaugaacauaaaaagauaugaaugaguucaggacaaccuuuucaguaccuagagcaaguguuauugugguucucaaaaaucccaauccuuucaaugaccuuugaggcuagaaguaguguaacugugacagugacugcaaguaggccaauccaaguuuccagaaagggggcaaagacaggauacauaaaaagaacacacuucagcuguucuacaacuuugugcuuuuuaccccugaaugauuccuuuaauuuuuuaaauugucgaaaauucauaguucacaucaugcuugugcuacauuucuugauagagcacagaugggauacaaugauacacuauuaugugagggaauuaaguaaguaaaauauagacacaagaguaaacaaagacgacucuuagaauaggagacaucucuggaggcugagcagaaauguguagaacaaaagcaucaugauggcagcuucccauauagccgaccuaaagcccuccaugaaguaaaaccaccaguuaccacccuucaacauucuauuacaaaaacauaucuguuauugacugcugggucacaguaagucauacuuuaauuauguuugcuccaaauauguagcaauguaagugcucuaggcuggaugugguggcucacgccuacccagcacuuugggaggcugagacaggaggaucacuucuugcuccaugcaagaaggggggacuugaagucaggggccuuauuagcuugggcugagcugggcuaagagacucccuccaagacaaaaaguaaugaacagagaaggagaagaagggaaagaaaagagaacaguacauaagcaaaaaacaccucccaguuaaaagggcuuacaaacagaaauuucaaaagacacaaggaaaauggcucagaaaaacugccaacaguaauuagcacaugaauucacuucagguaacauuuuauagaacaaucuuacaaagacuuucaagugaguauguuuaguaugcauaaaaagauguaaaaucuagaaagaacaugaaauuauaaaacaaaaaugaaacaaaaucagauauaaaauuagaaauuuugaaaacaaaaagugguaauugaaauaaauuauagauggaauaacuuguagauuaaauauaauuagaauuagugaauuggaagugagugcuacaacucacccaaaaugaaauauuccccugaacuuaaaaaaucagaccuaaagagacaaagaguaugaaaauauaguuuaaaaaagaugucuagauugaaaagugucaacacucaucuaauaggacucuaaaaaagaaguacaaaaggaauggucuagaaguuauggaagaaauaaugauugguaauacuguaggauaaaauacauuaguccucagauuaaaagucuaucuauaaauacauauauaucccuggauacagcauagugaaaccagaaucuucccuauaagacacuuccuugacuggagaaaagacagacuaugaauuaagaugaaaauaaagaaauuuucagguaaacaaaggugagugagugccacuguugggucuucacuaaagaaacauuaaaggguguauuucaacaagacaagaaaccccagaagguaugagauacaagaaacacugaguauagcaauuaauaaaacauuuggcugugacugcuguugacuagggaaaggguuaggguuuuauggauaauuguguuuaaaaauaaaaauuaaaacuuaaagaaauaugaaauauaugaacugaaaaugaagaacuguuuuuauagauaauuaaauuaucuacauagaaaccccaaaugacagacacuuuuagaacuaagaguucagcaacccugaacaacucugagcaccucuuguaucugcugccagauacaagaccaacaccccaaaauuauaagcauuaccacuucaggaauaaccaacagaaacauaauggaaaaaaaucucauucacauuagcaauaaaaacuauaagaucacuuaaaaauaagaauuuuuuaaauguaaaaccuuuaugaagaaaauuacaaaaccauauugguggauacauucaaaagacaugaauuaauggagagguauaacauguucgugaauuggaaacucaauuguauugucaauaucuuucuccguuaaucuauaaauguauugcaauuccaauaaaaaucucaacaguuuuuauuagaauuuguuaaucaacaaguuuaucaacaguuuucauuagaauuugacaaguuuaucugaaaguuaauaugaaacagcagagggccaagaauagccaaagcaauuuugaagaaugaaacaaacuuguccuacucaauagacuuuauaaagcuacaguaguuaagacaguaugcuacugaugcagaaacagauacacgaacuaauuaaagaggacagacagcccagaaacagucugacauauauguagauauaucugauauacaagagaggagguaauacaacuaaauaguucugugacaacaguuuacucauuuggaaaauauauuagguuucaacuucaucccaaugcaaaaauacauucuaguggaucuaagacccaaauguaaaaagcaaaacuuuagaaacauuagcaaggauauggaaaaagaggaauacuguugugggugggggugggaggggagggaggaggagaguaaugauguaaacugaaguacuuaagagaacaauuuggaaauaucuaauguauaaaacaaauuuucauucauauacacaagaaacauguguuucuuccagcacuguuuaugagggcaagagacuguauaaccaugcuaaaugccucuuaacaagagaauagaggcaggguaugguggcuaacaccuguaaucccagcacuuugugcagcugaggugagcagaucacuugaggucaguucaagaccagccuggccaacauggugaaaucccgucucuauuaaaaauacaaaaauuagcugggcaugguggcacacgccuauaaucccagcuacucaggaggcugaggcaccaaaaccacuugaauccgggaggcagaggucacagugagccaagaucacgccacuguacuccagccugggugacagagcgaagacauggucucaaaugaccaacaacaaaaaccaacagaauagauaaguuuuuaugauauaauagaauaccauguaacaaauaaaauggauuaauuaaaaguguagguuaagauaauaaaaccacaaaaucaaagcuggagaggaauaaacaaguugcagaaugaucccaguaacauaccuaauuuaaaacuaaaaccuguuuuuauuuuacaauagguuguacaauaugucuuuagcuuacaauaguuuacaacauauuguaaacuaaaaacaaguuuuaaauuaguauguuacuaguguguuacauauuguaaaauuacauauuguuuaugaacacauaaauauacugcaaaaauacaaaaaauauguaugagaauaaaaagaccgaguucauaguaaucuacagggaagaaggugaaugguauacaagugacuucagcuauguuuaucaguaucuuuuaugaaauaaaacaauugagcacauaagacauaauuuuaagauuuuacaaagccagaugguggacauacgaguguucauuacauaauuaucuauuccuguauguuugaaauguuucacuaaaaauaaaaccccuaauauuuguaucuacauuuuuuaaaucuaaaaagagaaugcuucuuccgcuggcaauauaaaguuaaaaauuauucaaggcacuaucaaaccccaaccuuugaagaucucacuauucugcugaguacaagacagccuaaaagagaacugagagcaagcucaagaaaucauuucuuuuucuccuaauggcaccacuuuuccaggccuuuaaugacuccuauugggaucccauugcaguucaagucaggcacuuucuccugagcauaagguucagagucuaacucugggugacuuuuagguucacuaccaugaucaucauccagaaacuugcacaaaugucuauuguguauagcaguuagcuggauauugucuggaauaaaauugacuggcucucugcucuugaggcauuucaccuggucuaucuaacaaggaucucagcccucagagaggcuccaacaauuaauuaacucuaauccuuaccuguacaaguacucagcauacauuauguaucugucaccucucuccauccccauugccaucauuugucuuaagucaucgcuguuucuugccuggaguaugcaacagcuucccauugaucucucuacuucuuguuuguguccaauccagucuccgcagagcagcagucagaaugaucaauuauguaacgaguuuccaaaauacaaaucuggugucauuucccucuuuaaaucccagguugguggcuuccuuuuaaacuuaaaggcccuaaaacuugcccaagauccaacagcuaguaacucuucaaucuucuuagagcguaugcuccucaugcucuccugugacauccacugcuaaauguggccagcuuuaaaugccauguuaaagagacugagcccuuaaaggacuuugaacaguggaguugucuugaacauagcuucauuucagcaagauuuacaggcauuauauguaaaucacaccaguagauuuacacugcuguaaaugcugcaaaggaaaaguacagggugccaucugagaguauaccgggguaccugauccagccucuaggauucagggauggccuuucugaagaguuaacauuuaagaugagauuuacaggaugaauaggauuguaucccuggaaagaauaggagaauggguguuucuaauagagaaaauaaaguagccuuuugaaaucccagaggugagcaagagcuuggucguucugagggaagaaagaggcaggagaggaagcuauauagugaggccagccagaucuucagguacuaauuuaaaaaaauuuuuucuuuacauuauccuuuaaauguuaccucuucagaaaggccaucccugaaccccagaggcuggaucagguacccugguauacucucagauggcacccuguacuuuuuccuuugcagcauuuauaacaguucauauuuacugaugugauuuacauauaaugccuguaaaucuugcugaagugaagcuguguucaagacacuccacuguucaaaguccuuuaagggcucagucucuuuaacauggcauuuaaagcuggccacauuuagcaguggaugucacaggaaagcaugcagagacugaagaucuaaguuacauucuaagaagaucuaaguuagaguuacuagccacugaaucuugggcaaauuuuugggccucccagagacuaaauuuacucaucuauaaaugguggcauuaguauauguaugugcgguaugcuuagaagauccaaauguuaacuuaugugcaaauguuuuuaauaguaacucuguuauuuugaucauuuuuaaguugugguaaaauaugcauugauaccauuuaccacuagugacauuuaguaguauauccacaauguugugcaacugucaccacuugauaauucuuuuuaucacaccuuuucucaaccccuauccucaacauacucugcuuaccacccuccccuuuguccacgacacaguucucucuuguuugaaauacuacuuuuaagacccaaccauaaccuacuuuucuucauaaaguuauuguugaucucuaaggugcugcaaauaacuccucuguuuaucuaaugcauuuuacuuuuaucuuucuucuaauacaacugaauucuuaccugauuugcccaccagccuauaaguuccuuaagggcuaaaacuauuauuuuucugcuuuuguagccauauauacagcuuugcgauacuucagaagaggaauacauguuucuuuaaaugacuagucugcucaacauaaguguucgcuuucugauuuuguacuuaucuaaacuacaaaaacuacauuuuauuuuuauuuauguauuuaguuauuuauuugagacagagucuaagucucuugcccaggcuggagugcaguggcgugaucucagcucacugcgaccucugccucccagguucaagcgauucuccugccuccgccucccaaguagaugggauuacaggcacccacuaccacgccuggcuaauuuuuguauuuuuaguagagacaggguuucgccauguuguccaggcuggucucgaacuccugaccucaggugauccgcccaucucggccucccaaagugcugggauuacaggcuugagccaccacacccagccagaaaaguauauuuuauaauuggagaaaauauauaaacagguauuuuucauuagaaaaguagugauauacagaagaacacagggcuacaagccagaaaauguacaguuuagucuugccuauucacauagccuuuucagcuguggcuuucacauuuuaacagauguuauaaccuaugaacgaggaucaagaaggucuuuagucccaggucuccugcacauaaaacaguuaacagucuacauagaacuaauuccuugacuguguuuuugucucuguuagguuuauauuucauaguauguuggagggaagaaguucgugggacucuccaaagcuagauauacauagcuaucuggcaaacaaaaacugauuucccccaaggcaguuaucuccuugcaauaacacuaucaauaaauaacagugcauagguauguaacacaguuuuaugaugugcuuucacacacauuucauuuggcccuggugaaccuacccagaugagacugcaggaagccagaaguauguaagacauuagauuuuacaacuuguuucaggauauacagaaacuacauucccuucucauaaccaagagaggugaggaaguagaagacaucugcagaggccaauauacaaucaccauacuucaacacauucugaccacuggacguuaagcaauaugaaggcagggccuacgucuaucuuguuuaccaacauaauuccuagcaucaaauguauacuguguggggcacauuugggauuucaguaaauauuugugaauuaauaaauaagauuacaaugugaccaaaaaaauggaggcacuguaggaagaucaccauaaugcuaacuaugaaaguacuugccuucuuucaauggggaggauuuuuaauuugucaaagugauucuagaggacgagaacguuacauuucaacaaaaaaagguuaucagcaccaugaaccagugcagcucucaacuauccccuuaccuugauucgugaacuaggguuaagcaugauguauuuaauggaaccuuggauguucucuguccaggaaaccagccaaguaaccuuguuaucaugccggacuucuuuccacuuauguccuggaggaggagaaggaaccuuggcaucucuggaaauaacagagcacgaggauagugaaauaagaugugaggaauaauuucaccuuucaugaccccaaguggaccuaucugcugagcauaauuuuccaaguuuccuucuuaacagucaauacaguagucccaccuuaugcaugguuuuacuuacccucagccaacugucauccgaaaauauucaauacaaaauuccagaaauaaacauuuuguaaguuuuaaauugcacaucauucugaggagcaugaugaaaucucuuguagucccaccugggaugcgugaaccauauauacaacauaccaugcuguauaugucacuugcccauggguaaccuaguagcugccuuauuuaucagguugacuuuaaugguuuuacauugcuuguguucaaguaauccuucuuuuacuuaauaaaggccccaaagugugaaaguggugauguuggcaauuuggauaugccauacagaagcugcacagagugcuuuaaaugaaaagguggaaauuaucgacuuaauaaaaaaaacuguauggugaaguugcuaagaucuaagguaagaauuaaccuuccaucugugaaauugugaagaaggaaaaagaaagucgugcuaguuuugcuguugugccucagacugcaaaaguuauagccacucuaugugauaaguacuuaauaaacauggaaaagacauuaaauuuggggguggaagacaucaacagaaauguguuccaagugacagcaauugggucgaaguugcaggcauccacugggggucuuggaacauauccccuguggaugaggggagacaacuguaccucaaaaacaucuggagaccuacgcaugaaauacuguccugcucuuaaguaucucccuucccaaacaguccuguguaaccugggaaauauucccaaguacaauaaaggacgcccuccacccccuuuuuggcccauaggaugaagugcgagcucacuugcuacaguugaugauuauauccucgggcaugauucgucucuucagcaugcccaucuuggggugguugccgcggccacggaaaaguccaggaggcucuaucuugaaguuagcaauccucucuuugugguuauccauaauacagaauccauauucuuucaguaauuuuucauucuccucuuugauuuucuggaagacagcaagaaaguacucaaaauagauucagauugcuguucucuacuaaugcauuuuaucucuugugggagacuaagucaagguagaggaaagucugaaaaaucacuaaaaaauaaauucaaauaaaggaaaaccucuagugguuuucucaaacuuaaauaucauaaaauuccccaaaaagaucugccuauaaggauugauuucaacuagauucaaaacugauucuugugucuuaaaggauauauguuuguaaauguuauuuggguguuuuuaaauguacuuuaaaaauucauacuguuuuacugaguacuaucaaaacaggaaauggagaagagucucugauagagccucauaaaagaauagcucaagccauuuaauuaaacagcaguuaaacagcuuaaaaacguggguuuuuaagcucagacagaucugucacuaauuuuuuuguagguauacagguauauacacucuauacuaugauccuugcuccaaaaaggugagggauggugggggagauuuugagccuccuuacccucuauugacucugcguuuuauauacuuauugauucaguuuaacuaaguugugcugccuugugggugggaacagauucagaccuugcuggcagcagguguccuuggcagaggcucugacaaggggauguuuauaaaaucuaucuuuggaucaauauucuaagaacaaagcuccaaagugaucuuuuaaguuucaaaaugccccugaaguaaauaauauacuaaauuucacuaacuuggaauauugaggauaagauuuaccugagacacaaagucugaugcaauuaacauucuuauaguaaugcauuaauuuuuaaacuagugaccaaauaaguaccaugaaacaaugaguuauaucaauacaauggucugaauuacguaaacacgcaaguccuuuaaaauacugaaacuacaggaauuugaagugcaaagaauuccuuaaaauccuuaacuucuggacuuccgauugguaaaaaugaaauucuagccuggauuccuuuaguucaggggcugacaacuuuuucuagauagaaaauauuuuaggcuugagugccacacagucucuuuugcaacuacucucuuuugcaacuacucaucucugucauuguugcauaaacacagccguagauaauauguagacaaguagaggcagcugguuccaauaaauuuuuuuuuuuuuuuuuuacaaaaacaggcagccuguagaagaaaaaugacaucccagcuggauaccagaaagauccuucaguaaugaggauggccaaggcuggaagauggagauggaugagcaucacaagauuccagaguaaaauagaucaaagagcagggagguacauggccaauaugauuucaucugucuuaaauccuuaauauccaguagccacugugggacaggucugcccauccuuaauuacuauauuauuggcuggaguuacugacugguuuuuaggucacugaagcaccaagauuccuguacagagcuacugagcaaaguacuuguucacaauuuucagucuaacuaaaaccuuuaagaaaauuuagacuuugagaacucuaagucuuuagcauagaaugaugugaaauuacugauguuaauguugugucauaagaaccaagaagaaaguuaaaugaaccaaucacaauuccagaauucuccagagguuuaauaaauucuguaguaccaguuucucuuccuugcucaucuguuuccgagcuuccgucugggcuuugaaauacuggcucaucuggguaaaaucacauuugcuuagguuggugauaauauucuucucuucauuagucauuuccuagucaaaagaaaauggggagaugaaagaaaaacaacgaaaauacacuaauaaguccuuggguuucuuugcaaauacacccaagcaccauuuuuucagucaaagguuucuggaaguagccaaucucaauuaaugaauuuugaaaaaacaaaaaaauacaguuguauuacuuuauuauaaaauauguacuuacuaauauuaaaauguuuuaaaaugacuuaucauggaaaaaaaugaauucuuaugugguuucuuagacuccguggcacacagcccccaggcauuaugaauacaaguuugaaaucccauacugauucucucuuggaaacauuaccccuauucuauucauuuauuaagucugcuuuuucugagcuaguucaggaaguaaacuuuacugcugccucuguccacauuauccaaauugagaauaaugagauuuuaaaaaaucaccuaggcaaauauaguauaugugguuucaagaguagaaaguaccuaaaauaaaugagcaagaauuaacagcgagagggacaucagauuaacauuucucuuugcaacagcagacacggggcaguccugcagcgacaaacuuuccugugcgcaacuggaguugagguuuucuguuuggccuaaucugauaacccccaccuaccugccaucacaugagagccaauagcaaagauauacaaguacucuuguuggacagaaacccuacauaauauaguaaaugaagacaaaaaauacgcaaguuuaaauacaacaaaauccauacaacucaaauuuuacaucaggaaauguuuugcaaaaugauaauuuauuacuuaguacuugauuguuuugcaagguacuaggauauuaacacaugggcuacaguaccuuucuccagucuuuaaagaaauuuuuccuaaauauuuccuugguaguauauucauggucgagcauuuuugcaaagaacguagcuacuuccucugcuuuggggcucagcuucaugacuuuaccuagagaaaaaagugguuccaaaaagugagguauaguauucauguucuaagcauaaauacccagggcuagcgaauucucuuuaauaaugguuugccuucucaugguauauaaaggucuggugacacauaguagcaacaacaacaaagacaacauacugauuuauaucuacuuguacaaauucuccuucucuuuagcauauauuuaccugggucauucucuggagacuaugccaguuaauuguucccaggugccugcucaggacagggaugaccugggggaggcccagucacucuuccuuuuccuuucagcaagcaggguccuuuacaccucuucaaugguuuuuaaaaaucaaauccucagagggacuccugccacugcuaagcuaagcagccucuguucaagaaggggaggaagggauagggcagggaguggaagaaaggaauuguggggaaaagaaauaggcaucuuucuucuucaaaguuagguggguggaauaugaauaaaaaaauauauauccauacuaggcaagcccagauuucccauaugaaaagccuaauaagaccuucuucuagaacuuugcuauucaacaagugguucacagaccagcagcauuggcaucaugugggaguuuagaaaugcagaaucccaggcccccuccuagaccuacugaauccuauacagaaauugcauuuuuaacaagacuuggaugcacacuagaguuugcgacacacugcucuggaacauggguaccaugaugcugccucuuucagggaaccaggaugcauccacagcacaagggaugacugggguuccugguguauccaauuguuuauguaaaagcugucuaaaggggcugggagcaguggcucaugccuguaaucccagcacuuugggaggcugaggcaggcagaucacuugaggucaggaguuccagaucagccuggccaacauggcgaaaacccaucucuacuaaaaauauaaaaaauuagccgggcgugguggugggagccuguaacuccagcuacucaggaggcugaggcaugagaaucgcuugaacccaggaggcagggguugcagugagccaagaucacgccacugcacuucagccugggcaacagacugagacugucucaaauaaacaaaaagcugucuaaagggacucagauguuuucacaaugaaagcugcuaacugguaaagaaaaucugaauagggccuauggguuuuauauaccugauuuaguuaauaaagcaaugaaagaaaaguacuugggaauuuaauccacuuuucaaacaaaugcuuuugacaguacucuuagugccaauuuccauucuuucuuaaaaauccaacuuuacaacaucaccucgaaccaauccaugcuauacuaagagcauuuggcuauacuuaaaaugagguuaacuauaauuccaccaccuuacuauuacacagguauuaauaauucaccaaggcugcccacauucuuuauagaaaacuaaaauuuaaccagaaauccauuuauuucaaaacucagaagacaucuuaucucauaaugauaugcaaucugacuuugcagggguguagagaacuguagcacaauauugaaacaguuauaauagaaagaacccacuuuggacgccauuaacuuaaaaggccaacagguggcgcagcugcccccaucaacccccaagcuucugcuuuggaagaaagacacuucggggaagauaggcuguguauuaaaagauucccugaacuucuuuagaaaacuguaacauguuuccaauauaaaggaaaacauuaagucauuaggaauaaaauaaaugaaauaaaauggcaagaaaaaaauguaaacuguuaacaccauuuaaaaaaaaauguggcugagcauggugguucacaucuguaaucccagcacuuuaggaggcggugcaaggaucacuucaggucaggaguuccagaccagcuugaccaacaugguaaaacccugucucuauuaaaaauacaaaacuuaggugugguggcacgugccuguuaauuucagcuacuugggaggcugaggcaugagaaucguuugaaccuuggagguggaggcugcagugagccaagauugugccacugcacuccagccugggugacagagugugacucugucucaaauaaauaaauauaaaaauaaauuuaaaaaaaaugagauuuugggcuguuuuacugaauucuguccuaauagagggagaagcaacugugacuccuccuauuuuagaugagcugucaaaagaugaaaugauggcucccugcaucagaguagugggaggaugacuggaagguuccuggcaauguuaacacuuuguggaaaaggcugagcuccaggaaaaggaaacugcugaaucaaagcuguaaacugaagguccucagagaaggcaguaauucacugcuucagcuagcccaugccccaccucccuggcaaguucuaaaggagucuaagaauucuccuccccagagaguaggcagcacuuacuguaucaguuugaaguaaagucaaauaugacuucuugacuuacugcagaguaagaguucacacaaucaaagagaagaaaucccagcagaggaccagcugagaaaaugcuggagcccuaaagcaggauccuguaaaggaggacugggcaagaaugggaggaaaggacuauggcaaccugugaacuagaccaggccucugcuuccuaucuugaaaaggaagagaaaccacaggacuagggaaucuagcuuucccucccaucacuuugaaccucaaagugaggcuuuaccagcugagcauccuaaagcucuugguaaguccagaccaggccuacggaauaccuacgcuuugagauggugcucuucaagguucuaggcccuuucucuuaauuaggaguuuuggcuuugaguuauaguuaagagucuccaggaaugaccagcgugagggcugaaagaacugucuuaggcucucuggucaacaggucaaaauguuuacauaacauaagcauuugccucugagauuauggaguccuguuaggcugcaaacuccccaagaucagggucuaagucaguaguacuauccacugcugggucuuggugucugaccacaaauacauucaauaaauauguuuuauuuauuuauuuauuauuuuauuuuuugagacagggucucacucugucacacaggcuggaggggaguggcacgaucuaggcucacugcaaucucugccuccuggacucaagcaauccucccaccuuagccucccgaguagcugggacuacaggcgugcaccaccacacuuggcuaauaaauauggcauuuuaaaaaacaaauuucagcuugccaaguuuggcacuuucuucaguugcagacccagcccuuuaguguaaacuacuaccuaggccuacaagcauugguggaccuaaggccacuacuggugggaagagagaugcaccagaaugccugaguguucaccacugaugcuuuucagcaguuauccugcccaguguuucucaaaguuuggucagcagaccacuugguucagaaguacucaaucccaccccagaacuuuuucuuuucagugcgggcggugggaugggugagaagaaaacaguggggggcugagggugggaaaaaugguggagaaaugggguggugaaauaacaguggccaaaagacggugguaagacaaguggagguggaagaggaaugcuggggaaaggagaagggggacugucaggaaaggggacagaagagggaaggaugguugggaaaggggaaagaagaagagggacgguggggaaagggaaaagaagcccaccccacaacuguuaaaugggcucagauccacuuuggugagucauaagcacauaaggguaugaggaacaaugcucuaaccauuucuggauaaaacucauggaaugaagaaaaucaguuauuaccaucuacauacugcuacacugccaacaggaggcaugucaaaggcuacccucaaauccuucaaacccaaggauacaaauaccaacgacagauaagggacaauucugaggguucuaagagacccaggcagggcauuucuuuaaagcagcucaucagacuugauugcacauauaucaaaggcauaguguuaugcuacacagaauaggugacagaugccuaccagcccuaucuagagauggauggcagacuauuaauccucgaccauauacuaauacuguuucuagugaugagcagcuuguccgauugcauuguuauauugcuaacauaaaauacuaccauucaagugaggcuuuucuaauaacucuugcgaagaguugcucccuagaaaugaaguucagaucaaaaccuucagcuuguggaccacacacuguuagccauguugacaaaccuuuuuuggacuauguagggaagacaugaauagccccuuuuccauggcacuuuuucagcagcaaaugagccuuuaagaguuaacaccugaugccccuuccucaaaauugcauggcaauaaaacaaaaugaaauaaaaaggauuaucuauuacauaggauccuuccuuguuuucuaucccuaaauagaagcagauuucuuuuccuggccaagaaucaagaaccuugaaacaacucaccaucauaauaaaacuugacauucucuggaagaggcucauaugguggggcaaauacuggaccuuuauguucuaggaauuuccacuugaugccuucaggauagcgcucuucuucccaccuuuaaaagacaaagcacagccucauuuagugaucgccuugucuaacauggggaucaucacugauuaaaugccaaauaauuauccgcucaacugauuagugcucuggaaugacuucugggccucacauucaaggccuggaucaaaagaaccagugucucucauuuugaaaaagccaacgcucacaaguaagaugaaauacuguggugaauaaaggaaaauacauuucaacagcucaguuuaagaauacuggacagaagagaucaacaaugaaggagcucaguaacaagugagggacuugaaaauguaaacaguuguuuuaccacaauggcauacaugacagagggauuguuuacauuguuuguaaggaaaaggccuccucagaguggugacgucagauggaagguagaggagaaaacaacccuaugagaaaggacauaaaggaagacgacuaggaaaugauagcuuaacuggggcauguugaguuuaagguacuuacgcauuaccuggaacuaucuagcaaacacugauaagugaaucuaaagcucagugggaacaacuuuuugaaaauguauuuuuaaaauggucgaacauaagaaaaaaaugaguaauacaauaaacaccauauacgccuguaaucccagcacuuugggaggccgaggcgggcagaucacgaggucaggaggucgugauccaggucaggagccugggcaauguggugaaacuccgucucuacuaaaaauacaaaaauuagcugggcaugguggcgcgcaccuguagucccagcugcucaggaggcugaggcacgagaauugcuugaacccaggaggcagagguugcagugagccaagauugugccacugcacuccagccugggcaacagagugagacuccaucucaaaaaaaaaaaaaaaaaaaaaagguuaauaauuugcuacauuuccuauuuuggccgaaccauuuucaaaguugguugcagauuugauacuucaccacuaaauauuucagcaaguaucucuauaaaaauaauauucuuccacauaaccacaaaacuauuaucacaucuaacaaaauaaucuccuaguauaauucuaauucccaguccauauuaaaaacuucccuauuuuaucuaaauuuauuuuauagaccaggauccaacucaggcucacaaauugcaacuggcuaugccucaaguuucuuuuacucgaauagauaacuaacuuacuacccucauauuuacuuuccaaguacaauauuuuauuuauuauuuuauuaucaaucauucagccauggaacaaguccaauauuuuaaacaaaguucagaaacaucaaauaaaaauuacauguaucaaaccauauuguaacaaugguauuacuauaaaaccaaagucaacauauauggucaaaugauuuacaacaagaugcuuaagaccauucaauggagaaagaacaguuuuuucaacaauaguguuggcaaaauaaucaaacugggucuuuacauuauacacaaaaauuaauucaaaauggaucaaagaccuaaauauaagagcaaaaauauaaaacucuuagaagacaacauaggggaaaagcuucacaauauuggauuugacagugauuuauuggauaugacacguaaaacacagguaacaaaaagaauaaaugaauugcagcugggcagaguaccucacaccuguaaucuccgcacuuugggaggcuggggugggcggaucacuugaggacaagaguucgagaccagccuggccaacauggcgagacccccccgucucuacuaaaaauacaaaaauuauccaggcaugggggcauacgccuguaaucccagcuacucaggagacugagacacaagaaucguuugaaccugggaggugaagguugcagugagccgagaucacgugacugcacuccagccugggcaacagagagacacucugucucaauaaauaaauaaacugaacuucacugaacuuaaaaacuucugugcaucaaaggacacuucaagagagugaaagacaacucacagaauaggagaaaauauuuguaaaucauguaucugauaaaggguuaacauacaaaauauauaaacagcuccuacaucucaauaaacaacccaauuaaaaaaaugggcaaagucucagucuuaagguggaggggaaaaaaaagauaaaauuaaaaauaggggcugggcgcaguggcucacgccuguaaucccaauacuuugggaggccaaagcgggcggagggaucacuugaggucaggaguucgagaccagccuggccaacauggcaaaacucuguaucuauuaaaaauucaaaaaauuagccaggcgugguggugcacgccuguaaucucagcuacucaggaggcugaggcaugagaaucacuugaaccugggaggcagauguugcagugagccaagauugcgccacugcacuccagccugggcgacagagcaagacuccaucucaaaaacaaaaaaaaacacguggggguggggcaaagaacuugaauggucauuuuucuaaagaagauauacaaguggccaauaagcaccugcaaaaauaugcaacaucaauaaucauuaggaaaauaccaaucaaaaccacaaugagauaccauucauacucauaaggauggcaauaaaacaaaaaauaacaaguguuggugaagguguagggaagcuagcacccucgugugguccugguaggaacguaaaaaggugcagccaauguggaaaagauaguauggcaguuccucaaaaaguuaagcacagaaaugccacaugacccagcaauuccauucccaggaauauacucaauauucaaacaaauacuuguacacgaauguuucacagcagcacuaucugcaacagccaaaggcagaaauaacccauguccaucaaaagaugaaugaauaaacaaaaugcaggacaaacaauggaauauuauuuagccuuuaaaagucagaaaauucugaaacaugcuacaauauggacgagcguugacauucuguuaagugaaaugagucagucacaaaggacaaauacuguaugacuauuaauacaagguaccuaaaguagucaaauucauagagacagaaaguagaauggugcuuaccaagaacugggggaauaggcugggcacgguggcucacgccuguaaucccagcacuuugggaggccaaggcgggcagaucaucugaggucuggaguuugagaccagccuggccaacauggcgaaaccccgucucuaccaaaaauauaaaaaauuagccgggaaugguggugggagccuguaaucccagcuacuugggaggcugaggcaggagaauugcuugaacccaggaggcgaagguugcagugaacugagaucacaccacugcacuccaaccugggcgacagagcgagacucugucucaaaaaaaaaaaaaaaaaaaaaagaacuggggcaacagagaaguggggaauuguuaauaacuacagaguuucaguuuugcaagauguagaguucuggagauggugauggugcacaacaauaugaauguacuuaaugccaccgaauuguacacuuaaaaaugguuaagaugauaaauguuaugucauauguauuuuacacaauuuaaacaaaaauauuuaacagaaucuuagaccucaaaggaauauuaaagaucuucuauaacuaaccuaccacuuuuucagguaugaaauuggcagagucauugauauauuaauagaaggaucucaaugcaggaaaccacccaauccuacagucuauuacucuccaaauagagaaaauauauauauauguagguguaugagagcaucugcaaggagccugucugcagcagucacagaguaaccgugaggagauuccgaacgccacccuuucccuuauccugggacuuuggcaccauucuucucaucgacuacaguguuuuuauuuauuuauuuauuuuuugagacagagucucgcucugucgcccaggcuggagugcagucgcgugaucuccgcucacugcaagcuccaccuccaggguucacaccauucucgcgccucagccuccugaguaccuggggacgacaggugcccgccaccacgcccagcuaauuuuguuuuuguauuuuuagcagagacaggguuucaccauguuagccaggauggucucgaucuacugaccucgugaucugcccgcuucggccuuccaaagugcugggauuacaggcgugagccaccacgcccggcccuacaguguuuuuaaaucaagacuccaaacuguuuuuacgacuccuauuucaacauguguauccugaagacccacagcaacuucuuuaccauuuaagcaaauuaagagauucagcaaaucacaacacuaaacuucaguuuaaacagaaagacagaauaucuguuucaguaagcucaugugacugggcugacagcuauuauuauacaaauaaaagcaaacaguucuguccuuuuagccuccccaugagugcauauauccgccccccgcaauuuaaaaacaaauaaacaaacaaaaacauguacuuagacaucgaaauggcuucccuuuggcagcuugacuugaauaaucaaguaccaauuuaauaauaaaauuugcuugaagggggaaagguggaaaagugcuagaaauauaaagacaggaaaguaaacuccaugugcuguuugauaucaaguucccuugcaguuaacaagcacuucacaguaugcuauaaaacucauauuuaauuuuuuuaaauuuagaaauaaaggucagaugcuguagcuucugaaugcuaauccuugaaauuaagggaaguuuuucugguuugagcaaaaugucaauaauccauauuccauaaauuucuuaccacuaucauugaccauauauuuaugagucuuggucuugcaacacuaauuccuuaaaacauuauaguccugacucaucacagcauuuuaccuuugcuaagagauugaaaacuccauuuaaagucacaccuaacaccugcaauaaacucgccagguaauucuuuaugaagaaucaucuguugagaauuaacuggcaacuuauauucccaggucagcccugacacaaaaguguacuuaauuaacccaacagugcugaaacccuguucagcuacaauggccaacaguuaaaaaucaggacaucugggauaaacaggauuucauguaugaacccaagcacacugccaccacuuauaacaauguuucuauggagauaacgugauauagcaaagaaacccugagggaccuggaccuuuuccaacugaacaauuaccaaaggagggagauaaagaucagaguaagugguuuuuucugguaaagacaaacaggucugcggacuuacgagggaagaaaaagaucugcaaauuugucaagcuuguaaaguguguacuucuuuuaguaggauagcauaaggaauaguaaaaauaaggguaucugccauuuaacuccccgacuaggucaucaguggcagucacugaggacuggauaacugacuucagaguaugauacacagccucuagcuaucaguuaagaggcucuucauucauauuuucaacaccaaaaacucggugugccauucaagcacugugcuugaaaagaaugugcaagguuuaaccaucacaccugagaaaugcaugcguuagaagcuguagcaaagucugcucauuccucaaaaaacaacuuuuaguuaaagacuagccaguuccccuuuaacccaaaauaagaauaaaaaccaaaagucauggucugucagagugaauguguggcaacacugauaaggauuucaaccacaaaagcaaaauuaggcuccuaaaccccucaagggcaccuaauucuacacauacaaggcuggacccagcgcacuugccuggaucccaaaaagagccaaagcuccgaaguaaaggggagacagcagggagcuccugauaaggaaauguauuuguucauuuaacaagcauuuauugaguaacuaccacagaacccugacugaugaauuacuaaccuaccauucucuuaacucccaauaauaaccucuaauuuacacaaucacuuuauuucuaaaaaucauuuucuuaaaggucaagaucacugaaaauguauuaguucuuaagaaaagugaaauaaaaaugaggaaaauaaacccaugugggguuuuuuuucuuuuuuuuuuuuuugagacagagucucgcucugucgcccaggcuggagugcgguggcgugaucucagcucacugcaaccuccgccucccagguucaagcaauucuccugccucaacuucccaaguagcugggacuacaggugcgcaccaccacgcccggcuaauuuuuguaauuuuagcagagaugagguuucgccauguuggccagguuggucucgaacuccugaccucaggugauccaccagccucggccucccaaagugcugggauuacagauacgagccacugugccuggccuuuuacuuucugacucugaccucuagaaagaggcaggguugcucugcucugugauauuccuuuucuauacuucccauuuaaucccaugaugccauagcaacaugcgaaucacauagcugucaccguguggccacauuucugccacuguggcucuccuucccucugccaccuuccuggucagugcucuuucucccuuuccucagaggugcuguggacaucaaaguucuaaauuacaaaagccauaaaggcacauaaacagguuuggaaggcuauacaucaaauuaugaacagugauuaccucaaagcuggaaagcuggaaaggaaaaugagaaugggagaagacagguaaaggugacuuugauuuuuauucuaacuauuaaaucugucaaucauuugaguuuuuucaucauaaacacaaaaucauguacugcugguauaguaguuaaauagaacauguuaacagaaauaaguauuuuuuaaaaacauguuuauuucaagauucuaaacagcaaaaguagaaaaguucuccaccuaaauacacuucucaagagcaaccagcuaugacuaaacuguccuucauaaagacugaauuuucacuccuauagggaaggcgaaugccuguuuucuuacauuugcaacucuagauauuuucacuuauuaaucuuucccaaucugagaggcauuaaacaaaaagauuuaucauuuuuuuugcaucuuugauuacuuaugaaguugaucacauuuuuagaugcuuauuaacuauuuuacuaaacugacuguuccucacauucugauuagaucauuccuuucauauuuguuuuaaaagagcuuuuuuucauauuaggaauaucagcccuuuguauugcaaauauuuugccuugaguuuuuuuuuuuuuuuuaaauggcaugaagguguccaccugccauaaauugaacuuugauguaucaaauguaaaacaccuuuccuuauggcucugguuaugucuugcuucaaaggaucuucacuacugcacaauuauaaaaauauucacccacguuuucuuguugagguuucuucuguuguugaacaggcaguuuucccaacacgacuuacauaauaaucuguccuuuccguaugguuuuaaaugcaucuguacucucuucguaugcuaaauucccaccuauacauaggucugcuucuacaguccauucuguucacagugguggaaaccaguuugagauccaauagauuuagaaccaguuaaugauuucacuagaaguuggaaaacuuacuucagaaaguuacucuagagaaauuguuuaaaguauuuccccccaaauaucaggauauuaauuuuaauaacucaauacucuugcuucguaaggauaugcaauaaaaaagguggcauuuuaacccagugcugagauguuaccauuuccacuucuguuccucuucuuucuucggcuucuuuuucuuguuaucuggcucaggaacuuuuuuaucuuuaucuuuauucuuggguuuuuucaauuuaccauccuacaaagaaacauggugagaaagcacuuaaauaaagacugaucacacuucuggaggcaguuuuugggagccaugaggaagaaaaauuguaaucauagaguauuagaacuaaagaagaucuuaguacuccucucauuugacagaugaauaacaauguacuggugcucuguucuacagcaguauuuccuaaaauuuccugacaaacaacuacuugagaaaguaguuaaaaaacacucugcaggggaagagacugggaaacuuuuuuuuuuuuaaccucaaaggaguuuggaaaaguacugcucuagagaguaauccgaguguauuuuccucacuuauguuuaauccuacucaucuuuaaaccucuuccaguacaaucaaauaacggcuagacggggcuuugcauuagauauuuaguauucaggaugaaagaaaauucccaguugauuuaguggaguauaguacuaucgcugcugcuuguauacacaaagucaugaugcaguaagcaaguauuugauagguucuaaaaugacaccaauuccuauggugguauuucuuuauggcucuucuuugaacucugaauguaaaugagcugaucacagugacacaauaaacgggcaucaaaccuaaacaggcacaauucaccaauacaggagaugaaucucaaaacauacacacaaaacccaaacaaaaauguaauauucaacaagugaagaucccacucagaaucugaacucuuuugaagaauauuuuccuuuguccugccuauucaacauaauuuaacuacuuauucagucuuuauucaacaaguuuuauauagcaaugaaaggugguuuugaaccaucuuaaaaucaauuaaagaguggcacagcuggaaaguguauggauggguucauuuaaccacuuccaguuacaaucaaggacuuugaaacauauuuugucacuugaucaaggucauauagcuguuauuaacuaugauaagagccuaacuuuaugagaaaaauaacagaaugugacuuaugggaauaacuggaauaaacauuuuagauccucauaauaggauggcaaucaagauaggaauagaaaaaagaggaaagcuuacaguaccauccauauuuuaaaacaggcacggagaauauaaauauguggguauguuugggagaagguacuacaggaucacauuaauucagauaauguuuacuauuuagggugaaacacaccacaggaaagggaaauguuuuucagugaagauacucuaaacagcuucugagcaggcauccagcuggucccaucaggaaacuacuggcuacauuguauguuuucaagccucaaauuggggugucagucacuaagagaccucagaacaauucucaaaaacaagagaaaaaaacaaaaaacaaaaaaacuauaguuggcgagugagguuuaaugacagauucugccaucuggggucccugccacaguaagauuguauuaauucagucuuucagccagcauuuuucccccuaugugguagggcugcuaaauagaauaauaacaaaugaagucaacuguucuuuuuucccaaugguuuaacaaacucagaguauuauuuuugcauaaaugcaauauaaacauaaaaaaaaaacacuuggagaacucaaguuuuauauuccuuuacugacuagucuguacugauuugguauaugcaaguggagugauuggcuaccauaaucacuacuuaacauuucacucucaauuccuugaauuagugcuuauuaauuugaacuucggccaagaauagacuaguugucaaaaaaacggcaaccuucuaaauucaggaccugaucaucucucuauggcucaacucacucacuaauggucuucauaugauuucauuaaagaccuuucuucucccuccuugcagaauuagagcaucagcaaagucccaggggagguaggauaauauaguagcuggugugcuggcacugaagucagacugcaugggaucaaaugcuggcuuuuccaccuuaguagcuaugugaccucaggcaaaugauuaaauauuucuauacucuauuucugcaucugcaaaauggagaugauaauagggauguaacaaccuauucagguuguaaggauuaaaugaaaugauacauauauagaagagugccuggcacaugguaagcaccuauuacauuuaauugugauuauuaacaucauucuauuaugauagauuauccucuuaagacucccugccccuucacuaucauucucuuuacugcugguacuucaaacuguccacuuuacauuugugaucccauuuugcccaugacaguggcuaaccucaaauguagcauaagagcuaagaacucacccaaccccuucuugucuuaggggagggcaucauuaagaccccugugaauuucugacaucuuuucuugaauuaccugcuaacaauuuuuugguacaagaacucaaaagugucaaaaggaggaagcauaugauucuauuuucaaucuaccacaagcaucaacaagaacauuuaggaaagcauuuaaacggaacugaguuuuuugaggaagguuauaggccaaaaggauaaagaagggagcauguguguuccagauagaggaacagcaggugcuacguaaagcucggaaguuugaaagaaucugguguggaaaagaaacaaaggaggcuagugugacugguacaaguaagcuagagaagaggcacaagaugaagagagacacaagaugcaggggccagauugggaggagcugcaguaaagaguuugggugucaauuauaugucaaagggguacccauuaaagaacuuuagauaggaaugguuaccuaaagugaaugaucagcaaaaaauucuuagggaaauuucuucaggguuauaagccaaaaugugguuucuuguuaacacugccucuguauauaugaagaugacauaguuuuuggaagaacaucuguuggcagccuagcuguggguagacagacacccaggaaggcugagagcagaaucacugcugguugugguuaacuuaagacacuguggggauucacagagaucuuaaaacuaccagugccacagccaccacuuauuaaauuuguuuucccuaauguuauaacaagccaauaaauaucuaaaacucauuugucuuaagaaguugcuuacuggaaaacucccacuuccaaacucaagccccaaaggaccuaagucucuuuacuaaccucuucuucuucuaguuuucuuuucuucuccuucuugguaucuucuguuuuaauuuucuuagguuuauaaucagcacuagaaaggggaacaugaauacacaguuaacauaauuaugauucaggaguucucacucauaggagaccuacaaacucuuggaugccuccauggcaagaguaaucacuguuauucuuggcugggcauucuacggucaagacuaacagaaauagagaaaauaaugaaggucagaccaaagaguaauaguuauagcccuauauagaacaaaacaaaccacuuacaccggccuggaagcaaaauaggguggggggauauaugcagaaauaaauaucauuaucagaugaaagucugggaaaaaaaauaaaauaaaauaaauaaaaauaaaagaugaaaguuugggaaccaaacacacagcacacuagcuaccacauagcaguaacucacuggaauguggaggaaagaaauucuauauugaaugaauacaaaugaguucacuaaguauuucccuucucccuuuccauccaauuucuacuauaacaauagcauaguaagcuauauaagagugaaaauaaugaauauaauuuaaucucauugaaucuggggaaagagauacauguaagccucgaccguuuuaugagcaguuuuauuauuuuuacacacugaaacuucacuuagaaugucugacaggaauaggucuaagagaaacugcuuuaaguuaucugugguaggcaauaagaaauuuuaaguaacuuaaauaauuuauucuucaugaauucuguauuauuugaaauuucuacaauaaauaucuauugccuuuucaguaauaaaaauuuauauaaucuucauguaagccuuggguauacuacuuguuuagcaaacucuacuucucauaguucagagaaaucaguccauuaaucacaaauuccaaaugaguaaaagccaauuaaugcaguuucuauauguauuauaaagaaacacaucacauuuauucuuuaaacuccuccuuuuuguuuucaaaagucaaaguuuuaagaaaauacucacucauccucaucucgaggucucuuuaauggcuuuauauccucuuuaggaggaacaaaauagccaucaucuucagguucaucuuuaauuugugguggacuaaagagaaaaaaaauugcuggucagagugcuagaacaucuguauucuauuaauacaaagaaggaauaugucauuucguugaaaagaagcuaacagaaauaaggauaaccacguacauaucaugaagauguucugugagcacuuuuucucacuucaauccugugaaguagauaguauuuguccucauuguacaggugaaugggcaauaucaggauuugggaucaagacucuuuauucuaagucagaauucuuucucacuauuucuuagcuaucuuugccagcauggcacgaaccacuccagaaauaaaccuaagguguuuucuugccuuacauggaaaccuaccauauauuugaccccacaaucugaacugauuguuccaguacucuaaaagcuaaaguacagcuuuuacaaggaaaggaauaaacauugauuuccccaacuuaguaccuuaaaguucuaaaaauguggcaauaacguacauguauaucuagcuacauggaaaaauaaccaagcugacaacauuacaacaaaaguagggcacguguuaaaccagaauaaacagaagguauccuaugccaaaucuauucauuguucaacguccuaacuuagguuuacuuuauauacagaagagugucucacuacuauuuguuaagaucuuaccuucaaaauauaaauauaaaaagacaauccuuugagacaaacaucuugaaccaaaacagagaaggaacaaguaaaaaacaccauagagcccagcaaucacugcagccaugggaugcucccuggccuggcacaucucuucagaaccucacugccuuaacuuaguacaagaaauggccuccuuacaugcagcugcccccuguggagggauccaaggauuaagaaucccgaccccacugcaaaguauauucacaggguuucaagaguaccuccgaccaaaaaaagcauacuggguccccuugcuugugauagaauuugaauguuuaaagaacuuauuuuagcacccuaaccaaaugccagcuucuacagcuguucccccuccugccugaauacugacacagacccuaggguccagaaggaaagaaagccuaucauuuacccaacuaguuaaguaaaugcuagauccuaaguuugucacacugaagacaaaaacugugggaaggguuacuuaggucugaaggaagaaguccuaaaacaauuuaccugaaaacuguauuccagugaagcaucuggauucucuacaaagacauauacacaagccagcaaggaguccagcaaagugaacauagagaccacugccucaaagaaggcuguguuccuaaucuucuaacccaaaaagucugaaaaugaauucaugacuaugcaccaaguccaaaaaauuuauucauaucaguuuaauaaaaauccaaggcagucucuuggcagagauuagcccagcagugccuccucagucacuuuaucucagaaaucaaaauuccuagggcagcuugcagcucuaaugcuuccugaauuguauuauucugcauuccuagaacaauuaugaaacaugccugaagagggcaccugcuuuucuccuugucuaaaggaccccagaguaccaggcacaauugucaaaaauuuuaacaaaugaaacugaaaguucaaagauucaaggaagcaaaacucucaaaguguuuugucccagucaauaaugcaaacacuuacaaccauuucuaauaaauccuuucugucauucagugaagugagaauauguaacaauaaacaucuaguuguuucgaaacuagaggggaccucugggcuuauuuuaggaaauugaggcugaggaaaacaaaauuauaaagguaaaaacaguauaggaaguaaccucuagauuuugcgcauuuuccucuccuucuagaaaagagauaacauaauucuacccaaaucuacacucaucccuaacauguaggucaaaugaucuuuuauauauaagccucccaauauuacuaaugaugaaaucagacuaagugauuuuucagaaaacuccauaaucgcuacugaauaugaaguuucuuuuuagagaaaugaaaauguucuggaauuagugaagaggcugcaauaccuugugaauauacuaaaaaaaaaaaaaaaaaaaaaaugguacacuguauaccauuaaaauacaaauuuugugauaugcaagucaaaucucaauuuuuaaaaaucucuccugucaaccuucucuauucgaaauaaccuucuggaaaaugugcuggucagucucacuauauggcacuguagaaaggcucagguuggcuuagaccgagucuucucacugcugagcuucugggaaccaucaagauggccaggucaguggguuuuggguuaacucagacaacacuacaacacaggcagcuggccugcuguccacccagagaaagggaagcccacgcagcagcaaagucuuaccuagagaagccauuuuccuucuccuucuuuauuuuugcauccccagaggcucgaaccugaaaaguaaaacaacaguaacuaguaccuugaaaggacuaaauuugaagaaaccucuuuuugagaauauguagcaucaguuccugggacaucaugaucacaagcuggcucuuauguuaccaaaacugaacagaugaacuaaagguccugaaauguguccaaaacucguuuuuaacaauucuucugggugaaacuguccaacucacugagaaagguuucccuuaaaaauggcagcuuuuuacuuuuaagugguggcaggucucuuuuccccaauaaauacauuccacuacucaagaauuugccauuggcagugcagagaggaaacaaaagcaaaaaccaaacaaacaaaacauauaaacugggccagaugugauggcucaugccuguaaucccaacacuuugggaagaugagguuggaggacugcuugaggccaggaguucgagacuagccccgccaacacagugagacccccaucuuuauuuaaaaaacaaacaaacaaaaaaguagucuaugcccugucuucuauuacuuaggcaaaguauacucaugacccccuccccuuugacuuccugcuuucuagauucgucagaaaauuuaucuuucaaaaaaaucuucauauauacacacaaagggauacacacacacauacagauauacagaguaucuauggaagaauacaaaacauaaucaguauagcgguugccucugagaaggaugggagacagugagucaggggugaagagaugucuucuucaccauauuccuuauuucauaguaucugaauuuaccaaguacaaaaauuacuuuuucaaagcuaaaauaaaaacaaucucuuuuuaaaacuauacagaguacuauucauucucagcugggugagccuagucauuuuuagaaggcuugcacugguuaugcuggaaccaaaugccacaaaagacaccagcaucacuaaauuuucacucgggaagaaccuuuaaugaacagaagaccaucaaggcauuaggccuucucccaaaaacaauuaauuuucccuaaugcauucucaauguauucauuggcaauauaaaguaaaaaagguaaugauauggacagaucugccacugugaaacauauggugguaaaaggcuuaguuuuuauaguuuaagacuacaguuugcucuaaauucuccugacaagaaaccuuucacuucaagaccaagggaucuuacuaugcaauuaagauaucugcuuucaaagguaaacaaaagugcauccacguuccuuccuccccuacuagaaaacucuguaccuuuuccucuuuucguuuuuccuugucucugucuuuauguuugucuuuaugcuuuucugagcuuccaucuuuguguuuggucuucuccuucucuuuguguuucuuuucagaaucuuuauguucacuguaaaaaguuaagucacaaagcguuagcccagaguagggaccacaaggauucguuucacaagauauccuaagauaacaugaaccguggaaacuuacaguacuuaaacaaacaguaccgacagaagguucaaguagagggucuuggcuacaucggacuuuaucuuguuugauguuuuuauuuuugcaaagaacagaaaccaucauucuagacacaccaggacauuuuuuuuaaagugacuaagaauacacagccagcccuguguauuucugcaacauucuaccagcacaaaaacaauaaugaaagcuccaacuucagcauucauaucugaugugagcagguuaaaaccaacucaccaaaaauguguuugguggcuuugugccagacuugaaacauaccacacauguagccaagccaggguuuauggaguaaacagcccaauacaguggauauuuccuucuaguuuuaacuaggcaaguuagucacuucuagaugggacuuacguuagcccuuuccucacaauaagaaaagacccaucugaaagcaagggcauaggaauguucuuuguuaaagguuaaaaagcaaaauaugacauuauaaggcaagagccaugaaaauguucauagcuucuuacccugggaucaagcuccuggaaauuuaucuuagggaaauaacauuacauauaaagauguuuauuuugggcugggcgcgguggcucacgccuguaaucccagcacuuuggaaggccgaggcaggcggaucacgaggucaggagacugagaccaucccggcuaacacagugaaaccccguuucuacuaaaaauacaaaaaauuagccgggcgugguggcaggcgccuguagucccagcuacucgggaggcugaggcaggagaauggcaugaacccaggaggcggagcuugcagugagccgagauagugccacugcacuccagccugggcgaaagagcgagacucugccucaaaaaaauuaauuaauuaauuuuaaaaagagguuuauuuuggugcuucccuuaaacaacaacaacaacaacagaaaaaaacaaaaacgaacaaacaaaccccaaaauuggauacaccuaacaagaggggaaacuguaauauaucaaauuauuuaacugcuaagcuauaauuugaguaccacaaacacauuuggaaaguguuuaugacagaaaaaggaauauaauaaaauaacugcaacuauguaaaaacaugcauguggucaaagacuaaagaagcaauaagcaaaaaccacaaguuguaguuuaaggugagagaacacuauuauuuuucaguacacugggacaggcaguuaaggagccuugcuuacugcacuaaccaaugcacaggaaaaaaagacuucaucagcaaugagcucauuaggcuauguccaucccaugaaguuuguucuaaagggacacuugacuacaguagaagaucacaaagggagaaacaaaugauggcaugcaguuaggcagagcaacaaaaucuagaucaggagaacaucugcuauuacacccugcacacaaaaguagcuacaacuugagauagguacuugagugaugaauaggcagaaacuuuaagaaaucuagccagggagaaacaggacacacuauagguuaggaaagacccaaguauugaaauagauggagaaaaaaaaaaacaaaacaaugcccacuuucccuugcuuacauauuucucccucuauauugcucucauuagacuguuauuuacaugugacacacauuuaaauaacaaguuucuauaggaggaaaauucuuuuuaacucaugagaacagagcacacuggauuugcaugguuacaaaauuucuccaccaugcuuuuuguucuuggaaucaauaugauguuccucuaacucaauguguucucauaaucuguguuuuuuaccaaaaugcaauguuuuauuuaaaaauguaucccuuccuuacuuuguuuaaaaaaaaaaaagucuuccaauugcauuagcacuccuauuaucuguucucauuaacuucgccaagcuuuagaaugaauggucaaagagcaagguugcugagauuauaauugauucuucaggaguuaauguauagguaaucacaggcacuugguuuuuauacuaccagcaaaauguuugagcuuaccauuccauuauaaaaccaugguaguuuuguuuuauuaagcaucaacuguaagaggguauacagucaucuauacaagguuuugccuaaaagcaaaacaucugggaacaauugcaucuauaauauugauggaugaauauacugccucccccugcccugccaacuauagugggggaggggauggcaaaacaaaauucuacuuucuaagcaagcauuguacuugguauuuucacauacauuauuucacucaauucucacaacacuccugugaggcagguuuuauuaucuauccccucaugcugauacaaacaggagacaaugguuaaaagacuucucaaaguugcaauguuaaaagaaaagcugggauuuaaacuuaguauuuccaccuccaaguucagagcagccuccacuacauaucaauacccuuauauuuccacuaaauugauaccuacugcuuaagguauacugguguuaagaaacagccauggugagucugagacuugcuauaagguccuagcuuuauuuuaccaucgaggagaaacuuucuagaauaaagauguuuggauaccugaaaggauaaaaaccuuugggguugcuuguuucuuuucuuuucuuuucuuucuuucuuuuuuuuuuuuuucauugucuucccaugaaacuauaaauggcuaauucaggaaucugaauucaggaacacuccaucuuccuuuaaguuccaccuuccccugacccguucucuuucucagugaaagcauuucuuagaauguuagccauuuucacuagaaaacuggcuuucugagccuuuuggcaaucacaacauagguaccuacaaguguacauguagcccugcgguuuucagcuuugcuguacauuaucacaccaaacagagaucagggaaaaggaaucaacaaaugacaaggcaaaugagacauuugccaggaagccaaaagucaacgauauuuccucugccugcuaaccagaaagagauguauauaggaaauucaaaguuccugcuagaguaguaaaccccuuuguaggucacaauuaaucacaaaaaccagaaugggaugaagcuaucauccugacuuuccaaaggaagccaagucuccucuacuccuaacuguuuaggcauaagagcagauuugcauuuuuauacuagcugaauacagaugauugaggguuaaggacagcuucuauuacagggcauuacauuggagacuguuagaaauuuggguuuauagagcuccaccaggcuucugaauacaaugugaucaucccuacuugucaggugcuguuaccgucccugccuccacaaauggagagcagagugccuggagcccaaccuggcauccauaacccccaaaccggcaggagugcuggcaaagagcaaaccccacugccaaucuuuccuaggaaugugccugaaggaaguagcaaaggcgcuggggaacaaguccuaugauacagaagcauguccagggcugugccaggaaagucagaaacaggauuuggccagcauauaaaauggagucaauguggggucagucaggcugacucauccauuugagauuuucuaacauguaugucuuuuuccaaaaggcuuaggauauguuugacuuucaugguagcuaaagaacuguacuuuccucauuaacagugaaaugauggaaauucugaccaaugcagaaaguucauuugcuggcugccuguuuuaagagauacuguauuaucuucauacugauccugcuacuuuuccauacacaauagacacaauaugucaaagucacaaaagggcuuuaaaaguacaauuguaggcuauaauauuagccagguuagaggcugaaaaacagaugauuaauuacugaagaaacuucaguagggcuaaauuagaaaaaugcuagauacccugaaaggauaaaaaccuucaggguugccuuuuuugucuccccauuuugucuucuaagaguagaagaaaggcuuaauaucaaccauaggaaggaaaccaaagguuggacaaacauauuuuaagaguaaguuuagucugggauaugcugaaggacaaaaauacagacaguagcaguccuagaacuucugcaauggucacacuuauggaugaaauaugaauuuaccccaugggcaugaggaacucugaacgagaaaacaaccaauuauuggcuaggcauagaugcugacuucuugguucauaguuugcaucuguaugggguaagauuccaacacacuagcagggacuagaaagcaaaagucagcgcuaaagagaacaaauggaaagauccaaagccaccuuuccagaguguucaugccauguguuaugcuucaauuggcugaauuccacuaaagaaaaaauaaucuggcugggcgugguggcucaugccuguaauccuagcacuucaggaggccgaggcgggcagaucaccugaggucaggaguucgagaccagccugggcaacacagugaaaccccauuucuacuaaaaauacaaaaauuagcugggcgugguggcacaugccuguaaucccagcuacuggggaggcugaggcaggagaaucacuugaaccagggagacagaggcugcagugagccgagaucacgccacugcacuccagccuggcgauagacugaggcuccaucucaaaaaaaaaaaaauuuaaaaaaaggaaagaaaaaaauaacuuacacuauuuuuaaagugaugacagcaaaaccuuuggucuaugauucuuguuggagcuaagcagaccacagaaaagggugaccagaguuucucuaaggcacuuauauagaagagugggagaaacgguggaaguagggagccaguagggaacaaugucucccuucuggcgaagcacuguuucuuuaggaaaaaagaccaccgcuaccacaacaaaauacugauauucuggaaagcuagaauguuggcuaugggaaaccauuuaaaucuguccucuaucccccauaaaaguauuuaacagauacuugaguagcacccagugccaagcacucaucuaagcacauuugauaucgguaacaaaacucagguaacuacugguaucuucauuucacagauguggaaacugaagcacagacaaguuaaguaacucacccaaggaacuaccucuaaagagagaaacaggauuuaaacucaggcagucuggcuccagggucaugcacuugacuacucuguuacuucccaaacaaagcaaaaaagcacuguuaaagguagaaggagccuccacauauucugagaaaaggacuuagccacuaacagcccagcuaccugucuacuccucaaggcagcagaccucugcaggucacaugaaguuggaucauggggauuccugugagacagcacagagagcuucaaagucuugguuuaggagggaaacucaugacccuuucaaggauaguagacaguuaaaucuuaaaugauauuuguuaaauuaaauauuuaaguaacuucaaaaguugccucugggaaaagagcgcagcuucugaaaugagccaguuuccaaaaggcacuaagaaacaaggguuccuuaauguccaucaucauuacacacuacaaugccgauuauauaucucuaaacaaaaucacaaggacuccggcguuuuauauuauagaaguaucaaaacuucaagguaaauguaauuuccuagaaauuauuuaauccuuuguuuucaggccagagaggauaaaaggaugugcccaaagauggcaaaaccgauacccauucuaacucccauuccucccuuaaguucuuugucucuauuaauagcgugaacagccacccaguuauccaagacaggaacccuuuuucuuagacccuucaugucauuuguagcuaagucuuauauccacuuugcucaaguauuuccaguggcuucuugcucagcucagaaucgagucccaacauuuccccccgauuuuuaguuaguguaaguaacaaguuccaacuuuuugaaauggcauuuaauaguuuugccucaagccacuuuuuugggucucauuuucuacuauuccacccuguguaacccaccuaacuagauuccucccagaacaaagcauauacuacaaugccucuauauuuugcuuauguuuuucuuucuaaccauuacuuuccguuagcaaaauuuuaaccaucuuugaauggcuagcucaaaugcugucuccaccaugaaaucuuaaaaacaaugauuauggcguacuaugauagggauaaauauaauauugaaaauaucagggcuccaaauugaaugcuaucaauaacuacugaauuagauucaacuaccaaacucaagagcuccaauuuaucugcaugauauuauacuaggcuuugcgguaauuaucaucaucaccaucauuaucucaauuauuuaguauguuacaguucccaaagagcugucaugugcauaaacaaacuugaaagauugauaaagcagguacuguuaucaacccuugaccaaaacagaaaaugagacccagagaaguuaagcaccuuggaucacgacacguagcuuauaaaugacagaacccagccucuuaacuuuuaucuuagugugcuauucaauauaucauacugacucccaugugaaugguggugguacugaguuuccucauuuccaaacuguucaaucuucucugccuacccauguuaguuguccauuucccacagacaggaugauauagugauguguagacaaagggagggcuuuggcaaaccacucacaaggaaagcagcaaacauaucuuuuaaauuuuauuaauuucagaaaaaucuccccuaaucugagaacuagaugcguaauucaagugcauauuccuaaaauccuacauucucucaauuacaauucagguaggauuuggaacuaaaaggaaagcagaagccaaaagcauccuuauucucagauguuucucacacugacaguacagaauagcacugccaauauggcuggaaaaguacuucccuugcuauuuuacagcaguuuucugucuucccuugcuuuccacaaauuugucacuccagugugaaugccagguuuaaaauuggcaagagaugcacagagucgaaaacuaggaggaauuucauuucacacgauucucuuauuuucuaaaaucaagccccccucccaaauugcuuuuaauaauauucuguuuauacaagagaucuacuauuaaagauaaacaauggauaagaauguaacccuuuaagaaagguagcucgugagauccuacaagcuacguaauuccuuggcaucuagaagaguauuccuuuugagauuauuuauguauuuuuuaaaagagggccggccaugguggcucaugccuguaaccccaacacuaugggaugccaaugugggagcccagaaguuccagaccacccugggcaacauagcaagaccgccaucucuauuaaaaacaaaaaaguuaauuaaccaagcaugguggugcaugccuauugucccagcuauucaagaggcugaggugggaggaccccuugggcccagggaggcugcagugagcuauaaucacaccaccgcgcccaagcuuagcagucaaugagacccugacuccaaaaaaaaagaaaaaggaucugaggagcaaaauauuaacgcuaacagaaagaagcagugucaagagauaagugaugacugaugaaauuaucuucuaacuuuggugugagcuguucuugucauguuacaggccagacaagagaaagacagagaugaaguuuucauagguucagaauuugaugacauuaauacuuucagugccaaagauuucagggauuuggggacaaagagagauaaaggcagugccugaggugaucugacauuuuuaaaccugagcugccuaccauaugcauacaaguaaggggugcuuguauuuaaacagacaguuuagcuacaaaacuaacucuuuuuacacagggagguauuuuucacuggaaggaauaauguaguggggacucaggauccuuggucucacauccucuucuuucugcuaccacaucacugugggacuuagagcaugugaccucagacuccuguccacacaaagagaagacaagaugaaaugauucuuaauaccuacucccuuguuuugcaccuugcaugaggacaauaaagaggaaaccaaauggcaucuucugggauguggauccauagccccauuuuguuucugcacauaauggcuacucucccacuccaagucugcaguauugcuacugcacaggacaguaaaugccuccugggcuuggguccuaaguauagccugaugacaaaugauuggugcuaauaucuagcagagaaggaagggacacagaaacacaucugaaacacuuguuuucuccuaacaaauggccacaaaauuagcuacaauugauuagcaaggauuggaauaaaugaaagcauuuuggaacagaacaugcuaaauacuaauuauucugggguucagaugugauuaaauaaucccccagauuucuuuaaucugcuacagaagaaaucgaagaaacccuaaacuauuuaaaaagaucagagguacuuuaaaaggaucacaguguauauaaaauuuuacuggaggccgggugugguggcucaagccuguaaucccagcaccuugggaggcugaggcaggaggaucacaaggccaggaguucgagaccagccuggccaauauggugaaaccucgucucuaccaaaaauacaaaaauuagcucggcgugguggcaggcgccuguaagucccagcuacucgggaggcugaggcaggagaaucgcuugaacccaggaggcagagguugcagugagccgagaucacaccacugcacuccagccugggugacaaagugagacuccaucucaaaaaaaauaauaaaauaauuuuacuggaauauaaccaauauccuugcuuuguugcaaagagguacugugucaguagacaucaaaacaagaaguacuuaaaaguuugcuuacaacagaucaucugauuaaacuguuaaaauuuacucaugugaauaagaaaccaagggcuagauuuagucaugucauauguaaacagaaacucgggccagguuuuuccaauagcucuuggcaaaaaggcuucuauuuuuauaggaaugaagaaaauauuaaaaggcacagaaguggccaggcgcgguggcucacgccuguaaucccaagacuuugggaggccgaggcagguggaucacgaggucaggagauugagaccauccugguuaacacaguaaaaccccgucucuacuaaaaauauaaaaaauuagcggggcaugguggcgggcaccuguagucccagcuacucgggaggcugaggcaggagaauggcaugaacccgggaggcggaggaugcagugagccgagauugugucacugcacuccagccugggcgacagagcaagacugucucaaaaaaaaaaaaaaaaagaaaagaaaagaggcacaaaaguacauacaacaaauuauugaauuuaccuacaauaugaucuuggaaaaguaugcuuuuaaauagauguaaaagugucaucucugcacaucuguagagcaguucacaacugaagagcuucuauauuuauugacucccaugguuccccugugaagcauguaucaagaugaagaugaagaaacugaguugaagaagguuaaguaaccuagccaagaucacgagacuuaaauggauguacaaggaugaggauuucuucuaaaaaaaucacaucccuuuuuuuuuuuuaagagaagauuuuuguaaaacaggacagggccaaacuuauaugucucaaagcccuuuaugucacuuuuacuguaucuuuccucccaaaacaaaguagaauguguuagagaagauaaguuuucaaaagcuuauguuuuaaauauuaaccucuuucuucuuaaagucuuuuggaauuucuucuuacagccuaguaauauaaaaaucaacauucuucaucugaucuguaagcaggucucucaccuccucagaugauacuguucacggucaaagguuaucuaauuuuuuuuuucacaccacaucaauuagcacaguaaaaacauagcaggcagccacccauuguuggacaugaucuagcaauucuacuccuagguauacaccccggagaaugaaaguggaacucaaacauguauuuguagccaaaggguggaaacaacccaaguguccaucaacagauggauuuuuuuaaaugugauuacaggcauacaauggaauauaauucagucauaaaaaagaaugaauuucugauacgcuacaauacggauaaaccuugaaaacauauuaagggaauauagaacagauuuaaaaaagauaaauauuguauuauuccacuuauaugaaguacuuagaauaggcaaauucauaaagauaaaagguagaagggaaagagaaaaaaagacaaaguagaaagauauugggacaggggaacagaaugaaaaguuauuauuuagugaauucaaagacugggaugaugaaaaguucuggagauaguggugacaguugcauacuauugucaauguacuaaaugcuacuuuaaaacaguaaauuuuguuauguuuauuuuaccacacacaauugugugaaaaaugagauaagccaaagugacuuaauaacuauccuauagaagauuaagaguacgugagaagaaagagagaugggaauuaauguacccauagaucauccacucauuaauucaauaaauauagacuaguaagugccagcuaucugccagguaccauacuaagccugaaggaugcaaaaugaauacaaaaggcugggcgugguggcucacaccuguaauccuagcacuuugggaggccaaggugggcagaucacuugaggucaggaguuugagaccagccuagucaacauggugaaacccugucucuacuaaaaauacaaaaaauuagcugggugucggggcacgcaccuuaaucccagcuacuugggaggcagaggcaggagaaucacuugaaccugggagguggagauagcagugagcugagauggcaccacugcacuccagccugggcaacagaguaagacuccgucucaaaaaacaaacaaacaaacaaacaaaaaaccagccccccgccccaccccagaaaaaacaaaaaagaucccaauucugcuuucagggacuuuagaguccaggaggccauagggaaaaguaaagacacaauuaaauauaauaauuauuacacuaggaauauauucaaggcaccagagagcacacaaaaguggcauuuaauaugagaaggaggguagaaaggauaccuggaacaagucaagucugagcugcaacuaaaagaaugacagcaaaggggcaagagaguauuacagaaccaacagcauguuuaaaggcuuagcggcaucagaaaacaugcuauguuuaaggaacugaaaagaaguucacaagaccaaauauggaaugugaaauaaggauaaacagcaaaacagguagcagagaaaagacagccaaaaacuguuaaggaaugacugugcauuagaaagaggugaaaaagguggccagaaagauggagaggcauggaagcauuaaagccaaagaagaugguuuaaggagagugggguccaaaguaugagcuauuuuggcacauuucgugugcacuuaaaaagaauguauucuaacaucaugguaaugguacagaaacacuaacagcaugguaaugguacaaaaacagacacauagaccaaauggaacagaacagagaacccagaaauaaaaccacacaccgacagcaaucuaaucuucaagaaagucaaccaaaauaagcaauggggaaaagacucccuauucaauaaaugaugcuaggauaacuggcuagccauacgcagaaaacugaaacuggaccccuuccuuacaccacauacaaaaaucaauucaagaugaaucaaauacuuaaauguaaaacuuaaaacuguuaaaaacccuagacgacaaccuaggcaauaccauucuggacauaggaacgagcaaagauuucauagcaaagaugccaaaagcaauugcagcaaaagcaaaaauugacaaaugggaucuaauuaaacuaucaacagaguuaacagacaacuuacagaaugggagaaaauauucacuaacuaugcgucuaacagguauaauauccagaaucuauaaggaaccuaaaugauucaacaagcaaaaaacaaguaaccccauuaaaaaacaagcaaaagacaugaacagacauuucucaaaagaugacauacaaauggccaacaaauguaugaaaaaaugcuccacgucccuaaucaucagagaaaugcaaaucaaaaccacaaugagauaucaucucacaccagccacaauggcuauuaaaaaucaaaaaccagcagauggcucacaaggcugcagaaaaaagggaacacuuauacacuguugaugagaauguaaauuaguccagccacuagggaaagcaguuuggagauuucucaaagaacuuaaaaaaacaacuaccuucugauccagcaaucccauuacuugguauguauccaaaagaaaacaaaucauuuuacuaaaaagacacauguacacacauguucacugcagcucuguucucaauagggaagacauggaaucaaccuagguacccagcaaugauggauuggauaaagaaaauguuguacauaucuaccacggaauacuauacggucauaaaaaaagaacugaaucauguccuuuguagcaacauggaugcaacuggaggcuauuauccugagcaaauuaaggcaagaacagaauaccaaauaccacauggucucauuuuuaagcaggagcuaaacaucgggugcucauggacauaaagauggcaauaauagacacuggagacuacuagagcagagagggcgguaaggguugaaaaacuaauuguuggguucuaugcucaguaccugggugacaggaucauuuguacccaaaccucagcaucacagcuauauacccagguaacaaaguugccuauauguacccacugaaucuaaaauaaaaccugaaaaaaauuaaaagcggaaaaguagacagaaagaaaagagaaaauucuaauauuguuggaugggaaaaaccuauaaaugucgauuagaucaaguugguugauacuguucaagucuuccauauccuuaauuauuuucuauuuggacuaaaaauuauugagaaagauaguaaaaucucugaccauaauuaugaauguuuauuucucuuugcagcucuaucagauuuacuucauguauuuugaggcugugacguuaguggauaaacauuuauaacugcuauguucuccuaaugggucccuuuuaucauuaugcaaugaacuucuuuauccuuggcaauauucuuugcuguacgguagauauuaacauaagcuagacaacuauaaacuagaaaagauguagaguagauucaacuacugagauuaaauuuaccagaauaaugaaaauggaaacuagaugaucaagugauaagagauaagugagggauagggaaaaaaggccacaggcaugauacaugauucccaaagaaauguccccaauagagaaaauuaaaucugguuauuuuaaugauucgcgaaaaagaacagacuuagaaagcaauucucacuuuaacuugucuacagacaaucagacaaguuaauaaagaaguucuaagaacucuacaauggagacacuuguucuaaugugugacagaucuuuacauucccuaaccuagcucaggccacuaugggaaugggaauaccauauggcuuucucaccaacaacugucuuuaaaucagaauggaaguacaaguccucauuuucaauaacuagauuuaaccacuugccuccuacaccaaaaaaaugggagcaaaaugaacaaaagaaacaucuucuugaggcuugcaucccaaaaggcagcacuauugaguuucauucauauuggugauuguaggcuuuugugggagccgaacuccucugauaacaugaugaaagcuacaaauagucucuccaggaaaucucauauacucaaccauuugcauauaauuucaggggcuaacagaccauggaagcccaaguuaagaauuuuuaauguaaacucuuuaaaauauagaaagaagaaaaaaaaucaggucuccaauccaguuaccuuuuaucaaggcaagcuugcuacagacuugauuaaaugccaucaugugucacaaugaauccuuaccuaucuuagugaacaacuguauuuuuaaugagguauauauuaaaagaaaauuaaacauacuugcuuuauacaucuugaucugaacaauggcaucccauuuaaggccuaaaucauggccauccucauagcaacucuaggaucaaauacaguuucuacuuacuuugcuaucuuuacauguagcucaaguuaagaccuauuccagguaagccaagcaauggccaacccacugcugaaugaugagggacuugcuugauuccacccuuaccuguugcuaugcuuggacuuuucccgguccuucuccuucuuguguucuuugugccgguguucucgaucuuuguguuuaucuuuguguuuaugagaaucugcaaccauaagagaugagucaguuaacaggagucaugagcuaucuucuguaugccuaccuugacaagcuggucaagaaguacaaugacaggauucaaauggcaugguaggcauaauagcacaugccacugaaaaaaaaagcuuucacaaagaagcccagacaaagcucccauuagccugcuucuacaaucaagacaaguuacuaauauggggaggauaaggaaaugagagccaauuauucuguggaaagaagccacaguuuggcguuuuucucccuagacauaauacuauuaagccugaccuauaaaugauaacaaagggauaguauugaacacugacucuaaagaucagauguuauaacuucugaaaaauccaaaccucaacagauguuuuuaaaugaauguuaauaagguguaaugucuaaacaauaaaauacaaucagcccuccauaucuacagguucagcaccauagauucaaccauuugcagacugaaaauauucaaggaaaaauaaaaauaguaauaacaauacaaccaaaaaaauacaaauccccccacaauauaacaacuauuuauauaguuacacuguauuagguaaucuaaguaaugugguggugaguuaaaguauauauaaggauuguguagguuauaugcaaauacugugccauuuuauauacaaaaaaacuugaacaucugcaaauuuugguauacuagggacaggggguggggugguccuggaaccaauccccuacaaauauuaagaaauaacuguaauaauaaacauuucaaagacacccacaggugcaauccccacuacaauaaagauuuagaacaaguccaucaucucagaaaguuucccucgugcuccuucccagucauuccccaucuuccaccccuugcccaaaggaagcacugaucugaucgugcuguauauuagauuugucuagauuucuagauuucauguaaauaacaucauauaggauuuauucuuuuugugucugaugucuuucucucagcauaacauuugugacauucauccacauuguuggauauaucaguuguugguuccauuuuauugcugagugguguuacauuguguggauauacuguaacuuacccauucaccugcuggacaauuuaguuguuuccaggcauugguuauuauuuaucugcuacaaacauucauauacaaauauuucuauagacauguuuucauuucucuuggguacauacuuaggagaaaaguuacuggguaauauaaaaaauguauguuuaacuuuacaggaaauugccaaauuguaccauuguauaucuccaucaaaaauucauuagcauuccaauugcuacaaauuuucaccaauaucugcuaucagucuuuaauuuuagccauucuagcacguguggagugguaccucacugugguuucaauucacauauuucugaugauuaaaugauguuuaaugacaagcaucuuuuggugugcuuguuggccucucauauaccuucuuuggugaaguaucugcucaaaucuuucuuggucuucuuacuaccuaguuguaagagcucuuuauacauucuggauuaccaauuuuuuguuagcuauacgaacugugaauauuuucuccccaucauuuucuuguuuuuauuucuuaauggugucuuucaaagagcaaaaguuuuaaauuuugaucaaguccacuucaucaauuuucucuuuuagggucuguauguuuugugccccaagauaucguugccuacucaagggcuacacagauuuucucucucucucuuuugcagggaaaggcagggaaagagucucauuuucuuauaucacgauguuacgcaggcuccucucgaacuccugggcucaagcaauccuccugccacagcccuuggaauggcugggauuacaagggcauaucaccaccaccaccuuauuuauuuauuuauuuauuuauuuauuuauuuauuuauuuauuuauuuucuagcaguuuugcagaguuaagggccaguguucauuuuuuucuaaucaauaaagacgucaaguuguucuaacaccauuuuuuuuuaacuuuuaaguucagggguauaugugcagguuuguuauauagguaaacucgugucauggagguuuguuguacagauuauuucaucacccaggaauuaagccuaguacccacuaauuauguuuccugauuuucucccuccucucacccuccacccuccaaaaggccccuguaucugcuguuccccuacauguguccauguguucucaucauuuagcucccacuuauaagugagaacaugcaauacuugguuuucuguuccucuguuacguuugcuaaggguaauggccucuaguuccauccauguuccugcaaaggacacaaucucguucuucuuauggcugcacaguauuccgugguguacaugcgccacauucuuuuuuuuaauccagucuaccauuaaugaaaauugagguugauuccauguuucugcuacugugaauagccuagcauuauuuuuuaaaagauggcccuuuccccauuaaauugucuuggcguuuucgagcggucauauaauuauaggucuauuuccggacccucuauucuaaccuuacacaaacacaaucuugacuauaagauuguuuguuacuccgcuuuucaagagguauagccuaauuccccuccccuugagugugggcuggacacugugacucacuccuaacaaacaagaugaaguggaauugugagggggcaacuuccgacacuaggccauaaaagguauuagaucuuccuuccugcucucuccuugcucugggggaggccagugacacacugucauguacucacucagaagcccucuggaaaggcccauguaguaagaaacuuaagcuuccugccaauuagccaugugaaugagccauccuggaaguggaccuucuagccuaaauuaaguuuucaaaugacugcagcccuggcugacauacugacugcaaucuacagaugguaagccaaagccacccagauaaacuaugucuggauuccugacucacaggaacuacaugagaaaauaagugucuguuguuuuaagcuauuauauuuugaggcaacauguuuuauagcaaucaauuaauaaugcauaggcaaugugucuucaucccaugacuggcucacagcaaaagaagccacaugugucauaaucugcugagcaucuauucugugucaggcccugggaaaauagaaaucugcaugaccguaguacuaacuguaagaaauucccauccuacagagaugggaaaaauaauaucauauggugucagaaguaggauuugaacucaaucuuccaugcagcauacagaacccuucagcuucuucuaaaaaccucgagucuauaauuuuaaaaugcuaaguugauucccacaagguuaguggccccaguuuacuugacagcaauaucccacuacuucugccucaaaccaaacacuuauggcuaaaaucauaauaaugacaauacauguaauagcaccacaaucuggaauaaagcaugugugucaauuaauuuuguuugcaggccagaugcaauaaacaagcuucagaacaucaagaucugcuaauacagcccuagaguauggaaaggacaucacauuaaaaaaaacuacucuguguauaauucaacaaacgcauaaauacauaugaagaagacuggaauacagacaucaaaauauuaaaagcaguuaucuuaggguagucaauuuaugaguaacuugaguuuuugugcauauacuucaucuuguuuucuaguuuuccccacaauuacuuuuauaguaaaaaauggaccaagcuuuaaaaauuuaucuugacaaauacuaguguacauaggaaaauuugcuuaaaucacuaaaaagcucuaaacuuaaaaaggaaauuaaguaaaggauaaauugaaaguaauuccaggcagguuucagauaacagucugccaauaacuuuuuuuuuuuuauuuuuuuuggagacagagucucacucugucacccaggcuggagugcaguggugugaucucggcucacugcaaccucagccucccggguucaagcaauucuccugccucagccuccugaguagcugagacuacaggugcacucugucacccaggcuggagugcaguggugugaucucggcucacugcaaccucagccucccggguucaagcaauucuccugccucagccucccgaguagcugagacuacaggugcaugccgccaugcccggcuaauuuuuuguauuuuaguagagaugggguuucaccguguugccgaggcuggucucgaacuccugagcucaggcaauccaucugccucagccucccaaagucuggugcugggaucacaggcgugagccacugcgcccggccacauuuuuuuuuuaaugcacaaaauuucaaaauugauuuuaagccagguccccaaguuuuuuaaagcaacugcugucuaaaaaugcaaaucaaaaaugucuggugagaaacucggggcuguggcucauuaaucucauugauacaaauaagaccuaggucaaagaucugaaccccaaguauuccuauuuuaaaggaauggcugagcacgguggcucauguuuacaaucccaacacuuugggaggccaaggugggaggcuuacuugaggccaggaguuugagaccagccugggcaacauagcaagaccuugucucuacgaaaacuguuuaaaaaauuaauugggcaucuuggugcaccuguaauacuggcugcucugagggugaggugggaagacugcuugggcacaggaguucaaggauggagcuaugauuacaucaccacacuccacuugggcuacagagcaagacccucucucuaaaacacaaauaaaaguuauuacaugugcuaugugugcugugaaaggugugucaaaaaguguauuacauggcaacuucuucaaauaucuuaaugacuauuauauuguauuauauaaauuuacucaguaaauuuguaauuucugaguaaauauaaauuuauauuacugcugagaaaugauagggaggcaaauugaggucaguacaaaagaacuaaccacuaaaagaaugggaugccuucugaacgccaaaagcauuuaaacaaacuaaauaaccaacugaaagggaaacuguagagauauucugcaguagguaaacugacagauuaaagaaucucuaaagaugaauacugaaguacuuccauguaagcgaugccuggaauuugcuuauaauacucucuggugguggugguugggggagcaccaagggauacggggauagacaaaauucaacuggcaaaagguugguaauuacugaagcugagugacagacacaugggaguucauuauauuucucuauguguaugcuugaaacuuuucauaaguuaaacauuaucuuuaagcuucuuccuuuccaacccuucauuuuuguguuauuaugugagggcauggcaagaagacuggccuaguuccaagagaggguuuguguuaaggcauaguaagagauaaaaguaaaagcaaaauaaauaguuagagguuucugaagcaaucuacaaaaaaagugacagcaaaggaacuaagaaggaaggaaaaaauguaaaagcacauuugggaaaauggaaguagaacccaguuccaggaacucacuacuauguguaauaaaugcaguguaauaaagagucagagaaagucuuuacguccaggugacugggggaacaaggggccuuggcaaaaacaagaaacuuguacagaauaaagauggugaaaaauacuggagaaaugauggaccagccugagccauauuguaucuaagguaacagugggacaucugacuaaagauguuggucagaagagaugccaguaagugaaaaaguaaagccaauaagggcacacagaucuacaucccucguggugaaaacauguguuuggagagaacauacuguggccuugaagauuacuuucagcacauaccuuuuccccuuaacuggaauucaucuacuaguguuauuuaaaauguuuuagaggaaggacccugccacuucaagcaccuguuaagugcaaaaagaaauguguugaauuuaacugacagauaugaaagaugcaaaccagugcacauuaaaucaucagaaaaccuaauucacugugaauucaggccaacuaaugcuuucuaguaacaaauauuuuaauuccuagugaaaauucuagaugaagacaugggaggaagcccccugcaauaaagcaaucuugauaaaacagaagacuuauggcaacuaacuccuuucacuguaauuuaacuggaguuacucccuaaggacagauaaguuaaacagauagaacaggaaucaacaucuuuugcuauuguuaccuaacguauucccugggguuuaaaaagcuuuuaaguaaagaagcuuccgacagacaaaaggaaagugucucugucuuuuccuacuguaggaauagauguuagguagcauuacacaggaguugagggcuaauguguaaaaaaaagaaagaaaaaaaagaaauccuuuuccuacuguuucagaaauauauucugaagacuaauucaauuuaaaaccaaauauauucaaguccaaagcuuccugcuaaagacucaccagacaaggacucugcccucaaggaguuuacaauccauuaagguaauuaagauauaaucucaaguagcuggcugcccaaggcacacaagagaaaagggcacuaauacgggugccagcaccaugcuagcgugcuuucaaacacuaucucaacucaaguuucuuaccacucuuacgauagagaaauagucccaguucacaaaagauaauaauggguaucuagguaucuguauuaguccauucucacgcugcuaauaaagacauacccaagacuggguaauuuauaaagagguuuaauugacucacaguucugcagagcugggaaggccucaggaaacuuacaaucaugguggaaggggaagcaaacacguccuucuucaaaugauggcagcaaggagaagugugaagcaaaguggggcaggugcgggggcgggguggggaagccccuuauaaaaccaucggaccucaugagaacucacuaucacaagaacagcauggagguaacugcccgggugauucaaucaccucccaccgggucccucccacaacacaggaagauuaugagagcuacaauucaacaugagauuuggguggggacacagccaaaccauaucaguauccuuuacuaaauguauauuuugugcaaggcaguauuacauauaucaccucuaaguuucacaacucugggugguaacgauuuccucaaaucuaagauacuuuuugccucauuuuaccaucucugaaaauaaggugcaucuaguugguauaacccccaugaaggaagaauuuggcaaaaucaaacaaacucacacacucccucuuuaaacccagcaaucccaugccuaacaauucagccugaaaaaacacuccaagguguaucuagagaaauaaguggaugacaacaaaguuaagaggcaguauuuuuaauaagugacagggaaacaaaggaggcagaauguagaauggcagaucaauggaauagcaaaaggguuaagaaaaaauguuuuaggaaacauuugaaacucaaauuuucgaacgucaauuaacauuaaaguaacaguuucuaucgcaucauaaugcuccuguauuuagaaacuauacaaacucuuuauaaagguaauagacauuuuccaaaugaagcaugugggcaccauuacuuccacaucucuuacaugauagcaagauuuucuauuuuucugcugugcugcuauuuuucaguaagcgcaguaaggcaguaagauugcuuaauuuaugggcauuuugggggaaaaaaagucuaagaguaaaaauacugaaucuagguuaacugccuccuuguuucaaagugaagaguaauauaaugagauaaaacagcccgguuccaccagcgaacaagaugaaauaaaaacccuggauccaagaguggcaguuaggaguuaacauaggcuuccuggaggaugcaguuugagccaagucuuacugaaagcuaagagggaguuggcaagacaaaggaaggugaaagggcauucuugguggaugugcuacgcugcagcaagaaaugaguugcaacagccagcuauuacuaucauugcugaaaaauucauccucuccugaaugagcaaaauuaagugagacauacuucucccagcuaggaaaugggagaguugacuguuuucaggagcauauuaaaaaauaaaaucccagaguuauguuuaucucccuaaagucauguguccaaaacagaguuuuuuuuuguuguuuguuuagacagagucucacucuacuguccaggcuggagugcaguggugcaaucucagcucccugcaaccuccgccucccagguucaagagauucuccugccucaggcucccgaguagcugggauuacaggugcauaccaucauggccagcuaauuuuuguauuuuuguagagauaggguuucagcauguuuaccaggcuggucucgaacuccugaccucaagugauauaccugccuuggccucccaaagugcugggauuacaggagugagccaccaugccugguccuuuuuuuuucuuuuaaaaaaguuauagauauacucuaacuucuuguaacucuagaguccuaguucucugcuuagauagaaaggaaacaaaauauacaggaauaagaaacucaguaucaaaugaauccaacaaaauuugauccaacuguuaaaaaguuccugaaagcuggccuaaacccaaaaugacaaugaagcugcagauauggaaaccaaguacaaggucaaccccaaguggccaaaucaaugucacaucaggcauauauaagauaaaaaguucauucuccauagggaaaacagacaaauacacaaauuacaugaggggaagaaauaaccaagucuguaaaauacuuugauaaacauguucaaacaugaugagcacaaaagaccaugaccaaacccuaaugugauagaggcacugcagagcagcacagagguccccuuuagggaccucugaaggaagcuggagaaagcagaccagugcaacagugaaaaauaucuuauucaaaauccuuguucuaucacucaguguaugaccuuggguaaaagucacuuaacuacuagaucuaugagaagguagcauaaaucagugguaaagagcuucaaaucucuguccaucauguacuagauacccaugaccuuaguaaauuugcuuaucuuacagaugaagaaacuugggcucagaaaauuucagugauuuuaaagaauuuuauuuugaaagucaaucaauauuuguguguaguuguaacagaauuccuggcuaaucuccaagaaauuauaaacauguuaacaacugucaaugcgguacaaccauuccuaaaccuucuccuugauuaauuuacauagaacugaagucagccuacucaaucauuucauacaacuuagcucagguuguauaugugcauuugaggcagcaaccauacccauucacaaugcccaccgagccaacaacugagaaaugcugucugauuuuccuuccuauacugagauccaggaaagaaaagcacuuaugaaaaaggaaguaaacuguggccuacucuaacaacccugguacccggaagccuaacgaacuuacagguuuuaaggaaggcacuguuaacgccauagcauuccccaugcagaagcacauaugccuguuuagcuguggucagcagguggcuaacaguguugccaaucuuauucuaucuggugucucuaaacucaauccaagcaaaaacauuuacucuuucuuaagggagaaaaggauaagucaucagcacagaauacugacuguuuuaucaacuauuccaugaucuuaaagcuuuuaggguaaucagaucagggcaggaagaagaguccuuugcugccuuauaagcaaaggcagagagcuuucugauauaaaggagacucuuugccauguuuugagccaguccccuuuacacugccuuuugaugauagauuugagacuuagggcagcuguauaauaugaugggcuccuccuucaaagauaaucaucaagucaaguguauggggaauggagguguggcauaguuacacaaucaaaaccuaccuucuccaaaaagacacucacaauauaacuucugucaaagauaaucucugcucuucucugacauacaaauauacaacuagcgcauaaggaaagugaacacuagaaccacuugagugaacacaaugggugaauaaauuauuuaaagaaaauauuuaucaccucauuauuaaaacucuuguacuggggcaaacccuuacaucuucuacuuccucccugacuuucaaacccauaucacauccccaaaagcagaaguuuuaaaaaaaucaacauucucuuuaacacucuauacccaguauguucuaauacuuuuaaaagaagauggcuucugucuaggacagauaacaagcuggucuugagugauaaaaaacuggcauccaggagugcaguaaauaucaggggugugugaaucucccaggaacuuaaugcaaaacuaaaggcagugaaaaagccugaaaacuugucaucauuaaaaggggaaugguugaggaguaaaaacaaguauuccccaacuguuaggggagagggaagggcauauuucuuuuuacuccucaaauucagacuauaccaacguugguccaguuucaauccaggacacccugucugugagccaucuuaaugguggcugguuucaauuuguagccuacagaagaguccuuaucacuacuuuacagcaauucucaaggagaacauuuccaaaauuccagggcauaguuaacagccuuucaaaguaagcaggacagagacuguuucuggcuaaaggcccaaagagcucuggaauucaaaaggaaagaaaacugcugggaggauucagcucuaaagaaacccuuaaaaaacugaugaaugagggcugggagcaguggcucaugccuguaaucccagcacuuugggaggccaaggcagguggaucaccugaguucaggaguucaagaccagccugaccaacacggugaaagcccaucucuacuaaaaaauacaaaaauuagccgggcauggugaugcacaccuguaaucccagcuacuugggaggcugaggcaggagaaucacuugaacccggaggcggagguugcagugagccaagaucgugccauugcacuccagccuaagcaacaagagugaaacucugccucaacauaaaacaaaacaaaagaaugagagaagagacuaguaacauuuccaauuuuuaaaguccacaugaccauuuauucucccuaaauguguauugcauauaaacaagaauuuuugucauggaccuguucaucauugaaacuaugggauuccccuguuagggaccucaacuugaaagcuaacaaaacaaacaaaaaaaaaaucucuagcuaagaagauggcagacaaguauaaauaguucuucuguccuuaaggaaguugggauucacaauauucauuuguucaaguauuuacugagugccacuuaaguguugaaauacaacucagccccaaaacugagucccugcccucaucaaguuucauaauaagcauaauacccaccugaccgcgccaucccaacaguagcagcugcugacugaguaacuuugaaaagggagagggaaagggucccccuaacugcccaaguuucacuggacuugccuccaugaaguuccagaaucagccucuaauguuaccguuggaaaagacccucauaagaaguuacaaagaccaaguucaagacagggucaaacugaauuaaaugaaaguugccaauuauuuugcaaaguguggucuuucuuuucaauauucaaaacuuggggaaauaccaucggaaacuuagaagugcacugcauuaaaagacucagaguugcucaaagacccaauuuuguuaucaccucugcaacacaacuucaaauuucuaaaaccugucacuacaauuuccaaagugcccaaguguucagaagaaaugccacaaacugacuuaaaaacacuucaagaauuagguucuuaaacaucagcagcugugugagauuaguggucagcuauuauccuuaaaggcuuugccauggaaaagacacacaagaaggaggcuauucgucuacuuuacgccucaaacugacacacacacaaaaggguuaaaugaucagagaauguuuucucuuccaggccacuuccgcauuuaaauuucuuuuauggcuuuacaacaccacaauuaccuuaaucugucucuccacaaccccuuccugucuuauuuuacaaccuucucuccuuaccuuaaucugucucuccacaaccacugucuuauuuuacagccuucuuucccaucccacuccuuccauuaugguccuuaaauucaaguucaucuucuuaucuuccucugguucucauuuccagggaccaauuaauuauauuuaaaaaucaaaaaaauaauucagacuucagugauaggaccgacaaacugucuuucagagaaguauguuacuugaucuacaagaaggucuucugaucuggagauucuaggcgcaauuagagccagaacagacuguucauuguuuuauuauuaugccaaaaacuaagugacagauuuaaaagucaauuucacuuucuaauaguaagaagacacgcuuagagcaacuccuuuaaugcaauguccuggugggguuuuagauaacuuauuucucagcuuugggucucaguuuucugaucuauaaaaugaccuuuauugaccccuuacgucuggucacaugaauucuaugaauuuuaaaaauugucuuggcccauguggauuuagguaaaaggaaaauuuuaaaugcuugagugcagugguucucaaguauuccuguguauaagcccugguacuuggaaucauccucagauauuuuaacacaagcucuccagguaacuauaauccacuguccagaaccauauuuugaagaaacccugcauuauuauuucuuauuccugagucuucugagcaauauuaauagcaaauacgagccaccuacaaaaauucaugugcugcugauuuuauuuucaguuucuauuccaauugggucucucuguuccuuuaaaaggcaggcaugugcugagucagccucuggggaauuuuuuuuuuuuuuuuuuaauuuauagccuagacuauugagucucuacaauugaggaagaaagagguuguucucaccugcuacucuuccaaccccuauuugaaaggaagaaggaaaagcuacuuaagggguggcacagcuacucuaacuuagauaauaaggaggggguuagucaagcucuuuaaaauagaaguuuucuucguugucuggacgcuaauggguggagucaugcuuagacagagacagguaacugaguccugccaguggggcucagaugccuuugggagcuagaggcuacauaccaagaguccuggugagcuuccugugauacacacaagcacauucaaucaggucagcaaacuuuuucugugaagggccagguacuaaauacaccuuguagcccauucaaguuccacugcaaguauucaauucugccacaguagcacaaaaacuaccacagauuacauguaaaugaaugagcauggccacauucuagugaacuuuauuuauggacacuggaauuuguauuucaaaugauuuuccugugucaugaaguaauacucuccuuucaauuuuuuuccuccaacuacauucugagaaaugugucauuaggcgauuuugucaugcaaacaucauagugugcuuacacaaaccuagaugguauagccuacuaccgccuaggcuauaugguauagccuguugcuccuaggcuacaaaccuguacagcauguuacaguacuguaggaaacuguaacacaguguuaaguauuuguguaucugaacguaucugcaacacagaaaagaggcaguaaaaauaccaccuucuaucuuaugggaccaucauuauauaaguggucuauuguugacagaaaucuuguuauguggcacaugccuaaauuuaaaaauacaaaaccauucuuaguucguggaccacacaaaagcagguguaguuugcagaacacugcgcuaguacuaacuagaaaguauccgcaaugucuccuguagaaaggugucuuacucaagcucagggucuaaaugaagaauauccucccugacuuaccuacaacucccgucuaacacaccucagcuuucugcuaacuuguucucgucucucuucucucccugcacacagcucaugaauggccaaucaacuugacuugaaagugguuaaaaucuaccucacucugcaaaacuaagugagucacaugagaacucugaagagaggccaaugacuggcccacugcuaauucugcuucuuaagcagcaagcugguuaaauuuguuauuuauuccccuugaagugggaacaacaucauacuuguucacaaaaugcuaaccaccucugaugaaauuccuuaguaaauaagcagacuucaggaacccuuauaaaauaagguuucuaguuaauccuuaguuaacaaaaagauccuuuuucuugaauacucaaauagguuuuacugauuucuggaacaacuggguccaagcacaagcugaacugcuaaaaaauaaacuauccagggggcuuugcugcaaaggcaagcaagcuucccuuaauagggaaagaauuacauuaaagugcagcagagccugcauuuagucuguuaaggacacaucauaagugaagagaugggcgcccccagucugauggguaauuccaccacagcccagaauucucaggaggcaacuaagucaccccaggucccccuuuaccuuguuuuguaucacaacuaagaacucaggcuguggcaugagguaggccuagauuagccucccugcucuguggcuuaguuauaacuauauagccuugagcuaguuacuuuacuuaaaccgugagauucaauuucuucaaaaguaaacuggcccagugaacauuacuggaaauaguaauguuaacuaccucaggauugauaaaugaaagcuuagaauucuuaagacgcugccuagggcauuaaaaauguucaaauaucagcuauuuauuucauuccuauucauuuucuccuugcaucccacgaaaacugaucacaacuugaagcuaaaccuggaggaaucuggaucuauucccaguccuuaagcaauuuacucaaguugguaucuaagaccuuauaugacagugguccucauaguggucaaagcuacaaucggauuuuguuccaucagacuaauauaugucuagcuaacugugagccagauuacuuauaagaugcagccuacacuggucaugagcgugcaagugagaagauaaccccagauggcauacagcagcugaguucugaucugcuuuuacuauaagcaacaccuugcaugaauuagccucuugggugcuauuugguagucuacaaucuuugauucucuaccacuuauaguaggauauugacuuauuacugauaacaauuuaacaaauagaaauaaauuaccuucuuguuauaggcaacaugcuagaaacuuacaauuucaaaugaaguugugggauaaaacuaaccauuuuaaaggcuacuaauccauaaagguguacauaaauauaaguucaucuguuuugucaacuacgcaacagacauaaccuaccucauaggguugcugagauaaaaugagaacuuacuucauccaaaggaccugaaauuuucaccuguuuagcucuaaggggucaaauaaaacguacaacugccugaacuuccaacugcuuugguaaacacaacuuuacuuaccaguuguaaguccucuuaggacuuacaaugucagucaggauaaaacaauguagacauacugaaggaaggcuguuauucaaacucauaacaucaaauucacacgugucuuuggauuuuuaaauuccaagagccccaaucacucauauuccaagcagaaucuaaaccacaaucucuugggucuuaccuaaauuuuaucuagagcuguccaauaugguagccacuauuggcuaguuuauauuuaaauuaaaauaaaauaaaauaaaauaauuaaguucuuuggucccacuuaccacauauuucaagggggcucaaaaccucauauaggccaggugcaguggcucaugcuuguaaucccagcacuuugggaggcugaggcaggugaaucacuagaggccaggaguuugacacaaaccuggucaacauggcaaaaccccgucucuacuaaauacaaaaaaacuggcugagcgugguggcccacgccuguaauccuagcuaucgggaggcugagggucgaaucaccugagccugggaggcagaggcugcaguaagcugagaucgcgccacugcacuccagccugaaugacagagcaagacucuugucucucucucucucucucacucacacacacacagacacaccucauauggcuaauagcuaccauauuggacagcacaaauauaggacauuuccaucaugacaaaaaguucuacuggaugaaauuauccaggaaaauacucugcuuccuagcacucuccacucugccuauugcagcccagucaaggacuuuucccuacaugguacugcacuauucugugugguucccaggccuggcuaagcuggcuaucucaaagcagccugcuucugcacagaaccucuggagaaucaggcccucaaugaacaccugcccagaaaacauuucaacugaaguuauuagucugccgaagcauaagacaaaacugagauagagcaauuauuuuaagcuucgggagcagggcaaacaaaucccauuuuuacuaacuaccuuugcucucuuaauagaagacaacacuggaauuuuuuuacuuaucucugaaaguaauuaacuaguacaagacccuuaagaugggcaauugcauuucuuuuuuucuuuuuuuugagaaggaguuuugcucuuguugcccugcuggagugcaauggcaugaucuuggcucacugcaaccuccgccuccaggguucaagcgauucuccugccucagccucccgaguagcugggauuacaggugucugccaccacgccuggcuaauuuuguauuuuuaguagagaugggguuucuccauguuggucaggcuggucucaaacucccgaccucaggugauccgccugccucggccucccaaagugcugggauuacaggcgugagccaccacgcccggcugggcacuugcauuucaaauacugcucuauaacaagucacauuuucacaaggacaucccugcacuacaaaugcaucuucuuucccaagaggcagaacuuaaaagggaaaaaggacuugucuaaccugaaaauguaucuucucaggccagcucaauuagggcaggcccauuccuguaggcuuguccuccuuugcuuccauuaaggaacgcuuaaugccugggaagagugagagugacuacaaaccucuggccuacgugcggauccacagcucagccuaaacugccuuuguuuccaauggucaggggccuccaaacacacuaagaccauacuuugucuggccauaaagacuuuaagugugcugacacauuguuucauguauccuauuacuaauucaaccaagggaccuucuuugucuagacaauucucauugacagggcuugaaaugcgcaggccauucucugggccacuagcuguagaaagaauaagacugaacacaccucuccuacugaaguggcauauauucaguagaaauacaagaaaccuuucugguguuaaucauauaacugcuccuuaaauuuuuuuauacuccagaagauccucccccgauuaugaauuacuccaacuucacaacuguaagaaagcacaaguaaugaacuccauacaugguuccuugugaaagaacaaggaauacugcuuaagagguugaauuacuacaaaacugguaucuugcucuauucuauugguucugaaacuucagugcacaucugaucaccugguagacacucauuaaaacccaaauggcuaagacccuacucccagaguuuaagagucaguagguaugggugaggcccgagaaucugcauguccaacaaguuuucaaacaaugcaguucugcugaucaggaaaccacacauugagaaccacagaugacaccugaacaauauguguuugaaaugcuugaguccacuuacaugaggguuuucuuucuccucugcuacuccugagacagcaagaccaaacucuccucuucccccucagccuacucaacaagacaaugaggaugaaggcuuuuaugaugauccauuuucacuuaauaaaugguaaauauauuuucucuuccuuacaauuuucuuaauauuuccuuuucucuagcuuacuuuauugugagaucauaguauauaauacauauaacauacaaaauguguguuaauugacuguuucuguuaucaguaaggcuucuggucaacaguaggcuauuaguuaaguuuucgaggagucaaaaguuauaacucgaauuuuugacugcauaggagucagcaucccuaacccucguguuguucaagcgucaacuauacugcuuuauucaaaugcuuccauuucaaucaguaccaucaggagcugaaguccccaacuaauuuaaucuaaaggcagugagcuccacagacuggauuuucaguauuccacuaaauuauuccacuuacuuucuaaaguccugauuuaaccauccuaguauuaguaugaaaacaaacccugcucauugugcucugcuugucacccaauccgaaaaaguaacaucagaauuaaauggcuuguuaaacacugaaguaggagaaaggauuaggauucugacacacaguaaaacagcugcaaaggcaguuaacuauaucugcuauuugguaaaugcucacugaaagguagaaacuauaacuuagagugaaguaucaagcuuuuauaaacauauauuaaaaaauacuguucugguccuuuaaaaauauccuguaaucuuggcugggcacgguggcucacuacuguaaucuaagcacuuugggaggcugaggcagccggaucacuugaggccagaaguuugggaccaucguggccaacauggcaaaacuccgucuccacuaaaaauacaaaaauuagccagguguggugguggugugccuguaaucccagguacucaggaggaugaggcaggagaaucgcuugaacccaggagguggggguugcagcaagcccagaucgugucacugcaccccagccugggcgacaaagggagacucugucuccaaauaauaauaauaauaaucaucaucaucaucaucaucacccuguaagcuuuauaccuuaaccuguggaguaucguaauugaaugaagcaaaauauagaucuuuagccaaauaagauaguaaaguucagauagaucaacuucuccaaaggagguuaugggucaccugcauuagucagaaucauuugggauuguugaagauacauuaaaaaugcagauuuucaguaccuuccacuauagaaucaacuucaagguguacgaguaggaauauguauuuucaccaaucauccccaggugacuuuuaggcauaucagcuugagaaaaacaaggaaaacuuacuguuaagcucucaaaagucucccacuugaucuucaaccagcuggggggagaaaggaguuugcacuucacaacugaaacauuugguaaaagcaucuguauugaccauacaggaugaaacagugcucuuaauuuuuuuuuuuuuuuuuuuuuugagacagggucucguucuggggcacaguagggcaaacauggcucccugcagccucaaccuccuaggcucaacugauccuccuuccucagccucccaaguagcugggacuguaggugcacaccaccaugcuuggcuaauuuuuguuauuuuuuuguagagacggggucccgacauguugcccaggcugcuuuagaacuccugggcuaaagcaauucacccacuuuggccucccaaagugcuggccacuucuuaauaaggaaaacacauaaauacagacuacuacagaaugaaauauuaaaagaggauaacaaaagcucaaugcaagucagagaaaagugguuacacuucuggcuugggguuacgugguaaugcaggcagacuucccuagaaaggaaauggaguaucugugacuaugccaucaauacucaaacaggcucugagauguuuagaacucucaaggaguucacaauaccuagugccuuccuaaaaauauguaguaaaauggagaaguauugaguauaccuagcuaaaccuuaugaaauucuaaagacuaagaggcauucauucauuccaggguauaagaaauacuacuuaaacagaaccuaacauggucuuuuuuuuuuuuuuuuuuuuugagacgaugccucgcugucucccaggcugaagugcaguggugccaucucggcucauugcaaccucugccucccagguucaagugauucuccugcuucagccuccugaguaucuaggacuacaggcaugcgccaccaggcccagcuaaucuuuuguauuuuuaguagagaugagguuuuuuuuaaaaaucaaauuuccaauaaaugcacuucuuagggacuucucaguguggggugccuggcccuggagcacuugugguuuggaaaucaaguguaacaagccaguaguuauaaagacuaacaaauuuguguuccuucuccucccuuuccucuccugguuaaguggaagcauuaaaaauuaagaaauagauccugagccacaaucaauuccuaagaagcuacuguuucuucauuucugguauuaaauaguaagaacuacuuacauugcauccauuccugcaaaaaugcacugacuguaugauuaaggcacaguaagucuaacauuuugucccgaucacuuuucuaguauucaaaccacuguaaguaauaccacuauguacucugcaucuuucucugaagagcuuuaacagcuuuuauguauuacccauaucaagauacuucauggauuaggaaggggcaauaauauuucaauaguuucauaaaauuaguuucccaggacuuuaaguagaguuuauucucuaagauuuuaguucuucaaauaugugaagauggugauuuuaaauacuuuauuucaaucaauucaguucaaggauuuaaauuauuucaaauacuugaauuagcuauugucacaugauuucucacacagaaugugaccaucucuagccauuccgacaaccuaccugcucaggaaaugugaaaacuauuuuucuuuuuuuuuugagauggagucucgcucugacgcccaggcuggagugcaguggcgcaaucucggcucacugcaagcuccgccuccuggguucaugccauucuccugccucagccucccaaguagcuggacuacaggcgcccgccaccacgcccggcuaguuuuuuguauuuuuaguagagacgggguuucgccguguuagccaggauggucucgaucuccugaccucgugauccgcccgccucggccuccuaaaaugguggaauuacaggcaugagccauuaccaagcccagcugaaaacuauuuuucuaaaauucaugcaacauggaugucugauacaaaaagauaacaggaaauaaauacacagaacuuaaaucuuuuugccuauuucaggcaaaaaaguuuaauggguauauagguauacaaaaaaaaaccauuuuuuguaacauuuuaagaaauaagaguuuggaaaucuuuggaaauccaagguccuaggucuccaauuucuuuaaggggggaaaaacucacgauuaggacuaaauggagacgucacucucuugcacugauagugaaauauuaacugccagaaaguaccuccaguccccauucauguuguaugacagcagccuuuguacugaggccuaaugaaaaaucucaacagaggaagugacuguauauaccuacaacguacuaauuucaaaguucauccugauaggcauguggguuugucuuguucaucugugucuagucacaauauucacuuucugaauguuuguaugaaugaauauggcaacuuaaacuuuuccauuuacaauuaaacgugaaaauuuuagcuuccuaaguagaugccaaauauugcaccaucccaagugugaaaggagaaaguuaaucacugccaaagaugaugaugauuuuuuuuuuuuuuugagacagggucucacucuguugcccaaaacgggguagguacaguggcaugcucacggcucacugcaaccuccaccucccggggcuuaagcaauccuuccaccucagccuucuaaguagcugggacuacaggcaugcaccaacacaccuggcuaauuuuuguauuuuuuuuguugagacagguuuuucccauguugcccaggcugaucuugaacuccugggcucaagugaucugcccaucucggccucccaaagugcugggauuauaggcaugagccuccaggccugccccaaagauuuuuaauccacaauuuaagguaugagaaacaaacaaagugguguguaugcagcaagccuugucacuggacaacugaaguugccgcaaagucaaagcaagucaguacccuccugagccagccuuucuaugauuuacagcaauaguaucauacucaaugcucccuagugaccccuccagcuugguuaaaauuucacaauagauauaugugcaaauuuaaagaaaguaaagauguucccuuuguacaaaagccuaauaaagcaauuucugaaaaagguguuguuguuguuguuuuuuagcauuggcaaggaacuaaaaauucuguucuaagcuucaccuuucauaaaguaauccucucaugcucuuuaauccucaauguuguaagguaaguauuaaaccuacuuuauaggugaagaacuaaggcucugauauuaacuuguucaaagaccuagccauugagcagaagcucaagaacucgaauuuaaauucccuuuaagucucuauuauggggugguggggauguagaggggguuggaggccgggagacuauucgcauucuguaucagaggaaaacgaaagaaaaagagaccaaagcuuugaagacuuuuaaauccaacccuauugugggcacauuccuuguauacugagggcaauggagcuacagagcauuaacaaauacucaucuucccagauuuuuuuccccauauuuuaugagcuauauuuuuccugauauguuuaucuuugaagacucuuuaaaauuaggcccuauuccauaauuucuauacaacaaaauuauguccuccugccuacuuuuaauugaauuuaagucugcgccuguugugaugcuucugugauaauccuuuugcugaauggcguaagaucucuacuaagauccauuuggcuuaaaccuaaugaacacuagugaacacauccuuaaaugacuuuuguuuauuuccuuuaaguaacacuuccaaaaaaacaaauucaaggcaauucaauauucagcauuagcuagacuuaugagccauuacugaaauuucuacugacuuuaucaaauuuuuucauggaaucucccaaaugccuauacucacgcauaacuguuaacacggcauuugguacuaaauucucacacauaagcuuuauuauauuauuuaagguauucuuauucccaagaauuacuauuucaaagaaaaccaaguuggucacuuuaagcaacuauuugaauaaaugaaaaacugaaguaauucucaggugcuuugagaguucucuguuuaauuuaaaaacguuuugggggagaaguaaaauaguggccuuugaaaaaauaugcugacacaagacauauugaauuuugugguuuuaaaaaauuaacaaauaaugaacuuggcauuuuauuaaaugcaucgaaaagggucaaguuauuuuuaauagaaaauccauaauucuauuaaaugguugagaaauuagucacaucaauagacuucuuucauuucugagcccaucuucuguacugcuacaaguuccuuuggcaaugaccacuuugcuguaaacauucuuagaaaaguaggaauuaggcuuggcgcgguggcucaugcauguaaucccagcacuuugggaggccgaggcugguggaucacgaggucaggagaucgagaccauccuggcuaacacggugaaacccuguaucuacuaaaaauacaaaaaauuagccaggcgugguggcgggcgccuguagucccagcaacuuaggaggcuaaggcaggagaauggcgugaaccugggaggcggagcuugcagugagccgagauugcgccacugcacuccagccuggguaacagagugagacuccaucucaaaaaaaaaaaaaaaagaaaaguaggaacuagauauacaauuggauccuucucagcccaaaccuagauaugaagacaccuuuuacuuuacagugaccgcuuuguaacuggaagacaucaguguaggcucugcugauucaauuagguaaagacucaacaacacuaguuacauguuacaauucacuguguaaaugucaagaagauuuaaaacuuuaacagggaauaccaaugaaagacagacuccccaacaucaaucacuauuucaaaccuaacauucaaaauaaagauccaguugagaauagaggcugucucaucaaaguuuacauuuuacaaugaggacagagaggcaccuucauauacuuaucuaauucucaacaguuugugaaacauaaauauuauccuugcuuauggauaagaaaacaagguucaguggucagaucauguuucauaggaagaacagggacuuaucucgauuuuucggaauccuacaccaauuuucuauuuuaccacagcugucuccucacacccccacucuuccccuagaccuaacauuccacauacaaaggguccaagcuaucucuaacagcagauaaucaagggcagguucugacaucuguacuagaagcuuaccaauuacagccugagugggguuuccagaaucuggaccaaggcagcauguuaucaaaaaggggacaugaaaaggcauaaaggguaaaaagaaaaaaacguuuccuuuccuggucucugguucuccccauaagccuaugcaaucuauauuaucuuuauucaauucagauuuaaugcacauaaaaauguggugccuaauaaguuuucaaaauuaguucccuucaucccacuucugcugcuuggcaagagcucacauagucaacuacaaggaaacaaaggggcuaccuuacuggagucagguuaaguaaaaggucuuagccaaugagauccacaaaugacaaugauccugaagccuccuagauuagucuccugcacaaucaguaauauaccuacaaagcuuuauaaaucugggcauucauacauauaugauagcaagauuaacauuuggacuucuacuaaggggaaaaaggguguauuauucugguggaggacuaaccuucaacaaagaacuuuuuuucuauaaacuccaauagccaagaaaaguccuaggcaucuaucuuugcuagcgugugcuaagaaaaacaauauaaagaauaaugggaccacaagcuggcugggucgguuucguucuuaaaauauaggaaaacgucagaauacccagggaucuguuaaauucuuuucccaacaucaucauuuacaacaacaaauacaggagaucugaagucccuaaaaauacugauugcuuuaacaucuuuuguuggagcuuaccuagguguuucuuaggaaugcuaaugaacuguguucuuuaggcuccuugaauccacagaaacaaaaauguuaauuucaaaggcucagaggggaauuaauugccugguagagaugccuccccaccccaaaucugaugggaaggguagaagggagaugguaaauuaaaacauuuauuacacauuucagaaaaauuuagcagacagguaagugagugaaacuagaagcuuaagacaacaaaugaaaaaugaauaccuaccaaaaagaaauuaagggucaggcacaguggcucaugcccagcacuuugagaggcugaggugggcaggcugcuugagcccagggguucaagaccagccugggcaacauggcgagaaaccucgucucuacaaaaaaugcaaaaauuagcccggcguggugacaugcaccuguaguuccagcuacuugggagggugagguaggaggaucgcuugagcccaggaggcagagguugcagugagcugcaaucacacuacugcgcuccagcccgggcaacaaacagaaacccugucugccccccaccccgcccaaaaaaaaaguaaaggaaagaaguuaaaauuaaaaguugccuaccuuccuuggaauuucuuucuuacuaaacguuaagagacauaaaugacacacauaaagacaguuaauacaaacuucgauacagauagccaaaguugauauuacgaucuauauacuccagagauaugcaugagauaccaguaacaucacuucucucccagugugaaaaauaucuaggaucuuuccuauacacacagaaaauguucaacaauaucuauuuacuauuaaaucauuucagcaaacuaucagccauuucucauaacgccaccaaaauaccaucaauaucuaacagacauuccucuacaagcuuccccgcaacccccaaucaaacuuuguccacccugcccucauuuacaucccucuccacccuucccaggcccuaugcuaucaacacagcacauacuguccacaucuagauaggcagguggcagggaggguggggguuggcaaaaugcuaauuauuccaacccuggccucuauuuuagauuuucuacugcagcuauuggccuggagccauggggauggaaagcugcugcucaaacuugagauguaugaggcauggaaauagggagaaaagacaguuccaaauauuacuacucgaaguuuaaacacaaucugaaagcuuccuuuaaacacaauacccauucgccucuuaaggacuaguuuggaagucucuaaacuuuuuaccuuaagaaauccaugugucaacuguuugccuaaaugcccuuauuauccaaaguuaaugguuucaaaauaauuaagggauagucagauaaucuaaaccauacaacacagaaaauucacucaacugacucucaccuccacauccaauauauuuuacuauucuuucaauaggguuuuuuuuuuuaaaccuccagguccaaugucaaaauacucauuucaaacauuuccacagcuucauucaaacuaauuacauuugaauucauuuucccaagcaaacacaguuuacuggaguucgacacaguuucacaugggaaagaugcaaucccucacaaaacacacuucugaggaaacgacuuuggauuugaagaauaucaguuuuacuuugcacuaaaaagauggcaaaaggcaaaaguugauaaugaugugucauauaaauaugcauucauguccaacuaauaugaaauaacaugguuuuaguauaaucugaaacuucuaaaaugauauguauucagaaagcacaacagaaucauuuuccauaccauuagcagcagggacaacuguuacuauauaauuaauauacaacaaagcuguauauuagaaggcaaacauuuuuuugcaccuccccaccccacacaugcacugaaaacaagcaaaacaaaaaaaccucacagcccaauuuuggaauauaaacuuuaagacauguuauuuaauaaucugaacaaacuaaugaaugucuuuccaacucucucaauuccccaucuuuaugcugacagcaaggggaaaaagucagacucaauuccuuuuuuuuuuuuuuuuuuuugcugcuauugguuaaaaugagauuuggggacugaccuugguuuccuauuuuccauuuuacucuaucuacugaaccaaagaaaagcaggaguuggugaccguuacugcuagcuauauuauuuaguuugcaccuuucaagccacaacguauuucugauucuuuuagugaugccuggauuuucuuguuuuuacuagaaacauccaauccgagccuaaaauuuguuugugagaucugauaugcugguaaacuaaaaaaacacauauugacaagcaacuuucuuuuaugucaaagcauaguauaaaaauccuagcggcucacuaauucuaaaaaggugccucaaggaguccaguugcaauguaagggaagaaaaccacccuggagcauaaugcuuaaguauuuccugauugagucugaggaugcugcagauuucauuuggcgguaccaucacuuuucaguuuuaaaaauguaguggcaauuuucagauagccacaucaucagcuaucugaaauucccccaccgcaaucagcuaugcuaccgcccaucccaacccauacccaacagacagaaguacaacuaucuauuagcaucagaaacaauucauauuuaauuaccuucauccaauuugauuccauuaagccaaccagaaucagcacaagaugaugucaaaccaugauccuauauaucacuucuuagacuaaagacugauggagccaaguauugugcuuugcuaagggggucaaaugggggagaacucccuaucuccauagcagacaggcaaaaacuucaagaccucugaaacagcagaagaaucgcuaacacuuuaaccugguauuaccauuaucaauucuacagauagcuacgcagccuguacaguacuguaauaaugacucagccccacuacaguuaguucuaccaauacuuaggaagucuuuucacuuagacuuagauaugguuucugcuccaaauuccuaacucacugucaacauuuuaaauauaaauaacagagucucccagcaguugaguaugggucagaauguucuaaauuacaugcaaagagcuacaauuuuaaauauugcgaagaaugagcuccaaaguggggggacgggggggaaucuuuuauaucuuaggggaugagggcaggcaaaaugagagacguuugauuuuaauauaugaacuuguacaguuaaucuguaagauggguuaggcccucuuaaaaucacgcuuaaacaaucucuuaauacaaaguucaauaaugacaugucugggcauaauuaaacauugauuucuacuuuuuuuaaaguuuuuuucauaguuacauaaaucaaucacugguuaacaauguauuacuugagauagcaagcauaguuaccaacaccacaucuuccagacaauauucacaaagaauaauuacaccaaugucagaacuuuaugguggcagauucucuucaaaaagcauguuuagauaaaaagcaaaugacaaauuaucaaauccuuccuucucuccuuuuucagcucuguaagaaaauagagauuuguggcuuuuuauuuuuucaugcuaguaucauauaguaucacucuagcauaguggcucagcucaugggauuuagaguggccaacucacagcccuugggcaagcuaguaaauacacugaagccucaguuuccucaucuacaaaacagaaauaacaggaccuaacucacaaggguccuuccaaggauuacauuuaauuagaugauccauggaaagagcugagauucaugccuggcaguaaguauucaauaaauauuagcuauuauugcuauuaaaugugagccaacacauucuaaaagucaacauacgcagauuacuucagccucuauaaaaaugucaguaaagaucaauaaccuagccagcucacaaucauucacgugacuuaggugagaaccauguaaguuaacuuucucacaagaaagggcuaaacuuuguuucauuacuuacauuaccuacucagcccagccugacagccaaaagaacacauuccauauuaaagaucccaccuuccucuagcaaggucaaaaggacuucuuacauccucaccugcacauccuuucuuugcuccuguaucccaaagaaacaugucuauacuguggcuuucuaaacugcaggccucaccuccucccucuuuuaaaaucgugauagguugguuaaacguacuuaagaaacacuccaaccccugacaauucucugcgcccagucuuccacaacccccagcucagaagucaccuccucugagaaauuuccccacccucagacaaaauuaacuccccuauacuucaaagcauuuuggguacacauaugccccaguaguuaccuuauaauuaacuaauuaugucucccccaauagacugaauugagagcaagggaguguuaugguuacaggaucagcucuagcaccaagcacagugguuggcacauaucuggugcucaagaaaugccauacuuuaaaccagauucucuccuggcugaguaccaucuccugcuggaugccccacuucaaacucugaacauaagguugcucucaguagagcaggcuaacaugauggacugcugauuacaacauuagaaaaccuacucaucaacuucucccauuggagagguucccggaacccaaacucaauugagcaggauuauguaccaucaaaaucagugggaauucccagcacacuacagaagguaacuucuccuucaacaggguuguucgaaagccugcaaggaugagcuuuuuauuggaggacucuucccuggguaacugaaguggaaauacaguaagaauaaaugccuugauuuggcugaaaaggguucaaaaacauaaagaauugggaaaaaaaaaaaaagccaguucuugauuccugaaaaacaguggcucgugaaaaagaaugaacaggaagcagggguggguacuggacacucuuugcuucaauaaauaaaaucuuuuuuuccuccuuacaacccaaacgaaaaggccaacacaccagguccacaagagaugcucaacaaucuuuccuuccaacaaguacacuaaacugcguuuccagaaaaacacugcauugggaaccucgaccacaaugaaaaguuccagugacuaacauaauuuuuuaaaaauccaacauuuacauugggugacccacagagaacuugcaaacuuucuuuagggagguacugcuaccuuugcaaagaacguaacuugggaaaaacaaccuggaaauauaaagaacuccacaaagcguggcuuuaguuuuagagccauaauuccuaucauaaacagccuaucaaaaaaaaaauuaacaguugcuuaaggaaaucuuucauucuggaagcagaaaaggaaacaaacaugaagcauaaagggaauaacccccaaaauaaaguuuaaaaaauaauaauucagucccccagccuucccucucuggugaaguaugugauuuauacggcuuugcucugcagaaagcucauucugggcagcucaaggaaagagccgagggagggagagaaagagacacaggcacagaaaggagaggagagagaaaaagaaaauggcgcagagacuaagucccgaccgucgacaaggcgacuuucccgggaggaaucccggcccggaaagaccgcccgaggcccgguggcggacgacacggggucuccguuguccccucuugggagggccgggaucuggaggagcugggguccccggaaagggggucaagaggcggcccgaugggaacaauggggccggugagcgaggagccgggacuuagucucugggacgccaugucuguccucugcccggcaccggcagggcgcgggggaggcggccggcggcuggggggccccggagucggcgcagggggcacacucaccauucaaucggaaauccgcuucgaucuggaaaaagaaaaggagagaauaucaaacaacagccacuuuaaccccuccggcggcgagcgcgcgcggccggggucuggcucacccugcgcccccggggaggacggggacccggggguggccacagagggcagccaucccugccucgaacuguaacuucgcggcccucgcucgcggccuagcgagccgaucuacuccggcaggcggccccucaccgggggcuccggccugucaaagcugccgggccggggcuggggucggggccugcgccgggggucgcgggacggccaggccgggguccggggccgccagggucaggccgggccguaccugggaaucguuguggaggugguccccacucaugucggcccggagggacgagcgcggcggcaggcgaggcggcgugggggagacgcagacggcgaaccggccugugcgggcggacggggacuccggaggcucgaggaggcgcagguaagcggcggugacugugggcccgagacuccagaaacggcugaggcugcuaccacggcggcgacgcugccugacugccgggcgggcggcgagaacagaccccagcaguuguguaacagccuaaguucgcauuugggcucacugcgccugcgcggccgcuuuuaaacaacacgucggcgacgucagcgcucgcggaaagaggcagaggguugcggcccgcccccuc

SEQ ID NO: 13507 - RNA, 63196 nt, Homo sapiens
gucuaguugaacacuugcaacauccagggaagagcuugauggagaggcuuacaaauuuugaugguuuuuuuuuguuucagcauccgcaagcucugcagcaggcaacuguggaaaauguuccuggugcagacuguuggugccaggguaggcaauaacaacuuuguccuccaaaagucaaguuuuuguggccaggugugguggcucacaccuguaaucccagcacuuugggaggcugagguguggaucacuugaggucaggaguuugaggccagccuggccaacaugguaaaacccugucucuauuaaaaauacaaaaauuagccaggcauguuggugagugccuguaaucccagcuauuugggaggcugaggcaggagaaucacuugaaccugggaggcagaaguugcagugagccaagaugacaccacugcguuccagccugggcaacagagugaggcuccauugcaaaaaaaaaaaaaaaagaguuuuuugauuucugauuacugcauuuaaucacugagggggccagugcagaggcugaucauugucucaaugcccuugggcagagggagcuuucuagccacaaggggauuuaaagagacaguaccuauuuuuuuuuuucuuuauuccuccuuuuggcaagccagauauuuaaggaaaucuuaggucacugguuaaccacagagauaucacaacagaaacuucacugaccccauacugcaaagaauacacacuucacaaaaauaguuggaaaagucacaaauaguuggcuccagcccucaauaagcaaaaaucagcaaucucugaggcaugacagaauuagauucucaguuaccacaauguaauacucauaauguccaguucucaacaaaaaauuacaaaacauaaaaagaaauagaaaaccaugguccauucacaggaaaaaaaauugacaggcaccauccuugaggaaguccagacauuggaauuauuacccaaagacauuaaaucaacuaucuuaaguauguucagcgagcuaaaggaaaacauggacgaagaacuaaaggaaaucaggaaaaccaugcaugaacaaaaugagaauaucaauaaagagauagaaauuauaaaaaggaaccaaacaaauucuagagcuaaaaaguauaaucccugaaauggaaaacccacuagagggauucaacaaagauuugggcaugcaaaagaagagaacagugaauuugaagagaaaauaauugaaauuauccaaaggagaagaaagaaaaaaaauauuuaggaaaaaaaaccugagagagcugugagacaucaucaagcauacuaauguacucauauauucauauaguuauuauauucauuaguauauucauacucauauacucauauaggaaucgcagaaaaagaaaagggacagaaagaauauuuaaagaaauaaugauagaaaauuucccaaaucugaugaaagacaugaaucuacacauccaaaaagcucaauaaaauccaagcaggaugaacucagauccacaccaagacauguuauauuaggauugucaaaaccugaagacaggauuuugaaagcagcaagagagaagcaacucgucacacagaauuuuugacaagauuaacagccgauuccucaucaaaaaucuuggaagcccaaaggcagugagaugacauaucuaaagucgugaaaaaaagaaaaaaaaaaaaccucuaaaccaagauuucuguauauggcaaaacuauucuucaaaaaugaaagagaaauccagacauuuccaaauaaaauugaaggagaucauuauuaguagacaugcccuaccagaaaugcuaaagggaguccuucaugcugaaaugaaaggauacugaacagaaacuugaagccauaagaaaaaauaggccaggugccguggcucacaccuguaaucccagcacuuugggaggccgaggcggguggaucacgaggucaggaguuugagaccagccuggccaacauggugaaaacccaucucuacaaaaaauacaaaacuuagcugggccugguggugcuaaucccagcuacuugggaggcugaggcaggagaaucgcuugaaccugggaggcagagcuugcagugagccgagaucgcaccacuguacuccagccuggguggggcagagcaagacuccaucacaaaaaaaaaaaaaaaaaaaaagagcacuaguuaagauaacuuuagagguaaauauaagagccaguacuauuguacuuuugguuuauaacuuuuucucuuugugcuuuauaauuuaaaagacaaauucauuaaaaaauuauaaaucuauauuaaugggcauagaauguaagauguaaucugucuaaauaguaaaacuaacaaauuagugcauuguaaaaacagaaucaaaacaguacauugugaacaaucaaauaaauacaaaaggagguaguaauggaauugaggaaucaaaaacauauaagacauauuaaaaacaaauagccaaauggcagaaguaaauccuugaucuguaaucacauuaaauguaaagggauuaagcucuucuauuaaaaacaaagauuggcagauuggaguuaaacaaauaguguuuauaugcugucuuaagagacucauguuagauauaaggacacaaggagguugaaaguaaaaggauagaaaaagauacaccuagaaaauaguaaccauaugacagcugagguggcuauauuaucaccagacaaaauaaucuguuuuuucuggagaaaaaaaauauauauauuuuaaauauauacaauuauauauaaaauauauuuaaaauauauacaauuauauauaaaauauauauuuuaaauauauacaauuauauauaaaauauauauguauuuuaaauauauacaauuauauauaaaauauauauguauuuuaaauauauacaauuauauauaaaauauauauguauuuuaaauauauacaauuauauauaaaauauauguauaacauguuauauauauauaauuuagaauuagccagcaagacucagccaagaugaucccaguuuuguuggcaaccucagaagcauuguaaucaggagccaguugaacauacgccuucuucucuccaucagcccugaucaauguguugacuuugaccacaucagugucauagagcugcuucacagccugaccugguacuuuuuggcuuuuaacauccacagugaacacagguguauuguugucuucuaucuaauucacaucagacucaguggucacugguuauugggaacuugaugauggcauaguggucaagcuuauuucuccugguagugcucuucugaggauauugaggcugucuucagagucauaaugucuugggccacaggaaggugggugaugugugaaucuuuuuuuuuuuuuucuugguggcuguguggaugccuuucagcacugccuucuuggccuucaaagccuucacuuugggaucagcuuuaggagagucaagagcuuccuucuucaccuccaguguccucuuuugaaaaaggcacacaaaauaaauguuaaaucaagaaagguuacaagagacaaggauauuauauugauaaaauauuuauauauauaaauauauauauuuuuauauauauuauauauaauauauauuauauauaauauuuauauaauauauaauauauaauauauauuuauaauauauaauauauauuuauaauauauaaauauauauuauauauaaauauauuauauauaauauauauauuuauauaaauauauauuauauauaauauauaauauauauaaauauauauuuauguuauauaaauauauauauuuauaagauauauauuuauauaugaaauaaaaauauauuuauuauaaauauauauuuauuuuuauauauuuauuuauauauauuauauauauauauaccccuaacagagcuccaaaacauaugaaacagaaaugacagaauuaaagggagaaagacaaaaauaguuggagacuuuaauauuccauguccgauaauggauauagaaaccagacagaagaucaaucaggaaauagaggauuucaacaacacucuaagcaaauuagaccaaauagacauaagcagaauaccacccaacaacagcagaauacacagucuucucaaauucacauggaauacucuccaggauaaaccguauguuaagccaugaaacaaguguuaauacauuuuuaaaaacugagauuauacagaguacauuccaguuacaguggaaugaaacuagacauugaaaauaaaaaaguggaaauacacaaauagguggaaauuaacacacuauuuaaaaacuaaugggucaaagaaaucauaagggaaaguaaaaaauaccuugagacaaaugaaaacacagcauaccagaacuuaugacacauagugaaagcaauccuaagagguaaaucuguagcuguaaaugcauacauuaaaagagaacuuacgcugggcgcaguggcuuaugccuguaauccccacacuuugggaggcuaagguggguggaucaccugaggucaggaguucgagaccagccuggccaacauagugaaacccugucucuacuaaaaauacaaaaauuagguggacaugguggcaggcaccuguaaucccagcuacuugggaggcugaggcaggagaauaauuugaacccaggaggcagagguugcagugaacugagaccgcaccauugcacuccagccugggcaacaagagcgaaacuccuucucaaaaaauaaaaaaucucagucgagcaugguggcuugcaucuauaaucccagugcuuugggaggccaaggcaggaggaucacuugaggccaggaguuugagaccugccuggguaacaaagugggauccugucucuacaaaaaaguaaaaaauaagccaggugugguggcauguuccuguagugccagcuacucaggugucuggggugggaggauuguuuaccaggaguuugagguuauagugagcuauacuugcaccacugcauuccagccugggugacagcguaagaccccaugucuuaaaaaaacuuuuuuuaagaucucaaaucaguaaacuaaauguacacuuuaaagaacuagaaaagagcaaaugaaacccaaaguuaccagaaggaaggaaauaaagguuagagcagauauagagaaucaaugaaaccaaaaguugguucuugaaaaaacaaaauugacaaaccuuuaaauaagaaugaaagagaagacuuaaauuacuaacaucagaaaggaaagaggggauguuacauuuucacaugaauauaagauauuuucacaugaauaugauauuauaagagacuacuauuaacaguuaugugccaauaaauuggguaaccuagaugaaauuccuagaaacccgcacucucccaaaaucaacugacaaauaaauaaaaaaccaaaauauaucaauaacugguaagaagauuguuaucagaaacauuccaacagugacaagucuaggaccccuggugaauucuuccaaauauugaaagaagaauuaacacaccaguucuccucaaacuccuccaaaaaaauugaagaggaguaaacacuucuuaacucaugaggucaccauuacccugacaccagagcaagacaagggcacuacaagaaaagaaaucuacagacuaauaucucuuaugaauauagauacaaaaauccccaacaaaauagcaagccaaauucagcagcauacuaaaaggauuauaccucaugagcaagagggaucuaucccugcaaugcaaggauugccuggcacaugaauaucaauguaauucaccacauuacaagaauaaagagaauaaaacacaucauccuaauucaagcagaaagagcaucuaacaagucaacuugcuuucaugacaauaaacacucaguaacuaggaauaugacaauaugaugaagaccauauaugaaaagcccacaauuaacaucauacucaacaauggggaaagaccgaaaacuuuuccccugagaucaggaauaaaauaaagaugcccaguuuugccacaucuauucaaaacagcauuggaaguucuagccagagcaguuaggcaaaaaaaauaaauaaaaggauccaaguucgaaaggaagaaguaaaauuaucuuuguucacagaugacaugaucauauauguagaaacuugaggccaguugugguagcucacgccuguaaucccagcacuuugagaggccaaggcagguggaucacaaggucaagagaucgagaccacccuggccaacaugaugaaaccccgucucuacuaaaaauacaaaauuagcugggcaugguggcaugugccuuuagucucaggguuagggcugaggcaggagaaucacuugagccuggcaggcagagcuugcagugagccgagaucaugccacugcacuccagccuggugacagagcgagacuccuucucaaaaaaaaaaaacaaaaacaacaacaacaacaaaaaaaaaacuugaauccacacacacacaaaaauaguuaagagcuaauaaaugaacuuggcaaagcugcaggauauaaaaacaaaaaaaaucauuuguauuuagcugggcacagugacauaacuguagucccacuacuugggaggcugaggcaggaauucaaggaggccagccugggcaacauagugagacccuaucugucuaaaaaaauuggucguauuuuuauacacuugcaaugaacaaucugaaaagaaaauuuuaaaaaugguaucauuuacaagggcaucaaaaagaaaaagugcuuaggaauacauuuaaccaaggaggccaaagaaguguaucuugaaaacaacaaaauguugcugaaaaacauuaaagauaaccuaaauaaauagaaagauaucccauguucauggauugauauuaagauguagacgugacccaaagcaaacuacagagucaauguaaaaucuaucaaaagcauagucgcauuuuuacagaaauaagaaaauccaggaagacccaaccaaaauggcugacuagaggcauuuuguacucgccucuuccauuaagaacaaaaauagagaguagauaaucacacuuugaauagauuauccaagacagaacacuggaauucacggaaaagagacaggaaacaaaguaaggaaggaaaaagaagcaaggcagccuguucagcugggauuggcugggaacugagagagaccccccagcauggggaaaagguaagugagagacccucagugguccacauuuccaccaugaaaggauucugcaguucuagccacgggagagcuccucagcccuugcagucccugaaacuuaacauaggaggugccaggagauuguucaauggaacugcuccagaacggagcucgcacugggucccccacacuuccugagaacaaaacagcuacagcaagaugccauuuaaagcccaccccccaaaagacuguacacuguccuggagucccugagugccagggcugagguguaagagaacugcagacuguuuuccccagagcugaggcauaagugacuggguuacugcagcuggggcugaagcacuacaaggcaugugcuccuguuguuguggcugagguacaacuauggugccagcuaccauagcaggggcugaggcacaagugccacuggagcugagugaggugugaguggcacaugcauuccccacuggccagcaacccugugcucuccaauggaagguaguaguacagcacugccacucccuauccaagcauucugaagguggccuagggauugcccugcaccugcccaccuugguuggcaccugcacacaucauagggagccugaagaugagacugcccagccuggcuuuacaccaccaccuccguggccagagcacacagucuaggggcugggggauuguccagccuaguccaccaccauuggcacuugaauacuccucuuggguaccugagguuggggcuuacccacuuggccacuacuaccuguauguaccacuugugggccugcagaaugggccgcccagccuguugcagccacugccaacacaagcacauaucacuugggacccagagggucauuucaacacugucacugccaucucccaugccacgccagcugcccaggggccugagaaccugaucacaugccugggaacugcugccacuacugacaucugaguaagccacccgaaagcccaagaaucagccugcuugaacccacuaacacuggugccauuguaugcuccucugagguccaaagacaggcaugcucuguccacugcugcuaccacuggugccuggagaauggcccaccuggcauuccaguccuuagcaaaauuuuaccauagcuuccacuaguaacuacucagccacugaggaaaucacagauaccacugaugcuauuuauagccaaagaaaucauacagagacuacacuacugcacauaccaagaaucaaagccaaaguguccuacccaaacaacaccauagauacgucuaggaaaaaguccucccuuacaaaugcaaaugcaaaaaauuagaagaaacaacuguuacaccagaugugcagauaucaacauaaggacacaaacaugaaaaagcaaggaaauaugacaccucagaaggaacacaauaaauuuccugcaauagauuccaauaaaaaauaaacucacaaaaucccagaaaaagaauucaaauuauugaguguaaggaagcucaaugagauguaagagaaugugaaaaagaaaaacaauuugggaaaugaaugauaauuuuaucaaagagauauaugucauaaaaaagcaaaugcuggaauagaagacuucaugaaacaaaguacagaauacaauugaaagcuucaacaauauauuagaucaagcagaaaaaaaagucuuagagcuagaacacaggucuuuugacauaacucagaaauaaaaaagaauaaaaaaugagcaaagccuuugugacauaugggacacaauaaagcaacuacauaucuaaauuauugggaucccagaggguuaagagaaaaugaaagagugagaaaaccuauuuaaugaaauaauauuaauaggugaaaacuucccaaaucucacaagagauuuagacaucuagauauaggaggcccugauagccucuaaauggauacagugcaaaaagguauucucuauggcacauuauagucagacucucuaaagucagauaauucuaaggacagcaagagaaauguguguaagcaacuauaaaggaagccccaucagacuaacaguggauuucagcagaaaccuuacagaucaggagaaaaugagauaauauguugacagggcugaaggggaaaaaaaguaagccaaggauacuaugucuagcaaaauuauccuucauaaaugaaggagaaauaaaguauuuccaagacaggcaaaagcugagagaauugaucaccacuagacuggcccuacaagaaaugcucacaagaguccuaaacauggaagugaaaacaugacauuuaacacuauguaaaacacacaaaaguauaaaacucacuggcaaagcaaacacacagaugaggaaaagacucaaaugcuaccacuacagaaaacuaccagaguacaaugccaaacaaaagaaaaaggaaaaaaauauauaaaacaacuagaaaacaacaguauaacaauaacaaaaccucacauaucaauaauccuuggcugggcaugguggcucaugccuguaauuccagcacuuugggaggucaaggugggcagaucaccugaggucaggagcuugagaccagccuggccaacauggugaaacccuaucucuaaaaauacaaaauuagccaggcaugguggcacaugccuguaauccuagcuacucaggaggcugaggcaggagaauugcuugaacccaggaagcagagguugcagugagccgagauugcaccccugugcuuccaccugggcuacaagauugcaccccugugcuuccgccugggcuacaagagcgaaacucugucucaaaaaauuauaaugcaaggaugguuuaacauacaccauucaguuaaugcaauacaucacaucaacagaaugaagagcaaaaaucguguggucaucucaauaaacagaaaaagcauuugauaaaauucaacauugcuucaugauaaaaaaaaaacacucagaaaacugcauagaaagaagauaguaaaggccauaaauaaacccacagcuagcaucauacugaauggggaaaagcugaaaauccuucuucugaaaacuggaacaugacaaggaugcccacuuucaccgcuccuauucagcauaguacuggaaguucuagccagagaaaucaggcaagagaaagaaaaggcauccaaauuggaaaagagaaaaauugucccuuuuugcagaugacaugaucugauacuuagaaaaaccaaaaaugcuccaccaaaacucuuaaagcugguaagcaaauucagcacaguggcaggauauaaaguuaacguacaaaaaucagaguuucuauacaccaauaauaaaauagcugaaaaagaaaucaagaagguaaucugauuuacaauagcuaccaaaaauaaaaaaagauacuuacgaauaaauuuaaucaaggaagugaaagaucucugcaaggaaaacuguaaaacacugaugaaagaaacugaagaggacacaaauggaaagacaucccaagcuuauggauuggaaaaauuaauauuaaaauggccacacuguccaaagcaaucuacagauucaaugcaauugcuaucaaaauaccaaugugauuuuuucacaggaguagaaaaaaacccuaaaauuuguacagaaccacgaaagagcuaaaauagucaaagcaauccuaagcaaaaagaacaaagcuguaggcaucacauuaccugacuucaaaauauaucacaaggcuauaguaaccaaaacaacaugguauugguauaaaaauagacccacagaccaaaggaaaagaaaauagaacccagaaauaaagccacauauuuacagccagcugauuuucaacaaaggugccaagaacaugcaaugaggaaaggacacccucuucaauaaaugaugcugggaaaauuagauauccauaagcaaaagaauaaaacuggaccuguaucucucaccauauacaaaaguuaagacagauuaaagauuuaaauauaagaccuugaauuaugaaacuacuagaagaaaacagugcagaacacuucaggacauuggucugagcaacgauuuuauggcuaagaccucaaaaacacaacuaaaacaaaaauagacaaagggaacuauauuaaaaaucuucugcauagcaaaggaaauaaucagcacagagacaauauguugagugggagaaaauauuugcaaaacuauucauccaacaaaggacuaauaucuagaauauauaaggaauucaacaaaaaaucauauuaaaaagugggcaaaagguggggcacagaggcuaacaccuauaaucccaacacuuugggaggccgagguagguggaucacuugagcccaggaguuugagaccagccugggcaacauggugaaaccccaucucuacaaaaauuagucggguguaguggcacauaccuguagucccagcuacucaggaggcugaaguggggggaucaguugagcccaggagguugagacugcagugagccgugguugugccacugcauuccagagccuggguuacagagcgagauccuguguccaaaaaaaaaaaaaaaagguggggguggguggggggacaaaagacaugaauagacaauucacaaaagaagacauacacauggccaauagguauauuaaagaacacucaacaucacaaaucaaaagggaaauacaaaucaaaaccacaaugagaugucauuuuaucccaguuagaauggcuauuauuaaaaagacaaaaaauaauagaacuggaggucauuauguucauuggaauaucccaggcacagaaagacaaauacacguucuuacucauauguggcagcuaaaaaucuugauuucauggagauagagaauagaaugauagauagcacagguugggaagggugugagaguagaagggggaaaugaaaagagguugguaaauggguauagacuuauaguagauagaagaaacaaagucuaauguuaaauagcagacuagugugacuaugguuagcaacaacauauuguauauuucaaaguagcuagaauagaggacuugaaauauuaccaacacacagaaauaauaaauacuaaggugauggauacccuaaauaugcugacuugaucauuacacauucugugcauguaaaaaauauucacauguaccccauaaauauguaaacuaucaauuauaaaagaauaauccauccuaaaguuuauauagaaucucaggggaccccaaauagacaaacugagaaaaaacaaaguugaaggagucacacucacuugauuucaaauuguacuacaaagcuacaguaaucaaaacagugugguacuggcauaaggagagacauacaaaaccaauggaauaaaauaaaaagcccagaaauccccacguaauggucaauugauuuuugacaggggugcaaagaccauucaaugggaaaagacagucuuuucaccaaaaggugcugggaaacuggauauauacaugcaaaaguaugaaauuauacucuuaccuuguacuauauacagaaauuuacuuaaaauagaucaaagaacuaaaaaaagcuaaagcuauaaaauacuuagaagaaaauagaauccuuccagauuuuugauuaggcaauuauuacuuuuuuuuuuuuuuuuuuuuuuuugagacagguucuugcucuguugcuggagugcagugguacaaucaaaccuacugcaguuucaaacuccugggcucaagcagucaucccaccuuagccuccugaguagcuaggauuacaagugugcacaccuggcuaauuuuauuauuacuauuuuguguguggguguguguguagacaggaucuugcuauguugcccaggcuggucuugaacuccugacuucaagcauuccuccccaaccucccaaagugcugagauuacaggugcaagccaccccaucuggccaggcaaugauuucuuauguaugacacucaaagcauaggcaacaaaagaaaauaauaauuuggauuacgucaaaaucuaaaacuuuuguguuucaaagaacacuguuaaaagaaugaaagaacccacagaaugggagaaaagagcugaaaaucauacaucugauaagagauuuauauucagaauauguauagaacuccuaaaacugaacaacaaaaccaauucaaaaacgggcaaaugauuuagacauuucucauaggaaaauauacaaauggccaauaaguacaugaaaagacgaaccuuuggcauuagggaaaugcaaaucaaaaccacagcgugauaccacuucacacuuaagauggcuguuacaaacacacacccagagaaaacaacguguugggaggauguggagaaacuggaucccuugugcauugcuggugggaauauaaaaugguacagcuccuugggaaacgacuuugugguucuucaagaaggugaauauagaauauuaccaugugauccagcaauuucacuccuagguauacgccccaaggacugaaaacagggacucacauaugcauguacaucaguguucuuaguggcauuauucacaguagccaaaaggcggaaacaaguacuuaccaccagauaaauaaagaaaauguguguguacauacaguaagauauuauucagccaaaaaaggaauaaaauucugauauauccuacaacauggauggaccuugaaaacauuuuugcuaagugagaugucaagacacaaaaagacaaauauuguaccauucaacuuacaugagguaucuaaaauaggcaaaggcauagcgauagaagguaaaauagagguuaccagggccuaagggguggaggacauggggaguuguuguuuaauggauauauaauuucuguuuaggaugaugaaaaauugcuggaaauagagugaugguuuuauaacauuguaaauguacuuaaugcuacugaauuguacacuuaaaauugucguaauggugaauuuuauguuauuuauauuuuaccaugguuuuuuucuuaaagucaacauggaaaugugaugaguggauuugaaugacaagcauuggcuccccucagcuacuaaauccaacacaaagugacauguugcuguccuuugugggacagagcaggaauggcaggggguggccauugccauuggcauuguucucuucugucugagacagguaacuguggguacaggaagggccaaucuguuuaucuguaccugguuucucauggcuuucucagccagcugcaauuaaggaccauuucuuuaugaaucacagaugaugaaccucucugauaucagccuuacuuugacuuugauguuaggguugcaaguuacaaaugaagugaagacaucaguagaauacauaucagaacuagacccagcugcuauuauauuggaacaguauguucuggagagccuggaaggagagggcaggaugaagcauuuuaggacaggacuccagagacggugguggcggaagccuggggagcuagggggauuuagugggccuggagaggccaaaccacugcuccugcugcuaggccuaggguuuagcagggucucucagagagucugauggccuuacaagguugagccagcauccuguccuuaacccacauucccucaggcuggagggugggggaguggguggcagaaggccauucauugcucauggaauuaagagguccucaaagccagugaugccacccugguauagcaaggaccaggcugccuggggggcaggugguggcagcugccguagagugacaggcauguguuuucuucucagaaacagacugaauuugaucugauuaaugugaaggacuggccagucugggaaaccgccugccacguggaagagccaaacccgacucucugcugccacaugccguucccaugcccggcugcugggcaccugggagagcuuccagaauccucgcagacagcccagagccugccgcuacccucggccugcccaccaccaagcaagcagcaagcaagaugggguucucaucaguucuuccucccacaauguaggaccuuuccuuuaccuuccaauggauaaaauaguucagaguucauagucauauucauagacacagaaucaagcuuuuaacauauacauccaccucuauauguuaaauaaaacaucagauuaucaacacugucauuacguagaaacuuugguuagccaagcagugcauugucaguuacgucaucucuaaaaaugaccugugucuguucucuggggauugcugggucacaggugccccucaccuuccacagucaggcagggaaguuauaggcacaaagcuacgucuggaaccccuuugugcccccuuuguguuccucaaggaagcaguaccuuugaagagaucucugcugcauuaagugaugaccggcuacguuucaugucaggcuugcuuugccuugugggcuacucagugcagaaccugcuguaacccucaguucaaaaaauggacuggcaaugugauuagcguuggaugcuuuaccauucucuuuaguuguuaccguaauucugcuuuuucaugggaguuugaaucauggaccauaacuuuucaguuaucagaucaacuaaagaaacauuuguuguuaagccuaaugugcugaccuaugugccugcauuuuuuuuuuaaucuagacauguuuggagugagagaaagauggaaaaaagacaugggguagggacguaaguggaaaucuauagccacagccugaagcuuugaccacugcgguuuucagagcccuuucuccacacucauuucagagccuccuaugguuugggaaggaauaacacacuggcccauuaguaagggugaaggcuggagggauuuguugacuucuuggaauuaucagagguaggguggucuuuagcacaaagacuugcaugcagagaucccuggcagaacacccagagugcccguggcucccaccccagggucuggccggugugcuggaugcaugcccaagggugcugggcaucacugguccuugugaggaugcuuuuaaaguuuuauauuuauguccccaaacuuggaaacaagaacucuacuuuagccuaacccucauguccuuuuuugaauugagaaaauuacaggaaauggugccuuugaaaauuagaaaacuugcuuacagagcuguucuaaaugguaaauccucaauuuccccaagaccgguugcucugagaguagcugguaaagaggggcgaacuaaagaccuguccaccuguagcuccgcucauuucuuagaaaccaccugcuucccagagugccaagccacaaguaccaggcuucgugggcacagacaccuccugggcugggcagagugacagugcuagaagaccccagagagagggcaagggcuuugggcaagaagcacuggugguguuuuagggaccguccuucuccccuacccagggaacuggaccuggcagggcaccgugcucauguggcuccaaggacaagcauggcgguggccccuucugccuuccaggagaggucuugcuuuugaaaccaaaaucauguucuucuaaagugucaucuucugcccucccugucccaauagggaccacaucuuauuugucucaaacagggacuugugaguacuuggcaaguuuugcagccuauuuuuguauucuuaauuuggggaguaaagauguuuggucucaaaaaccuuugaggaauugccaagaauggcgagugauugcuuuccuucagagaacagacacuuggaauuucuccuuuuaguguuuauauacgugcagauuaauuuauauauauauauauacacacacacauauacaguauaaauacucauuugauucucguaaaacgcgcaucuggcgugugcaguugagaaacuugguggcacauggguguugggggaguagccuguguuggagggacaccagugcacuaggcagcuggggcggcccaggcugaagccaucuccgggugucugagaaaccacccagugccucaccuccagauccugcuggcaucaccuccagagcccugcaugcacuggcugaagaguuggucuguggagaggauuuucuugguuacuuguauucacgguuaauuuacaacccaaacagcaaaacacaguugguggacaaguucaugcaggaccuacagugacccagccaugggcacuagcucaucuuucagguggaaaaguacagugcugccugcccugguauguuuuucuuauagauguuagcccugcccaacagccagggcuacacuacaaaaggcaagaaugcccauguaaggagcccagcagucuggacagauccuucuuccucugcuguuggaugagagugagugaguaugcucuggaccuuauccuugaaagaugaucaaaagcgaugaugagggaggcagucaucacgcaggugcuuaaagggacauuguaggagguacucaaggguuugggggcaaaacccugaauccagccagucgugcacagagacacacccacacuagcccaguggcagugggggaugugggauggcagcagccagguauguagcccugucacaggacagcucacugugguuuugcacacugccuaaggguuaaauuguguuguugccuucaguagaaggcauuugugggcugcagaguugagaguugggugagguuagucucuccugaagaaaaagccuauaaaaaguggcuaaucuuaucccuuuucucuguaugcaguuggacucgucagagauaguaaaaucaucuuuuaguguuuuuuuguugcugaugucuuguacccauuuguuuuuuacaugggguuguagaucgaguucucaaaggugaaaccagaugaucauucugauaaaggaaauuuaaauuugauacauaugcuuuguauauuuugauuacuuguuuucguuuuugacuauaaaggagcuuuuuuauuuugggaggggaggagugucauuuuugagaaucuuggguuccugaaaaagaacgcccuaguuggauggcuugccagggccuugggguuugguagugauuguacaacuuaaagcuccuuucucuuggcugagugacagguggcuguucagguggaccaaagcaccuugacacaaggacuccacacugugcucucuaguagcacaaggaggaaguuggacagaacauuggguagugccuugcgggcucacacauguacuaguggucucaucuccagcuagccuugggaggccgucccaccaggaaaucucucuauuccguagccugagaugugcccuuguggguuuuauccugcucagucaguggccuaggggcagguccuguguucucucccucucucuccuggcucugggacaucugucccuggcugccuuucauggaggaaggacacuggccuuucugguuggaugcuguguggaugcucucugcuugagccucguggucucuugucucuuuuuggaccaauauccucagauuggugcagcuuuuucaguucagauaucacaccccaaguggauaaaggcaacuugcaggagaggagagccagccaagaagaaaauuuuaaaaccaaaccucguuuaggauuuuccuaaagucaucuucucuuuuuucuugcucagaguuuaccugggagauuucaccaguuugacucaccauuugcagaugugcuuuuguauuaaauuuaaauuuucacauaucacauccauucucaagguaguuauaugcuggagaagaaaaauccucuagacacaugaaggcccacauagucaagucuuccagggcaaagccagcagcccacccaggucagguagccagcagggcucaguuccccucacuccagacacggacccuccucuucagggucucuugacccagcuuccuucucuccuuuuaccugagagcacagaccucucucagccagccugcccagaccacggggggcuacucccauguaguuuggggagcacuugaucucagaaaagcuccauugucugagcaaaugggcaguuguggagcucaagccuuucuccugugcucaagucccuuccccaagcaaggcuucaaccucaucuacccaccauguaguuuucucuggccauuuaaguggggcggcagggacaugguugggccaugccacaccagggcuggugaggcaaccaguuuugauuuugacagaguggcuggaggaaaaguggcaaucaaggugcugcuugguuugcucugagugcaaauggaaccaacagguuucugcugcaaucuguguguucccagugccaggucacaccaggagggguggggcagggcuaaccaaguggucucugaacucaccgagcgucugcacuugguugugaaguuaaugggaguacagagagcgucuggccuuggagagggguugagagccuccuuuuugguucuucauuccugagcucuugccugcccacaaaucugaccucuuugaauggggacgcaguccuucaacagagaaguuucuauggcaaagaaguuucuauuuagcucuagauccagcagagucauccauucuaacugcccugaagucuagagcaggggagggaacccagaggcuggggaugagacuaggcagacccugguuaccauauggacaaggacaggggaaagcacccccuuccucaauuucugaaaguucuaucuuuggguucgcaggacuuugaggaugauaaagaacauauagguacuagcuuguuguugcugguccaaagcuuccacagcccugagaauuuggcuuucguggcugcucuggcagcugagcgaagggaggaaggcagccgcucugguggggacucuaggcaccuucccugcuguccacuuggauaggcggugagccccaggguacugagaggagccugagcauuuaccugccauuagugccucuuccuucaggagacuggcuugaaacguguguucaugugcgcgugcacacacacacaugagcaccuguauguguuaaugaauaguuuuucuugguuaaugcuuuuuaacuucuguuccuuuccguaaguggaugauucaaaauuaacgugacuuggcugggcgcaguggcucacaccuguaaucccagcacuuugggaggccaagggaggcggaucaccugaggucaggaguucgagaccagccugaucggcauggugaaaccccguuucuacuaaaaauacaaaaauuagccgggcgugguggugcgcgccuguaaucccagcuacucaggaggcugaggaaggagaaucacuugaacccgggagguggagguugcagugagcugagaucgugccacugcacuccagccugggcgacagagcgaaacuccgucucaaaaaaaaaaaaaaaacuuaaugugacuggaguuaaaagugaaaugucagguuguuuagucacugaauagagagcuacaagugcuuggucuuucccaagaaucaaaccugaguagaaauacauuuaaaagaaaaaucuacaugguaccuaugaauccuguaauuuguuuagggagaucuugucacucaucccugguuccugcccauacuguuuggucucguucuugcaguuugcuuggaacagggccagagccccacaugagauugucagcaggagugaggagcgccagucccuacuccucagcagggacccagcacagcaauccgguuguucucgguuagacugggucggggccaggggagaagcagucaccccuguguagaggguucccgcugugcuucugagcaguugcuuuguucagaaguguuaggagggucagauugugccauaauuguuauuaaagagaaaacacgcccaccuuccuuucuccccugcuggccauuguucauugaguuuuacugagggcagccuuuguggaagucagggagguugccaaaggccuguagaugccuccugacaaggucuugauuccugguuuucuagcacccauuugcauuuuggucuucagcacaaagccuuguucccuguggccggacuucugggcaauaagacuggggagugacuguugagcagucugcugucaggagagauggcugaaaaggugaucaucuuggugcuaaacaaguaagaggcaacugcccuguuuuuguuuguuuugaggcacaaugaaacuuuagccaaacucugcaagagggucccaucuccugccauggccaggugugagagaccaaaccgagaaaacagcauacucuaucacuuaagccuuggguagaaugggaauucuuuacccuggguaaacguuuuaacaaaaaaauggaacuuaacuucgguuuggacuguggucgugcugaggcaggagugggguugcccucuuggggcugaaucuccaggccucacgagguccccuguggggaugcugcuauuucuaagaugcaaauugcacauuuccuagauuuuguaucuguggauuuggauaagggaggggaacacggacaaauugcuuguacaauuugaaaugggccucaaugguacuucaaaccuuuugauuauuccuaaauaaaaacauaaauauauuucacaucugcugacuuauuuugugggggagucaggaaaaaagccaaaaacauuucacuuguucuugcccacuucuguggaucuuaaacuccaguggaugaguggggcaguuucccucagcucaccagagaaguuccaacucacugucuucugcauugcugagaucaccacacuggcuucuacaugagaaaacuaugauauuuuagaaauuaugcuaaauagacaaaggcaaacagucaaaccugguaucaucuggugagaggacacuggcaaguucuuuucuguuuccugugagagugcugaaaagcauagccugucauuugcuggggcggugucggggguuagggaauaugcauaaggacccaggggcuuucuggaggaaaaagacuaaagccccagcuucuaagacccaaagcauuugaauuuuguugggguggcccugaaggccugggacagaaggaaaaaggguccuuugaaaugaaaucaccuacaguggagccaggcagugauucuggacaccagaauaggaguccagcuuaugucauggggaagcagcuguguguguugaaucccaaaaaccagguccuuggaaacuagaccaaacuggcaugcaacuggcaaagccaaucagcugaaugcuguaguggguagacucaggcagugacucacuugggauacuauggguggaauucgcaggagcggccagccagggggguugcugugggguuccuccaggcagggaacagaaugccuagauuaaccccuaagcacaaguccccugggaauuacuaaaguacccagagaagacaggaguugcagucugagacugugcuugauccauuuaauuaaaaugugaagaaggcaugauccuuucauucaccgaguuagucuggugggauaaccugaaccuauuugcuuucuacccacccucaacagaacucacauggugagugaugggcucaaguugaaagacaagugagugucuagguccuuagugauguucaagcucucaggugauguucaagaugugcuuggucaggaggcagaccccugccuuuucugcucauggccacagauacucaacugaggucagaaacugcuccugccaucuucccgcagggcagucuuuaguccuguggcgggggcagaaugccccugaccuuguaggcucuacuuuguauguguacaugucugcugagccaaagcuguugaaagugaaaggucugucacuuugaacccagucuacuugucccuggucugucagccagaagguucuacuggugauggcaggagaacaaggagccugcaagggagcccaucuaccuucugguaccacugacuucccucucccggcccugccugcucuuuugguuugugcugccaaaaucaggguuuuucaacccuuguuacucauuuaaaucaccuugagagguuuugaacaauaccuaugcuaaggccccggguaccaguauuuuucagaagcuccccaaguggugcuaaugugcuguuaggguugagacuccacaggucauaacccugagcugucgcacuguagggacacggccugcaugcaugggauggggcaaacaacuccugaugccaaagcauucggccccaaguaagggucuuccccaccaacaaacacucugccuucugggucaaucaacauuugucaggucuggaggaaucuugaagugaaaaugaucuuuaaauuugcuugagaguuggcacguuuuccacuaggaagaacaaucaaaacauuugcagugaggcaaaggcaaugucuuacagagcccaagagaggugagccucaggucuacaaagcugccuuaagaaaggcagagcugucuguuccccagguuguguuccagaaagacacuuguucagcaaauagagauacguauugaugaaaacuaaaagggucaacacuaacaaacacgccaaggacguccuaaccaacguggaugggcccuaacagaagggccuacacaguccucuuccuucucugauaggaaaccuuucucuccaggccauaaaaaccuagagaggaaacauggaucaugagggcccaggugaauucccacccaccaccuucuuguguaugggaaaaagccacccuccucucuaugaacugggacugugaagcuguaaaagaaagucacacaagaaccugagcacuaucgcuguuugauacuggcuaucaucaguucaugucauccacggaaccggaucuaucuuaaauuuuuuguguggcgucauuuuuguuccaucccagcacagccaacuauggaaacagagcuucaggaagagaagggccuuucaacuguguugaaagggcccagagauuucagcugccaaguccuagaggcaaucagaauggcaccuggcaguguuaacgaacugaaugcaacauuuuugaaaggagagguuucuguggaacuggaaaggggcucugguuguuuccagcucaccaccaaaacuggcuggccacaaagaacccaggcaggauguacucugcucagacacacccucagagggugggcaggagagaguggacccacaacuccuguuagcccagaggagggguuacagcucuugcugcuuaaccugagaaauuuccagaaauuuccuaccugcuucuacugcagaauaaucaucuggcgacuguuucuagugagcaugucccaugcaacaggcuuuccugagcccccgaaagagcauacaagucaaaggaaaaaggacaugaggaugauuuauuuggcagucagaucuuaagagggcagcagaacuagcaaauggccaacccugagcccaaaugugggcaguagguuugugugugcugaaugcuggcuaugcuaugaggcaccuuugcgcccacgggccuggaccccggccucuguccucagaggugagggcugccuuucuaaccuucccaucuccaucccuggaucuuuuuaccaguuagaagcugcagcaaggauggcagcuucauucagcaccuaacugccuguaccccacccacccaggagucaggcaacuccucaaucccuuuuucauuccucagggaaagcauacugagucuucuuugacuuaaaaacaaaaaaccucaccaaaauaggcucugcuauuucuucucuucccacccuggcccgccccccauuccugacagugccuuacaucacaaacuaaguccucuuaacacagcaggcagcccaccugccacucuccucuccaagguuucccuacaggggugaggagcaggaggaguaaauaacuuaguuacaauaccauugagacgaaaaauaauacugcuauuuuuaacaugauccccuguaucuuucaggcugggucauguucccagccaugggcaaugugcccuugugcuguguccuccuccucaggcagggcagaacccuucuccaugcaggcccuacauuccucugcccuggcuccagggccaaacugcaggggcaucuagcuucucacccugcccagcugugguuuuaaagcuacaggacaauguaaacuuuguuucccuggcccagcaaggcuccuccuccuccuccacucuuaggaaugucaguagcuccuuggagucuccugugccacuggcugaggcagccucucucuccaaggggcuucggccaugguccuggccccacaagauggaaggauccaucuccagaagucagggccagaugugugugcuuaaugcgaaacacaguacaguuuuugccuucauccagagcuggggcauggaggcccaaaacaguaauaacaucucauuaauggcuugguuucugucuagcauucacugcuggaauccaggcuucaggcugcgagacccggaaggccgccacagggggcugcuuccaaagaacccaguucgcggcauucuacaaggcgcacagcaccugcugcucuccaacgaggcugggguacaacuagaggcgguugucuccauugacccgaguccuucuuggggcccuggacagaagggaagaguguccuuacuggcaggcagggccuugcagcccaaugccagacaauauuacaacuuuucuacccaggagaaagaaacacugaagaaggaggaccuagccacugccuuccuggcucuagcaccccuccaucuuccucaccuucguucucgacugucaaaauggucugcgagaugcuccugggagaugcggaaguccucaaacggcugcugguagcgggauucaaaggagccuucccgggcucggccaugaaacagcuggccugaggcaucugagccccgcucccgcagggacguaccacugaagggacugaggucaccauucuccugcuucaacgaagccaggugcacaagagggucaaugacuccucugcacuucuagaggcugcugccuggcucuccucccaccuaccccaggccagcccaccccugcugcagauaccuuggcagggaaaaugucaaucuugaucagcagggaggccaacuccagguccucacuguaguuguucuucaaaggcacugcucuguauccuaggaggaggaaaagccuggcccucagcccacgagggacagagcaaggggcccagccccacccugccagcaagauugcaggggcacugccuccaggaaugguccucaccugucuucaggccuuuuacugggaaaguagccugagccaggaaauucuggucacuaaacaugucuuccucauacaccacgaagcgcagaaaggcaaauucaggguuacugaucuggaaguggaagggcuuggcuggccauacaggguugaguccauuguccacugugaaggcaacgacaaaaggcuucaggucaccgugggagaggaugggaugacugguggggagaggcuugcagugccccagcaggaugaggaggaugacugggaagacagacugacccacaaacucugucuucugcuuggugcugucauacucagcuccagccaccucaaucuccacaaaaggacacacaaugccucggccauucuuuggcagaugucgggcccccagcaccuguaggcagacaaagaagggccugggauuguccuuccugcucccuccaauuccccacugcggaggcucagucagcaucuguggaguggaggcagcgcgcccucugcugggcccccgggacacugcccauggagucccucacgacaucagggacccuaagcuguccagagcagcugcugccuguaguuuaucugaagucugagcuuuagccaaaauuuccaugugaguuuugcaaucuacuucauguuaaauccauuacuauuuuaacacagaaaucuuuuaaaugaccuccccuuagggaaaaaaaagaucucaucagaacaaaacaagucaucagaacaagucacaccauggcucugcacguccuagaugcauacagugacugcaugcuaucuucaccccuucaaagacucagcucaggccccacccacccugaccaccuugaugccugaaaauaccuacuuuuggagaacucaacauaaacagacuccaacggcaagcagccccuuuccuacccugaagcccagaugagcagcacccaccucaauagagauggcacauggcuccagcccgcggaggcugcucuugucaaaggggucgaaggccucaucccgcauggugcuuggcugcagcacguagccacagugccugcccgucaugaagagggccugguucaucugcauaggcuugucuggaagaggcagauuaugguguauuccaguccagcugccccacagugccccuccucacccuccucacaggggacuuccucaccaggggucuggaaguugagggccacaagcugacugccacagauccacaugggcaaaggaucguaguuggaggaauccagucgcuggcccuugggguagaugcgggagagcugcagucgauuguacugaaggaacuucuugccuuuggccuuguucacguauuucucagccuugguuuccgggaaggaugacaugucccgguagcaagcacguucugugccaaucucugggccaaacagggaaaacacuuacagagcccgcccacccaggaaguguuggggggauaccuaaauacucuuuuugcacccaccaggcccuccaggcacaugcacaccccgccugggcccuggcccuuacucucuucaucaaagggaacaggccggcaguagacgacaaguucagagagcuccagggcaaucuucuuccuccguuccauuaucuucccuucagugagcuggugacacacacaaggcccuguagccccaggcuacagcccugcccaggagaaggaagccccugccaaccuugggcaugcccacacugcaggugcucugggccccucucccaccuuccccuguaccuuccagacaccacacccaacaguaaaugagggagcucuguccucagccucauccugaaaucaucuuuccucuuuucugucccagaggacacauuugcccuccaacccucuuagggggggugggggauacagacuccucaucaccacccauguucccagugaccuuccagggauccuggaauuggccacacucccaaaugacacuuucugaccauuuauuacccagccucaugcugggguaaaaaugauucuucuguguuaccugugacugcacuggggauacaggccccuggcuugguuuccaucuguguccuaaggaugauccucacugccucagcgcccccaacucaaauauaaccacccacucuucauggcaaaucuccaugccaaaucucuacagaagcccacuuacaagcaccccaacccauccucuccuggaggacuuucuuucaguggcuuuuuuuuuuuuuuuuuuuuuuugagacagagucuugcucugucgcccaggcuggaguucaguggcgugaucucggcucacugcaaucuccaccucacggguucaagcgauucuccugccucagccucccgaguagcugggauuacaggugccggccaacaugcccggcuaauuuuuguauuuucaguagagacaggguuucaccauauuggccaggcuggucucgaaguccugaccucaagugaucugcccaucucggccucccaaagugcugggauuacaggcgugagccaccacgcccggccucaguggcucuuacauucagacucuucccuuuucagccuagacccccagauccaguccuucaaccaccugguaugccagcaccuuuuccuucuaggggacagccuggcaagcacccuaucccuucucuauuuggcuugcgggugcccucuccaaagcagcuacagacccaucuaccaaaugcacuuggugaaagggccaccaaguaggaauucccuaacccuugagaauacuucucuguucccccaggcucaggggaagaggccaccuucuccagaaggcugguccuaccagcuaagcuugggcuccaucuccucccacacgcugcucgcuccuuucagccaucugcaugagagccugcucaaaccccagucaccuguucucucccucaaggacaggcccuacaaaggcucugcuuuugccauuccagacucccugcugcccacugccaucuaaugccagccaugcugcugaugcagcucaaaagucucacaagggcuauuagcugcugcugaauccaaagggcacuugcaaguucuuaucguuccugucuuuaccucuguagcucucaacacagcagacccucucccucaccaguggccugcagucugucugaccugccuuuccugggcuccuuuccucgcccaugccuucucauauggagcuucucaauccaucccaaguucucuuccuaugcgacaccaccucaucccuucuaugccucagcccccacuccacuccugcuuccagcccaggacuucuccucuuaccucuggucuuguguauccaauugcccacuaagcagacccacuucaacgacccaucaguaucucaaacucaacacaaccuaaacacaccacauugcaucuuaugugucuguuucuucucaaucccuagcuaaggcaggggcuguggccuaucuagcauaggccaucggcugccccacugcucugagggggccugugcugggagcuggaggccucagcugccugacgggcccacacacugccccccagaagguuccagcagaaucucacccuggcgucugcugucugggccacuucacggaucuuuuucacccaguccugcagcuccuccugugagucggcagcaacauccagggaccagugggccaccgacgccaugcugauggagaagacgaagagccgguuguucuugcccucaggacggauggcugggagggcgagagcagauaacagcugggaauagacaucucacccccuccaccccacuccacaccgcaggcacuggcucaaaugaguucuaucucaucccauuuccuccuucccacaccccaugaggggaaggacuacucugcuggcccauuugacagaugacgacgcuacaacucaaacaagucacugcugguugugguggagccaguguuccaacucagcucugacucaugcuucuuccucaggccgugucucccucuccaccccaucuccaagccucugucacaucccugugguacaacccauuaggccuggggaugucagccaaccagcagcaucaacuuuguucugcugauucugacggguuccccagugccuggcauagguaaacaugcaggggucaaagcugacagugacaaagggagcccagggugucaaggggauguccagagcauggggagagcuuggagugagggcagacuuugggguucagccaucagcuuccucccuaggagcaggaaagagauacaaagaagaaucucacccuagggaacagugggcaagagaaacagaugggagcucaccaaucugacaagccggcacauccaagaccccccgcagcaaguccccuagggggcuguucucguccaagugcugugggaagcaaagcccaccaauggucagcauggcuacugcauaugugugugaggggauauccgugugcaugggacaaauacaucuuguggguguaccugugacugccaaauguagcacagguauaugggagacuacgugcauggccacaugggcugugcgaccagcccaugugacaggugucugugcaugcacgugcgugcuugggacugugugaugggggcaugccaaggagaaucugggaauagggaaugcuguuacucaggugguucuggucuuaccucccucuccggcuccagggccacgggguugaccaucucuuccacguaguuugaugggaaccacagcugcuucuucccuccguaguccccucgccaccugugggagccacagggugcugaccuccagcaaccaccccgaacucccaugaggaggguauccuuugguagggguucccaugccuaagccagggugaggcaggcacugcuggugcacacaggagacaagcacaucacaaaugcaugucuuuggggccccagcuccacuggggcccuuggacucugggccuaccacaccacuggcuuaccagccucccucuugcuucuccacauucuggaugauggcgcucuugaugaaggucagcucguccucccucugggccuuguagucaaagagggcuuugacugcacacugcagaggugagaagcaccagucagagcagaaaggcucucccugccacugccaaccuggggcuucaugugcacacacacaugugcuugggcuucccugccuggggucaggccagugggagaugacacugccaucaacaggcccuaguuauaguucuuguuacugcccugcagggaagcuccaggacagauaugaucagagaggcagggccucugccagugaaauaccucgggacccagguggaaccuuaagccccacccugggccacagggagaaccuugaauccgcucccaggagucagggcuggcaggccaagaaggcagggucugcaguggcccugagugccuccccgggaccuggaagcauauggggccuggaugggacccuaccacucaucugugaaguggaaagaaaaacuuccuuccagguccccuggcuguggaggggagggggugagaaauagggcccaggccuuuuuagagaaaaaggcaaaacaaaaaagaaccuguguaacagggcuccaugaggccggggaaugaguggccagugugccucccagcuccuaccccgcugcugcccaggaaggaaacaggggucacccacaggagcaguuuaaagggucacugcugacuuaagggguaggggcuagggagugggucggcccugggagaccugcggucgcucaccaaccacacaucucucacaaccucuugggccucggaaaaccacaaccaccacuucuccacaaagaccacagauggcccagaacacagaaaugaagccccaagcagcuggggacccuccccagcuuccuaugcccagaggccugagcuguaccuugaaaguuggcauaggguuugccucuacauagaagccaggguugcgucccucauacagggccccguagucaggcuccuggaaacaggacacaaugggauauguuaaugccccagagcccagagguagaaagcagcuacugguuucuggagcagcuucccuuucccccagugcagcaaacuugcaccugauccacagggauccuucgaccucaguagagacggcuucagaggccucaggcccggccucacuguucccuuuccuuucuucacauucuuacauguaaggcccagcccaggauucuaaaaucucucagguccuaaaugcccaaacucccaaguauuucugagcuaugugcaggugggcccuucacagacuacccauauucagugcuuuaguucaguggcuuguugguucacugcugagcccaaagucaggaaaagccuucccacuccccacauuccuccugccgcuccucuccaucacuugagucccaggugccaguggacaacaggccucucucuccccagccagcccugucuacugacgacagcagucucucaacugaucuucugguccuagaccccuuccuucuguccagggcccuuaucaccagcugugcugccauggguccugacuuuuucccucacuggucucaccuccuguggcucugcccuccauaccauccaccaggcggaggcuccacaaccacucuuggguagccucaucucaucugcccuaggacagaguccaggccaagcccagguggaugaguuuccacugugugcaccucucccagugugagccccagaaccuccucacuccacaucuugacucaugaggaacccucugcuuaugugccuguccccauccuuaaagaugcugcucagauguccccuccugcagacacccuccugguacccacacuguggcucccagcuggagucaggggcccucccacgaacuucuacaacacaccaggucuugcuguuacacacauccagagacugguaagauucugggucucuccugccuccccugccaugccccgucuaccacagcccccucacagcugugccaaucuucuccagugccuccucguugaugggauagcgcagcuucaucuugcgguauagcggguguuucucauaguagcugaugaggucaacaaggcugucgaacuccgaguucccuagcaucacugucuggcccucuugcuggacacggcaaugcuugaucuugcccucagcccuucacaaggacaaaacagucacacagggucagggcagcucagacccaagcaaggccccacaacccagugccacaccccucaccggaaagagauggcauaugaguuggguucauuccgcuuccgcaccaggaaggccccaucacgagggacgcgcauuagcaugugcucagccugugcucuggucaggcucgcgugguaccaccugagaacaggcagagucaggcccggccagcaccacccauggcccugcccugccuuguccgcccccaggcccuucccucacucuuugcucucgugggcguuggucugugggacaggcucugaaagucgcaucucaaacucauuacagcgcaggggcaccugcugguagugcgugaugaggucauagagggagucaaagacgagguugucugucaagaagaacuugggggucccagcaucuugccgggaguggauacggcagugcuggacuuucccguuccgccuguggaagacacagagugagggaggcuggggaaaacaggccagggccccaaagaccaaguuccaccccaaaugaggguggaacucaaggagggagccucaaggagggaggccaaucuccugaggagcucaggugugggcagucacaugaaccaaaggugugggcuucaaaugaaccgaaaagggagggguauggggggggggugagacagagaguguguguguguauguaggugaaauuauguuccauguaaagccuaauuauuguccuggaucaaaggcucaaauguuaacugauuaucucugggugaugugaugucuguguacacacgcugacugaacauacgcaucugcaugggaaguguuaccagaaagagagcguguagucgcccacgaaggucucacucucucgcacgaggaaggagccgucaggggcuccggucucgaugcaguacucaguaagcaggcgcucagcgaugugacgcccgucacgcccugccccuagcuucccauggaaccacuucucauuggagugcagcucugugcugcugcugaccugucaggggaaggcaacagcaaagauacugugacccuggcccaggccugaccuggcccagcccccagaccugagcugguuccucaccuccuugggcuccuccucauccucguugcccuggucacugcuggucuccucagaguaguagaucuugcugcuggucagaacaaaguaguggggauaccauuccuggaacagaccaaagagggacuugugagccaggguccucacacccacuggccuaccacccccagccuggcccaguccucacgugguucacaggguccuccagguagaggaugccauucuugauagaguugcugaugucguucucagaguacaucauggauguaggcaccuccucguaggcacugcccucagccagcuucuugugcuguaggggcaaccagaacagggcaaugcagaccccaguccucaccccaccuccucacccagguuuaggcccaacagcugaagccauggccugggcaaggcacugagaaguguggggcuuccgcaauaagcccgccaccccaccuugaugaggaucuuccucuuaagcugguugggugaggggagcccgucggcagagaucuccacgggcuuggugaggagugugucccccagcaccuucuugaaguauugggccauguuucucugcugggcaaugcugcagugguccucaauggacaggaugacuggguaccugcgggaugggggacaagcacagugaaacagauucugcaauucucugggucuaaguagccccucacagugagcuguuggaagccaagggccugggggcuucuugucuguaaaaacuaucccagaaaagaggcaggccauagccacugguggggcagagagggguucuacagcuguggcagcaguggaaaccaaaggguggcaacugaugcagucccgagcuggcccaauuauggaggcugcucagcagugcaagaaaaauguuucacaccaaagaggccaggagagaggagaagccuccaaaguuagcuguuagagcccuggugagcuaagggagaccagugaccacaguuuaagcaguaaacagaauugaaggaaugggacacagggaacagagacaaucuucugggcugugagggcaaaggaguuggcaggacacuggccuaaagaaaccagggcauguuuucugaagaugagaagagcauguguucuacagucuaaaggacccaugaagaagagagugggcccaacacguaggaaacagaaaguguaacuugggaagcaacagcucaagcagggagcaggugacgaggagaggccaagaggaaggacaaagaugaaaggcugagggagaggggacagggcauuugaggagucuuucugcccucugucccucuagaacgagagaccuggagccaaguuaaccccugggucauccagccuccgacucacucugaggccacaaaggcaugcuccuugauggugugcaggacaucugagaacuugaucuuggugguaagggugugcccaugguaaauaacuggcaucccauccgggccgucccagcaguccacuggggagcaacaucaccauggucaagcgggcaggccucccaucuucccucccccagcccuggaccccacgcacacucaaugcagcgacagcccauccgcaggcagcgagcauaggcuuccaaggaggacucacuggagaacugguccccggucagguaccuggauaggcaaggagaggcagguagguauggucagaugggcccuccuggggaagaagcugggugggccugaaggagccacacucacguguugugcgaggaggagauccaguagugggaaagaggguuguucaugguguccgggcauacugcauccagcugcgaguuccacacacuguucucuuuggagaacaggaaggugacaaacuguccagaaacauguggaagggaagagacagugagucccugcccuguccaacccaagaugguagguuggggguaggagagagagugcucugucccaacugggggugggcaaggugcacaguagguagaaacaagguggcaucccuaaggagcgucuagcuccuggagcccgggugggguccuggucaccccuacucauucucuugacaaaaaaugggugaaacaucgggcucaccucauccaggaagaaguauggcuccucgaucucucguaaggggucucggaggaagcugagcaugaacuccugcaccuggaggcgaucaacagcccacagcuccugaugggguagggagggcaggggaugagagaagccuccagucagggaugagcccagccccccacaaccuaccagccugggccaaugucagcccagccauacccccugguagucaagaaggaacugcuggaacucaggaagggacacucggcaaagcuccggccgcuccccagcccugcagggagagaagguaagcuagcuaguauggucaacagacaacaaggugccccacggaaggcagaacccaacucccagccagcacagcuucccagaaugguccagcaugguucccuacucccacugccucccaccuggaucaagaaucgcccaguggagagaugaagggggcccagggaaaaccccaccuccccacuccaaaccaaaccucagaguacuggcuuccaagaaggggagguccaucugcaggaaacagaaccuggucagggcaagaccccugggaggccaugugggaaaugggcuaguaagaaggcaggcuagagcagcagaugggggcaggccucaagaggagaagaacuggagaaauggcacccaaaagccccuaagcagggcagcagggcugaggcaggcagagcuggggugugggguggaagagcaggggcagggguugagggagggcagguggcucaugcaccgucuucugggcgcuguacaugaggcugcgguacagcugagcaaacugcccguaggugauguccccgcugcgcugcuccagguccugcaugguauagagcaggagugccagucaggcagucaggcccccagcugaagggcucuuggcuuccccugcccccaucuacagacagcccuggguggcacuuaccgucagccgcucucggaggaagcgcauguuggggacccgguaguugaccugggacagcauguucuucagguccuuggcugauauacugagaaaacagggacauccccaguggucucauccagcuucucaugaccucugaccugugggucgagcccaccuggggcuggacagguaaacaacacuauucugggaaccuggaggccugagggcaagacuggaucagaacccauggggugagguuagucccuuccuuucuuuggaccucaguuccucaucugagcaaaaaaaaaaaaaaaaaaaacaaaaacaaaacaaacaaaaaaaaccuguaauucuggcaaggaagaugugaacagauucaguaaagugggucaggcaugggaggaagaaaaaccacacuccaggccuccccuccuaccggcacugcugaggccugugccaagguggcagucagccuauccaagacagaaggcagggcucacucacaacuucccuguugggggcagcauggcagcaggucccuaccugcugcccacugggaugcugggaguuugguccucagaacccacuaacccaugagagggaggaaggaggaggugcaugcuccaccaaauacaaugacuggcaacugggcaccuccuggggcuagacagggccuggcuccaggaaagaaacugagagaacaagcgccccugcucuccagggguguccugcccaggaugugaggcuggggacacugcuggaccuggcaacaggauggacaagaagggggaaggggggggcuuucucuccuggaagguggugucaaggaggggaggggagggugggaccaccuccucugggccccaagagccugggaggaggcaccaaaauuccccgagggggcugagcgccacacugaguggaucaagcacugcggagggagggcuggcucuauauaggcgcccccuccucugauccucagucacccaggagguaggugcuaucaggguccuuguuuuccagugaggaaacagaggccuucugguugcaacugccugcaucaccgaucuugcccucuguggucucuuucccaucagcauacgaacagcuuguuacuucuuccaccaaaaacaccugucuugccccugcuuagcucuccagcuacugcccucuucuuugcuccccuccauagcaaaacuccuugcaagagucaucuugcucccucucauucccuugagccccucaccgcuagggugacaccgcucuucucaccauguuaaauccaagggucaacggucagauuucaccacugucuucuuccuugggcugccagaacucaacacucuggggguucuccucuuaccgcacuaguugucccugaccccuccaaucucuaauauggggguggucugggaucagccacuggacccugcccuuuucuuggucugcuugcccccuaggugaucucacccagcccuguggcuuucaguguuaucuacauacucccaaguuaaaaucuguagccccuacuguguauguaccuaaacucacucuaaccaccugccuacucaacaucucucccuggacagcuaauaggcaucagaaaacuuaacaugccucgaacugaacccaagcuucccuccaaaugggcuagucccaugaucuucucaucucagucaauggugacucuguuuuccaguugcucaagccaaacagcauacuauuauccucaaugccucucacaccccaaaaucaaucuguuaaggacauucuuucuggcgcuaucuucaaaauacaacauggccaaaauccagccacuuccuaccauuaccaucaugauccaagcccucucauuuuucaccuggaguguggaaacagcuccuaacugagcucuccacacagcaggcagagugaucuugaguaacccaagucaggucacaucacuccucuccucagaacccuuccauggcuucccauuucuuucaggucaaaggaccucaccauggugcagcacccacacuaucuggucuuugcucccccuucucuccuuggccccucuggcugccauaccaggucucagagccagaguuucagggcacccuucacacgcuacuggccacccucaccuccaggacacccaaagccaguucuacacauccagucucugcccauaguggcagggcacacagcauguggcuggcuccucucaccagcucacaccaaggccaccagaggacuuugugcagaaagcuacacguggcagaaccuucugcccacccuccuggccccacuuaagguccccuggguccucuggcucuccgggcagcuacuuagaggccuggcuaagguucuggaugcccauccccacccugcugggcuacagccacagcucaguacuuaccgauccucacgauuccgauccacugaguaaaacugcuuccggagccaccuggagagagaagccugaggugagggccacuucuccaucuacagucaggccugggagaugucugggcacacaaaggucugcugucccugucccccuggucccuaaugcucccagcccuaaccccuucaggagugguucuuaccucucaaucugcaggggugugggugccugcaauguauccuccaucagccaaguuaagcccuugauccacauguucacuucauccucagauguggcugugagcaagguaucaauagcugccccgagggcacauaccucccacugggcaggagccagcaggcauuccccuaacuauccucuaccuccucuacccccuuaacucccaccuugcaggcucagcguuuucaggcgaaauuccauuccauagagaaugacaaagcaaugugacugguccggccggaaagcuggguccucuugauagcgaucaaagucccgugaggucuucccugggcggaucuccuuaauuucacgaaugucaacuaggaagguagcaaagaggccaagaucaagcuggggucucccagagucaacaccgaaaggagggcagccugguuuccucauucuuacacucucucucagggaggaaccccagaggcagagccaagaccacucagucacucugguaauaagagggcuggguugagucuagggauaggccuuugcuaaguaagggcugagaugucagagagggcuauaugggggaaaggugguucuguggggugucccuucccuaucuuuguucccucacugagacauuuugaccugcaaaagagcuagacuccagaagaagaaauagggacccaaggcuguucaugaggaccacuuccugacacaagguacacacaaaucaaaucauaaagucccagaggcagggcuggguaggucaagaugggccucaggaucccugggagaaaguaggcucuggcccagaggacuggugcaucccugaaaugccuaacugcuaaagccauccccacacaagucucagcaaggggccuaauccccaccccauccccugaccaaggcacuggcuguccaagagcagcaaccauccuggacccagaccaccauuuugccugggaccauuuccuuaucuuagcuauccaaggcccuugcaugcucccguggccuucacaaggcauagucagagagguacacgggcuugaauagcagaugaccugcccucagccacuaaaacuugaggcaaugaugaauaauuuauuuaacuucucagagucucaguuuuaccauguguaaagcaaagggcuugacugaguuucucuagaaggcagggugguagaaaaaacaugcacgagcucugggugagacuggcugaacuaaaauccuagcucuaccucacauuagcuaugugaucucaauaaagugacagccacucugaccucacugcuacaccugugaagagaguaacauaagaguaacacaauagcaucagaaagauguugguaagaucaaaagucguaacagcuagaaacacccagcacuauaugugggacauggagggggcccauccaauggacuccucugcucccucagcaaaggugcacaggcucugacacacucuccagcacagggaggggcugccugcuggcuggagggcagacauuccagcccagaaaucaccgauuuaagguagauuaggucaaaggaaaaaagcuuggcuuagccaacagcuaugacuuucuuugaguacuccccaagcucugaagccucuuaaaauccucuaaacccagacuggccugguaacuucggagccagaugcagugccagcauuugccuggccagcccccaccccaggagcccuuccagcccgaacugcacaccaaccugccuggaauguccuaacggcccaacucccccagaugcucucuuccuguccugucccucuagcaacugucacaaaacuccacaucuaucccaccuggaacagugggcauugcuucuggcccuaacccuagcuccccgacacauuucugguucuaccuggaaccaccuguccccucagcaaaccccuccagccuguccuccagcugagaguccugccuuuucugcuguuuucccugaccccugguucucacccaucagccauccuuccccagucuucuggcucuucauaaaacauuauucugaccccccuagaccucauucaagccccucccgaggcugcccacugccagucuaaggagaacaaacaacaaacaccuucuauggccuugaaggcucuuugugacagggcucaggaauuuaccuccccagcuuuugcccucucacccucucugcuccauccacacuaagccacaccuagggcaagaauagcuguugcuucccaucccuauuucaucuugauuccuagucuggaaauguccaccuccccggcucccuucucuuccaccaagggcccaacugagaagcuccuuccugugguacuaauacacuugaugccucgugcauacaaacacguacauacaugcucacauaccuaaggccaggcagggccccuccagggcuugcuuaaugacugaagaaaugaaaaaggcagguacacaggcagaaggagggaaaaccaaauagggauggggaacaaaaaugaacaguuauacucggguagaaacaggggcagggagaacugggccauaaaagaccuaaccgagaacacagggcuuccaaugacagaaggaggagcuuccaucaggggaaauggcuagaucagaaacugcagaacaaccacaaacucugccuuuugaaacagaaaccagucugcucuuccgguguggagcugcugucaucccccucccacaccuucuugcaaaggugagugugacuguacacacacacacacacacacacacacacacacacacagagucaacaggccugcacuccugcacauauuuccauugagaucaguugaaggcagaacaggugccugagauaggaaccagguaagcauagcgcagcuccacgccaggcauccaaugcucccaaguuccuguuggccacaccugaucccuuguacugucuuccguaagaaggcaccagccuggcccuggcagcacagugagaugcucuacuagguucuugaaagccacauccugugcuaccucccaaccucacccuucaucuuccugccucccagaacaaauauggcagcauccucuuucuugagagagccagagcugguccccagaaauucacaaggagacuccccagagaggaauggccucugcccugguggcaggugacagagcgaaugauccagucuggcacagucugggucagaccucucugccauuagucaggagggcaggaaaagagaccuucccagaacuuaggagcuugagaaggggagaacuacuuaggggaguaggaaagucacacguuauacccaaaaauccaugaccuagcacuccuccccaacucagaaccaugagaggacaacauucaggggaacucuggggaaaagaaaagccagggguacgaagaggccgucacuaugaagaagauggggcagugagaaggaggaacucuuugagaacaagggcaggaucccacaaguagcagcccagaagccugauguauagcauaaugacaaaggccuaaugcccaggcucgccuugacccaagaaggcaaagcccagccagcacagcccaucagggcugcagcauauucauucugcccagcaccacguccccaggcccauggugauggcugcccaggcuucaggaauggcaccauguccccaagcccacagugaaugcugccugggcuucaggaauggccugggcauuaccauuccaaauguggcuaugguagacagugacaagauaagcugcuuggggcagugagggggauuuagucccuuauauugaaucgcucacaaacucugaugaagaaauagauucagucuuucuuaaggggcucugaaguaaugagggaccacacacaccugugccuggacuguauaucacaugucagcucugaggacugagaaccuucucauaagccaggcuuccuggugccccaggcagaauccuggggccuugcucugcucccugcccugauggagaucugccuucuccugcucuuucaagaagcuuucccugaccauccccuucccagcuuagugaggagaaccacacagcucuuaaauucuagcuaugaggccuuggcagucccucacucuuuuggucucaguuuccccaucaggaaacuggaaauuccucuuaccucacaugguugcugugagggccaugcugggaagugcugguaauagagaagucuggagacagcccaccugucuaccugugugccuagugccauugacauggagccuacaaaagcuggcaguaguggagacaaauaaggccacuugccaaggcuccacuaggugcaaacccaaacuugggugaaauaaagaugauccaugaagagaagaauacaagcagcuauuucgccagcucaaaaagaagccuggcagggaugggggcauuguauggggagaagggggacucuuacagacuuguguacagauaagcauaugcagacacgcugcuuccugagccugcagugccccaccagcacacucaccaauagucugaggcacgugcauccccaaagaucaaguuucaaauccuggcuccaagcauauagcuaggccuuggcaagucugcaguccucucugguucaucguaagaugaaggcuuucgugggaguagacccacaacagacccuuacauguaggcacacuaccucacagauauccacauaggacggucagccuuggccugcccuuaccacgcccaaccucagauucauguguguuuuguuuuuugggcagaaggaaaugugccugcugccuggcaccuggggccagcucuaagcauuaaagcaaaaugccacaagacugaauuuguaaaauaaaagguuauaugacgaggccagggagacugggaagagcaauguuccuuuuccaucucuucccucuucuccccucccuucucagcccagggacagacuccuggccugagaccacagagauuagagaccagcaguuacucagagcggagcuucugggccaugcaguccuggacagcaucccccuuuuggacaugccaguaauggcaguugcuuucccuuuaaaagaggagccuguuuccucaucugagccacccuaugcccaagcacucugggagcugugaagcuauacaacccucagggccagcugagaaccugccucugcaggagaguaagcccccacccugggacagcacccaauccacugaguggggagagagggugcugucgaagggacaagcuauauggcgggcagccagucuggaaccugggaaagggagaagacaauaaccacaaaggacccaucugugugccuggcucuucugaagguagggcugcuuccugucuuugacucuugcucccaccccgacucccccgagacaucaggccaagucacaggccugccacuagcucucuuccuguccaguaaagugggauaaccacccugucuggccaccacgaggaugugcauaagggcaguauuccuguugccccggcagaguucaaggacagcaggaacccuagggaagagaaagagaagagcaaaggcagggcuccucagagcacagccagugagagccagccaauccugcccuagggggcagacacauggcaggcccuagaagggggagagggagcccaaucaucaaauccaagacccuaaauuagaccuaaguuucuuguuggaaccuguguccuaguauccccugugcucaaaaaagccacuuccaaauagcccaacagacagaggucccccaaauuuauaagccuguuaaccgcucagcaggcaaaaaggguguagagagguauuaugaacaaaagcacuggcaaggugggcaggaggccuggacccaucucucugagccucauuuucuucaucugcaaaauagaaucaccacuccuggcaccuccuucauuggacuacagugagaugccaaugagguaagagauacagaagugauuuaaucagaaagggacaggaggacauauugaaaacuaaacccaccaaaugaugaagauauggccaagaaaaccauaaccaaaaguaccccaaauuucugaacaugaaacaugcuuucacugaaauauuucucugggucugggugucucgcucuguugcccaggcuggagugcaguggugcaaucucgguucacugcaaccucugccuccgggguucaagugauucucauaccucagucucccaaguagcugggauuacagaugcacaccaccaugcccagcugauuuuuguauuuuuaguagagacgggguuucaccauguuggccagcugcucucaaacuccugaccuccagugauucgccugccucggccucccaaagugcugggauuagaagcaugagcaaccaugcccugucugaaauauuucucuucagagaggguuuucccuuuauaaagugcauacgcucacuuuagaaggcugaggcaagaggacugcuugaggccaggaguucaagacccaucuggguaacagaggaagaccccaccucugcaaaaaauaaaaauuaaaaaaacuuagcuagacaugguagcacaugccuguagucccagcuacuugggaggcggugggaaagaucacuugagcccaaggguuugaggcugcagaugaguaggaagcucuaugagcuaugaucacaguacuguacuccagccuggccaacaaagcgagauccuuucucuaaaaacacaaaacaaaaacacaaaacccaaaguguguaagcuaauugauguaaaugguagcaaaaacuauccauuuaaacaugcauggaguaaagaaauuuuguaacuuaaaaaaacugcaacucauaguaaauaugaaaggucucuuuaaaaucuaaagagcuugaaagagguaagcgaagauuuccuggacagguuccuucccuucuggggguuuuuacuacccccaccuguggccuguggaccccagaaccccucaaggccugugugccccacucugcagagggcacuggaggaaggcagggaaagcccagcccuccucaaaaggguccaaguccaauuaacacaacacagacaccagcccaugucuccccauacuccuuccugccucagccuuugcacaagccacuccuaccuccucacuuaagcccccaccaggcccaggccaggggcacacuaggugcccccuccucucuugugugucaccacuugucacaccugcuggugcuucccuggugucuuaggccacuggccuaugagcuccuccaaggaagaaaccacauuugacucuucucuccauucccuaccaguccaacacaaacccagggccuggggaggccucaaaauguucagaguacuuaagagcaggaguaaacacaugggaguuagauuccagagcuaauuaucuaacaggcagcaaaggccacagaugcucaaaaaugguaccagaaagaugguaucaaggauggcuuccuggaagagguggcacagugggccacagaggcugaggggcuacaacaaauacugaaaaugcaguggucagugagguaacaacgggaacagaaaaagcagcagcaggcauaguuggggggaaugugaccccugggggcaaauacagucuggaaacacugggaaguccuuacauaaagauuccuauagccagugggaaccacgggaagcuaacagagcuuugggaaaaacaguaaaagcagcaggaugccgagcacccacgcccugcugggcccgaagccaagaccaugaggagauucaggagaguggucccaggggucagaagagguguguagaucuccaaaaugaccucucaccaaucacccucuccacauguagucuguggcaaacagaugagucccucccaguuccccacucccauaccaaagaaaauacacagccaggaccuaggagagcauuaauggagcuaagccuucuccaccagaggaugcugaaagauggacaaagaaaaguuccagcagaagugaguaucaucugggccacuucuggcccccuaccucagucaccccauccccagguuccuauacaacucccugugggguacggcaggcacugcacugcagaucccccuucacaggcagccagaggcacaggggcucugcacccaucaggaccauacggcuuuggcaagguuuuugcagcucugaaggaaaaggauggagguagccaaagaagagacaaagauaggaccuggacacaggugggaaggaagccugaugcaauaguagccaggucacaggauggucagcauuuccaagcuggcugcauaugcccaaagccuguggaaagggugagaguucuccucucccucucauuccucccucuuccugagacuauaauauuccuccuccugccucucaguagaaacauacucacaaaucugagguuucccugagcacaucuggcugccaccaaaggaaggucaaaguggagggguggguagcuaucccuuuccauuuuacaaacaaggaucuggguucagggacuucugaggucacaggguuauauggcaaagggaaggcgaugguggggcuuacuguccuucccauuacugugcagcagcugccuucaaaccagacccgcgggcagcgaguuggacaagcuuggucuagauucuagacaaaucucuuugaaacaaugaggaaacagaggguccaaagggucuugucauggucauauggugagucauggcagaacugggacacucugcaguguccccacagcagcugcuaucccugacacuggguauacagagaaacacagagcagccacagccagccuuuguaccauccaggcaggcagcccucuucccuaggacucuaaauuaaucucaccuauuucagagguaagaacagaauccaaaggaaggaagggaaaggaggucccacccagagaaauuaaagcuggaagagcacucagcagugaucuauucggcuuaugcagucauucauuccaucaucugaucaaacauuuaucgggcaucuaucuacuccaugucaggcccugggcuggguccuagggaaacagagaucaauaaggcauuugaguuccugccuuugagaaaaccccugccugauggaggaaacagauggggaagcagauaacuaugaggucaugcaacgaguagaacaacagggaggugucuguggagcugaguguguguagagcaaugucuuggagugcucuguaaaagccaggucuggagggcugacaagcacacauugggcagagggguucauggaaaccaagacagaggugcaggaguccacuaaguuccacaaacagggcauucagaguaucauggaugagaagggagggaagauggccuauaccaagccuugacugccacaguagggaaagguggcuuuccccaacuuuucugcacaagcccagaagauucuccaggcagccaugggucagccucugugucaggagucuagugugcuccaaacucugccucccuugcagacugaugcugccuaaguucuuucuagauggccuguguaugccaggcuccuagcuacaggagagagacuggggacccaccagggccaugucucagggaugcccaggaccucaaaagucccucauaaaaugcucccccacauaguacacucaggcuacuuggagaaccagagcaauggguauaagucacuuuuaaaauuuuucuuuauauuuuauagagauggggucucacuauguugcccaagcuugucucaaacuccuggccucaagugauccucucacuucggccucccaaagugcugggauuacaggugugagccaccaugccuggcccauaagucacucuguuguccaggcuggagugcaguggcaccaacagggcucacuguagccucuaccuccccaggugcaggugauccucccaccuuggccuuucagguagcugggacuacaggcaaaccacaacgccaggcugauuauauuuuuugcagagaugguguuuugccauguugcccaggcuguucuugaacuccugggcucaaaugacucgccagucuuggccucccaaagagcugggauuacaggcaugaaucaccgugccugacccauaaaucacuuaucuaugguccuccuuccugacaccucagagcaaucaacaugguugaucacgcccucucuccuugaagcucugcccuugauuucuccugcacaaccuugccugguuuucaugcuucuuugugcgcuacaggccuaccugcauuuagcaauggccuuggucaaggcucaggucaagguccucucuuccggugcucugccuucuuccucaucagugucagccaugcccacacccuuaauuaccuccuauguacagauaauucacaaacaggucucuagccuaguccucuccucuuaagcuucagauccuucaauucagcugccuacuugcuauccccacucuucaucucaaaacgucucaaagacaacuccucaaaaccaaacacugucuucucucucucaccagaaccaaggccucuugccauacccccugggucagcuaagagcaucaccauucaaacagguacccaaacuccaaacuucagaaugauccuucgcaucuccuuuucucucaccagcccccaauccagcccucugagaagucccacuggcuuuauuauucaaaauuaaccauacguucugagcaccuacaugagagacauuaaacuagauacuuggaauacaaguaccucaaggagcuugaauguggaaggaaaaauuagauaugaguauuaugcuagauagcuuacguuagaguccacagacaaauacuauaagaagcugagaaguagaggaugaaguaguuacuaccucugcugggugggaagagacgaugagcaacagcagcaucuggcauccuaacacuaauuucuugcauauuuacuuugcauagacauugcauaaagcucuugauaagacugccuuacaacgauaaaaacugccuuauauuuuauacuugcaaauaacacuaugaaguaaguauuaggguccccaauucccgagugaggaaauugagcacaaagagguuaauuaacuuaccuaagguggcaguuggugaguggcaaagccaacaauacuucaaagccaagacugccuguacccuagacgugugcucuguaaugccucagaauccuuguuggaaguggccaagcagggccagcacagacagaaggggaggauggagaggacuccagguuucguggugcacuccugcuucacaguauuuauuauaguagccauacauguauuuuaaggcugucugauuguuuucuccacuagagcguaaacuccuugagagacugcaccaugucugccaucuucaaugcuccaugccuaccaggaacuuaauaagguuuuggggaccuuauucaagaaaaauacuaugaaagcaucacugcuauauaaccuguuccugcucacuagauaaaugaggcccuccugaccacagcccagcauaucuccaagucucucucugcugcccugucucugcagagcccucucacaagggagaggaaauggaauggguugggagaagaaauaaaaaucuggggucucccuccuacaaggaaacaacaggggccuaggacucauaguggugggggaagcgucagagcaacaggggcugagguagggagacaagugggaaagggagaauagaggccuuccccucugccacucccugaaccccaugacaucucaccaccccaaccuugguuccugccucuuugguuucuguguuacugccaccucuuggacaguaaauguugguuuaguccuuaagccuccaacagaguaaaucuguggggcuggagacguucuaaauaaugaccggaagucgucaggucagaggccugcuugcugagacauccugcuucagcagaacccacuaggcucuccuguuuuagagcuacuugacccagccgccacagcaucuggcugcacucccuuugcgccaugccagcccaagccaagccacucuccuguucccuuuuugcuuccugggaaacagggccccagugagugaucuagacucugaucucacuccaaggugccagggaucucauucacucacugccugcccagaaagcccagcuuaaauuuuuuuuuuuuuuuaaagagacagagucuugcucugucacccaggcuggagugcaauggcgcgaucuuggcucacugcaaccucugccucccggguucaagcaauuauccugccucagcuuccugaguagcuggguuacaggcgccugacaccacgccugguuaauuuuuguauuuuuaguagagaugggauuucaccaucuuagccaggcuggucuugaacuccugaccucgugaucccccuaccuuggccucccaaagugcugggauuacaggcgugagccaccgugcccagcccagcuuaaauucuuugaacucaccuccccuacugagagagauggcuaccuuggauuucuuucucugaaguugaaguugaauaaccuaucguuuuaccugcuuaggacagcugcuugcccaaacuuuacuagcacacaugauuguauggagcuucaugcuuccgguguagaccaguucucaggccagaaccaggccauccucuugugaucagucuggcaacagacauucuguucucacuggagggaaugcucuguguuucacugcuggccucaaaaggcccucagcaaaauccuuaacaaagugacauauguuaccuuuuccaaccuccuugguagauaugcuaagaacgcccaagaaaaggccacagucccaguuaggauggacaagcuaacacaggcacauuauacucaauuacuguugaagguggaggaagugacuagggcaggaagaggggagcugccuccaaacaggugguggacuaucaggcagaauagggugaccauaaagugggucuucagugccucagagaaggaccaucaccccugcccccaucgcugcccaaccucccaacugagggaauggaguuguauuccuuagcucaccuccugcccccaaguaagcugagaaaccugugggaccuauggccaacuggagcucuccuucacuccuuccuaggguuagucacccugugaacucaggcccacacucucugggccuuaggcugaagucaaggugggguuggaauucucccaccacacauccacaccuacacagccagaacccaguguggucaauacccgacuccuaccaugggcaaggccaagccaaggacacuaugacccaagcccaugcccucaacaaucauuucccucagaacauuuuaacucaaccauauccccagguguccaagaaaacaggaagccaaccccaaagugaacuccccaccugugcccaggaagaacuaaacacacacaaacaaguggccaaacucgccauggcccaacuccucaccaguuuggccagcuguucacugucagggcccagaacaucaguaagaccacccacucuccuccguacccaagccuugcugccuugcgcccaggccccucacagccuuuguacagaugcuuuacccaacaccugugugccagcuggcagguggagggaccccaggggguaggaugggcugcuacagggagaaaagcgauuccaucuuggcccucaggcccagccuacagcacuuuaggcacagcugucuccugccagcccugggcauuagcgguuuucugcaugguccagaucacaagcuucucaggaucaaggacugggucaccucguuuucuugcuuccuaacuccagccuccucugugccaggccugggcucaguaaaaagggaugccagucuucuguaggagaacgcccugccccguuuacucugcauccugagucuugcugaagccagggccaccggccaacaccaggaagggccagggccggaaggaagcagcagagccuauacacaaagccuacauguggacuauaaaaaggagcuccucccugccucccccaggaugggcccgguuccuaggagguaaagaguggggagaaagcuaggacuuaagccugggcacacagccacugcagccucucaaaagcuagccaagaaccaccucaaaaggaacuagucuugcaaggaggggugcgagaauauuaagggcuuagccaggaaugcaaguagagacucuccaagucccaucucuugggaccauagccucucuuaaggcaaccaacuccacuguccccauugcuucuuccccaaaacuacagaauauucggggaccaaccccuucucacacuucucuacucucuaggggcugaaaacacccccuagaagucucuaggcacccauauuccccacuuucucuggagacuucagcacacccagcaaagcucugggaagcaagugugaugaguggcagaaguagcgagaaacucaaacucugggcagcaggaggauacuguggccacaacagaguaggcucagcaggcagcucaaguagggccauggguugguggggaaggcgggggcagcuauggcagagaugacaauuaggcaagggccacacaaauauaccuauuucaaagaugucagccaagacagucucuugacccacacaggcagcacucuacucuaccacaacagcaaagccacacucaccacaugcauccuaagucauagaaauuaauuccuucuaaaccuccauacuccaaaucccucuccagccuaguuugcccaggguguucagguucuguacuagaggccucacccagaaccacugaggccacucuccagggacggugguguagguuagcacacauagcaaacaggggaaauuaaccuuccuuguugccagccauugauaugugggcaucauuuguuaucacagcacacccucaccuacccugacagagcagccucuugccuuauuuccuucauagaacucaccaaauccuauaagaauuuuaucugucugccuauuuaucuccuuucuggcuguaucuacccuaaccuuauguccacuacuggucuccacagugcuuggcacaguuagcaaaugccagagucuaaagccagggaagcacaagucgucucucacuuauucaaugagccacugaggcccaagaaagcuaguuuuuuguuuuuuuuuaaggagaguagguauggugagauggaacacaaaccacgcuagagaucuacugccaccaugaacaagucagaggcuggaguaaucacauccagcucagugugcccaacacacaguagcaaggcccacaacaaauguaugacaaauuaaagagcacaugaaugaaugcaugcucuugaguugucauagagaauccuggaaaagcccuucucaggauauuuggggcauggagccccagguucccauguucuguagaagcuuaggcggaagugucaccacaaaccagaaagucaagagggugaggcucuucugugucccacccccaaucagcggcuacauucacccccauguaggagugugggaaaggucugggugggccaagcaucucgacaccgguguuguggcaaggaugagugcaggacggguuuugaaauugaggcaaugaguccagcuuguccacagauggaagucuaggcuggucaaacacauguggccagagggaagaaaaacaaaacaaaacaaaauaacccucuguuccuauagaacgguccauccuauuaucauuuuccccagaaugggagaauaaacugaauacuauagcaggaaucugaaauccuaggaucugccaugaacuugcuaugugaccuuacccuuagggcuugguuuucuccucuguaagagagggauaguaacuccugcccuccauggauucauggagcugcugugaaguucaaacaauacaacaggugagaaaauguuccaugaacucccaauaugcuauuccaauuccagaguuuuuugaugccccaguccucuguguacagacucagggaaggaacacagaaagcaaguaggaaacagacuccuagcccagguuguuggagcagccacuuguggccgagcuuagugguggaaaagauuggagcucugugguuaacaaaggugagaguaaaggaaaugaauacuguuaaguggccacuaagugacaaauguugugcuggguaguuuucacauaaaaucucuuacucuuauauauaaucucccuuauuauuaauauacagcucugugaggagaaauuacuuuuacagcuaaagaucaauuucagacagggaaaaguaaucugcccaaggucacaguaagagcugagaccugaacccaaaucugaccagcucuagccacaaaucuccaggcacuucagcucaauuaccagcaaggugggacuaucuggucaaugguagccugaagccacuccucacccguggcuccaccuugagucuugccaccuguaaacaugcugcucucagagauucccuccaaggacgcacuguucccaugcuccucucaacaaggcacucuacaaggggcaccagaacauucccauccuccuaucccacacccaucucuccuaggacucuccucacagucugcagugacuucucuaguucuaacaaagcaaguggaaagggggaaaaaucagucuccuaauaucacaccuuugcaaucucaggccucacucccuuccuccaacuuaucaucuguggucuccuugaagccacaucccacaggaaaaggcacagaguaagaagagaugcugugaguuaacggagacugacacagaacagugacagcagaggcaggcccuaccacaucgaggcuguggcauuagagcacuuccucaaagacaagaucucuccagauagcguccugggcuaggcacuuagaaauaggacaauaucauaccuucacucuacagaagggguuaccacccaaagcagcugcuuccagccaacugcccugucucccugcaaaaccagcagugggaaagagcccugacaauagagggacugcugagagcugcaagagaggaugggcgggccuccuugccucugaaucaaagggcuugguggccaggcaccagccccuuaggacagcaggugcauucgaacuccuccccaccagguccuccugagaacuuaauccucaucucuguccugucagggauccuacguaguaagcacuuacacugugccacacuccaugcuaagcacuuuauacaggugcuaagcacuuuauacagguucucaucaaauccucacaaaaaccuuauaaaauaaaugccauuuaauacuauccuuuuuacagauaagcagcccagagagguagucauaugcuuuaaggucacagagcaaguaagcugcacaacaggauuuuaauucaagcagagucuagggcccaaaugcuuaacuacuaagcucugucucaccccucaagacccagcccuucucccaucuaccaccauggcauccccacccugccucagcaagaaggucuugucugggcccucagcagcucucuccugcaaacugugcaaaccguaggagcucacuggccucccuccccaacaccugccugacaaaccacugccacuguggucucccaggcagaggcaagucagucccacaacagccuccgcugacucccgucgccuccaggacugaguguaaucugcuggacauggcacacuagggcuauagcugucuccaaccagucccagcuuccucucuaccacaccauaucuguucccuaccccugcacagagugauucccaguuccuuagccucggcacagacaggugccucaguaauucaaggccuaccucaaaggucaccucuccuuuaaugccuuccuggcagagcuccucacaguucuugguagaggccuuuauauuaugguauguaacacacaggguuauaaucauaugccucuacaucugucuuuuccaagaguucaucaauggcacaaaccaugucucaauaaacuuuugaauccuuggugccuagcacugggcaaauggggagguauaauaauacuuauugcaaauauuaauaaaugugccucauuccaagaagcuacccagagcaaagcugguagccaagaucucuaaacuccaacugaauccugugcaucuguguacacacacacacaagagucuggagagaagcuggagguguugugggucccaggacugggugugcucagcuccuccaguuaucugugaagcaggcccuuuuccuagguucacaggaaacagaggaucccagcugggcgggggggccuggaaacccacacaucggggcaagccuggggugcugaggaaacacuaaaaggucugacuucccuuggaaaaaacuacaucagacaggaaauacacaggcagggauggcuagcucuggagauccggacaugugcuccugccccucucccacugggaguaacagccaguacaaagaaaacccuugaugacaccggccugggccuugcccucucccgugcugugggccuagcccucggagcaggccuccugguguggucugcuccccagccacaggggucaagccccagccagcugguuccacuacuaccucccuucugagcccgccugccucaucaaggcaguuagcuguuuucuuccgccacccucacccucuucaucaaagguacugcucacaauugucauugccuguuuucauuucccuaaaagcaagcacccauacuccuucaccucagagggccuggcaucuagaaaaguaucuagugaaggaucagccaaagacagaagccuggggccucagaaguccccauggacaugcucagccaguauucagaguaccuccacagugucuacaccaguguuuacugggcccacaaagacccucaaauggacaaccucauuaaacacgagucugaaccaucucaacucagaaaacaccagaagaaaaaguguggagccagagccuagagaggcugaggcugucuugggauacaaaagccaaaguggucuuugcccuguaaugcauggucugagcacaaaggugucucacagaggagccacguggaccacagggaacaugggcuugggguugcuagucagccucugacuagugagcuggccccagcugaggcccuggcacacacugacacaacaccuugggcacaaacgauucuccauuuccauuugcucaucuguaaaaugggacgaaaggucucaauagcacucagcuggaacucuacauaacugcauuuuauucauuuaugucaguaucugcaacauaaaaggccaaacaccaaccugguuccugucauaccaccaggacaaccaaacuugucaacaccuaagcacuuccccaccccgcuuuugagccaaaugaccacccuagaaaucaggaggugucagcuccauuucacaacugcugacaagagagggcacagagucagggcagaagaaggucuuacauaucaguaugagugcuccuuaaaccacacugucucucccucaggucuaccaacacccugaagguagcacagugucucucucuuaggccaggcuucaggcacugcugguacccugguagggucagcaggaaaggccagauaccugaggugcuugggcaagaguccagguggcagaaaacccggcuggcaguccaaccuccucagaggccgcagggaucagaacccaccaacaaggagagcccacgaauggguagaagcagggcacggcuucaguggaagccuccauuaguuaagucugaacacacaagcaucgaccagacuuuucauccaggcucuuuucaaucugagcccccaaaauccaaaagccaggguccuccuacauccucugccuacucuccaggccuguuaaaucccagcuaacugaugagaucacugaauuuguacaccucuggcugacccaccugcucaccccuggguaggggguuaucagguccucuguaugccugccuccaucccccaaauacaugaggcaugauaaaucauccccucucugcaccccucuuuucuguucaggccccaacuuacaaacaagaaaggucacacccaggagucaaaugugcacaacugcaaacacuuucucuacagaaacacuguucuacauggugggugggugagugggcacauggguuggggcaaaacaaaacuguuuccugccuuuuucugaguagcaaucuaagugaaaugugaauuuggucaccguccuccucccuuccugcaccuucauccucaccuauagccacaccucacccccucaccauucccaguucagggucuugaagggcagccacggucuauuguuaauguuauugcuaauaacagcucauauuuauuaaacauuuaugugucagacaaugcuagauguuuuauaugaauugucucauuugauccuggagcaaccauauauacuggauauauuauuacccccauuuuacacaugaggaaaucaaggcucagagaagguaaguaacuggccgggaaacacacaaugaauauaugggcuucaaauccagacuugccaucaaccacugugcuacauuuauugccugcuaauaugcgugguuuaaaaugcagucuguuacccaggagaucucugagaacuuccagccagugccaccaacucaacacagcauagggaguaaggaaggggaccaugccuggagccugaugccugagugauguucccaggguuaucucagcucuuugcagugucgauucuuccuuuacuuuggaauccacaggcucucaagucacuaaaauguucucccaauggcugacagggucagugggggcacugaggaagggggcugccauuucuaaguugagcagcugcauuagaucugugucagaucuggaguuuguagcugaggaugguuggcugccucaccacaagaccuuccuuccucccaaucuccucaacuaucuacacacaugcacaccauacccaagaagguuugugggacccccccuuggggugucacuuccugaucucccuccuucacacagaccugguucugagccugggucucucuaacccuagucuccgggggucccugcaagaagcaacccagucuagaguugcagacacaccaucucuucacacugagaggcgggggaauggagggcagagcagagugcccauccgaccacagcacaggcacgcgcuaaguggaacaacucucaaagaucugggguuuuucaaaaucccccaacucccuccucccacuagagaccagcgcaaaagcagccaagcucaggccugggaaggcgaaaaggcaggaaacuaagagaagccgcucccgcucccugaagccaccggacagaggacaaagggcuagacucacaaacuagcugcacuccugagaagaauaccugacuccaaggcgcuggggcaggccuuuauggggcccaucuccugggaacgugcuucccagggcaaggggagucccugcccuggcauugagugucugcccacccacauaggccuccaaaacccagcuuugggacaaaaguagcagaaaaaaaaaaaaaaaaauuccagccacuggcuucucucaggcuucuccaaaccaaacaagaccaccuuccucccucucccccagagggagaugaguaggcccagcucugcuccaagaccagcccuacccaacaucugccuaaguucuacuuagggaacccaaagauuccuuugcaaauaagagcccagccugggggcccggagaguuucacagacugcucuuucuggauaaagagugggcggggaccgucuggucaggccccagguucccgugcagggugggggccacugccuuagcuccccucgccgacgccgccaccacucccagggucuggggggcccgaugccugcaccgcaggucuccagcccgcgaggauuuuuaggccucagggcaaagcgccuggaacacuccccccagcugggggaggggggguguccugucaggugaccgaggacccggaugccccccgcccccagugaccacccgagacgaagcgggggcggggcccggagggagucugggagggcccgaaaguuugcccaagucgcuggggcggccggccggggugcaagcagucgggccgggcucccacgacccccgcgcggggcgggcccaggcaggaagugggcgcacuuacuggcccccucgaucuugucggcgccccggcuccacgugaucuggcgcgucuccagcuugaccuggaaggucuuccgcucgggucgcugcgacuucuuggaguagaacaaagucaugacggugcccaccucgaggcugcggcagaggugcagcaccucggcguccgagggcgcgccgggcccgcagccguuggcgcaaggggacgcggcgcccgccauggcuccgacgcugggggcggcggcggcacaggccaggaccgcccgggagcaagcgcaacggcggcggcugagguuggggcugaggcugaggcggcagacgagcgggacccggcggcggcuccugcaggcggacacggggcggggccucagcgcggcggggcggggcugcccugaggccccaccccgcuucggcgccgggaacaaaggcgcccgcgcacccguggggaggacccccgcccgucggcccgccgcgccugcgccccgcgacccccagacaggccgcaggcggggacggaggcgcgauggcggcgggagcgcgcgccguucccggucgacccacccagcccucagucccgcagagcuuucucacgcggccccggacacagcccggcggccacgagcggcccugucacgcacggcagccccgcccacaggccgcaggcccggcggccggcgcgucagucaggcguacucgcacgggcggccgcuaccccgcggucccgcacagacgcagcccccgcgucccgaacaccgcccaugcagcgaccgggacgggacgugaggggauggcgcguccuccgggaaugcccggccaaacucaguuaccugggcgggcuucccggacaagggagccaggacgggccgccucacac

SEQ ID NO: 13508 - RNA, 8392 nt, Homo sapiens
cagccgcuagcagcgccggccacuccgcgggacgcagccgccgcgaagcgccaggcggccgggccagcgagcucgggggccgaaggggaccccgggacccucggggcgggacccgggccgaccagcggcgggggcggcgcggcgcugcaggcggacacccggcggggggcaccgcgcggggccgggcagaggcgcgggggccgcuaugggccgccgccgccugcucgucuggcugugcgccgucgcggcgcugcucucgggggcgcaggccaggggcaccccgcuccuggcgcggccugcgccgcccggugccucccgcuacagucucuacacgacgggauggcgcccgcggcugcgcccggggccgcacaaguaagcgcgggcgggcggcgggcgggaagagggagggaugggcccgcgcgcgucgccgcucccaccugcccgcacccgcggggggcgucgaggccccgggcaccccgaggccgcugcacagagggggcggcgcccggggccgagccccugcccaggcgagcgcccuacgcuccgggagguugcggggcuggcgaggaaaaaggaaccgagggggccuggcgcggcggcuugggauccuggcagugccagcggaaaccuuuccagcgaaguaacauuuuccagcugcgcugugugcagacuccgggcgagcggaccagguggagggagaggaggaaaggcgguccgcgcgcugagcacgcggggcucccccgccccgggccucccuucucuccccuggcccggccagguaggagauagagcugcgcauccgggcggccgcugcccucucgcagucagccuggccccagcaaccccaugggagccccagcguggccgggcugcagagccagagcgggcuccuggcuccgggccugugcuguggcacagccguccacagcggucggcuuaugccaggcagccaccuccucagcccuuguggcucaucaaggagccugcuuuccccgccucagcuucugguguuucgugggcaguggcuugcgaacuggccucaguuaagugggcuggaggcucugccuggggugcuggcugaacuugaauucuagcugaauuugagagcuguuguaggaggaagaguaccgacacucagugggccuggguacaucacagcgagccuccuggaggaggugguacaagaacugcucugagaguaagggaacaggaccaaaggcaggggcugcaaaacuacgaggagagguggauuuccccgggagccaggcagggaggaaggacaagacauggugcucucaaaggagucacugaguggggacucggaagccuuaaaugccaagauaaggaguuuggaaucagcgaaggauggggggguguggcagggcacuugagggagaauccgggcuggccucuuccccacgcagggaggggcagccacaucaggcuccugguuccaaauagugcuuagcccaggggccacccaucacggaggcuggaaucagagaccagcagcggggcuggaccccagaccaagggcguuggcucccagggacacagagaacagacagaagagacaugggaguuuggaguccugcugaggcccacagauggaggugggaggguaggcgccucugugggccucgcucagccagauauuccaggggugccauuuucuccuguagggcccucugugccuauguggugcacaggaaugugaccugcauccuacaggagggagcggagagcuacguaaaggcugaauaccggcaguguagaugggggcccaagugccccgggacagucacguaagugcacuccucaccuacacacuuggaauccccuggcacaagcgccaguccugccuucagcugagagcagcugccaacuccacaaggggcuucuuggacuccagagagcccaccugagcccccauacaggccagaguagaaggcggccccagaaaagagggugccaaggaggaccccagggauuugggcuugcagcagagcaucacccgcacagacaggggcaggcuuggguuggagcccaggaaccacagagggacaaggggaagguucugggggcagaggcagcacaaggcuaggaggaagugacagaggcagaaggugaggggagaggagggagcagagggccccuuaggcaacgggugaugccacaggggggccuggcaggcccagggaggacuguggugaccacaaggaggcaggccauggggcagggagaggaagccggagcagcagggcugcacgcacaugggaugcacagcucuguaccuggagagguucacguguguguguggaaacaaaccuguugucuccggugugucagugggugaacagguacguggcugaacagugagggcauggacccucgcgagccugccuguacccuggaccuucccuucccugcucacaaucagagguacccguccaucugccucucugaccagagccgaggucccggagcaggcuagagaggaguggaaagaacuaaggggagcagguaggagccaagaguggcccccagggcagugagggggcugccagcgccagcuccagggcagugccccucccugcccacagggagggcuggggcugugucugauucucccaggugcuacugcagccugaguggaauuucucauggcagccugagcuagaggggguccaaguggucuugggagggauggggcaaaauuccugcuucucuccaagcuaccaggaugggugggacuucuaccugcauccuucccuaacaugacugugagcuucaggaaggccugcccuuacccaccccugucaccuuaagcacagaaaaaguacagcccugggggugcuauggagguggggagauacccagccuuaugcaagugucugagggcggcccugagugccagcuagggggagaagcacagcccucaggugcaggaucccacucucuugcccucccuggcccagguaccgcacaguacucagacccaaauacaagguuggcuacaagacagugacagaccucgccuggcguugcugucccggcuucacugggaaacgcugcccugagcaccucacggaccauggggcugccucaccccagcuggagccugagccucagauuccuucagggcagcuggacccaggccccaggcccccuuccuacagcagagcagcccccagcccucauggugagucugcccaaggagacccuccaaggugauuggguuucuugggcucaguggcaggggcagggaggggacugaucccaggcuggcugagcuccggcauggauggggaggggcaagccccaagccccacuuucaccccaccauaaagcugagggaguuaugcccagugagaagguaggcuuagaacagaaagucugggcugggcgcgguggcucaugccuguaaucccagcacuuugggaggccgaggcggguggaucacgagguuaggagaucgagaccauccuggcuaacaucgugaaaccccaucucuacuaaagauagaaaaaaaauagccgggcgugguggugggugccuguagucccagcugcuugggaggcugaggcaggagaauggcaugaacccggaaggcggagcuugcagugagccaagagcacaccacugcacuccagccugggcgacugagcaagacucugucucaaaaaaaaaaaaaaagaacagaaagucucuuggguggccuggcauugugacaagcugagagggugaggccagugaugccccuggggcucucuucucuuucccaggaaggaaaggcccagggcuguuuggugagcggcuggaacgccuggagggugauguccagcgccuggcucaaacauaugguacccucaguggccugguggcuagccacgaggaucccaacaggaugacugguggccccagggcuccugcugucccugugggcuuuggggucaucccugaggggcuugugggcccaggagacagagccagagggccacuaacaccucccuuagacgagauccuaagcaaggugacagaggugagcaacacucuucagaccaaggugcagcuucuagacaaggugcaugggcuggcacuuggccaugaggcccaccugcagcggcugcgggaagccccaccauccccgcucaccucccuggcccugcuggaggaguacguggaccgacggcugcaccgacucugggggagccugcuggauggcuuugagcagaagcugcaaggcguccagagugagugugaccugcgggugcaggagguacggcggcaaugugaggagggucaggccgccagccggaggcugcaccagagccuugauggccgggagcuggcccugcgccaggagcugucacagcugggcagccagcugcagggccugagcgugucuggcaggggcagcugcugugggcaacuagccuugaucaaugcccguauggauggccuugagagggcccugcaggcagucaccgagacccaaaggggccccggugccccggccggggaugagcuuacgaggcucucugcugccaugcucgagggagguguggacgggcugcuugagggucuggagacgcucaaugggacagaggguggagcaaggggaugcugucugagguuggacauggggggguggggagugggcggcuuugggaccaugcuggaagagcgcgugcagagccucgaggagcgccuagcaacauuggcuggggagcuaagccaugacagcgccucuccgggcaggucagcucggccccuuguacagacagagcuggcugugcuagagcaacgguuggucucacuggagacuucgugcaccccgagcaccaccucagccauccuggacagccucguggcagaggugaaggccuggcagagccggagcgaggcccuccuacgccagguggccagccacgcagcacugcuccagcagcucaauggcacuguggccgagguccagggacagcuggcagaagggacgggcagcucacuucaaggcgagaucacucugcucaaggucaaucugaacucagugagcaagucgcucacaggccucagugacucugucagccaguacucugaugccuucuuggcugccaacacgucccuggaugagcgggaacgcaagguggaagccgaaguccaggccauccaggagcaggucagcagccaaggcuccaggcuucaggcuggccacaggcagguccugaaccugcguggggagcuggagcaacucaaggcugguguggccaagguggccagugggcugagccgcugccaggacacagcccagaaacuucagcacacagugggacacuuugaccagcggguggcacaaguggagggugcgugcaggaggcugggccugcuggccgcgggccuggacagcuugcccacugagccacugaggcccagagagggccuguggagccauguggaccagcugaaucguacgcuggcccagcacacgcaggacauugcccgccuccgggaugaccuacuggacugccaggcccagcuggcugagcaggugcggccagggcaagccaacuagacaggcuggccaggacccaaccccuagaucccaccaacucggggaacaucaccccagagcccagccuuauccagcagcgccuuccagccuucccuggcuagcccaaauggcacuaaggaggccacugagggaauccuccacguggcugucccagccaccaaaacccaugcacagugcugcagaaacuggacaguuccggacagcggucaaggcaaggaugucaugcuugaaggccaggguagacuugagagaguucacauuccacugucagcaaaucagugucuggacagccagcugcagggccugagcauggcuggcaggggcagcugcuguggcaaacuggccuugaucaguguccguauguaaggccuugagaggacccugcaggcagucagcaccagccucagcaacugugcagagaccuacaggcccacagccaguggccuguccgcauugcccugugcccacaagcaacaguccacagcccuugguggcuucuguuccuuguccccucggcuucucuucgcagccaucaggacuagguuugugcaggaaggugaugcccacuggaacucuccucacaccuggcagcuucauggauguuguaucugaacuaaggaccagaggcugccagauguuucuggcuccucacguguccuucaggacagaacagaagcacaaagacucagccaagaguucucuuuauucccuuugauccucccccaaggugagggcuuaggcagcuguagaaccccaggaaagaacggaauccaggcaaucuguuuagagaccccccacuccaaauuuauccuuuuccuuuccuuccccuaagauguuuccagggcccucuggugcccacacuguccucuuccuuccacuuggggguggggaaauccuuccugcgaggucagggcauuucucuacaaaguggccugaaugaggccaggcccugagaaggagccaccagcuggaggaaaggggcuccaagccuugcuuuuaacaccccugcaaaacccccacccucccaagauguucacaaaaggugagaaauucagguacgaaaccaucaauggacaacuugaaaaugcauguuccucaggccuaugcaguucccagagacucuugacaccggucucugcugaggcucccagccucaguuucccccacagcagcacgggccccacugugcugcucuucagguccccacagcccugccuuugguuccuggacauuugguauucugcccuccacucugguacuaucagaguagggcaggcucuggauuaaagcuuuuagccggucuaaagcuacuuucuucaaagacagugggaggagagguugcuggggcaucagcccugcuucccacagcuccuuaggcaagagcuuacccagcagcugugagcaccaagcuggccagcagaggcugggggaggacuuucaggccaacaccugccccagcugaguuugggacuguccuuaagcgaggucuggagagaggcagcggcagcagccggacggggagcaggccaagccggaaccacagccugcaggugugggugugugucaugugcugagaugccagggcaccagcaagggggauauguuggcagugaugucuggcuucggaggguacaguccuggcucccagacaaggggcggggagaacacuguguccuuccagaggcuguaccacacucccacugcugucacccuucacugaagccucgagccucgguagggccucccucuucucccuguccuaucaagacuuacagcaaggucccagguugacagggagacagauaucaagggcauagaaaacccugcaaggaggccuggcaugguagcucaugccuguaaucccagcacuuugggaggccgaggugggcaaaucacuugaggucaggaguucgagaccagccuggccaauguggugaaaacccaucucuacuaaaaacacgaaaauuagccaggcguggugguacacgccuguaaucccagcuacuugggaggcugaggcaggugaaucgcuugaacccgggaggcggagguugcagugagccgagagaucaugccacugcacuccagccugggcaacagaacaagacccugucucaggaaaaaaaaaaaaaaaaaaaaaaaaagaacccugcaagggcccagaugacaagcuaauugccccaggacagugccacacugacgccuggagcagcugcagcuuagcuggcaaaaauaugacggggaagaugggggagucucucuagcugccaaccaaccugcagccuccuccuuccccuucaguggguuugccccaugacacuccaauucccacccuccuauaccccaggacaccuagccaguccugggccgggccagggaggaggagccagccagggcagguucaguccaggguaucaagguccacagcaggcaguggcucccgccaguagcagaaguuacuguauucaggguuggccaggucugugcuggggccacgggccacaggugggaagaggagcucgaccacuucaccaagccgcucauaccuacaggcagaagggggccagcacugagccugagcugccaccaaacgauggccuuggccaugggucugucccagaguaagggacagacuccccgguaagagguaaaauuggggcccagggagaagccagggcagggggacgugguagggcauggggaacauggcaggguuuagccucacguggauuugugguucuuuaugagcuccuggaugagcucuccccggggguugacugugaagaugcgugacucaggcaggcccaccugccgguaggc

SEQ ID NO: 13509 - RNA, 1521 nt, Homo sapiens
uaggaacccauccuucauaagagacauuaauuuaauacuuuucuuaugagaaaguaggaaaaaugcauaauuggaauugccaucauuuguuuuaucucagcaguucuuuucuucugaaggaaacauuuuucaacuuugaaguccuuaggaauugguuuuuggcaucauuucuccacucugucccagguggccuugaaaggcucauaauuucucucagauggugaucuuuuuuggcuuuuaaaggcaaagaaaaugucuacaguuucacuuugaagcucuuuagaaaaaaauccugggacacuuaucaugugguuaaaagaaaguaaaacaaaagauaaaaucaaauuuggaaucagugauagcaauuguauacuucgcucaccugcaagagcugaagagucauuuguuacaacuuccuguggucuaaugguaucugaaaguucuucaucggcagcugaagauggaccgugacgcccaguccaauguguuuucaagaaauuggccgggcgcgguggcucacgccucuaaucccagcacugugggcggcugaggcggguggaucacgaggucaggagaucgagaccauucuggcuaacacggugaaagcccgucucuacuaaaaauauaaaaaauuagcugggcaugguggcgggcgcuuguagucccagcuacuggggaggcugaggcggaagaauggcgugaaccugggaggcggagguugcagugagccgagaucgcuccacugcacuccagccugggugacagagcaagacuccgucucaaaggaaaaaaaaaaaaagaaaucacccuguucccugcacacuucaucuucacccacguccaaagguuuggaaaacucuuuugguggguacaugguguugugccaaggagagaacugagagcauuuaagguuuuuguuuuuuguuuguuuguuuguuuguuuguuuuuugagacggaguuucacucuuguugcccagacuggaaugcaauggcgcgaucucggcucaccgcaaccuccaccucccagguucaagcaauucuccugccucagccucccaaguagcuggaauuacaggcaugcaccaucacacccggcuaauuuuguauuuuuaguagagacgggguuucuccauguugaggcuggucuugaacuccugaccucagaugauccgcccgccucggccucccaaagugcugggauuacaggcgugagccaccgcacccagccaagguuuauucuuuuccucacaaaaugcuauaauuaccacaacaaaaaaaugugcggaauuccucagaacuccuucaaugucacucaauuuucuaugcaugcuagauacaucaucauagaccuaguaaauuuuaaaaaaaacugauuuuauucaaauccauuccauuuugcuuuuuauuuuuuucugauauacuuuugcaaguauaaguaaacuuuugauugaucccagucaucucuucaauaucaugaaacccaagaacuucucuuuaauuaaaccuccagggugaaggca

SEQ ID NO: 13510 - RNA, 6537 nt, Homo sapiens
aaccacagagacaaagaggacucuccggauacauaaauauauacccauccuaucuccucaaacaaauggaaaucagauucagacaacauggccucaagaaagucucaauaaaggucgcaugcuaccaugccacuauuuggguauuugguucuguuuaugggaggaguucuguaaaaagauuagcgcaaucggucaauguaacugcagugggauugaauuuccacagaggcuggcaacaagcucagcacagagaaggcaagaggaugaauaaauuauagcaagaacaugagguucauaaccaggaaagaggagcgaaugaagccagccucucagaaucagguggcuuguagagaaaccucuagagauggcuccaucccucuccccaaaaaaagaacugcugcaaguuccuugcaggugagaagauacuccaauucuauaucuucacgucuuggggaaggaaacacccaaguaguaaauccauuaauacuguccuuacaggugagguauuccugaaaacugcuuaauuccccauaaaagcauaaaauuguuuucuucuaaucauuucaucauuuugggacuuauauuuaagucuuuaauccauuuucaguugauuuuuguacacggugagagauaaggaucuaauuucauucuucugcauauggauauccacuuucccgaauaccauuuacuggcaagacuguccuuuccccauugugugcucuuggcacuuuuguugaaaauccauuggcuguaaaugcauggauuuauuuauggguucucuauucucuuccauugguuuaugugucuauuuaaugccaguaccaugcugcuuuaguuacuacagcuauguacaguauuuugaagucagguagugugaugccuccagcuuuguuauuuuuguucaagauugcuuuggcuauucagggacuuuugugauuccaaacaaauuuuaggaguguuuuuucuauuucugugaagaucaucauugguauuuucauagggauuacacugaaucuuuagauugcuuuggguaguauaaaacuacuagaagaaaacauaggagaaaagcuccaugacauuggucugggcagugauuuuuuuggauaugaccucaaaagcaaauggaauugcaucgaacuaaaaagcuucugcauggcaaaggaaacaaucaacagacugaagagacaacucacagaauaagagaaaauaucugcaaacuguacaucugauaagggguuaauauucaaacuauauaagaaguucaagcaauuauauagcaaggaaauaaccugauuuuaaaaugagcaaaagacucgaauagacauugauccaaaaaaaaagacauacaaauggccaacggguauaugaaaaaaugcucagcaucacuaaucaucagggaaaugcaaauuacaacuacaacgagauaucaucucacuccguuagaauggcuuucaucaaaaugacgaaagagaaguguuagagaggauguggagaagauagaacccuuauacacuguugguggaaauguaaauuaguacagacauuaugaaaaacaguauggagguuccucaaaauauuaaaaauagaacugccauaugauccagcaaucucacuucuggguauauauccaaaggaaauaaaaucaauauguugaagagauaucugcauucccauguuagccaagauacaaaaucaaucuaaauguccaucaguggaugaauggauaaagaaaaugugguaaauauacacaauggaauaccauucagccauaucaaggaugaagcccugucacuugcaacaauguggauaaaccuggaggacauuaugucaagcaaaauaagccaggcacagaaagacaaacacugcaugaucucacucauauguggaaucuaaaaaaaaguugaucucauagaaguagacaguagaaugaugguacgauuggcugggaugguuagcagggagaggaugggggaugguggccaaaagauacaucauuacaguuaggagagaaauaacuucaagagaucuauugcacagcauggugacucuaguuaaugaugauaaauuguauucuugaaaaaugcaaacaggguggauguugugcucucaccacaaaaaugauaacuuugugaaguaaugcauuuguuaauuagcuagauuuaaccauucugcaaugucuauauaugucaaaacaucauguuguacaugauaaaaacauacaauuuuuucugucgauuuaaaaaaagaaauaaaacauuaaaauaaauuuuuuuaauguaaauugguuucucacucuucagaaauuagcagccugagcccucaccacaagacuuccacauaugugaagggagccaagucgcuuguucaguuccucucuuuuuaaaaauaaucccuguucucaguauuccucccugggagcacuuugaaaucuguccaucauuuuaucugggcauuuuuacacacuauucacgacaccuccaagcaacauugaacuucccugaaauugagaaaggcauggggagugcuggguggguccuugugcugggaggaaccuuguuugggggcuucucucuuugcuccugguguuggaaagaugaaaggccuuauuuccugaucagcacuggggacaggaaccacagaucaaguggacaagcuccaccugcaucaggcauggaggcuuguccauaacagaaccucagaauuaggagcuacagcaucagaggggccuuagcaacauccauuuuacagaugagaaaacugagacccaaaaaagggagcgggugccugugguuuccugggaaguuaaugacagaaggagacuggaaucuagggcucugagcucaaagagcuaaaaugacugaugaauggagagauggacagaugccuggauggcacagagacagacagacucaggggaugacuaauuggcaucuugguauaaaaugaugaaugaggagaaagucuucucccaaggcuguguuggcccaugguuccaaaaccuguccugagaccccaccccaccaucuuaaaauuuccugccaugguuuacaauggacaaagagagugaaugguuggaucaaacccaaugcugacuuggauggaggagggaggauuaaagccuacauacucuuuauacagcaagagugccaggaucucaucaguuccucuucagucauugaucauccaauggaaaaauuugcuacagcuacacuggagugucugagaucauugagagacaccagccacaagggcuucccugccuggcuugcagugagagcucuuuguugaacauuuugagauucaaggagggguacacccacauuaaucagcuccuuggucaggguucaggcagagaugguagcuggaugugaugcaucaguugucagaagccuucugccccuucauccaugcauucaacaccuacuugcugaaucccuaucacaugccacuguuuuaagccauugggacacagcaauuaaaaaaaaagacacaggcugggcacgguggcucacuccuaucaucccagcacuuugggaggccaaggcgggaggaucgcuugagcccaggaguuugagaccaggcugggcaacauggcaaaacacugucucucuacuaaaaauacaaaaaaaaaaaauagccaggcauggugguacacaccuguagucccagcuacuuggggaggggguggaggcaggaggaucacuugagccugagaggucaaggcuguggugaguccugaugaugccacugcacucuagccuggguggcagagugagaccgugucucaaacaaacaaaagauacaaaucccugcccucuuggauuuacaucuuacuggggaugggaagcagaaacagacaauuacgagaaauauaauaaaguacacuguaaagguagaaccuuaacugacucccucugcaagccaacccauagcugauuauggugggagggagugggcacuuugcaguauuaaacuaaguaguuggugggggaaggagacucacuaauuuucccaggacagucacuccuggcuuauuccaguuguagaccaauuaaugucaauuaguuucuuuuagugcuaccuuuguaucucaaaaguguccugguuuggauggcaaguuauauaucggucaucuuauugagaaguaugcuuucagacuccaaggaggcaagggaguuagccaagcagguauccuagggaagaacaaguagagcaaagacuccaaggugggagugugccugauguguucaaggaaaagcaacugggcccagaggcuggagcaugcauggguuacagggacuaaauagucaugggcccuuccaaguuuuccaacaaaaacugugguuuugcugagugagauggaggaauuugggugaguucugagcagaggagggacaugauccaauucugauuugcagugagccuuucuggcugccaucuugagaguagauucugucaagacaaggcagaagaaggaagacugauuaggaagcccuucuaauaaucccaggggaaaagaggguggcuuggccagguggcucgcaaguggagguggcgagaguggggggacucuggauguaguuugaagacaacacauuggacuugcugauggauucgauguugguaugggacauagagaggaaucaagaaagacuagggcaacuuggccagggcaaguggacgugugcaguugccauugacugacaugaggaagucugaggguggagcugguuuggagaauuaggaguucaauucuggacaaguuccaugugagaugaauguuagacauauaaguggaaaugccacgcaguuaaauauuggaggcaagagcucuggagaggguucuguacuggagauacaaauucgggagucauuagcauggagaaggucuuuaaugcaauauuuaccaacaaagaacaucuggccuuuaguccaauucaaagcagcacaaauuauaugguaguugccuaucauuucaucucccccauucuguucgugcucccaucaaaacuuccuaugaccccaaacuacacagccagaccucacuccagggccugagcagucagagcugcaaggcaccccaagggguacaagcacuuccugaaacaauucuacucuauaacaauacugguacucaccaaggacaccuuguguaaaauaggaagccaguuguggggagcagugaacauggagucagaaaaucuagaagaagaaucuuggcucuaccaaugguuugacucuagcugugugaccuugggcaagucacucaaacucucugugcucagcucucucacaugguuuauauugugcaguaagugacaaaauccaucucaacagcuuagcacagcaccugggacauaguaaccgcucaguaaaaaucagcaaaaugacuguuuuguugccauuauuauuagcauuugacuuaagaugaggauaagggaacaaaucauuuauuuggaagguaauccuagggggcacugguuaaggagaggccaagugauaaagagaaagaaagaagccagugaaggguguguucucaagccaguuaucgcugucagcaaauagagcugaacuccaccagggcacccugacauccaguguagaguacacaccccagaguucucccaccugaggggugagggagcugagguauuuauacaccaacucccaccaaccaugccaugagagcuggggguggauacuacuuucuagcuuuggagaaagagaugcaauuggaagucggcuggugcauacugcagugguaaggcccaaaggauguggacagggcacacacuggcaccugcugcagagucaucauugccuaucuggggcaauucacccagcuucucugagccucaguuuuccaucuauaaaauggcaggcaucauaucugcuucucagaguuggcaugaggauuucagaaaauaauguuugucaaagcaccuggcgugaugccugccacauggaauuucaauuuccuuucucccuuucucuucuccucauuacgcccuuuccacaugaagggaaaacuuacuugcucacaagccacacagaaaaugccuuucagaagggcacuuuguguuuuacaacauuguucucuggcugcagagcacuccuuccauauaauauacucucagauguccauaaugaucuugcuaaguauuccuuucuggaaggaggaaguagaggugcuuugauagugaggacggagguuugugcccccaagguaugcuucaugucuguggucgcuguuuuucgccccgaccaugucaaggcccccuaucuccaaacaaauuggucaagauggagucauuccuaaucugaugacauccagcacugccaugugguguaagcugcugagcugcuaacagagacacugguaaguugacccagaaaggagucaaucccuucuuacuucccccugcaaaaaaaaaaaaaagaaagaaaaagaaaaagaccaacucaaaaggccccugcaggaaacaggccugcccggugcaacccaccagcccauacagcagaacagacgugggccca

SEQ ID NO: 13511 - RNA, 1423 nt, Homo sapiens
uaaguuaauaacaacuuagaacagaaaauccaaacacugccccagugucuggcccaguuccagcucaaugcugcauucugcaucuguuuauuguaagaugugaaugccccauccaacuuucuuggcagauguauccuuuuuuacacuuuuuuaaaaacugaaagaugauuucuucauuucuuauucaguuuugaaagggaggcacagucaaugaucucgcacguauuccagaaacugacuuccuuagaccuuaacagaagcuacucaagugcacagauguuugcugguuuuacauggaggccuugcuggcuaugaaaaaacauuccccucuaauuuuuugcucaauuuguuuuaaguugguaaugaaaucugugaaucuguguucccuuucuacaggaaaaauagaauuuugaucucuuuuaaaaaucagaacgcaacaggauaauggagaaaucagucucaauagcacauuucuuguucguuucagagcggugauguaaacacgaugaugcuaugcuuuuggggucuuugagguuucugccaaaagcauagcagcuuagguggauucgugccuaccgcaugcuucuuugguggauuucugucgacaaauuguaugucugcucuucugaaauagcaucaugaaguuguuaaugucuuugcauaaagaccaccccauucuguuugcccuggggacaaagacuuugcacuaaucaccuugcucucuccuggagcgaagagcugaagaggcaacaggaaaugcuuauuuacugaguucuuacuggguaccaacuguggacacccacagaagggguuugaguaaguaucuccucauuguccaggggccagaguagagaacagaaaggaaacagcuuggccucugguuccacaaaauaaauaagaauaaaauagaacauugaacauuuguguuucuuucaccaucuuaauguaugcacuuuguagauucugcauucaaacauguagaacaggcuaaugaaagaaaaugccaaggccgggcacaguggcucacaccuguaaucccagcacuuugagaguccgagguggguggaucacaaggucaggaguucgagaccagccuggccaauguagugaaaccccgucucuacuaaaaauacaaaaaucagccggguaugguggcgggcgccuguaaucccaguuacucgggaggcugaggcaggagaaucacuugaauccgggaggcagagguugcagugagccgagauugcaccauugcacuccagccuggguggcagagagacuccaucucaaaaaaaaaaaaaaagaaagaaagaaagaaagaaaaugcccucaaaucucaccacccagagacaaaaucauucacuuuuggagagcauucuuccaaaucucgcucucuuccaaugguucucagcugaggacaauuuug

SEQ ID NO: 13512 - RNA, 11286 nt, Homo sapiens
ggccggggcccggggccuuggagauaaggccuggacaggauauaacccgcgcaagagccgaggagcaggggugugcaggguuccagcgacagcagcacuggacucguccagagggcggcgggugagcggcuggggccccguggagccaccauggaccccgcaggggcagcaggugagcgcuuacccucccgaggccccggagacgccccgugagaacuacgaaggaccacccccccacccccuccccacuauacaaauaggaaaacuaagccccaaggaggcagcccgccgaacugcaaaagcaggauuagaaccuagggcuccugguuccccuucucucucuugaggcccccuggcgccuagaauucacuaaaccucauuuccuuccagcuccuaccccaccgccgcgccccaugcugaagcuguguuagccauuuuucuguugcuguuucuuggcagagagggccagcugccccuaacccaacagcagcuccgcccccgccccccaauuccgugaaugcgccuauucugagcgaggccagugccugcuucucacuccaggcgaccuucucaucccggauucuucucccuuuuccccucccaggccugguagaagaacauaaauccucuggcagggcccgucgugggagggugaccaagcaagauguggcagcgcugguggaagugggagggcggggaacccuugucaagcuugggccacaggcaaagccaacaucccuggacagcaugagggcuaaggcacaaggggccucugccaccucccauacuuuccuacccggagaugccucugggccccuaaaucuugguuaagguuccccucaucccauucuuggucugagccaacuucucaccuggcacccugccuccaccccaggaauccuagaaagucaaaauagcaaaugccucaaaguucaucaccuuuccaaaccccucauucuacaaagaaaggaacuagguccagagaggguagugucuugcugaaggguacauggcgaugucguggcaggacugauacuagaaccugggauuccucugaggaguuaauccuugcauuaaaaaaagaaagauucagagaugcccugaggugagguugagggaguggagcagcaagggaggagaggccuguaaauaaauucucaaaagucccuuagggacauuucaggggguuccuggagggaugagaguagaaaagggaugauccuauuuugauggcuuugagggugggggcucgauuuggaaaggacccugcagaaguggggaagggcacugcaaaucagauagggcacccuaggcagcgucucugcuaaaauacacucgccugaccuggcuugaugccuacuccccugcagaccccucagugccucccaauccuuugacucaccugagccugcaggacagaucagagaugcagcugcagagcgaagccgacaggcggagccucccgggcacuuggaccagguaacggcggcguggcagcgugcccuagguggggacugccaggcagcuggagcacacagaggcaacggccgcauuuaacccagggcuggcggguggggaggggaagugcaggcugcaaccccucccacuggcagggagggauccccccuuccuccugagggggggcaaacccagcacccccugcuccuaccacgcuuggagcugcagacagggcuagcugcgggccaggcuggaauucagcuacagcgggagacuggggagaccggggcagccacacuccacagccggaauucauuggaagcuuagaaggcacuucccugaggagagccccaagggguggagcgguccuggcuguggcugcugccugucuggccuggcuuucgagggugcggucuugcgcuguccccuccaggagugaggagagacucugguccugccaagaggaauaagggcucagaaggacagccucaguuuucauggcucuccuugggccucaaccugcuaaccccccaaaucucucccaccuccccuccucuacuugcucccugcaauugcucgggccuacccacccacaccgcucaagacccccagguuaagaagccaccagaccucuaggcucuaaccuggcucacucugcaggaccaaugucaucugccuugacuccuguaaucaaggguaggaaagcccacacagcaacaggccacuucucaugggagaaagggaagaauauggcuuuggccccagaaaggcucagauucccccaggccaucccccauccugaggacaagguuuugggcccuuuucuguuugcaggcaggaggcuagagagcgcuccaggccaggagcccaggaaaggcucucccuuccccucccuccucaccccccacccugccuuccccaggguggggaagcuucaucucuaccaauuccaucagcccuaaaauacucuucuccaucccaaggccaguauaagugcagccuuugugucacagccacgugucccuauggcccugggcuccaaugggcaugaugccagacccacagaguggaaccuggguggucccauggguuccaugcaggcuucguugagcaccuugcagccuaaauauuuagccuacaauuugcagccaagucuccuccuuaccuaaugcuuccucuuccugaccccacaggggcaggauauagagcagccccacccucccacucacucuaacccccugcucacuucauuuuacucaaccugagugcuuggacccugugccaccuugacccuucucccuccuguggcuggucgaccugccugcccuacucccaggucauccccagagcacaccaccauucugaggggaggcgugcgcaggugccugcagcaacagugugaacagacugugcggauccugcaugccaagguggcccagaaaucauacggaaaugagaagcgguaggugccuccgcagccccucccaggucucugcaacugucagcccuaugcaccuccuccauccacccauugggccucuuuuagacgcagagcaggccucagggcugagaucucagcuauuggucgaccagggccuugacccucagccaccauuagcccccacuuuggucuauaguucuacagcaggagauucccugugaaucuccugucuccauucauucacucauucucccauugauucacuuauucauucauucaacaacuacuuacugaguguuugucauguaugcaccaggcucuguggguacugcugggcacugggcauacagcugaacaagacagaaacagccccugcucuguagcccacacucucacucaaguguggaagagacagacaguaaacuccccacaagucaggaaacaagauacuugcagauuaugaugagcacuagaaggaaaacugaacgaggccauuugacggaaacugaaggcaggggggacauuagcuagaaaggucaaggagguugagagaccuuuugggagguaacauuggaacugaaacuugaaugcugaaauggagccagacaggagaauaucuggggaaagcgugcuacaauuagaaggaacagaagggccgggcgcgauggcucacaccuguaaucccagcacuuugggaggccgaggcgggcggaucaccugaggucaggaguucgagaccagccuggccaauacagugaaacccccucucuaccaaaaaauacaaaauuagcugggcaugguggcgggcaccuguaaucccagcugcucaggaggcugaggcaggauaauugguugaacccgggaggcggagguugcagugagccgagaucaugccacugcacuccagccuggcgacagagcaagacucagucucaaaaaaaaaaagggcaacagaaaaugggaagaccuugaggcuguaccaauuaggccuguuugagguacaaaagaaaugacaguggcugaaaucagagggaggaguuguaggaaacaagucagagagguaagcaggggucagaucucaggaggacuuugaauuuuaaaccaguggaggauuuuaaggaguuaacaugauuugacucauguuuuuaacaaaacacucuggccagccugguggcucaucccuguaaucccagcacuucggcagacccaggugggcagauugcuugagcccagaaguuccagaccugcaugggcaacaugacaaaaccaugucuguacaaaaaacacaaaaauuagaugggugugguggcuugugucuguagucucaccuacucaggaggccgaggugggaggaucaguuggggaggcagaaguugcagugagcccagacagccgagaucaaguuacugcauuccagccugggcaacagagcaagacccugccucaaaaaaaaaaaaaaagaaaaagaaaaagaaagaaacaggaaggaaggaaugaaagaaaaaaagaaagaaagagagaggaaggaaggaaggaaggagcacucuggcugcugugcgaaaugggaaggagauagaaacagaacuuucuggaaauagaccaguuugaaggcugaugcugugguccaggcaaaaaguaauggcggcugggaugaagggcgaggugguaaaaagccaguggauucuggauauauuauauuuugaagguggaguggacaggaccuucugaugaguugaaugagggguguaaaaacaauaagguuuggcuaugaaugggguuuacagucgugaaaaagcguugcggggagcgggaggaggaaacgaagguucugcuggguuuaugcuacuaccuugccgugcuuacaggagagccaaguggagauggaugcacgacuccaacacucacuuaucuccgcagguucuucugccccccgcccugugucuaccucucggggccuggcuggagggugaagccagggcaggaucaaggugagggcggaaucaagggcugccggccgccugcucuguagggaggaccacgagauugggcccgagacggggcgguucgcaggcgcagucuccccgcgcccucuggcggcgagcgcuaagcuugccuggcaccugcguccucccgaguccuugcagagccaguucgcgucccuuuccagcucaccaggcgggggaaacggggcccacggucugcgguuacaugggacuggacagcgcguccggcagcgccacugagacgcagaagcugaauuucgagcagcagccggacuccagggugagagcgcacgggaagggguccgauuccugcucccaucccugccucuccugggaaaggagggcuccuuuacuccccuccgaaagccaagagauagguggggagaccgggaggccgggguccugccuuaaggccgagccugagagccuggaugguggagcuucuggucaccuccgacggggcggacguccgauaucugggagagguugguucauccgacgggggagggcugggaugagauggcccuguaccugugagcccccuaggaauucggcugcgccaagacccuguacaucucagaugcagacaagaggaagcacuuucggcuggugcugcggcuggugcugcgcgggggccgggagcuggguaccuuccacagccgccuuaucaaggucaucucgaagcccucgcagaagaagcagucgcugaaaaacaccgaucgugagcagggcggggccugacccccggcccgggcggggaggugcaaccaagcccagaacggcuaaacuggggcgcggagguggggguaggcugggcuuaggggucagaguggaaaagguggagucggagccgagaggggaaggagucuggaugagugggugcggcccaggccuggggaugagaagaguuggaggaugaaaagcagagaggaaagggacagauaccaaauuccagguugggaguuggggucccagagcagacaaaaguugaacuaggcaggaguugaacuagggacagacuaaaagugacauagguggggcacgguggcucaugccuguaaucccaacaauuugggaggccaaggugggcggaucaguugaucccagaaguucaagacuagcuagggcaacauggcgaaaucuugucuguaccaaaaaaaaaaaaaaaaaaagaaaaagaaaaauuagccuggcaugguggccugcacuuguugucccagcuacgugggaggcugagaucagaagaucacuugaacccaagaggucgaggcugcagugagcugugauagcaccacggcaguccagccugggugacagggugagaugcuaucucaaaaaaaaaaaaaaaaaguuuuacuuuuguuuguugaacugaaagauguccagacagcaaaggaacaggcaaagguuccaaagcaggacugcagcagguccuggaaaaacagcugugaacugggaaugcccaguguaucuaggccugugggcacauuagccaggccggcacagggacagaagauuggaaacugucuggaaaguccaaggaaccaagccaggacagggcacugauagcaccaacuaaccuuaacccucacccugacccccucccucacccuaacccucacccuaauccuaauccuuacccucacccucacucuaacccucacccuaauccuaacccucacccucacccuaacccucacccuaacccuaaccccaauccuaacccuaacccuauccccucacccuaacccugacccucacccucacccuaacccugacccucacccucacagugugcauauccuccggcucaaaggucucccucuucaaccgccugcgcucucagacggucuccacacgcuaccucucuguggaggauggggccuuuguggccagugcacgacagugggcugccuucacgcuccaccuggguaaugacaucugcaggcccuggagcugggcacuucacaugcauuagcuuauuuaaccuccaccacaacuccuuaaggaagguaaacucugccccaugugauuaaggcucagaaacacaaaaagacuugacuacagucccagugagcuggugacuguuccaagcuauucugacucccuuauccaugcccuuuccccauauaucaacuaagcugccugcccccaaccccugcccccagggcagacauuugugaggauggccucaaauggccucuccagaauuagaaccuucaguuggcuccccugaguaccaagcuuucccgcagggcccaugugugaugugaggaagagccagaggcaacaaggcaggguuuaaggcagaagcuugggggccgcugaaaaccuugucccuugcuuuuuuugucccccagcugaugggcacucugcccaaggagacuucccaccgcgagagggcuacguucgcuauggcucccuggugcagcucgucugcacggucaccggcaucacacuaccucccaugguauaggaagggagggcaugccuggagggguccccucagauccaugcagagaauguggcacacacgggcagggcuggagagugaggccccaaggcauggagacaccuguucucacccagugucgcguaggaccagacagaagucaaagggcagggggaaucugcuagugccuguguggcuauuggaguagcagacagccggcuaggagggcagccucuggacgcccgggcuccuugccaccacuguucuuaccauccuuccauugcagaucauccguaaaguagcaaaacagugugcgcuccuugauguggaugagcccaucucccagcugcacaagugugcauuccaguuuccaggcagucccccaggaggggguggcaccuacuuaugccuugccacagagaagguggugcaauuucagguaagaagcagagaauaccagcaccaaguguccuggaaagggagaaugcagagaaccacagaauguaagaucaucacccucaccaugguugcuacuuccugagcagccucccauggaacauuaaaaucauagacucccaggacagaaucauaggauguagaaaaauaguaauaaguaauaguaugaagcaauauuccuucccaaagaauuuuagagucauaaaauauugggauauagccaggugcgguggcucaugccuguaaucccagcacuuugcgaggcugaggugggcagaacaccugaggucaggaguucgagacuagacuggccaacauggugaaaucccaucucuacuaaaaauacaaaaauuagcugggcauggcagugggcgccuguaaucucagcuacucaggaggcugaggcaggagaauugcuugaaccugagagguggagguugcagugagccaggaucacaccauugcacuccagccugggugacaagagcaagacuccaucucaaaaaaaguaaguaaauaaauugggauauaaaauuguaggauguaaauaaaaaucaugauagguaauagagagcagagaauuaaugagcaaagacuauucgaagcacagauaaagacacagaauguggaaaauuauagaauguggaaaauaauaauuaucguuaagcaguaguacucccaaaagaauauuaucauagaauguuacgagauagaauuauaauauguggaaaauagcaaguauuauuccuuccccaagaauauuccuucccaaagaauauuaaaauuguagauuauuagagcauagaauugcacaauguuaaaaaaaaaaaaauucuggaaucccaagaaaaaagacccuuagaaaucagcuaucccaggccgggccaauggcucaugccuguagucacaauacuuugggaggcugaggcaggaggaucacgaggccaggaguuugagaccagccuggccaacauggugaaacccugucucuacuaaaaauacaaaaaaauuauuugggcgugguggcuggcaccuguaaucccagcuacccgggcgccugaggcaggagaaucauuugaacccgggaggcggagguugcaaugagccaagaucaggccauugcacuccagccugggcgacagagcgagauucagucucaaaaaaaaaaaaaggaagaaaggaaggaaggaaggaagaagagagaaagagagagagagaaagaaaaagaaagaaagaaagaaaagaaagagaaagaaaagaaaaagagaaagggaaagaaagaaaaggaaggaaggaaagaaagaaaaagaaagaaaggaaaaaagagagagaaagggaaagaaaaagaaaaggaaggaaggaaggaaaauaaagaaaaaagaaagaagaaagaagaaagaagaaaucagcuagcucaacaagcuuucuuaacgcuaagugagagaacuuaagggcacuguccaagcugaggggacaagugaaccccagagccuaggauuaguauccaguucggucuaacgcagaagcccacgcgccaugcuggcucccuacacugguggccaccaugagaagcuucggccucguccccuugggucuccucccaggccucucccugccccaaggaggcgaacagggcucugcuuaacgacagcucuugcuggaccaucaucggcaccgagucgguggaauuuuccuucagcaccagccuggcguguacccuggagccggucacuccggugccucucaucagcacccuagaggugaagccgggcgcuaggggcguugggcagggggacccugccugcacugggcagugguggugcuagugaguggggggcagcggguucccgcccuacuugguucucucaccucaccuggucccacccucccccagcugagcggcgggggcgacguggccacgcuggagcuccacggagagaacuuccacgcggggcucaaggugugguuuggggacguggaggcagaaaccauguacagguacgggguggugaggcagccucucuugggccccggggagcaggggaagggggugcacgcgucgucggagucgccgcagcccucacccuggugcuccacccccaggagcccgcggucccuggugugcguggugccggacguggcggccuucugcagcgacuggcgcuggcugcgcgcucccaucacaauccccaugagccuggugcgcgccgacgggcucuucuacccuagugccuucuccuucaccuacaccccggaauacagcgugcggccgggucaccccggcguccccgagcccgccaccgacgccgacgcgcuccuggagagcauccaucaggaguucacgcgcaccaacuuccaccucuucauccagacuuaggcgcgcccgguagccccggcugcccacccuggagggcugcgcccgcgccaggcgcggggacguguuucuggguucuaggcccugcuuccuugccccuuugcugcagaagggcagcugaaggcucacccuagaaaccgggccuggugggucuuacccggcucacucccucccuuguccuuacacauacaggaagacaagaccugaguggugcugucuuuguguccgucguguauggcucucccugucuucauuucuucucacucugucucuaaaccucucucucucucccuucccccucaguacuuagucuacagaccuaugugcgugucccuauccuucuguccuuuucucucuucagcucucccugccucucacacacaauuuuacaugccccgaggagccaaguuugggacauuuacccuccaggcaucuguguccccucuugaagagaaaacacacagcuucacacauccaggcauagggggcaagcucuuggggcaucaggacccuggagcaccagguccuuccuggaauauuagauccaccuggagcaccgggucucucuaagucucaccuggggaauucggucccaccuggggcaccaguucccaccuagagcacuguguccugcccuagagcacaaagaccugcuccucccgagacucucucugacugcagccaggcauaguaccuuugccuguguuugcucccugguccacagauuugguggcugggcaggugccuggacagugaugaggucuugccgccuuaacugucccccccagucacuucucccacaggcccagcaggacgcaguccugaggaucagggauucuacagcugcauuaaaaucaauccuauccaaggcagaguuuggucuguaugagccaccuccccaagugugccucccccaacccucgcaccaacacacaaaagaggggaccugcacagaaagaaaagaaccacaagucugauggagcagagagccuaccuuuuggacguuuucuagaggaggaacagggugcagaggcagcuggcauccugagucccugucccugcccugggguuguuacccuacuagcuaucucuccaucccaag

SEQ ID NO: 13513 - RNA, 11286 nt, Homo sapiens
cuugggauggagagauagcuaguaggguaacaaccccagggcagggacagggacucaggaugccagcugccucugcacccuguuccuccucuagaaaacguccaaaagguaggcucucugcuccaucagacuugugguucuuuucuuucugugcagguccccucuuuuguguguuggugcgaggguugggggaggcacacuuggggagguggcucauacagaccaaacucugccuuggauaggauugauuuuaaugcagcuguagaaucccugauccucaggacugcguccugcugggccugugggagaagugacugggggggacaguuaaggcggcaagaccucaucacuguccaggcaccugcccagccaccaaaucuguggaccagggagcaaacacaggcaaagguacuaugccuggcugcagucagagagagucucgggaggagcaggucuuugugcucuagggcaggacacagugcucuaggugggaacuggugccccaggugggaccgaauuccccaggugagacuuagagagacccggugcuccagguggaucuaauauuccaggaaggaccuggugcuccaggguccugaugccccaagagcuugcccccuaugccuggaugugugaagcuguguguuuucucuucaagaggggacacagaugccuggaggguaaaugucccaaacuuggcuccucggggcauguaaaauugugugugagaggcagggagagcugaagagagaaaaggacagaaggauagggacacgcacauaggucuguagacuaaguacugagggggaagggagagagagagagguuuagagacagagugagaagaaaugaagacagggagagccauacacgacggacacaaagacagcaccacucaggucuugucuuccuguauguguaaggacaagggagggagugagccggguaagacccaccaggcccgguuucuagggugagccuucagcugcccuucugcagcaaaggggcaaggaagcagggccuagaacccagaaacacguccccgcgccuggcgcgggcgcagcccuccagggugggcagccggggcuaccgggcgcgccuaagucuggaugaagagguggaaguuggugcgcgugaacuccugauggaugcucuccaggagcgcgucggcgucgguggcgggcucggggacgccggggugacccggccgcacgcuguauuccgggguguaggugaaggagaaggcacuaggguagaagagcccgucggcgcgcaccaggcucauggggauugugaugggagcgcgcagccagcgccagucgcugcagaaggccgccacguccggcaccacgcacaccagggaccgcgggcuccuggggguggagcaccagggugagggcugcggcgacuccgacgacgcgugcacccccuuccccugcuccccggggcccaagagaggcugccucaccaccccguaccuguacaugguuucugccuccacguccccaaaccacaccuugagccccgcguggaaguucucuccguggagcuccagcguggccacgucgcccccgccgcucagcugggggagggugggaccaggugaggugagagaaccaaguagggcgggaacccgcugccccccacucacuagcaccaccacugcccagugcaggcagggucccccugcccaacgccccuagcgcccggcuucaccucuagggugcugaugagaggcaccggagugaccggcuccaggguacacgccaggcuggugcugaaggaaaauuccaccgacucggugccgaugaugguccagcaagagcugucguuaagcagagcccuguucgccuccuuggggcagggagaggccugggaggagacccaaggggacgaggccgaagcuucucaugguggccaccaguguagggagccagcauggcgcgugggcuucugcguuagaccgaacuggauacuaauccuaggcucugggguucacuuguccccucagcuuggacagugcccuuaaguucucucacuuagcguuaagaaagcuuguugagcuagcugauuucuucuuucuucuuucuucuuucuuuuuucuuuauuuuccuuccuuccuuccuuuucuuuuucuuucccuuucucucucuuuuuuccuuucuuucuuuuucuuucuuuccuuccuuccuuuucuuucuuucccuuucucuuuuucuuuucuuucucuuucuuuucuuucuuucuuucuuuuucuuucucucucucucuuucucucuucuuccuuccuuccuuccuuucuuccuuuuuuuuuuuuugagacugaaucucgcucugucgcccaggcuggagugcaauggccugaucuuggcucauugcaaccuccgccucccggguucaaaugauucuccugccucaggcgcccggguagcugggauuacaggugccagccaccacgcccaaauaauuuuuuuguauuuuuaguagagacaggguuucaccauguuggccaggcuggucucaaacuccuggccucgugauccuccugccucagccucccaaaguauugugacuacaggcaugagccauuggcccggccugggauagcugauuucuaagggucuuuuuucuugggauuccagaauuuuuuuuuuuuuaacauugugcaauucuaugcucuaauaaucuacaauuuuaauauucuuugggaaggaauauucuuggggaaggaauaauacuugcuauuuuccacauauuauaauucuaucucguaacauucuaugauaauauucuuuugggaguacuacugcuuaacgauaauuauuauuuuccacauucuauaauuuuccacauucugugucuuuaucugugcuucgaauagucuuugcucauuaauucucugcucucuauuaccuaucaugauuuuuauuuacauccuacaauuuuauaucccaauuuauuuacuuacuuuuuuugagauggagucuugcucuugucacccaggcuggagugcaauggugugauccuggcucacugcaaccuccaccucucagguucaagcaauucuccugccucagccuccugaguagcugagauuacaggcgcccacugccaugcccagcuaauuuuuguauuuuuaguagagaugggauuucaccauguuggccagucuagucucgaacuccugaccucagguguucugcccaccucagccucgcaaagugcugggauuacaggcaugagccaccgcaccuggcuauaucccaauauuuuaugacucuaaaauucuuugggaaggaauauugcuucauacuauuacuuauuacuauuuuucuacauccuaugauucuguccugggagucuaugauuuuaauguuccaugggaggcugcucaggaaguagcaaccauggugagggugaugaucuuacauucugugguucucugcauucucccuuuccaggacacuuggugcugguauucucugcuucuuaccugaaauugcaccaccuucucuguggcaaggcauaaguaggugccacccccuccugggggacugccuggaaacuggaaugcacacuugugcagcugggagaugggcucauccacaucaaggagcgcacacuguuuugcuacuuuacggaugaucugcaauggaaggaugguaagaacagugguggcaaggagcccgggcguccagaggcugcccuccuagccggcugucugcuacuccaauagccacacaggcacuagcagauucccccugcccuuugacuucugucugguccuacgcgacacugggugagaacaggugucuccaugccuuggggccucacucuccagcccugcccgugugugccacauucucugcauggaucugaggggaccccuccaggcaugcccucccuuccuauaccaugggagguagugugaugccggugaccgugcagacgagcugcaccagggagccauagcgaacguagcccucucgcggugggaagucuccuugggcagagugcccaucagcugggggacaaaaaaagcaagggacaagguuuucagcggcccccaagcuucugccuuaaacccugccuuguugccucuggcucuuccucacaucacacaugggcccugcgggaaagcuugguacucaggggagccaacugaagguucuaauucuggagaggccauuugaggccauccucacaaaugucugcccugggggcagggguugggggcaggcagcuuaguugauauauggggaaagggcauggauaagggagucagaauagcuuggaacagucaccagcucacugggacuguagucaagucuuuuuguguuucugagccuuaaucacauggggcagaguuuaccuuccuuaaggaguugugguggagguuaaauaagcuaaugcaugugaagugcccagcuccagggccugcagaugucauuacccagguggagcgugaaggcagcccacugucgugcacuggccacaaaggccccauccuccacagagagguagcguguggagaccgucugagagcgcaggcgguugaagagggagaccuuugagccggaggauaugcacacugugagggugagggucaggguuagggugagggugagggucaggguuagggugaggggauaggguuaggguuaggauugggguuaggguuagggugaggguuagggugagggugaggguuaggauuagggugaggguuagagugagggugaggguaaggauuaggauuagggugaggguuagggugagggagggggucagggugaggguuaagguuaguuggugcuaucagugcccuguccuggcuugguuccuuggacuuuccagacaguuuccaaucuucugucccugugccggccuggcuaaugugcccacaggccuagauacacugggcauucccaguucacagcuguuuuuccaggaccugcugcaguccugcuuuggaaccuuugccuguuccuuugcugucuggacaucuuucaguucaacaaacaaaaguaaaacuuuuuuuuuuuuuuuuugagauagcaucucacccugucacccaggcuggacugccguggugcuaucacagcucacugcagccucgaccucuuggguucaagugaucuucugaucucagccucccacguagcugggacaacaagugcaggccaccaugccaggcuaauuuuucuuuuucuuuuuuuuuuuuuuuuuuugguacagacaagauuucgccauguugcccuagcuagucuugaacuucugggaucaacugauccgcccaccuuggccucccaaauuguugggauuacaggcaugagccaccgugccccaccuaugucacuuuuagucugucccuaguucaacuccugccuaguucaacuuuugucugcucugggaccccaacucccaaccuggaauuugguaucugucccuuuccucucugcuuuucauccuccaacucuucucauccccaggccugggccgcacccacucauccagacuccuuccccucucggcuccgacuccaccuuuuccacucugaccccuaagcccagccuacccccaccuccgcgccccaguuuagccguucugggcuugguugcaccuccccgcccgggccgggggucaggccccgcccugcucacgaucgguguuuuucagcgacugcuucuucugcgagggcuucgagaugaccuugauaaggcggcuguggaagguacccagcucccggcccccgcgcagcaccagccgcagcaccagccgaaagugcuuccucuugucugcaucugagauguacagggucuuggcgcagccgaauuccuagggggcucacagguacagggccaucucaucccagcccucccccgucggaugaaccaaccucucccagauaucggacguccgccccgucggaggugaccagaagcuccaccauccaggcucucaggcucggccuuaaggcaggaccccggccucccggucuccccaccuaucucuuggcuuucggaggggaguaaaggagcccuccuuucccaggagaggcagggaugggagcaggaaucggaccccuucccgugcgcucucacccuggaguccggcugcugcucgaaauucagcuucugcgucucaguggcgcugccggacgcgcuguccagucccauguaaccgcagaccgugggccccguuucccccgccuggugagcuggaaagggacgcgaacuggcucugcaaggacucgggaggacgcaggugccaggcaagcuuagcgcucgccgccagagggcgcggggagacugcgccugcgaaccgccccgucucgggcccaaucucgugguccucccuacagagcaggcggccggcagcccuugauuccgcccucaccuugauccugcccuggcuucacccuccagccaggccccgagagguagacacagggcggggggcagaagaaccugcggagauaagugaguguuggagucgugcauccaucuccacuuggcucuccuguaagcacggcaagguaguagcauaaacccagcagaaccuucguuuccuccucccgcuccccgcaacgcuuuuucacgacuguaaaccccauucauagccaaaccuuauuguuuuuacaccccucauucaacucaucagaagguccuguccacuccaccuucaaaauauaauauauccagaauccacuggcuuuuuaccaccucgcccuucaucccagccgccauuacuuuuugccuggaccacagcaucagccuucaaacuggucuauuuccagaaaguucuguuucuaucuccuucccauuucgcacagcagccagagugcuccuuccuuccuuccuuccucucucuuucuuucuuuuuuucuuucauuccuuccuuccuguuucuuucuuuuucuuuuucuuuuuuuuuuuuuuugaggcagggucuugcucuguugcccaggcuggaaugcaguaacuugaucucggcugucugggcucacugcaacuucugccuccccaacugauccucccaccucggccuccugaguaggugagacuacagacacaagccaccacacccaucuaauuuuuguguuuuuuguacagacaugguuuugucauguugcccaugcaggucuggaacuucugggcucaagcaaucugcccaccugggucugccgaagugcugggauuacagggaugagccaccaggcuggccagaguguuuuguuaaaaacaugagucaaaucauguuaacuccuuaaaauccuccacugguuuaaaauucaaaguccuccugagaucugaccccugcuuaccucucugacuuguuuccuacaacuccucccucugauuucagccacugucauuucuuuuguaccucaaacaggccuaauugguacagccucaaggucuucccauuuucuguugcccuuuuuuuuuuugagacugagucuugcucugucgccaggcuggagugcaguggcaugaucucggcucacugcaaccuccgccucccggguucaaccaauuauccugccucagccuccugagcagcugggauuacaggugcccgccaccaugcccagcuaauuuuguauuuuuugguagagaggggguuucacuguauuggccaggcuggucucgaacuccugaccucaggugauccgcccgccucggccucccaaagugcugggauuacaggugugagccaucgcgcccggcccuucuguuccuucuaauuguagcacgcuuuccccagauauucuccugucuggcuccauuucagcauucaaguuucaguuccaauguuaccucccaaaaggucucucaaccuccuugaccuuucuagcuaauguccccccugccuucaguuuccgucaaauggccucguucaguuuuccuucuagugcucaucauaaucugcaaguaucuuguuuccugacuuguggggaguuuacugucugucucuuccacacuugagugagagugugggcuacagagcaggggcuguuucugucuuguucagcuguaugcccagugcccagcaguacccacagagccuggugcauacaugacaaacacucaguaaguaguuguugaaugaaugaauaagugaaucaaugggagaaugagugaaugaauggagacaggagauucacagggaaucuccugcuguagaacuauagaccaaagugggggcuaaugguggcugagggucaaggcccuggucgaccaauagcugagaucucagcccugaggccugcucugcgucuaaaagaggcccaauggguggauggaggaggugcauagggcugacaguugcagagaccugggaggggcugcggaggcaccuaccgcuucucauuuccguaugauuucugggccaccuuggcaugcaggauccgcacagucuguucacacuguugcugcaggcaccugcgcacgccuccccucagaaugguggugugcucuggggaugaccugggaguagggcaggcaggucgaccagccacaggagggagaagggucaagguggcacaggguccaagcacucagguugaguaaaaugaagugagcaggggguuagagugagugggaggguggggcugcucuauauccugccccuguggggucaggaagaggaagcauuagguaaggaggagacuuggcugcaaauuguaggcuaaauauuuaggcugcaaggugcucaacgaagccugcauggaacccaugggaccacccagguuccacucugugggucuggcaucaugcccauuggagcccagggccauagggacacguggcugugacacaaaggcugcacuuauacuggccuugggauggagaagaguauuuuagggcugauggaauugguagagaugaagcuuccccacccuggggaaggcaggguggggggugaggagggaggggaagggagagccuuuccugggcuccuggccuggagcgcucucuagccuccugccugcaaacagaaaagggcccaaaaccuuguccucaggaugggggauggccugggggaaucugagccuuucuggggccaaagccauauucuucccuuucucccaugagaaguggccuguugcugugugggcuuuccuacccuugauuacaggagucaaggcagaugacauugguccugcagagugagccagguuagagccuagaggucugguggcuucuuaaccugggggucuugagcgguguggguggguaggcccgagcaauugcagggagcaaguagaggaggggaggugggagagauuugggggguuagcagguugaggcccaaggagagccaugaaaacugaggcuguccuucugagcccuuauuccucuuggcaggaccagagucucuccucacuccuggaggggacagcgcaagaccgcacccucgaaagccaggccagacaggcagcagccacagccaggaccgcuccaccccuuggggcucuccucagggaagugccuucuaagcuuccaaugaauuccggcuguggaguguggcugccccggucuccccagucucccgcuguagcugaauuccagccuggcccgcagcuagcccugucugcagcuccaagcgugguaggagcagggggugcuggguuugcccccccucaggaggaaggggggaucccucccugccagugggagggguugcagccugcacuuccccuccccacccgccagcccuggguuaaaugcggccguugccucugugugcuccagcugccuggcaguccccaccuagggcacgcugccacgccgccguuaccugguccaagugcccgggaggcuccgccugucggcuucgcucugcagcugcaucucugaucuguccugcaggcucaggugagucaaaggauugggaggcacugaggggucugcaggggaguaggcaucaagccaggucaggcgaguguauuuuagcagagacgcugccuagggugcccuaucugauuugcagugcccuuccccacuucugcaggguccuuuccaaaucgagcccccacccucaaagccaucaaaauaggaucaucccuuuucuacucucaucccuccaggaacccccugaaaugucccuaagggacuuuugagaauuuauuuacaggccucuccucccuugcugcuccacucccucaaccucaccucagggcaucucugaaucuuucuuuuuuuaaugcaaggauuaacuccucagaggaaucccagguucuaguaucaguccugccacgacaucgccauguacccuucagcaagacacuacccucucuggaccuaguuccuuucuuuguagaaugagggguuuggaaaggugaugaacuuugaggcauuugcuauuuugacuuucuaggauuccugggguggaggcagggugccaggugagaaguuggcucagaccaagaaugggaugaggggaaccuuaaccaagauuuaggggcccagaggcaucuccggguaggaaaguaugggagguggcagaggccccuugugccuuagcccucaugcuguccagggauguuggcuuugccuguggcccaagcuugacaaggguuccccgcccucccacuuccaccagcgcugccacaucuugcuuggucacccucccacgacgggcccugccagaggauuuauguucuucuaccaggccugggaggggaaaagggagaagaauccgggaugagaaggucgccuggagugagaagcaggcacuggccucgcucagaauaggcgcauucacggaauuggggggcgggggcggagcugcuguuggguuaggggcagcuggcccucucugccaagaaacagcaacagaaaaauggcuaacacagcuucagcauggggcgcggcggugggguaggagcuggaaggaaaugagguuuagugaauucuaggcgccagggggccucaagagagagaaggggaaccaggagcccuagguucuaauccugcuuuugcaguucggcgggcugccuccuuggggcuuaguuuuccuauuuguauaguggggagggggugggggggugguccuucguaguucucacggggcgucuccggggccucgggaggguaagcgcucaccugcugccccugcgggguccaugguggcuccacggggccccagccgcucacccgccgcccucuggacgaguccagugcugcugucgcuggaacccugcacaccccugcuccucggcucuugcgcggguuauauccuguccaggccuuaucuccaaggccccgggccccggcc

SEQ ID NO: 13514 - RNA, 5375 nt, Homo sapiens
gugccauauggaagaucuuauuuguagacucgugaauuucgccacccauuccuccccuucagcugauggcgcgaucuccacccucugcucgcaccucuggcucucguccaggucacaucaaccugccagcagaaaccucgguguuaggcgcuaagacuguccccagggggcgcuggucguuuggggagcgggcgcagggacaagggugcuguggugucugguagguuggaaaugccuuugcuaaaaaggaaaagccucccuuuaagcuagacccggugggcacucacccccuuccuuucgugggacuuucauucucccacgaaagggcugcgguauuuucuucuuuuuuugcuaaggaacuuucugcucagaguaaaucuuuuuuuccuuucuuuuuuuuuaagacagggucuugcucucuugcccaggcuggagugcaguggcgaagucacagcucacugcagccucgacuccugggcuuaagcgauccuccgaccucagccuccugaguagcugauacuacaagcgcaaggcaccacaucuggcuaauuuuuaaauuuuuuguagagacagugucucauuauguugcccaggauggucuugaacuccuggccucaagcagucuuccugccucgaccucccaaggugcugggauuacaggcgugagccaccaugccuagccuguucagaguaaaucuuauuugaggcaugaaucaaucaaacauaaauagagaguugaauugaucuuagagggaaugggaugcagcaaagcccuacuugaccaucuccccccucccacauuuggaaauccuuaaacccacuuauguaggccucugacugugagauucagagccacagcaguuuccaccucugcuaaggccuucaggcagugagauggcucacuucagugccccuccuuccacacaucuccuagcuguauccugagacgccucaaccuagucacuacccuucuguaugauguuggucuaaggcuucccccucucuggacaugaaggcggagccucccagcacuaccagccacacaccacucaagacuccagauccugaacccugacucuggggcccagcucugggccuggcuuggggcuugcaucucaccuagccuggcaguguuguugucacacccaccuuguauggaugccacauaggcauuucaagugaugcggagcagaagcgggugcagcggcgcuugacccaacgcaggguggaggaucugcacaucacccugggcgccgggagguggauucgugugggcagccccucaaaccagauccacuggucggcuacauccagcugcuucaugugccccaugggaguucuauugcgguagggcuuaaugaagaugacucgggggcccucggugagugguugccuccccuggacuccaggguucaagcuaucaucccucgauguccuuggaaccucaggcucuauaugcuuuucuuuccguggcauugccgccaaugacguuuucuccuuguuccucaucccugacugcaccugggacuuccacuccuuguacucuuuuuucuuaggguccccuguggacucuaauuucuuggacuugaguuccuucucggagcacccgaucuccuggaacucuucauuauuuuguuuuguuuuauugcaggcacuguuuucccuggcagggagaggaaaggcagucagcacagcaggaccgaggcccugguucccgagacaguugcuauguagccagcucaggggagccuguuaagaaaggcuagaggggccugcaaagaaacuucucuacugcccagaggccuugugcuggugugaggaggugugaugagcacuagcagagggaugugagagauugggaaggugaaagccaugacuaguaguuaaggccccuaagaaugaauauugucuacaucaucugccacuagauuaggguucugucucucuggacuucagcugggagggugaacaguccaguaguuuuucuaaauugugcuccaagaaccuuaggguucugaggaggugucucaaugucaccuccccugacccacuggggcaggauaccucuccccagcucauaacaacacaauuggggcuuggaaauagauauuugaacagagguuucacugcuuuaauaaaguuggaaaacuguucaagaccagccugggcaacauggugagacucugucuccauacaaaaaaaaaauuuuuaaguuggaaaaugauggggcuagaugauccugauccuucuagcucuauguuuccugauugccugcgacuagaggccaaaucagaaagaggagcccagaaagguggccuugacagaaauauuaaaugcugagacuuucccaaagggugucuguaacagacugggcccccugcaaacccccaguggcaacaccauccuagccaagggcguggagagagaugaggccuugggcugcagauaauggcaauacugugaugauaauaauggcucccgcugauugaguccucgcucuaugccagacucgggacccuuacaacuugggauccuuacuauuucugugaaguagaaggcagugaaacagaguggcuuacagagcacagguguuggauucagacaaacgggcucagauucugcuucugccucuuaccaccugugugauuugggcaagauauuuaaccucucagagccuuagcuuccuuaucuguaaaacuaggauaauucugucuaccuaacaggauuguugugaagaauaaacuaaaugggaaaauucuuaagugcuuaacacuguaggaugguacuuagcaggcaccaaucaauguuagcuuucuuaauacugucaugugacuuaugaggaaacgguuugaacuugucucggaggcaugguaaaaaaaaauaaaaauaaaaauaaauuaauaaagaaaccaagccucagcaagauuaaucuucagauuucaggggucagucugcaggugacucucuggguuauauugacuugcaggggaggaggaggaggaguaaccugucugucucagugccccagggugaagugagcaccacaacuggaugauuacaaccauuguuauggccacagcucuaauaucagacaggaauggcuucacauccuagcucugccacuuaucaguugaguuaacugaaugagacaagucacuucaccucuucagccucagcucuccagcaguaaaauagaguuaauaaauaccucucucacagaggcuuugugaaaauuagacuuguucucuaaaugccuuagcacaaugccuguucccagaaagacggcauuuggguccauuaugggggccaggccccagcuuacccagaggagaugcggagaaucuuuggaacacugagcagugaaugccaacaccuuuuggccagcuuaugcaguucuuggauccggcgguuugagcucuugaguagcuucaagagcgacaaguuuuuuaacaccugccagggucaagaaaccagguaaauagaagcuucagcuuuccuggacagccucccucuccccugccugccucuggcuccgcucagccaagggccggccugcuggcuccccugggccacucagccuggcaaccaggggcaguacugcaugaguauaugagcuuccccaagcuggggccaaaacagggcgucucaccguucucagacgguuccgcucaauuacuuugcucacaggcugcucugucucgucccgcaguuucucaucuugcaucugagggacagaggauaagagagacauaaacccagaggaaucagccagguguggugccucaugucuguaaucccagcacuuugggaggccgagguggguggcucauuugaggucaggaguuugagaugccuggccaacauggugaaacccugacucuaccaaaaaaaaaaauacaaaaauuagcgaggugugguggcaugcgccuguagucccagcuacucaagagggugaggcaggagaaucacuugaacccaggaggugaaggcugcagucagcugagaucucgccacugcacuccagccugggcgacagagugaggcacuggaggaauccuccugaacuccuccaugugccucuucauuuggcugagcaugguuugaccaauccuaggcugggaguuuugucaucuuggucuggggacagaacugggagaccauuuuaacucuccugaccucccuucacccuucaccuuuuccuuuucucccaugcuggaaagccccuuuccuuggcaugguggauucuuuguuaagguccccucuagggacucacccccagggucuagucccaagucugaccuuggaaacccugcuguucuugggccucuucuuugcugauggacucaugcuggggcugugagaccucagagaugaauggagcaacaccagugccaggcaccaacccuguuccucucaguucagccagcacucaggcugggcaucagaugguggugcuggcucuguaccaccugcagcugugacaucacugaaaugugacaguagcagggcugggucuccaaggaguguauguggcagaggugagggguagagggugagaaagaaauauagacaauaggcgacagacagcugugugcauugucacaaccucccugugggguaagaggauuauccccucuuuuuaaaugaggaagccaggguucaaagagguugaauaaucuacucaaggccacacuagaucuagcccagcuagaucauagugggcuggaaaccuaaccaaggucugauagucaacccaugaaaccagggauucccaaaccaugcucauccauucagucaugucgccuguuuugacugggcgccugcuacaugccaggugcuuuuucuuuucuuucucuuuuuuuguuuuuuguuuuuugagacagagucucacucugucgccaggcuggagugcaguggugagaucuuggcucccugcaaccuccgccuccuggguucaagcgauuuuccugccucagccucccaaguagcugagacuacaggcacccgccaccacguccggcuaauuuuuguauuuuuaguagagaugggguuucaccauguuagcaaggauggucucgaucucuugacuuugugauccgcccaccuccaccucccacagugcugggauuacaggcaugagucagcgcgccuggccuugccaggugcuuuuucuaagugcuagaauaacagaaaauucuugcccucaagcuuacauucuaguggaggggaaacaguguguguacuuguaaauguuuaauaauuggcucucugaagcaaaauguauauguguuuguauuauaaauuuuacugauagaaaucaacaaauaauagaauccuauaauacucuuuauuguaacuucuauuagugaguugcu

SEQ ID NO: 13515 - RNA, 1540 nt, Homo sapiens
gguacuuccaaggcggucaaaaaguuacccgcacccauccuuccucccuccgcccagccggacuccucugcaccacccucgccaccgacgccggugcgcuagucuccgcucgcucggaugcacuugcugcgcccccgccccgcgcagacccgcggcgggcgcccgcgccgguucugcccacgcacacuugaugcucugcgccuuuugggcagcgcccacgcaacgacuacgcacccgaacccugccuccggcacccuuggccacacucgccacacuuacacgcgcgcacuucuccagaggacgcacgaugggaaagagagaguugggacccgcaggagggggcagggcacugacccggugccgcccagcagggcaggugcaaggcggcggaggaccccugcccugggacucgcccggcugccccugauuccuggcucugggacuagacagagccgccgcccaaccuaccaagcacacugggcggggugggcgccgggccggccgggcgggucagagcuggaagggugggccgcuacgccgcgccccccgacgccggcaaggagccagcaccuccacggugcuaagaggggcgcugcgcugcuggccaggcggggguggaggggcgaggcggcaacugcgagaggagaaacguuugcccucuuuucgcagcgucuccuggcucagaccagugcuagaaguguccagucuagcagcuccuggaccaagacuccguggccauucccuuccuccugccuuccauccacccccuuacggucagagcuccgaaggcagcguggugacgggugcggggaggggaguggggggaucucucugagauacuucugccuuggggucacuggaucauucauucgacaaacauccgcgagcaagucaggaacuaggagucauccuugccaccucccucucccucgcugccuauauuaaaauacaccuccauuuccugucgauucucuuuccuaaauaucuuuccaguccaccauuccuuccguuugccccaccaccucccgccugggcuccuaaugcaguaaccuucuaucugguuuucuuuucuuuuuuuuuuuuuuuuugagacggagucucgcucuguugcccaggccggacugcggacugcaauggcgcaaucucggcucacugcaagcuccgcuuccuggguucacgccauucuccugccucagccucccgaguagcugggacuacaggcgcccgccaccgcacccggcuaauuuuuuguauuuuuaguagagacgggguuucaccuuguuagccaggauggucucgaucuccugaccucgugauccacccgccucggccucccaaagugcugggauuacaggcgugagccaccgcgcccggcccuaucugguuuucuuguacucauucuggcccggcuacacuccauucccugcauuacaagucagcugucauuucagaacacaagucuggugugccccccucgacccccccgccacgcggcguugccuaaauuccuccacuguuagaauaaaaucuggacgcugau

SEQ ID NO: 13516 - RNA, 10433 nt, Homo sapiens
uggggccgagcgccgcuggguaggcggaaguagccgcaggcauggcggcggcuaugccgcuugcucugcucguccuguugcuccuggggcccggcggcuggugccuugcagaacccccacgcgacagccugcgggaggaacuugucaucaccccgcugccuuccggggacguagccgccacauuccaguuccgcacgcgcugggauucggagcuucagcgggaaggaggugagggcgcgagaucugaccagggaaagauuuccguagugccugcuggcuggccggccgugggaugaaggcaaacuuugggggcggggccuaauuccuggguagaguucgggauccuggguguggaccccgacgagguggggaucgucacucaccugcucccguuuccccagugucccauuacaggcucuuucccaaagcccuggggcagcugaucuccaaguauucucuacgggagcugcaccugucauucacacaaggcuuuuggaggacccgauacugggggccacccuuccugcaggccccaucaggugcagagcugugggucugguuccaagacacugucacugagugagugcacaccuugggcccuguugcaggccauggagggaauguggcugggagaguguugucauccugccacugcucuuggggacagcacuuccaguaggcagcgauuccauggggguagagcuggcauuggaaguaagaaauguuaccacagaugaauaaacuucccaauccuaaaacuuucagaccugagguagcacaugcauaucccuggagaggcaaauagcaaacaauuaaugcuuauuuggagguaaggcaguagaaaacuggcaacuggauaaccuuuuaaaaggcauucauuaauauuuuuuaaaugauaauaaauaccacgaaagccaaccauaacauaucuguggguuacaacuggccaacaggaugcuacaucacaguguuagaggaacugcuuuuguuugggagggggcaggucuaguuacugugccuacuacaaaccgcuauuucccaguggcugcuguggcuauccuguuuagaauagaaccuuucugugcagugguugcaaacaggucuacaugggccacacagguaaggaaugaauaaagguauuuuuaaaauugacaaacacaggaaugagaaauauaucucauuuuccucuuaaucccacuauaagaaaucaauagugcaaguaugauauaacaaguuuuagggcaauaaaaaggagcagcaggaauuguggcaggcuagagaguuugugugacauucuaacgaggacagcucugccacucagcuucuauggauuguugccaugugggaauagaggccuaauguggucagagucaaauguuucuaaaaauuuuuuguagaaacaaggucucacuauauugcccaggcuggucucgaacuccuggguucaagcgauccuccugccucagccucccaaaguguugggauuacaggcaagagccaccacaccuggccucauuuuucaagagauaccagaaaucuggaauuuaaugugaaaauuggcaaauucaaauaucagcaaguaauuuaaaaauuuuuugagugcugugcgggucaauguugugcauaccaaaugaagcauguuuaugguuugaguagagcuuuccggcuucaaguuugccauuuuuauuugaggcuuaaggauuggagcaguugaaaagcucugaacauagaauuaucaaaagcuccuggacaacacuaaggaauaaggaauaagcaguaacuccccagcuugccaagacuuucucucuugccucaacucuggcuccccuacccuuuccugucuacucugcugucacugucuucccucagcccguaauugccugaaauguggagcaaaugcuuagaauucuuucuagugcuuauuaaguuuuaugcuuucucuauuacugagagcaaaucucuuuugauauuucuccaagaaaagaacauuaauuuaauuugauguuuuuaugaaauccuagaacaguuguuuuucccauguucagugagcuuuuuuggauauaagacuucucaccaugauaguagaaucaggacuuaccuuuauucccagaguauacacaggguaguaugcauuguuuugcccagcccagcacauucaaggaagaucagugagcucauuucagcucugauacaugaggcgcuuuccauggugucaggggaaguacauagaugacccagacugguccuuguccucaaguugcuuacagccuaguuagggagaaaagguggucaggacacgaugcugcugccaccuagccaucucccaggagggaccuaguaagaugcuuggauggucagaaccgugacugcacagaggagacugugcuuaaggagggcaggaaaggcuucguggaggggagguaagcacuggagccggaucaugaagguaggcagaaagaaguuagcaaaggcuugcaaggaaggaagaaucaccugagcagagacccauggggaugcagagauguccagaggagagugaggaagaaggggcugaguaggaugagacccagcaagugggcuggcugggggcagcaauguuccagcuccaucaacuggcccgucuaauaguuaagaauacagccuccuccuaucauagguuuagcagccagcuguggacuuugaaagagggagcagagguagccccaggacagugaguggauuugugucucuauccaguguggauaaaucuuggaaggagcucaguaauguccucucagggaucuucugcgccucucucaacuucaucgacuccaccaacacagucacucccacugccuccuucaaaccccugggucuggccaauggugagauaaccccuacagcccuuuccuucuuccucuuaccuccugcccaaaccuuugccuccuuuucccucaguuuccugcuuccucagccugggcuagauccuaaguccccugugugugcaggcccccaauacugugccaucucugcaugccuuuucccaaggagagaagggaguccuacucccaguugggacuguccagacuguggugcuagaggugguguggggagcaggagggucauucccaucucuggaauguggaucccgaggggucagagcccaaggcccaccccagacagaccucugucucccucagacacugaccacuacuuucugcgcuaugcugugcugccgcgggagguggucugcaccgaaaaccucacccccuggaagaagcucuugcccuguaguuccaaggugaggccgcagagccuggcagccgggggcgggggguguauagagaaccugcgccccaugccaagugcuccauacagggcuucucuuaucucuuuccaucuccuccaggcaggccucucugugcugcugaaggcagaucgcuuguuccacaccagcuaccacucccaggcagugcauauccgcccuguuugcagaguaagucauggggaguagaggaagcugccauccaggggcucagagaagguacauguaaagcauguggucagugucuggcucaggcugagugaguacugagugguagaugugaugacgguuauucagggcauuggccaagcaccaagaaaacagugguugccuagcaagcacugaauaaauauuugucauggaaaauagugguucagaacaauagcuaugcgggugcaauugcuagcucagucacuugccagcuggcguaaccuugggugaaucauuucauuccccugagcuugguuucccacccugccacaugacauugauaguagaauccacuccuaggguuguugugauaguuuaucaaacugaugcacauacagcugucagcacggggucuggcacgaggucaagugcucaggagugggugguagcaaaucgauggaugugaagauacauagaugagggauugagucugaguaggagucuuuuugggggcuguguggugagagugauacccccucacugcugccaucuggcccuugugauagaaugcacgcuguacuagcaucuccugggagcugaggcagacccugucaguuguauuugaugccuucaucacggggcagggaaagaaagguaaguuaccuuggcaacucaucuguacccacccaugccagcccugccuuaucuauguggacuaggccuaggccuggccccugcucagcccugcgcucuguuucucagacuggucccucuuccggauguucucccgaacccucacggagcccugcccccuggcuucagagagccgagucuauguggacaucaccaccuacaaccagguaacaaggucuccagccacacacacaaacacaccgcugguccccaggaccagccuacccucucugcuugcuucuuagcccugccuuuguguccccaggacaacgagacauuagaggugcacccacccccgaccacuacauaucaggacgucauccuaggcacucggaagaccuaugccaucuaugacuugcuugacaccgccaugaucaacaacucucgaaaccucaacauccagcucaaguggaagagacccccagagaauggugagugggugguugguuggacugcuggguugcaacggcuacagagaaaagacucacaaucccacgucuuugccguuagaugauuggguuguauuuagaccagauuuccagagucauaugcugcugacuguagcuauuccaagcucuacgauuuuggguagguuccuaaacuccccaagcuucagcauccacaucugaaaaauagaguauacuuagcaaauuggaugagaugaugugaaaaauggaguuaguucaugcauuugcuuaaucaaccaaauacuuuugaauucauacuaagugccaggcauagaguguugaauaagacagaggacacugcacucaagaaauauaagucuacuagcuagggcaggugucaguuaauuaauuacaguuguguucaguucccuuaccaagggaaagagcagaauauccugagaggaccuggauuggguucgaagggggcacgguguucgucacguaagcacuucaauacuagcaaccuauugucaucaucgcuuguuggcuggggaagacagggaugauuccagaacccagauugcccaguuucaguggcagggcuguuccccaucuacucacuggcuugggacucugaacauggccugggcaggugggguggggagugauucuuaccuuuggcagcuguuaacuguugauauuucuuuacacagaggcccccccagugcccuuccugcaugcccagcgguacgugaguggcuaugggcugcagaagggggagcugagcacacugcuguacaacacccacccauaccgggccuucccggugcugcugcuggacaccguacccugguaucugcggcuguaugugcacacccucaccaucaccuccaagggcaaggagaacaaaccaagugaggaccugaguccugaaccaggcccccagcccgcccucucauguccucuccaggucccccaaacucucauuucccaggguaguuccugaaguaccucugaaaagcuacacaggcauaaagaguaaggaauaguuucucaaaacuggaacgggagccucacugugccagguucagaaguaauuuauaaaacagcaauaauuaaaacacauaauacuggugauucuuaauaggacuguacaaggacaguagcuuccuuuuucacuuacuuuugccuccuuucuggagcauuggguuuugugaugauucauagacucuuuaagguagggaaaggguuuggcaacguuaggcuuuugaagcuaggaagauagcagagcuggaguagaugguguuuugcuuccuugggagggguaaagagguacaguuaauuaaauuuuuuuauuucuauuuuuauuaaaauuuauuuuuauuuucuauuauuuuucuaaggagaagauaauauuagugcuuccuauuaggugccaggcauagcacuaaagcacuugccuuucuuugguguagggggagacuaguaguaaaguaaaagaccucugaggaagagguuguaccauaucccaaacggccaaacuuaaaaaccuuucaguacuuuaguugauuccuauauuuucaaacauacggugaauaguuucacuuauuuucagcaccauuauuuguaccaccuucaaaaucucuauuucagacauccuaacugcauauucuauagguuuuucuguuauuauucuuuuaaaucuucuccuuuggaaaauuucaaacccaaacccaaacagaauaguguaauaauccccuguacacacccugcagccuuuuuuuuuuuuuuuuaagagacagacuguugcucugucagcuaugccggagugcaguggcaugaucauggcucauugcagucucagacugcucggcucaagcaauccuccuaccuccgcuucccuaggacuacaggcaugaaccgccaugccuuuaauuuuuucacagaggcagggucuuguuauguugcacaggcuggucucaaacuccuggccucaagcgauucuccugccucagucuccuaaagugcugggauuauagguguaagccgcugccugcuggcauaucuuaaagcaaaucuuagacauugcaucaauuaaccuuuaaauacuuuaaggauuuuuaaaaauguaaccguaucauuaccacuucuguuuuccccuguggucuuaaaaaugucuuuuuauaauugguuuguuuaaauugggauaaacaagguucucacauugcauuugcuuuauacuaaguuccucucuugggugggcacaguggugcacaccuguaaucucagcacuuugggaggccaacacagaaggaccacuugaguccaggaguucgaaaccagccuggacaacauugugaggcucccccuaccuauacaaaaaaaauuuuuuuuuuuuuuuuuuuuuuuuuuugagacggauccucacucugucacccaggcuggagugcaguggcgcgaucuuagcucacugcaaccuccaccucccggguucaagcgauucuccugccuccaccucccgaguagcugggacuacaggcgcgugccaccacgccuggcuaauuuuuucuguuuuuaguagagaugcgguuucacuguguuagccaggguggucucgaucuucugaccuugugaucugcccgccuuggccucccaaagugcugggauuaaaauaaauuguuuuuaauuagcugggggugguguugcacgccuguagucccagcuacucaagaggcugaggugggaggaucacuugaacccaggaggucaaggcuauagugagccaugaucauacuauugcacuucagcaugggcgacagugugagacccugucacgaaaaaaaaaaaaguuucuuuuucuuuaaaauuacuagacuauucuuagagcaguuuuagguuuacagaaaaacugagcacaaagcacagaguucccauauacucccugucuccacacccagaaugucccuuauuauaaaugucuugucuuuggugugguacucuucagucucucuucaucuguagcagugcccaugccuuuuuuuuuuuuuuuuaaugucauuuauuuguugaagaaacugggucauuuguuguguagaauguuccacauucuggguuuguccuugugcuaguguuuaacacaccccuccucuccuauauuucuuguguguuggugguuagauuuagaaaccugauuagauucaugucccacauuuuuggcaagaaaaauucccaggugguucugugaacuucuucuugcgucacaucaggcacuuggugucuggugccccaguuguagugaugugaagauugauuagccaucugcagcacuccuaacaaccucucuugaucgcauccugggaucacugcccuggaaacauccucucccuuuucuuagccccugcuuucuucccuugccugccuggcuucuaugcucccaagcccaucuucuaggcacccagauugaggcuccauggcaagcagcagggacaggggcagcagguagccugaccccaggaaagagaugugggugaccuugcaugucuccagguuacauccacuaccagccugcccaggaccggcugcaaccccaccuccuggagaugcugauucagcugccggccaacucagucaccaagguuuccauccaguuugagcgggcgcugcugaaguggaccgaguacacgccagauccuaaccauggcuucuaugucaggugggcuccacccccacaggccaccucucaucccccugaccuacccuuucugcugcuuaccccuugauagggcagccagaugggaacacgggccaucucucugcuucucuguagcccaucuguccucagcgcccuugugcccagcaugguagcagccaagccaguggacugggaagagaguccccucuucaacagccuguaagugugaccacacucacugauaacacauccucagcugccugcugggccuuaacacaggugaccaggcuccugcaggggaguucaggguagauguuacaucuuccaaagagauguguagauuuaauucaauccuaauaaaaauccuggcagucuguggaauuugugaagacuuuauaaaaugauuuuaaagugcuucuagaagaauacuuuuacuuacagccuacauuuacuucuugaugcucuuaaauauuuaaucaagcacuuaucaaaugccaagugcuucugagagcacugagugugcaagauuaaacaaaacagacuuggcccuggccucccuuugcuuacagucuagaaggaagauucuggucuagagaguaaugggguuagagguuggguaggaauugauuuacuggguuaucuaggaaggcuucauuuaggagguggcauuuaggcugaaaccaggcuaagaaagaagcaaccaagcaaaggcggggccccuuuccuccaccucaacaccaggcgucucucuuucuuuccuuucucucucuuucuuucuuucucuuucuuucuuucuuucuuucuuucuuucuuucuuucuuucuuucuuucuuucuuucuuucuuucucuuucuuucuuucuuauuuauuuuuuauuuuacuuuaaguucugggauacaugugcagaacauacagguuuguuacauagguauauaugugccacggugguuugccguacccaucaacccaucaucuagguuuuaagccccgcaugcauuagguauuuguccuaaugcucucccuccccuugccccccgcccgccgcuccccuuuaucagguuuagagauugagcuaugccuucuguugaaagguuuugagccuaagagaacauuggaaacacuguguugcauugcccaauacugccggaaugaggauggggugagauggggaggagcagccaguccugucucaccgcucuuccccugaccccagguucccagucucugauggcucuaacuacuuugugcggcucuacacggagccgcugcuggugaaccugccgacaccggacuucagcaugcccuacaacgugaucugccucacgugcacugugguggccgugugcuauggcuccuucuacaaucuccucacccgaaccuuccacaucgaggagccccgcacagguggccuggccaagcggcuggccaaccuuauccggcgcgcccgagguguccccccacucugauucuugcccuuuccagcagcugcagcugccguuucucucuggggaggggagcccaagggcuguuucugccacuugcucuccucagaguuggcuuuugaaccaaagugcccuggaccaggucagggccuacagcuguguuguccaguacaggagccacgagccaaauguggcauuugaauuugaauuaacuuagaaauucauuuccucaccuguaguggccaccucuauauugaggugcucaauaagcaaaaguggucgguggcugcuguauuggacagcacagaaaaagauuuccaucaccacagaaaggucggcuggcagcacuggccaaggugauggggugugcuacacaguguaugucacuguguaguggauggaguuuacuguuuguggaauaaaaacggcuguuuccgugguucuuugccucuuguccuugaguccugggaagagcuggggacuggggauuguuugcugagugccugaacaggaccuccuacccuaugccugcaacccccuccacaaaaaacaaaaaacccuaccuccucccaccuggccggaaauuucuucuccugaucugcucccccuguccuccccauccccaucugauugugauucccagaacuccccggguuguuugggaguguuucugaaagcauaauccauggccauggaaaugaaucauccuacuucuugggggcauugagagucaguccacaucagca

SEQ ID NO: 13517 - RNA, 12103 nt, Homo sapiens
ggaauagaaacccaggagcccugagccuuggcccucaggccccaggagggaggucaggagggaggcguggacaaggguccggccguagcuggucccguccuggaagcugcuuaaguuccugguucccaccggggccaagagugauaccugauccugggggauugugaaaugaccucauguggcagcccgcccgcggugcccgcaaagcccuccacccuccccuuccccgcucggcuccaccccuaccccacgcccccucccgcgcgcgcgguuaaauccccgcaccugagcaucggcucacaccugcaccccgcccgggcauagcaccaugccugcuugucgccuaggcccgcuagccgccgcccuccuccucagccugcugcuguucggcuucacccuagucucaggugaguggggcggggagaggcccggcgccuagaggggccgagccacgagcgccaggauggagccaggcggaggcguagccucuggaggcuggggaagugggaauuccgggggcggaaguggcggggacccuuggagccuagggugugggguccaaugugcuggagguggagagaccacugauggcugcaauuugggaggauucugugcugaacgcggacacuccguggcugcagugggcugggggugggggcugcucugccucgaccucggaagcuccgagacgcucagcugugcggcguccccuagggcugagaucugagggccccgacgccaaggguuagggagcucucguacucccaggggucagggacuccuggucuggaagaaggagucucugggggcuguaaggggacuccuagggccagagacugagaauuccuugggguuaagguuuggagcaggaggugggcauccucuggggcuggcgcuacgccccacccucgacugucccgggccuccccucccaggcacaggagcagagaagacuggcgugugccccgagcuccaggcugaccagaacugcacgcaagagugcgucucggacagcgaaugcgccgacaaccucaagugcugcagcgcgggcugugccaccuucugcucucugcccaaugguaaccccacggcggccgagcgggaacggggcggggccgcgcugggcugggaggaggugggagggcccggguuccgggaacaggggcgcccccggacccggggacccccgggaaagucaaggcgguugaaaccagauccgucaguccucucccucgcacggcccagggguagacaaaggcgucguugaaacgcagccaaggggggguccccaccccuagcugggauucgagucucuggugcaugacgggcuuccgggcacgcacagccgggacauuguuccccgcggccuggggacccggggccgcaguuuccuucucgaaccggccgaagccugcccugcgggaaagcccggagccuggggcgcucaccucuccucuuggagucccucccugggggccucccccagcccuggggaaagacugggagagccuggccuggcaagauuuuccccaauuccucuguccaggcggaaaggaacuuuacagauuuaggaaaaugccccgcucaucuuaaagauguguaagggagcaucggugagaaaaaaauguucuugcccaaggucacaccgccaucccauggcugcuggagucauagugaggguucagcuuuugccuuucaggccaacuggcugagugauucgaagaaagugaggaauccucccuggacacuguaucgcccuucgucgucuuucagucaaucucuuccacucuaaggauugagugagcgcgagcuggggacucucucaaaggugcuugcuggagcugcagucuccaccaggcuaucagaacaggggguggcuuaaacagcauggaaucucagcuuuccguucuccagaggaaaaugcugaggauuagaggcagggauaggaccuggagagaaccaagguacuguaaugauguucuuuauccagaauacagccccugugacuuuuccucucuguuauuuccuugaagaugccagcacaggcugggaagguuuguaauacggugacccaagacaccgaucagcagggaggugguaaguggagggggacuggcagcccaccaagggcagcuucaaggucaugaguccccuccucugggccagggagaggaggaccagaaggagagaggaagauuuggagagaaagcaggcagcagccagaugagagagguggaggagcaaaggagggagucuuugcuguuugauggaugaagaauuuguucccuuaucucagauggacagacugaggcaggaagagggacaaggucagauggccuccugagccagggaggcagccuggagguuugaauccuaguucugccauuuucuaguuaugugauccugagcauguuguuuaccucucugagccucugcucuaagaugggaauaauuccaaacucuauaggauuggcaugaggacuaaaugaaauaaugcaucuaaagugucuauuagugagaagauacuccauacacaguggcuuguuuugaucauaaaugguucccuauuuauuuccagggcagcccaauauuacagguuccuacuccuuucaagagaaugaauuucuuuguauuaggaagucaagacuguuggcaacuuaacaacauuuuuuuuuguauuuaugcuuuaaguucugggguacacgugcagaacgugcagguuuguuacauagguauacaugugccauggugguuugcuucacccaucaacccgucaucuacauuagguguuucuccuaaugcuaugccuccccuaauucccaaccccccgacaggcccuggugugugauguuccccucccuguguccauguguucucauuguucaacuccuacuuaugagugagaacaugcgguauuugguuuucuguucuuguguuaguuugcugagaaugaugguuuccagcuucauccaugucucugcaaaggacaugaacucaucauuuguuauggcugcauaguauuccaugguguagacgugccacauuuccuuuauccaguccaucacugaugggcauuuggguugguuccaagucuuugcuauugugaacagugcugcaauaaaccuaugugugcaugugucuugggcauuugcguugguuccaagucuuugcuauugugaacagugcugcaauaaaccuaugugugcaugugucuuuauuguagaaugauuuauaauccuuuggguauauacccaguaaugggauugcugggucaaaugguauuucuuguucuagauccuugaggaauggccacacucucuuccacaaugguugaacuaauuuacacucccacgaacaguguaaaagcauuccuauuucuccacauccucuccagcaucuguuguuuccugacuuuuuaaggaucuccauucuaacuggugugagauguuaucucauugugguuuugauuugcauuucucuaaugaccagugaugaugagcauuuuucauguuuguuggcugcauaaaugucuucuuuugagaagcaucuguucauauccuucgcccacguucuaaugggguuuuuuucucguaaauuuguuugaguucuuguagauucuguauauuagcccuuugucagauggauagagugcaaaaauuuucucccauucuguaggcugccuguucacucugaugauaguuucuuuugcugugcagaagcucuguaguuuaauuggaucccauuugucaauuuuggcuuuuguugccauugcuuuugguguuuuagucaugaagucuuugcccaugccuauguccugaaugguauugccuagguuuucuucuaggguuuuuaugguuuuaggucuuacauuuaagucuuuaauccaucuugaguuaauuuuugcauaagguguaaggaaagggguccaguuucaguuuucugcauauggcuagccaguuuucccaacaccauuuauuaaauagggaauccuuuccccauugcuuguuuuugccauguuugucaaagaucagguggcuguagauguguaguguuauuucugaggccucuguucuguucuguuggucuauauaucuguuuugguaccaguaccaugcuguuuugguuacuguagccuuguaguauagcuugaagucaguuagcgugaugcuuccagcuuuguucuuuuugcuuaggauugucuuggcuaugugggcuuuuauuugguuccauaugaaauuuaaagucguuuuuucuaauucugugaagaaagucagugauagcuugauggggauagcauugaaucuauaaauuacuuugggcaguauagccauuuucacgauauugauucuucuuauccaugagcauggauuguuuuuccauuuguuuguauccucucuuauuucguugagcagugguuuguaguucuccuugaagagguccuucaccucccuuguaaguuguauuccuagguauuuuauucucuuuguagcaauugugaaugggaauucacucaugauuuggcucucugucuauuauugguguauaggaauacuugugauuuuuguacauugauuuguauccugagacuuuacugcaguuucuuaucagcuuaaggagauuuugggcugagauaaugggguuuucuaaauauacaaucauuucaucugcaaacagggacaauuugacuuccucuuuuccuaauugaauacccuuuauuucuuucucuugacugauugcccuggccagaauuucuaaugcuauguugaauagggguggugagagagagcaugcuugucuugugccgguuuucaaagggaaugcuuccagcuuuugcccauucaguaugauauuggcuguggguuugucauaaauagcucuuguuacuuugagauaccuuccaucaauaccuaguuuauugaguguuuuagcaugaaggguguugaauuuuaucaaaggccuuuucugcaucuauugagauaaucaugugguuuuugucauugauuuugcuuaugugauggauuacguuuauugauuuguguauguugaaccagccuugcaucccagggacaaagccaacuugaucaugguggauaagcuuuuugaugugcugcuggauuugguuugccagcauuuuauuaaggauuuucgcacugauguucaucagggauauuaaccugaaauuuuuuuguuauugugucucugccagguuuuaguaucaggaugaugcuggccucauaaaaugaauuagggaggaggcucucuuuuucuauuguuuggaauaguuucagaaggaaugguaccagcaacuccucuuuguaccucugguggaauucggcugugaaucugucuggucccagacuuuuuuugguugguaggcuauuaauuacugccucaauuuuggaacuuguuauuggucgauucagggauucgacuucuuccugguuuagacuugggaggguguauguguccaggaauuuauccauuucuucuagguuuucuaguuuauuugcguagagguguuuauaguauucucugaugguagauuguauuucugugggaucaguggugauauccccuuugucauuuuuuauugugucuauuugauucuucucucuuuucuuuauuaguauggcuagcagucagacuauuuuguugauguuuuucaaaaacccagcuugugaauucauugauuuuuuuugaaggguuuuucaugucucuaucuccuuuaguucucucugaucuuaguuauuucuugucuucugcuagcuuuugaauuuguuuguucuugcuuuucuaguucuuuuaauugugauguuagggugucaauuuuggaucuuuccugcuuucccuugugggcauuuagugcuauaaauuuccuucuaagcacugcuuuagcugugucucagagauucugguauguuaugucuuuguucucauugguuucaaagaacuuauuuauuucugccuugauuuuguuauuuaccuaguagucauucaggagcagguuguucaguuuccauguaagguuaugcggucuugagugaguuucuuaauccugaauucuaauuugauggcacuguggucugagagacuguuaggauuuccguucuuuugcauuugcuaauuaguguuuuacuuccaauuauguggucaguuuuagaauaagugugauguggugcugaggagaauguauauucuguugauuugggguggagaguucuguagaugucuauuaggucugcuugguccagagcugaguucaagucuuggauaucuuuguuaauuuuccgucucauugaucugucuaauauugacaguggggguuaaaguuucccacuauuauuaugucggagucuaagucucuuuguaggucucuaagaacuugcuuuaugaaucagggugcuccuguauuaggugcauauauauuuagcauaauuagcucuucuuguugcauugaucccuuuaccauuguguaaugcccuucuuugucucuuuugaucuuuguugguuuaaagucuguuuuaucagagaauagaauugcaaccccugauuuuuuuuugcuuuccauuugcuugguaaauauuccucuaucccuuuauuuugagccuaugugucuuugcacuugagaugggucuccugaauacagcacaccaaugggucuugacucuuuauccaauuugccagucuuugucuuuuaacuggggcauuuagccuguuuacauuuaagguuaauauuguuaugugugaguuugauccugucauuaugaugcuagcugguuauuuugucuauuaguugaugcaguuucuucauagugucgauggucuuuacaauuugguauguuuuugcaguugcugauuccaguuguuccuuucuauguuuagugcuccuuucaggagaccuuguaaggcaggccuguugaugagaaaaaucccucagcauuuguuugucuauaaaggauuuuauuucuccuucauguaugaagcuuacuuuggcuggauaugaaauucuggguugaaaauucuuuaagaauauugaauauuggcccccacugucuucugguuugcaggguuucugcagagagaucugcaguuagucugaagggccucccauaguggguaacccaaccuuucucucugggugcccuuaacauuuuuuucuucauuucaaccuuggugaaucugaugauuaugugucuugggguuauucuucucaaggaguaucuuugagguguucucuguauuuccugaauuugaauguuggccuuucuugcuagguuggggaaguucuccuguauaauauccugaacaguguuuuccaacuugguuccauucuccccaucacuuucagguacaucaaucaaacauagguuuggucuuuucacauagucccauauuuuuuggaggcuuuguucauucauuccuuuucauuauuuuuucucuaaucucaucuucauucuuuauuucauuaaauugaucuucaaucucugauauccuucuucugcuugaucaauucggcuauugauacuuguauaggcuucaugacguucucgugcuguguuuuucagcuccaucaggucauuuauguucuucucuaaacugguuaaucuaguuagcaauuccuauaaccuuuuuucaagguucuuaccuuucuugcauugggguuagaacaugcuccuuuagcuuggaggaguuuguuauuacccaccuucugaagccuacuucugucaauuugucaaacucauucuccguccaguuuuguucccuugcuggcgaggaauugugauccuuuggagaagagguguucugguuuuuggaauuuucagccuuuuugugcugguuucuccccaucuucguggauuuaucuaccuuuggucuuugauguugaugaucuuuggaugggccuucugaguggacguccuuuuuguugauguugaugcuauuccuuucuguuaguuuuccuucuaacaaucaggccccucagcugcaggucuguuggcguuugcuggagguccacuccagacccuguuugccuggcuaucaccagcagaggcugcagaacagcaaagauugcugccuguuccuuccucuagaagcuuugucccagaggggcacccgccagaugccagccagagcucuccuguaugaggugucugucagccccugcuggaaggugucucccagucaggagacacggaaaucagggacucacuugaggaggcagucugacccuuagcagagcucaaaugcugugcugggagaucugcugcucucuucagaaccggcaggcaggcugaagccacauccacagcugccccuucccccaggugcucugucccagggagaugggaguuuuaccuauaagccccugacuagggcugcugccuuuuuuucagagaugcccugcccagagaggaggaaucuagagaggcagucuggcuacagcggcuuugccgagcuguguugggcucugcccaguuugaacuuccugguggcuuuguuuacucugugaggggaaaacugccuacucaagccucaguaaugguggacgccccucccccuaccaagcuugagaguuccaggucaacuucagacugcugugcuggcagugagaauuucaagccaguggauguuagcuugcugggcuccaugggggugggauccgcugagcuagaccacuugucucccuagcuucagcccccuuuccaggggcgugaaugguucugucucacuggcauuccaggcaccacugggguaugaaaaaaaaauccugcagcuagcucagugucugcccaaauggccaccuaguuuugugcuugaaacccagggcccuggugguguaggcacccaaaggaaucucuuggucuguggguugugaagaccgugggaaaaguguaguaucugcuccagagugcacuauuccucacggcacagucccucauggcuucccuuggcuaggggagggaguucccugaccucuugugcuucccaggugagaugaugcccuacccuacuucugcucgcccuccgugggcugcacccacugucuaaccagucccaaugagaugagccacguaccucauuugaaaaugcagaaaucaccugccuucugcauugauucacugggagcugcagacuggagcuguuacuauucggccaucuugaaagcugaaccuaaaucuuuuuuuuuuuugagauggagucucgcucugucgcccaggcuggagugcaguggcaugaucucagcucacuacaaccucugucucccaggugcaagcgauucuccugccucagccucccaaguagcugggauuaccggugcaugccaccacgcccaguuaacuuuuuuguauuuuuaguagagcggggggucucgaguccugaccuccgaugaucccacccgccugagccucccaaagugugggauuacaggcaugagccacugcacccggugaucugucagccacuuuccuuguccucuacagcuaaucacccaguucugugccuguguuuuacacacaaaaaccugcacauauuuauagcagcuuuauuuauaauugccaaaaguuggaagcaaccaugauguaccucaguugaugaauggauuuggcugggccuggcuccccucuaucuaaccugggaaguggagugugauuguguguguguuuguuaguggaaggacgugugguuucucucugcauggaugaaugaguguauuuggagggucauggugcugagagacugcaacugggauucggucuguggguaugagugaagauuauaaguguguaaccccucacauguguacuguacuuuacacuuuaaguggcagcauagugcuuaaccauggcagcagcaguuaacacauagacucugcagcuagauuucuugggguucaaauucugccucaauucugugugaccuuaggcaaauuacuuaacuucucagugccucaguuuccucacuuguaacacaaggaaauauuaacagaucccuccccuucuuuuaggauuauugugagaauuagaagaguuaauauauguuaggggcuugauaccuggcauguaauaagagcuaauuaaguguucacuguuauaauuucucauaacuacagaguaguuugauauuucagggagaaauaauauauguuuguuucccacugcuuucacaacaacccuauguuguaauuagcacuguuccacuggcaccuaaagacacggaggcucugggagauuucuggcccuaggccacgaaggcccacuugggacucaagcugagguccugugauuccauuugggagcaggaggagggauuugcaggugaucuuccugggccuccugagagcagcucaggugcccaagauggacucaggcaggcagcucugcuguaugugaagcccagugaggggcagugggggggccaugcugcagguacaaguuaaucucccuguaucgccucugcccacuuacccuuacuccuuuuucuacccagauaaggaggguuccugcccccaggugaacauuaacuuuccccagcucggccucugucgggaccagugccagguggacagccaguguccuggccagaugaaaugcugccgcaauggcugugggaagguguccugugucacucccaauuucugagguaagugaacgggaaagagaaagugcauugauggccagguguugugggaaacaggagaaaacgucacccaggcggaggugaagggagguuaguugcagggacaguugggaaagguauaccaguggggugacccucagccuguucuaaaagaagagugaaagguggguagucugaugagcugcauuggggaggcugucucaggcagagggaacagaauaagcaagagcuuggcugggugugguggcucaugccuauaaucccagcacuuugggaggcugaggugugcggaucaccugaggucgggaguucaagaccagccugaccaacauggagaaaccccgucucuacuaaaaauaccaaaaaaaaaaaaaaaaauuuaaugggugugguggcgggugccacccacccgcuacucaggaggcugaggcaggagaauugcuugaaccugggagacagagguuguggugagcugagaucacgccauugcacuccagccugggcaacaagagcgaaacuccaucucaaauuaaaaacaaacaaacaaaaaacagcuuggugguacccuuggguugaaaucucgugguugucaugugcuacuuuuaacaauuucucagcaaaguaaccugaagauaacugauagaauccaauagugcagagaugagcaauugaaaucuagagagggggugugcucuuggugcccgagagggaacuaugguuucucuaaacuaagcuauggucucccuggagccagggcucucagaugccaacugcauggauaggcuuugcagucaagaagaccuugguucaaauguuagcucugacacuuaccuaaccuucucaccucccugagucacaguuaucucgcuuauaaaauguagcuaaauaagaucuaauugaucagauaaucccauuuuaaccuaaagaagaaggcauggcagaacuuccuaauaguagaaggauucuuggggagagaaauggccaugaccccucaggaaggccacaguggacaucugggaccacaguauacccaggugccugcuagggauggucugaccacaguauacccagguaccugcuagggauggucugaaggagaagaguaugucuagaaccuguagaaaaugcaagcagagcccccagaaggugaggcuuugcugugugggugugugggaugggguggggucaaggagcuggucuaggauuuaagcugcagguacuccugccuagucuaauggauauuguuguugaugguauuguuauaauuuucuuccuccagcuccagccaccaccaggcugagcagugaggagagaaaguuucugccuggcccugcaucugguuccagcccaccugcccuccccuuuuucgggacucuguauucccucuugggcugaccacagcuucucccuuucccaaccaauaaaguaaccacuuucagcacguucugucucugucuccccugac

SEQ ID NO: 13518 - RNA, 3579 nt, Homo sapiens
uggaguacacggugaaaggcuagucacacugggccuccacuuugcccucuuuccuucucuucuccucacagcagugccuggucaaacccagcaacccuuggccagaacuuacucacccaucccacugacaccaugaagccugugcugccucuccaguuccuggugguguucugccuagcacugcagcuggugccugggagucccaagcagcguguucugaguaggugcuggaucugggcccaaggagggaaguaacauguguggauaggagaggaucugagggcugacagucugucacaccucuuggaaaaauaccgugucauguucaagggcccaagcuuuauuguuggcaagaucuagguuugaaucccugcucuguugcugagugaccuugggcauaguaucugggccucagguuuuuauccuuauaaugaauacaggaggagaacagauaaugcaugcagacauagcucacucuuacuaaaccaugguaaaugcucaguaauauuaaaugcuguaaaugugaucagccucaucauccagcuuagucuugcugcccguggcuccuucauggaugcuuggacucacuuuucaagcaauaaaacagagagacaacgaaguugguagaacucaagcuagaaucuacauaaccuuggccuuggaggauguuuugggaaggagggaaaggaagucuugccuuuuauuccacauuuucaaacuccagagguacuguacaauuaccgguaauuagcaucaaugggacaguguagaguccaucucagcagccaccacugcccagcucaacucaaaagagcucuggcucuaguaauguugaccuuaaccaauaccaagugggaaaagaacuguuauucaucauacauccacucuucuauggggaaaacaucuucagaauacuggcggcucagaagagggauaagugugguagcucaugugucuggggaggcuagguccugcuuaagaaguuucagaaaaggcaugcagguuuguaggacuaagagggacuaagcaagcuacaagaaaauaggagugcccaggguagaguuaauuggagaaucagaauuugaggaaaggcacaaagaggcuuucuaaaagacugguaaaugcugugagugaaguugggaccagauacccagaagaggggucaagacuugaaaagggugaccucucugagaucucuggaucauggugucuaucucuaaacugcucuguugagccccaagcucuucaaaguguggauuaguuccaauuucuugcagugccccagugagcuauagaauagcugagaggccaggggugaguacuaguuauuggucucuguuaaauugucaacagcuugaaccucagcuucuuuuaccccaauucuggugccauuugcuacuacaguuauagucaugaccucuuucuucauucauuccuuucaaaucaucauaauauccuauagauuuccuucuaauugcaaauauuugcagaggaauagacccacaauuccucuauuugcaauagaaugccccacuuuugacuuuugcccccaaagaaagggagaaucacaagguacaaaaauuaggaccuggaagggcuuggggaaagggauuaauggggcccaucuuuagaguccaggaauagaaaggagauuguggguuguggacuuagggaagacucucccagggcagguaggucuuagcuuugaacugaaauacuuggggguaggggaggaaauaggaagucaacauaaugaugcuuauucuucucuaacaguagaaaguggggcauccuggugcucuggccuccugaucgagagacaccaaggaagaaaaaagcugaaucuuugaacgccauucugaaauccccacccuucuuaccaugaaagaagucacucccagaacuuacuugugaauugggucccagcucucugauccaguaccuucaguuuaaugcauggucuucauccuuuaccaaaacuuaccuuucacucauucuuccuguacacaaauaacccauguuagguuaaccccaggguaaacuauguuguuaaugagaagcucuacaacuugcucaagaccacacaaugaaucagugcagaacgaacauacaaaccucuuucuuguucaccacauacaccauugauacccuugauauggacacaaccauagucaaugggggcuuggcaucugaacuacaaggauggugaaugaccaaugggugcaggguucuaccaaacucuguucuugaucaaaaaauauccaugcccugcuucccugcucagaacucagaggaaggcagcagcugaggacaaaaccugaugccaccacccuggaaccaugcaaggcagaugaggguggcagguuuccuggcaguucccugggcuuucugaguucugaacauuacuccagccuguuggugaggcccuucucuuacuuguucuguguuccagaguauaucuuggaaccuccacccugcauaucagcaccugaaaacuguacucaccuguguacaaugcaggaagauugcgagaaaggauuucagugcuguuccuccuucugugggauagucuguucaucagaaacauuucaaaagcgcaacagguaagagauaucucauauccaggucugauccuagagcugcuggugggagcccagcagaagagucccuuaccagcaacugugcuggaucucuccuuuuuuuuuuuuuuccuugguggccauguugccaacaugccccuucucuugaccaaggauaauuuccauaaaaguccugauuagaaaagcccuccuccccucccaaucaccacaucccaucaccauauccgugaauuucugacucugccucucugaacacacccacaaaugccuuuauccacagaccuucccccgacccagaauccacccuuaucccagggacacuguaccugcagguguaaccaaaaucccaaagcaaaauuuguccuacacuuuugcuugcccuccuuucacaagacaccauccuuuggccaccaguguucuugggcucuggagauccagcccaaaggaaguuuugauuaauuguccagacauuaacacuagccgcaagccugcuaaauggagugugcucccagggcagagaaaggacauagggugcugaugagacauaugguuucuaaucccaucuugcaacuaugucuuucuaugaccuugaguaagacaauucccucuuuuuuacuuucuuuuucucaugaguaaaauaaguacucuuguuuuuuccugcuuugcaaggcccauaugaaauuucaaaagacucacaguggaagacucaaccaaugagcccuuugagggaagccuggcagucuuguucccugcuguauucccuaccaugagcagaauacccagcaugagauaaugugcagagugauuaagcaugggcucaaagccaaacaccugggcucaaauccuggcuucuuagcuaagugaccuuaagugaucuuagacaagcuaauuaaccucucucugggcaucaacuuccucauccuuaagacuggaacaauaauagugagguuaaaauagacaauccauguaagcuuuaaaa

SEQ ID NO: 13519 - RNA, 4119 nt, Homo sapiens
ccacgaguuuuggaacauuugcuuuuauuccuuccagacaaagacccacaaggggucgcgccucccugguggggacccggcagggcggagucucccacacccuagggacacgcgaucuugguagaggcgacuguccacuccuuacugcacgcccuccaucaucuucaggaacucugagggaaaggagagggagagggucaggggucccacuggggacgcagaggccaggccagggcuccagccacacagaggggaugacuuuuuguuuuuguuuuuguugagacagagucucacucuguugccaaggucgccaaggucugucacccaggcuagagugcaguggcacaaucauaacucauugcagccuugaucuccuaggcucaagcgauccucuuaccucagcccccggagcaacugggaccacaggugugccaccacaccugccuuuuuauuuuauuuuauuuuuuguaaagacagggucucacuauguugcccaggcuggucucgaacucuuggccucaagcaauccucccaccucauccucccaaaguucuaggauuuuacaguccugagccaccacgccccccugccuggucauuaauugauaaacugcacagagucguggagcgcuucuauaccugcccccaggagacuauggggaacuuggugaaguuacgcccagcccagcccacaaggccaaggacacugcaccggagccaggcaccagugcccgccguccucuggggcucccacccgcucuucccaagcucccguuggcccucaccgucgaagucaaugcggccgucguuguucuugucgccgucuuucaucagagauucgaucuccucguccgucacgugcuccccggaggcccugaaaaucucagccagcuccuccgggucgauguagccgucugcauuccuucagguccgagggacagggcagggcucagggccggggcgagcugcccuggccaccacacucgacgccccgcuuccgcacucccaacacggggaagcuuccagcgcugccggccggguucugacugcuaagccccucccucggcucccgggcccccagcgcaccugucgaagaugcggaagcacucggccagcuccuccucgcucuucccuuucgcguccucuuucaucuggcgcaccaucaugaccaagaacuccucgaagucgauggugccgcugccugcgggcagcagguggcagacugagccugagcccagccgcugccgccucuccccaccauccccugccuccgagggacacccgcucaccguccucauccaccuccucgaugauggcguccagcuccuccuuggugggugucuggcccagcauccucaucaccgugcccaacuccuugacgcugauguccccaccaccaucagcaucaaacaugucaaaggcagccuugaacucugcgagggagggcagagggcagaggugaggccugcuggacugucagccucacaccuacccccccccaacccccacccugccuagaggccaacauguccccagcauacauccacccagcccccagccugccgcgccucacucaccagcgaucaucucuucgcugagguaggaccuggccucagccugcugguccgucugcaggagacacagagaaagucugagcugaagaggcagccccagagcaguuccucaccucaaagccauucuucccaacccccacucugucagcgcccuugguucuccagaagaacaacuucaaacuugucacauaauugugugcccgcacagcacccaaucacaguuuuguuuugucucguucugucacacaugcuggagugcaguagugugaucauagcucacugcagccucaaccuccugggcucaagcaaucgucccacuucagccuccugaguagcugggacuauagcauacaccacgccuaauuuuuaaaauuuuuuguagagauggggucccacuauauuacccaggcugguuuugaacuccuggguucaagugauccugccaccucggccucccaaagugcuaggauuacaggcuugagccacugugcccagcuucugaccccaguuuuuguuuuugcuuuuuguuuuugugacagucucgcccugucgcccaggcuggagugcaauggcgugaucucggcucacugcaaccuccaccuccuggguucaagcgauucuccucccucagccucucgaguagcugggauuacaggcaugcgccaacacgcccagcuaauuuuuguauuuuuaguagagacgagguuuuaccauguuggccaggcuggucuugaacuccucacaucaggugauccgcccaccucggcuucccaaagugcugggauuacaggcgugagccaccaugcccggccugaccccaguuuuuuuuguuuguuuguuuuguuuuguuuugagacggaguuuugcucuuguugccuaggcugcaguguaauggcacgaucucagcucgccacaaccgcaacccccaccuccgggguucaagcgauucuucucccucagccucccgaguagcugggauuacaggcaugcaccacaacgcccggcuaauuuuguauuuuuaguagagaugagguuucuccauguuggucaggcuggucucgaacccccuaccuuaggcgaucugccugccucagcuucccaaagugaugggauuacaggcgugagccaccgcgcgcagccugugaccccaguuuugagcaaaagagaggagacaacaaguuaagcccaaggccuucucacuugucaauugaaggccaagucgggaaccccccccaccccccagugaccuuaggcacgucaauuagcgugccuucaucuuuucucuguagcuuuucagggaugagauaucaggggugugaaagggcuuuguaaagggcuagcaccauuccagcacuauuuuccaguuuucugcagcuccuaauggugcccgguacuuuaauaguugcucaauaaaauguuuguucucaaauaaauaauaaugcaacacaaaguuauugaguacuugcugcaugucaggccacagaucaggcacuggaaccacaaagaagagauaaaagacacaucaucccgccccucagagaacuggcagagucggaggcugucagcuuccuucuuaggauucagucauuggagaaaaggccccucauggggggccgaaugugauggaggccuugacaugaaagugagauuucugcagggguuuccacgucauauccaagccaggccaucugggucagaggcuuuggauugaggcuggcagugaggacagggugaggcuuccaaggagcucuucagccagcuggccaccagugcuccuccuucucccccuccuuccucuccuccucuuucccuaugccaggagggcaggcuauuuuuagucaggcaugggcaacagcagcuggccucugggaucuaguuacuccuugaagugaaguggggagggggaucucagaccaaaacaacagcuccaaaucagaagcccucucuaggagagcggagucucucuaacucuggucugucaucuucugccccuucccaucauccucagggcucccagagcccugcaucugagcaggccccacgcccugccggccucccgucuucuggaggaggcuuucuucucuccaugaugauaggaggguuuggccaggcuucuggcucaccccugccacuggccugcugggugacucacucugaccccucagaguccccacugugugaaggaaacaagcuaagagcucuucacaggucuaugaaugacacugcuggaaguuuccagaagugaguaggcagucagcaagccuuaaggaucaaucucuggaauaucccagcccuccccuuucaagaaaagucaaaggccuuccuccaagacaccuggguuccaggaaccuccaugcuccaaccucaaacauccaaguuacugccccacagagcacccaggccuggccugaaagggguccagagugcucccgugaguaaaggcacaaaguccccucuuguccuuaccaugguugcuggugaccgggacuccucuguugcaggucgccuccuuugcacuccaccacccaaagaugaccuggccugcu

SEQ ID NO: 13520 - RNA, 4119 nt, Homo sapiens
agcaggccaggucaucuuugggugguggagugcaaaggaggcgaccugcaacagaggagucccggucaccagcaaccaugguaaggacaagaggggacuuugugccuuuacucacgggagcacucuggaccccuuucaggccaggccugggugcucuguggggcaguaacuuggauguuugagguuggagcauggagguuccuggaacccaggugucuuggaggaaggccuuugacuuuucuugaaaggggagggcugggauauuccagagauugauccuuaaggcuugcugacugccuacucacuucuggaaacuuccagcagugucauucauagaccugugaagagcucuuagcuuguuuccuucacacaguggggacucugaggggucagagugagucacccagcaggccaguggcaggggugagccagaagccuggccaaacccuccuaucaucauggagagaagaaagccuccuccagaagacgggaggccggcagggcguggggccugcucagaugcagggcucugggagcccugaggaugaugggaaggggcagaagaugacagaccagaguuagagagacuccgcucuccuagagagggcuucugauuuggagcuguuguuuuggucugagaucccccuccccacuucacuucaaggaguaacuagaucccagaggccagcugcuguugcccaugccugacuaaaaauagccugcccuccuggcauagggaaagaggaggagaggaaggagggggagaaggaggagcacugguggccagcuggcugaagagcuccuuggaagccucacccuguccucacugccagccucaauccaaagccucugacccagauggccuggcuuggauaugacguggaaaccccugcagaaaucucacuuucaugucaaggccuccaucacauucggccccccaugaggggccuuuucuccaaugacugaauccuaagaaggaagcugacagccuccgacucugccaguucucugaggggcgggaugaugugucuuuuaucucuucuuugugguuccagugccugaucuguggccugacaugcagcaaguacucaauaacuuuguguugcauuauuauuuauuugagaacaaacauuuuauugagcaacuauuaaaguaccgggcaccauuaggagcugcagaaaacuggaaaauagugcuggaauggugcuagcccuuuacaaagcccuuucacaccccugauaucucaucccugaaaagcuacagagaaaagaugaaggcacgcuaauugacgugccuaaggucacuggggggugggggggguucccgacuuggccuucaauugacaagugagaaggccuugggcuuaacuuguugucuccucucuuuugcucaaaacuggggucacaggcugcgcgcgguggcucacgccuguaaucccaucacuuugggaagcugaggcaggcagaucgccuaagguaggggguucgagaccagccugaccaacauggagaaaccucaucucuacuaaaaauacaaaauuagccgggcguuguggugcaugccuguaaucccagcuacucgggaggcugagggagaagaaucgcuugaaccccggagguggggguugcgguuguggcgagcugagaucgugccauuacacugcagccuaggcaacaagagcaaaacuccgucucaaaacaaaacaaaacaaacaaacaaaaaaaacuggggucaggccgggcaugguggcucacgccuguaaucccagcacuuugggaagccgaggugggcggaucaccugaugugaggaguucaagaccagccuggccaacaugguaaaaccucgucucuacuaaaaauacaaaaauuagcugggcguguuggcgcaugccuguaaucccagcuacucgagaggcugagggaggagaaucgcuugaacccaggagguggagguugcagugagccgagaucacgccauugcacuccagccugggcgacagggcgagacugucacaaaaacaaaaagcaaaaacaaaaacuggggucagaagcugggcacaguggcucaagccuguaauccuagcacuuugggaggccgagguggcaggaucacuugaacccaggaguucaaaaccagccuggguaauauagugggaccccaucucuacaaaaaauuuuaaaaauuaggcgugguguaugcuauagucccagcuacucaggaggcugaagugggacgauugcuugagcccaggagguugaggcugcagugagcuaugaucacacuacugcacuccagcaugugugacagaacgagacaaaacaaaacugugauugggugcugugcgggcacacaauuaugugacaaguuugaaguuguucuucuggagaaccaagggcgcugacagaguggggguugggaagaauggcuuugaggugaggaacugcucuggggcugccucuucagcucagacuuucucugugucuccugcagacggaccagcaggcugaggccagguccuaccucagcgaagagaugaucgcuggugagugaggcgcggcaggcugggggcuggguggauguaugcuggggacauguuggccucuaggcaggguggggguuggggggggguaggugugaggcugacaguccagcaggccucaccucugcccucugcccucccucgcagaguucaaggcugccuuugacauguuugaugcugauggugguggggacaucagcgucaaggaguugggcacggugaugaggaugcugggccagacacccaccaaggaggagcuggacgccaucaucgaggagguggaugaggacggugagcgggugucccucggaggcaggggaugguggggagaggcggcagcggcugggcucaggcucagucugccaccugcugcccgcaggcagcggcaccaucgacuucgaggaguucuuggucaugauggugcgccagaugaaagaggacgcgaaagggaagagcgaggaggagcuggccgagugcuuccgcaucuucgacaggugcgcugggggcccgggagccgagggaggggcuuagcagucagaacccggccggcagcgcuggaagcuuccccguguugggagugcggaagcggggcgucgagugugguggccagggcagcucgccccggcccugagcccugcccugucccucggaccugaaggaaugcagacggcuacaucgacccggaggagcuggcugagauuuucagggccuccggggagcacgugacggacgaggagaucgaaucucugaugaaagacggcgacaagaacaacgacggccgcauugacuucgacggugagggccaacgggagcuugggaagagcgggugggagccccagaggacggcgggcacuggugccuggcuccggugcaguguccuuggccuugugggcugggcugggcguaacuucaccaaguuccccauagucuccugggggcagguauagaagcgcuccacgacucugugcaguuuaucaauuaaugaccaggcaggggggcgugguggcucaggacuguaaaauccuagaacuuugggaggaugaggugggaggauugcuugaggccaagaguucgagaccagccugggcaacauagugagacccugucuuuacaaaaaauaaaauaaaauaaaaaggcaggugugguggcacaccuguggucccaguugcuccgggggcugagguaagaggaucgcuugagccuaggagaucaaggcugcaaugaguuaugauugugccacugcacucuagccugggugacagaccuuggcgaccuuggcaacagagugagacucugucucaacaaaaacaaaaacaaaaagucauccccucuguguggcuggagcccuggccuggccucugcguccccagugggaccccugacccucucccucuccuuucccucagaguuccugaagaugauggagggcgugcaguaaggaguggacagucgccucuaccaagaucgcgugucccuagggugugggagacuccgcccugccggguccccaccagggaggcgcgaccccuugugggucuuugucuggaaggaauaaaagcaaauguuccaaaacucgugg

SEQ ID NO: 13521 - RNA, 4697 nt, Homo sapiens
uuucacacacacacacacaacaaaacaaaacccgcgguggcucacgccuguaaucccagcacuuugggaggcugaggugggcgaaucacgaggccaggaguucgagaccagccuggccaacagggugaaaccccgucucuacuaaaaauacaaaaaauuaacugggcgugguggcgggugccuguaaucccagcuacucaggaggcugaggcaggagaaucaucgcuugaaccugggaggcggagguugcugugagucgagaucuugccacugcacuccaucccaggcgacagugcgagacuccaucucaaaaaaagaaaaagaaaaaauauauauauaacugcuauuuauuuuccuuuucauuuucugcuuuugagggaguuuccauaguaacguguccuuccagucgccuagccugaagggaagccccggagcuccagcuucaaggcucagcucucccagaugcaaguaucuuuaccuccagccagcuccuuguaacccuggcaacacggcccgcccgcgaaucgucacgcuacgauugguccguggugcuaaagccugaaagcgaauuccucagacauugguccgagucacugcgaugcugacgcugugguuggugaguuuggaugucagucagagucggaggcagggucaaauagggagaaauggcgacggagccuggcugugggugagugcuuccugaaggggugaaagugugagacagcggaucaccgcaguuagccgucacacagcucccaaagggaugggagggagguuuucuucucauccggcuccagcuggacucugggaaugucagacauccacaucucccacccagguuagaggugagaggucaaaggccguauucccucuguugguuuuuggaccccagguacuguggacagcagucaggaucccgaaccaaagacucaacuuucagcuacuuacagaguaauggugggcaagucacuuagcuucuuugagccuuaguuuaucaucuguaaaaugaggacaguaacucggucuggggccaaauagaggaaacaauggaauagaguauugcugcuaaaagagggauauaguagaggcaggagaagcuaugcacauuuguuagccauauuuuaugguggaagggauugaggcucagagagggucauugacuugcccaagauaacacagcaaguuuggagcaauugcaguucucuuauacauaccaggaccaaaggaaagaauggaugccaaucagucauuuauaaauauaaaaucguauuuuuauuuuauuuuauuuuuugagacagaguuucacucugucacccagagcuggagugcaguggcgcaaucucggcucacugcaaccucagccuccuggguucaagcaggucuccugccucagccucccgaguagcugagacuacaggcaugggccaccauacccggcuaauucuuuuuguauuuuuaguagagacggguuuucaccauguuggccaggcuggucucgaacucccaaccucaaguuaucugcccaccuuggccucccaaaguacugggauuacaggugugagccacugcaccuggcuagaaugcuauuuuuuuaaaaggccauaugcagcucuggccauaccuauuuaaauccccuggaaccauaucuuuccauagcuaacuucuuaucauuuagauuucagcuccaaugucauccuucuccccugagaggccuuccauuaccacuuuaacuaaaguaucccucccuuccccagcuuacucucugacauguuacucagguuuauggucuuuguaagcuucauuauuggauauauauuugcuuauuuguuuacauguuuauuguguaucuuccccuagaacagugcugacauauaguaaguguucaacaaauauuguguggaugaauaauugaagagccaggucccugcugucuccuuaaaccucuguuacucuccauaggcccaucuuuggaaaaaagaucugggaaugauugucuagccuccagccucaacuuacuugaugcuugagagacucaaagccccguggucagcugcccugcaaagaaaguauuuugaccuuggcauuuggacagcucccaucucucccauggcccugacaaugcugaaugggcuccugauuaaggacucaagcccaccuaugcugcugcaccagguuaacaagacugcccaguuagauaccuucaacuaccagagcugcuuuaugcaaagugucuuugaccauuucccugagaucuuauuuauccaccggaccuauaacccaagggguaaggucuuauauaccuuccugguggauggaccucgggugcagcuggagggucaucuugcccgagcagucuacuuugccaucccugccaaggaggacacugaaggccuggcccagauguuccaaguauucaagaaguuuaauccagcaugggagagagucuguaccauccugguggauccucauuuccuuccacugccuauccuagcuauggaguuccccacagcugagguccuucucucagccuuccacauuuguaaguuccuccaggccaaguucuaucagcugucccuugaacggcccguggaaaggcugcuccugaccucccugcagagcacaaugugcucagccacagcaggcaaccugagaaaguuguauacacuccugagcaacugcaucccuccagccaagcugcccgagcuucacucacacuggcugcucaacgaccgcaucuggcuggcucaccgcuggagaagccgagcugagagcagccacuacuuccagagccucgaggucaccacccacauccucagccaguucuuugguaccaccccaucugagaaacaagguauggcuucucuguuccguuacaugcagcagaacucugcagacaaggcaaacuucaaccagggccugugugcccagaacaaucaugcucccucagacaccauccccgaaagccccaaacuggagcagcugguagaaucccacauccagcacucccucaaugccaucugcacagggccagcagcccaacugugccugggcgagcuugcugugguccagaaauccacacaccucauuggcucuggcucagaaaagaugaacauacagauccuggaagauacccauaaggugcagccccagcccccugccagcugcagcugcuacuuuaaccaggccuuccaccugcccugccgccacauccuagccaugcucagugcccgccgccaggugcuccagcccgacaugcugccggcucaguggacggcaggcugugcuaccagucuagacagcauccugggcagcaaguggagugagacccuggauaagcaccuggcagugacucaccucaccgaggaggugggucagcuguugcagcacugcaccaaggaggaguuugagcggagguauagcacccugcgggaacuggccgacagcuggauugggccuuaugagcagguccaacucugauuauucucgaugcccagagaugcucaugcaccugugcacacucacauccacccauacacacacacacacacacacacacacacacacacacacucccuuacacuguuguacuuccgugggcccuccuuccagaacaaggacaacaaggacaagguugaagggucuucucaucuaccauggccugcuaccuagcaugugucuagcucaaugagacaggagucagcaaaucuuaaucuguuuaguuuacucagguggccacauacagucucuguuguauauucuugguuuuguuuuaauauuuuuuuucuuuuuuuuuuuuuuuuuuuuuuugagaaggagucugucuccgucacccaggcuggagugcaguggcgcaaucucugcucacugcaagcuccaccuccuggguucacaccauucuccugccucagccucccgaguaucugggacuacaggcgcccgccacaaugccgggcuaauuuuuuguauuuuuaguagagacgggguuucaccguguuagccaggauggucucgaucuccugacuucgugaucugcccgccucggccucccaaagugcugggauuacaggcgugagccaucgcacccggccuguuuuaacauuuucauaagguaaaaaccuuucuuagcucaaaggucuuuaaaaaagcaggcaauccagcugggcaugguggcucacgccuguaaucccagcauuuugggaggcugagguggacagaugacuugaggucaggaguucaagaccagccuggccaacauagugaaacccugucucuacuaaaaauacacaaauuagccaggugugguggcgggggcccuguaaucccagcuacucgggaggcugaggcaggagaaucgcuugaaccugggaggcagagguugcaguaggccaagauccugcugccacugcacuccagccugggagggugagacuccaucuaaaaaaaauaaaauaaauggcaaccccuggucuaagauaagagauaaaacaucagguggugagguugagguuuggggcuugguagcaguugccccagucaugagaugacucacuuaacccgucuccuuuaagugagcugggcugggaggcuuccuacaggggaagaggccccucuggggagcugacucagccaggcucccugaacuuuuuuccuugucccauccuggggucaauaaaacugaauguugcauauucuagcac

SEQ ID NO: 13522 - RNA, 4697 nt, Homo sapiens
gugcuagaauaugcaacauucaguuuuauugaccccaggaugggacaaggaaaaaaguucagggagccuggcugagucagcuccccagaggggccucuuccccuguaggaagccucccagcccagcucacuuaaaggagacggguuaagugagucaucucaugacuggggcaacugcuaccaagccccaaaccucaaccucaccaccugauguuuuaucucuuaucuuagaccagggguugccauuuauuuuauuuuuuuuagauggagucucacccucccaggcuggagugcaguggcagcaggaucuuggccuacugcaaccucugccucccagguucaagcgauucuccugccucagccucccgaguagcugggauuacagggcccccgccaccacaccuggcuaauuuguguauuuuuaguagagacaggguuucacuauguuggccaggcuggucuugaacuccugaccucaagucaucuguccaccucagccucccaaaaugcugggauuacaggcgugagccaccaugcccagcuggauugccugcuuuuuuaaagaccuuugagcuaagaaagguuuuuaccuuaugaaaauguuaaaacaggccgggugcgauggcucacgccuguaaucccagcacuuugggaggccgaggcgggcagaucacgaagucaggagaucgagaccauccuggcuaacacggugaaaccccgucucuacuaaaaauacaaaaaauuagcccggcauuguggcgggcgccuguagucccagauacucgggaggcugaggcaggagaauggugugaacccaggagguggagcuugcagugagcagagauugcgccacugcacuccagccugggugacggagacagacuccuucucaaaaaaaaaaaaaaaaaaaaaaagaaaaaaaauauuaaaacaaaaccaagaauauacaacagagacuguauguggccaccugaguaaacuaaacagauuaagauuugcugacuccugucucauugagcuagacacaugcuagguagcaggccaugguagaugagaagacccuucaaccuuguccuuguuguccuuguucuggaaggagggcccacggaaguacaacaguguaagggaguguguguguguguguguguguguguguguguguguguauggguggaugugagugugcacaggugcaugagcaucucugggcaucgagaauaaucagaguuggaccugcucauaaggcccaauccagcugucggccaguucccgcagggugcuauaccuccgcucaaacuccuccuuggugcagugcugcaacagcugacccaccuccucggugaggugagucacugccaggugcuuauccagggucucacuccacuugcugcccaggaugcugucuagacugguagcacagccugccguccacugagccggcagcaugucgggcuggagcaccuggcggcgggcacugagcauggcuaggauguggcggcagggcagguggaaggccugguuaaaguagcagcugcagcuggcagggggcuggggcugcaccuuauggguaucuuccaggaucuguauguucaucuuuucugagccagagccaaugagguguguggauuucuggaccacagcaagcucgcccaggcacaguugggcugcuggcccugugcagauggcauugagggagugcuggaugugggauucuaccagcugcuccaguuuggggcuuucggggauggugucugagggagcaugauuguucugggcacacaggcccugguugaaguuugccuugucugcagaguucugcugcauguaacggaacagagaagccauaccuuguuucucagauggggugguaccaaagaacuggcugaggauguggguggugaccucgaggcucuggaaguaguggcugcucucagcucggcuucuccagcggugagccagccagaugcggucguugagcagccagugugagugaagcucgggcagcuuggcuggagggaugcaguugcucaggaguguauacaacuuucucagguugccugcuguggcugagcacauugugcucugcagggaggucaggagcagccuuuccacgggccguucaagggacagcugauagaacuuggccuggaggaacuuacaaauguggaaggcugagagaaggaccucagcuguggggaacuccauagcuaggauaggcaguggaaggaaaugaggauccaccaggaugguacagacucucucccaugcuggauuaaacuucuugaauacuuggaacaucugggccaggccuucaguguccuccuuggcagggauggcaaaguagacugcucgggcaagaugacccuccagcugcacccgagguccauccaccaggaagguauauaagaccuuaccccuuggguuauagguccgguggauaaauaagaucucagggaaauggucaaagacacuuugcauaaagcagcucugguaguugaagguaucuaacugggcagucuuguuaaccuggugcagcagcauaggugggcuugaguccuuaaucaggagcccauucagcauugucagggccaugggagagaugggagcuguccaaaugccaaggucaaaauacuuucuuugcagggcagcugaccacggggcuuugagucucucaagcaucaaguaaguugaggcuggaggcuagacaaucauucccagaucuuuuuuccaaagaugggccuauggagaguaacagagguuuaaggagacagcagggaccuggcucuucaauuauucauccacacaauauuuguugaacacuuacuauaugucagcacuguucuaggggaagauacacaauaaacauguaaacaaauaagcaaauauauauccaauaaugaagcuuacaaagaccauaaaccugaguaacaugucagagaguaagcuggggaagggagggauacuuuaguuaaagugguaauggaaggccucucaggggagaaggaugacauuggagcugaaaucuaaaugauaagaaguuagcuauggaaagauaugguuccaggggauuuaaauagguauggccagagcugcauauggccuuuuaaaaaaauagcauucuagccaggugcaguggcucacaccuguaaucccaguacuuugggaggccaaggugggcagauaacuugagguugggaguucgagaccagccuggccaacauggugaaaacccgucucuacuaaaaauacaaaaagaauuagccggguaugguggcccaugccuguagucucagcuacucgggaggcugaggcaggagaccugcuugaacccaggaggcugagguugcagugagccgagauugcgccacugcacuccagcucugggugacagagugaaacucugucucaaaaaauaaaauaaaauaaaaauacgauuuuauauuuauaaaugacugauuggcauccauucuuuccuuugguccugguauguauaagagaacugcaauugcuccaaacuugcuguguuaucuugggcaagucaaugacccucucugagccucaaucccuuccaccauaaaauauggcuaacaaaugugcauagcuucuccugccucuacuauaucccucuuuuagcagcaauacucuauuccauuguuuccucuauuuggccccagaccgaguuacuguccucauuuuacagaugauaaacuaaggcucaaagaagcuaagugacuugcccaccauuacucuguaaguagcugaaaguugagucuuugguucgggauccugacugcuguccacaguaccugggguccaaaaaccaacagagggaauacggccuuugaccucucaccucuaaccugggugggagauguggaugucugacauucccagaguccagcuggagccggaugagaagaaaaccucccucccaucccuuugggagcugugugacggcuaacugcggugauccgcugucucacacuuucaccccuucaggaagcacucacccacagccaggcuccgucgccauuucucccuauuugacccugccuccgacucugacugacauccaaacucaccaaccacagcgucagcaucgcagugacucggaccaaugucugaggaauucgcuuucaggcuuuagcaccacggaccaaucguagcgugacgauucgcgggcgggccguguugccaggguuacaaggagcuggcuggagguaaagauacuugcaucugggagagcugagccuugaagcuggagcuccggggcuucccuucaggcuaggcgacuggaaggacacguuacuauggaaacucccucaaaagcagaaaaugaaaaggaaaauaaauagcaguuauauauauauuuuuucuuuuucuuuuuuugagauggagucucgcacugucgccugggauggagugcaguggcaagaucucgacucacagcaaccuccgccucccagguucaagcgaugauucuccugccucagccuccugaguagcugggauuacaggcacccgccaccacgcccaguuaauuuuuuguauuuuuaguagagacgggguuucacccuguuggccaggcuggucucgaacuccuggccucgugauucgcccaccucagccucccaaagugcugggauuacaggcgugagccaccgcggguuuuguuuuguugugugugugugugugaaa

SEQ ID NO: 13523 - RNA, 10098 nt, Homo sapiens
caggcggcuacggcgcgcggucggaggcagcacguucagcucauagagcugguccaagagauggcuguagagcccuggccggcugcggcccaccaggcggucccggggaaugcgaaacugcucaaugcgcagauaugguuccacgaggaggguuggaggucggcugggggccgcugccuccgccuccgggcggcccucccggggcacgcgguugugguggcgcgugauggcgaagacccagguguggcccagguugaccagaucgggcagagaaaacucgggaacgggggccagacuggcgggguccagcgcggucagaccgagacgcagauguccgcaccagcccagcucuuucuccucgaucucgaccaggaagaccuggcccggggccagcggcucgcggcugaagcacacgccgugggcgaagcucuccacgcguguggcccgcgucccagagggguccacgcggauguuggcaccgugcacccgauggaagcgggugggagggggcuccgggcgcucgaguccccagagugcacccgaauccacgggcucggaggcagcagccaucucucggccauagggcaggccagcuggcgccgggggcuauuuugggcggcgggcaaugauggugaccgcaaggcgaccuuguaaggcauuuccccccugacucccuuccccgagccucugcccggggguccuagcgccgcuuucucagccaucccgccuacaacuuagccguccacaacaggaucaucugaucgcgugcgcccgggcuacgaucugcgaggcccgcggaccuugacccggcauugaccgccaccgccccccagguccguagggaccaaagaaggggcgggaggaagacugucacguggcgccggaguucacgugacucguacacaugacuuccaguccccgggcgccuccuggagagcaaggacgcgggggagcagaggugagcuggcaccggaggcuggaggggauccccgagcccgggaucggugcgcggcagaggaggcucgcgggugggagcuggcgcuggggccggggcuucccucgcggaggcgccgccagcaacuccccgggggcugcugcacggaagcgcugaggagcgagucaacagccccucugcugccucccguagaugauccgagccgcgccgccgccgcuguuccugcugcugcugcugcugcugcugcuaguguccugggcgucccgaggcgaggcagcccccgaccaggacgagauccagcgccuccccgggcuggccaagcagccgucuuuccgccaguacuccggcuaccucaaaggcuccggcuccaagcaccuccacuacuggucugccgcccugccuucugggcgggauugggagaagagaugacggaugagggaugggggguaguucugcagaccccugaggaugccugggagccgggagggcuggaaagggccccuccaacugcgccaacccugcccugaccccccucccagguuuguggagucccagaaggaucccgagaacagcccuguggugcuuuggcucaaugggggucccggcugcagcucacuagaugggcuccucacagagcauggccccuuccuggugaguggacagcagggggaaagcacaguucccaaaguaaaaggcuggggaaagcgagagaggggcuuugugauuuuccaaaaaguuuccuuccuucuaagccucgggauuuuccucuaugccauuggcuuugcugccuguaccucucagagguuuuacccacauguaaagugccucucaugguggcccuuucccuccacccagcuggcccuugggacuuacucagccaucucuuuccuccucagguccagccagauggugucacccuggaguacaaccccuauucuuggaaucugguauagcuggagcugugggugugucugggcacuuggaugggguggcauuuagcuaauuuuucccuccccucuagauugccaauguguuauaccuggaguccccagcuggggugggcuucuccuacuccgaugacaaguuuuaugcaacuaaugacacugaggugagucuggugccugcccaucugccccaggcuccccgguccuccauccauggcaugaugcugggagagagagcauggccuuggagucuacuuuucgcucugucauaugcuauugugguaugguggccagucacuuccucuugcacaaauaggguggguuaaugucauuaucucugaaguucuuuccaguucaaauaccaaagcuuccugauucccucugucuugcucugccauccccaggucgcccagagcaauuuugaggcccuucaagauuucuuccgccucuuuccggaguacaagaacaacaaacuuuuccugaccggggagagcuaugcuggcaucuacauccccacccuggccgugcuggucaugcaggaucccagcaugaaccuucaggugcaggguagcugcaggagggaagggagguagcuugaggcuguggccuuacaguuagcaaggucagacugacuggucaauguccccauccaacccagcuuccugcauaaccuccccaccaccggcugcccuaggucugucugugugccucccacacaggaaacucaccugucaggcugccagcucuguguuuugcauugaguggccucucauacccaccggccuacauaaaccacccuggguuucagcuuccggauugcugaaggucugggugguagggugagggaggcucuuccuuuuugcccuccacaugagcugagcacccuggguguuucacaggggcuggcugugggcaauggacucuccuccuaugagcagaaugacaacucccuggucuacuuugccuacuaccauggccuucuggggaacagguaugggauagggcaguugggcaaucucuggggugaggcaggucacaugaucucaggucuguccuccaggcacaugauaugacaggcccagcccagguuuaugagcagcagguggguugcagaaagaaccuagugcugaaaggccaaagaauagagaucaguuuuucuuucuuucuuuuuuuuuuuuuugagacagauucuuacuuugucacccaggcuggagugcaguggcacgaucuuagcucacugcaaccuccaccucccagguucaagcaauucucaugccucagacucccaggcagcugggacuacaggcgcguaccaccacaccugccuaauuuuuuguauuuuuaguagagaugggguuuugcuguguuggccaggcuggacuugaacuccuggccucaaaugaucuucccaaagugcugggauuacaggcaugagcuacagcgcccagccagaaaucagauuuuaaaggaacuaaggaggccugucuguaugacccuggggcaccucuuugggagcuagcuuagaugacauacagaccacacccugugauaucuuucccagucuccuagggucagggagguuggugggaggugggggguaugcucgccuccucugccuuccucuucccaccagcagcugaugcgcuuuucacucucaucuccuacaggcuuuggucuucucuccagacccacugcugcucucaaaacaaguguaacuucuaugacaacaaagaccuggaaugcgugaccaaugugagguucugccaucacuuugcaugagcucucccaucccuaauccugagaacaggaccacauucccuccuuggggacuccuuguucuccgucccucauugcuuucuugcaccuuuaagcaauuuaguguucucugggacaugugucuaaguguguauucccaccaccaccuccuaugguggcaaaucccauaaccuccgugaggagaaaggacuucuucacauuuaucaaacaccugcaacguggcaggcacugugcugaacugugucuauguagauuauuuaagcuucaagauucccccucaaaugagaucauacuacccacauuuuccagauaaggaaacugagggcuaugaauuuugaaaucacugucugaagucacaguguugggaggcagugaugcuaggauuuggacccaggucugggaagauuccugccacugagccucaguuucccuaccugugaaaaaaagugggugaagaggugaaauccaagagcaguaaaucuugggacaacuugguggggucguggagaggcuggggaucuguaaagcaugguggcuugguguaucauugcagcuucaggaaguggcccgcaucgugggcaacucuggccucaacaucuacaaucucuaugccccgugugcuggaggggugcccagccauuuuagguaggugcugcugggugccccuggagccaaccccagccccaucuggaggcuccacacccauucccccaccucacauugcagguaugagaaggacacuguugugguccaggauuugggcaacaucuucacucgccugccacucaagcggauguggcaucaggugugcgagggcgugggcuuccuccuggugaggugggggcagggggaggggcagggaagcagaggcccugacccacugucugugccuuccaggcacugcugcgcucaggggauaaagugcgcauggacccccccugcaccaacacaacagcugcuuccaccuaccucaacaacccguacgugcggaaggcccucaacaucccggagcagcugccacaaugggacaugugcaagugagguuccguggccaccugugacuuggggugguggguugcuggggcuugugggcaucggcagguuucucagggaucuucuguguagaguuucucaaugagaugagcuguagaggauguuuaacauccaucccugaccccucaguggauugagagucagccaauucauucuuuuaucuuuuuuaaauuuaaaauuuuuuuguuugagacaaggucucacucugucaccuaggcuggagugcaguggugugaucauagcucacugcagccucaaacucaugggcucaagcaauccucccaccuccccaguagcugggacuacagacgcaccaccacccccaacaaguuuuuguauuuuuuguacagaugguguuuuaccacauugcucaggcugguuuugaacucuggggcucaagugaucugcccauuucagccucccaaaguacugggauuacaggcaugagccaccccgcccagccccauuucauuacguagccacauugguuguuguuucacaguucacuacagccucaaccuccuaggcucaagcgauccucccaccuuagucuacugaguagcugggucuacaggcacaugccaccauuccuggcuaauuuuuaaaaaauuuuuuuguagagacagggucucacuauguuguccagguuggucucaaacucuuggucucaagcaauccucccuccuuggccucccaaagugcugggauuacaggcgaggguccccacacccggccaucacauugguuaauaacuauuacuuccgacugggcgcagugguucacgccuguaauccuagcacuuuuggaggcugaggugggggaaucaccugaggucaggaguucgagaccagccuggccaacaugaagaaaccccaucucuacuaaaaauacaacaauuagccaggugugcuguugggcaccuguaaucccagcuauucaggaggcugagggaggagaaucgcuugaacccaggaggcagagguugcagugagcugagaucaugcuacugcacuccagccugggcaacaaaagugaaacuccaucucaaacaacaauaacaaacuguuaacuuccauguccagucuccuguggccacccccccccacaaccccaaguaaaaggguaacacugggcccagcagggcugcucagguccauuuugauuggucagugcucacacucuacccuguuguauguugugacucccacaccugcuggccccuagacacuaaaugccagaugcaucccaguccucguaacaaccaaaaugcgucccuuguacauuucuuuuucuuuuuuuuuuugagauggagucuugcugucacucaggcuggagugcagugcugcgaucuuggcucacugcaaccuccgccucccggguucaagugauucuccugccucagccuucugaguagcugggacuacaggcacgcaccaccacgccuggcuaauuuuuguauuuuuuuuuuuaguagagacgggguuucaccauguuggucaggcuggucucgaacuccugaccucgugauccacucaccucggucucccaaagugcuaggauuacaggcgugagccaccacgcccagcaucccuguaccuuucuaaaugguggugaguugaggcugucugaaucccagcccauccagcccaacauccaagucaguccuagagagguggcccccccccaaaaaggggaguggaacccagcugucugccuucuggguuggagcuuggagauaggagagaaggucugaucuguugacuacuuuucgccccgaccuggucuuccuggggccugcucguauguucccggcagcuuucugguaaacuuacaguaccgccgucucuaccgaagcaugaacucccaguaucugaagcugcuuagcucacaggugaguggggagagcacagcuggaucaccagcagccuuaggaccccagaguagcacagcaagcugggggcccuugagacuuccugucaggacaagggaagcugaaacuccgaaaggcgaagcccaggguccugugauugguggggucagaauuugaaccuggguuuguccccacccaugcuguccugcuauaggaggccuaggggucugcaucagccacggagucuuaagggugagaagagcuucauucaugccaaaaaugggccagcagagguccagggugggaggagaccuugcacaaggugauauaggaagcacuggcagggccaaguuaggacuagguucuguccagcacagugguuaauagcaugggcucuggagucacauggccugggugcaagucccuguacuagccacauaaucuugggcaaauuucuuaaauaugagccucagguucuccaucuguaaaauggggauaauaaugauaucuaccuucacagauaaaacauuuaguagaauacuggacaugcaguaagucguuagaaaacaugaaaauucccugguucguguuaucuagcuuggccccuugaauuuccugagggguaggccuugaacuagggaagggcuggggacugggcuuguuccacaccccucauuuuuaccccauccugcuuuagaaauaccagauccuauuauauaauggagauguagacauggccugcaauuucaugggggaugagugguuuguggauucccucaaccagaagguaagguagagauuccuggcccugggauaggggcugcuguggaggauugggagcggguaugccugggaguggccagcuggcugccuggcucuggcccacagagggcaaguguggaggaauucccagcccuaaggucuugcugguagcugugagcaaggaugcagcugcuguaggcugaugucuuuccugguggggcagauggaggugcagcgccggcccugguuagugaaguacggggacagcggggagcagauugccggcuucgugaaggaguucucccacaucgccuuucucacgaucaagguagggacugggccugcugagagauaacugggccggaggcaaaggagcaggacccacccguccuuucccucuggcugccuuuuaggcugggucaugggucaccaucuggccccuguaugggcaaguuuuuuuggagagggguggggaggguucugggaagaauaaaggguuugggaugaaggaauugcccccgagugagcaguuauauggggaggagggaaugguggggucaggagcucacgaacauugcuccucagggcgccggccacaugguucccaccgacaagccccucgcugccuucaccauguucucccgcuuccugaacaagcagccauacugaugaccacagcaaccagcuccacggccugaugcagccccucccagccucucccgcuaggagaguccucuucuaagcaaagugccccugcaggccggguucugccgccaggacugcccccuucccagagcccuguacaucccagacugggcccagggucucccauagacagccugggggcaaguuagcacuuuauucccgcagcaguuccugaaugggguggccuggccccuucucugcuuaaagaaugcccuuuaugaugcacugauuccaucccaggaacccaacagagcucaggacagcccacagggaggugguggacggacuguaauugauagauugauuauggaauuaaauuggguacagcuucaaaucccgucuucucuguggcacuggggguuagagggggcacuacaggcuaugaaugugggaaaagaggggcugagagggguugggguccugaaugacagcugccagcuuggggauugagggcucagacagcugcuguggacggugugggggcaguggacgcccugacaucagcaggccgguucuucucaaucaccucucgcagcccuuuggcaaaguggagaucagccccgauggugaggaaucccuguguuggggagaggggagccucauuuauucauucaguuauugaggccagaguuuagagaucaagagacagaguguuugucuuucaggaacucaaucuaauggauaauuccaugucaagguguuaaaaugaggcuguaggaguguagacuaugggugucaaggagggcuucuuggaggaggugaccucugagcuaagaccugaacaauuaguagguauugggaugggagaagagugcuccaagaagucacagugugugcaacggcuuuuaggagucuaagauuaaaaugggaggggcgacugguaaugggggagcuggggucagguaauggagggcacuggggagcuauagagagaggggaaggcccucccuccuuccccauccugcccccacucaccgcaugguucgucaccaccucaugcacaaaguugaugcccucagguagugggaucugcaccccacgccagguccgcucugugggugggagcaccccgcucagucugggcccgcccaguucaccccuccuuucuuccuccauccucacaccccagccuuaccauugagcaugggcaucaccccaaucugcagcauggucuucagaggggccuguaaugggaucagcugggaggggcgagggcggaaacagggcagugagucaggguuggguuugccuuuagcugcccgcaggugagcaguuauaugaggagggggggauggugagggucaggaucucacgaacccagcccagcccacccacccuuccccacucacagccagcgacuccagugcagaaugguuggaauagauucggaaccugcgggaaagaaaggagcccugugggcaggaagccuggaagcuccccuuccucaggccacccaggccuaccugccagaggugucugaguugcaggcucagaugcccaccuaggcaccuuuccaagugcuacaacuuuccagguauccucggggcagucauugcugccacuugggucuccuuuucuccaagacugcuacuuuuuauuuauugagcaccucuuuuuuuuuuuuuuuuuuuuuuuuuuuugagacagagucucgcugugucgcccacgcuggagugcaguggcgcgaucucggcucacugcuccgucucccggguucacgccauucuccuggcucagccucccgaguaacugggacuauaggugcccgccaccaagcccagcuaauuuuuuguguuuuuaguagagacgggguuucaccguguuagccaggauggucucggauuuccugaccuugugauccgcccgucucggccucccaaagugcugggauuacaggcgugagccaccacgcccggccuuuauugagcacuucuaaugugccagacuucugcugguagcuuugcagguguuauuuauuuuauguaacaaaacuucacauugcuuaguuccugucagacacuaagcauauuuau

SEQ ID NO: 13524 - RNA, 10098 nt, Homo sapiens
auaaauaugcuuagugucugacaggaacuaagcaaugugaaguuuuguuacauaaaauaaauaacaccugcaaagcuaccagcagaagucuggcacauuagaagugcucaauaaaggccgggcgugguggcucacgccuguaaucccagcacuuugggaggccgagacgggcggaucacaaggucaggaaauccgagaccauccuggcuaacacggugaaaccccgucucuacuaaaaacacaaaaaauuagcugggcuugguggcgggcaccuauagucccaguuacucgggaggcugagccaggagaauggcgugaacccgggagacggagcagugagccgagaucgcgccacugcacuccagcgugggcgacacagcgagacucugucucaaaaaaaaaaaaaaaaaaaaaaaaaaaagaggugcucaauaaauaaaaaguagcagucuuggagaaaaggagacccaaguggcagcaaugacugccccgaggauaccuggaaaguuguagcacuuggaaaggugccuaggugggcaucugagccugcaacucagacaccucuggcagguaggccuggguggccugaggaaggggagcuuccaggcuuccugcccacagggcuccuuucuuucccgcagguuccgaaucuauuccaaccauucugcacuggagucgcuggcugugaguggggaagggugggugggcugggcuggguucgugagauccugacccucaccaucccccccuccucauauaacugcucaccugcgggcagcuaaaggcaaacccaacccugacucacugcccuguuuccgcccucgccccucccagcugaucccauuacaggccccucugaagaccaugcugcagauuggggugaugcccaugcucaaugguaaggcuggggugugaggauggaggaagaaaggaggggugaacugggcgggcccagacugagcggggugcucccacccacagagcggaccuggcguggggugcagaucccacuaccugagggcaucaacuuugugcaugagguggugacgaaccaugcggugagugggggcaggauggggaaggagggagggccuuccccucucucuauagcuccccagugcccuccauuaccugaccccagcucccccauuaccagucgccccucccauuuuaaucuuagacuccuaaaagccguugcacacacugugacuucuuggagcacucuucucccaucccaauaccuacuaauuguucaggucuuagcucagaggucaccuccuccaagaagcccuccuugacacccauagucuacacuccuacagccucauuuuaacaccuugacauggaauuauccauuagauugaguuccugaaagacaaacacucugucucuugaucucuaaacucuggccucaauaacugaaugaauaaaugaggcuccccucuccccaacacagggauuccucaccaucggggcugaucuccacuuugccaaagggcugcgagaggugauugagaagaaccggccugcugaugucagggcguccacugcccccacaccguccacagcagcugucugagcccucaauccccaagcuggcagcugucauucaggaccccaaccccucucagccccucuuuucccacauucauagccuguagugcccccucuaacccccagugccacagagaagacgggauuugaagcuguacccaauuuaauuccauaaucaaucuaucaauuacaguccguccaccaccucccugugggcuguccugagcucuguuggguuccugggauggaaucagugcaucauaaagggcauucuuuaagcagagaaggggccaggccaccccauucaggaacugcugcgggaauaaagugcuaacuugcccccaggcugucuaugggagacccugggcccagucugggauguacagggcucugggaagggggcaguccuggcggcagaacccggccugcaggggcacuuugcuuagaagaggacucuccuagcgggagaggcugggaggggcugcaucaggccguggagcugguugcuguggucaucaguauggcugcuuguucaggaagcgggagaacauggugaaggcagcgaggggcuugucggugggaaccauguggccggcgcccugaggagcaauguucgugagcuccugaccccaccauucccuccuccccauauaacugcucacucgggggcaauuccuucaucccaaacccuuuauucuucccagaacccuccccaccccucuccaaaaaaacuugcccauacaggggccagauggugacccaugacccagccuaaaaggcagccagagggaaaggacggguggguccugcuccuuugccuccggcccaguuaucucucagcaggcccagucccuaccuugaucgugagaaaggcgaugugggagaacuccuucacgaagccggcaaucugcuccccgcuguccccguacuucacuaaccagggccggcgcugcaccuccaucugccccaccaggaaagacaucagccuacagcagcugcauccuugcucacagcuaccagcaagaccuuagggcugggaauuccuccacacuugcccucugugggccagagccaggcagccagcuggccacucccaggcauacccgcucccaauccuccacagcagccccuaucccagggccaggaaucucuaccuuaccuucugguugagggaauccacaaaccacucaucccccaugaaauugcaggccaugucuacaucuccauuauauaauaggaucugguauuucuaaagcaggaugggguaaaaaugagggguguggaacaagcccaguccccagcccuucccuaguucaaggccuaccccucaggaaauucaaggggccaagcuagauaacacgaaccagggaauuuucauguuuucuaacgacuuacugcauguccaguauucuacuaaauguuuuaucugugaagguagauaucauuauuauccccauuuuacagauggagaaccugaggcucauauuuaagaaauuugcccaagauuauguggcuaguacagggacuugcacccaggccaugugacuccagagcccaugcuauuaaccacugugcuggacagaaccuaguccuaacuuggcccugccagugcuuccuauaucaccuugugcaaggucuccucccacccuggaccucugcuggcccauuuuuggcaugaaugaagcucuucucacccuuaagacuccguggcugaugcagaccccuaggccuccuauagcaggacagcauggguggggacaaacccagguucaaauucugaccccaccaaucacaggacccugggcuucgccuuucggaguuucagcuucccuuguccugacaggaagucucaagggcccccagcuugcugugcuacucugggguccuaaggcugcuggugauccagcugugcucuccccacucaccugugagcuaagcagcuucagauacugggaguucaugcuucgguagagacggcgguacuguaaguuuaccagaaagcugccgggaacauacgagcaggccccaggaagaccaggucggggcgaaaaguagucaacagaucagaccuucucuccuaucuccaagcuccaacccagaaggcagacagcuggguuccacuccccuuuuugggggggggccaccucucuaggacugacuuggauguugggcuggaugggcugggauucagacagccucaacucaccaccauuuagaaagguacagggaugcugggcgugguggcucacgccuguaauccuagcacuuugggagaccgaggugaguggaucacgaggucaggaguucgagaccagccugaccaacauggugaaaccccgucucuacuaaaaaaaaaaauacaaaaauuagccaggcgugguggugcgugccuguagucccagcuacucagaaggcugaggcaggagaaucacuugaacccgggaggcggagguugcagugagccaagaucgcagcacugcacuccagccugagugacagcaagacuccaucucaaaaaaaaaaagaaaaagaaauguacaagggacgcauuuugguuguuacgaggacugggaugcaucuggcauuuagugucuaggggccagcaggugugggagucacaacauacaacaggguagagugugagcacugaccaaucaaaauggaccugagcagcccugcugggcccaguguuacccuuuuacuugggguuguggggggggguggccacaggagacuggacauggaaguuaacaguuuguuauuguuguuugagauggaguuucacuuuuguugcccaggcuggagugcaguagcaugaucucagcucacugcaaccucugccuccuggguucaagcgauucuccucccucagccuccugaauagcugggauuacaggugcccaacagcacaccuggcuaauuguuguauuuuuaguagagaugggguuucuucauguuggccaggcuggucucgaacuccugaccucaggugauucccccaccucagccuccaaaagugcuaggauuacaggcgugaaccacugcgcccagucggaaguaauaguuauuaaccaaugugauggccggguguggggacccucgccuguaaucccagcacuuugggaggccaaggagggaggauugcuugagaccaagaguuugagaccaaccuggacaacauagugagacccugucucuacaaaaaaauuuuuuaaaaauuagccaggaaugguggcaugugccuguagacccagcuacucaguagacuaaggugggaggaucgcuugagccuaggagguugaggcuguagugaacugugaaacaacaaccaauguggcuacguaaugaaauggggcugggcgggguggcucaugccuguaaucccaguacuuugggaggcugaaaugggcagaucacuugagccccagaguucaaaaccagccugagcaaugugguaaaacaccaucuguacaaaaaauacaaaaacuuguugggggugguggugcgucuguagucccagcuacuggggaggugggaggauugcuugagcccaugaguuugaggcugcagugagcuaugaucacaccacugcacuccagccuaggugacagagugagaccuugucucaaacaaaaaaauuuuaaauuuaaaaaagauaaaagaaugaauuggcugacucucaauccacugaggggucagggauggauguuaaacauccucuacagcucaucucauugagaaacucuacacagaagaucccugagaaaccugccgaugcccacaagccccagcaacccaccaccccaagucacagguggccacggaaccucacuugcacaugucccauuguggcagcugcuccgggauguugagggccuuccgcacguacggguuguugagguagguggaagcagcuguuguguuggugcaggggggguccaugcgcacuuuauccccugagcgcagcagugccuggaaggcacagacagugggucagggccucugcuucccugccccucccccugcccccaccucaccaggaggaagcccacgcccucgcacaccugaugccacauccgcuugaguggcaggcgagugaagauguugcccaaauccuggaccacaacaguguccuucucauaccugcaaugugaggugggggaauggguguggagccuccagauggggcugggguuggcuccaggggcacccagcagcaccuaccuaaaauggcugggcaccccuccagcacacggggcauagagauuguagauguugaggccagaguugcccacgaugcgggccacuuccugaagcugcaaugauacaccaagccaccaugcuuuacagauccccagccucuccacgaccccaccaaguugucccaagauuuacugcucuuggauuucaccucuucacccacuuuuuuucacagguagggaaacugaggcucaguggcaggaaucuucccagaccuggguccaaauccuagcaucacugccucccaacacugugacuucagacagugauuucaaaauucauagcccucaguuuccuuaucuggaaaauguggguaguaugaucucauuugagggggaaucuugaagcuuaaauaaucuacauagacacaguucagcacagugccugccacguugcagguguuugauaaaugugaagaaguccuuucuccucacggagguuaugggauuugccaccauaggaggugguggugggaauacacacuuagacacaugucccagagaacacuaaauugcuuaaaggugcaagaaagcaaugagggacggagaacaaggaguccccaaggagggaaugugguccuguucucaggauuagggaugggagagcucaugcaaagugauggcagaaccucacauuggucacgcauuccaggucuuuguugucauagaaguuacacuuguuuugagagcagcagugggucuggagagaagaccaaagccuguaggagaugagagugaaaagcgcaucagcugcuggugggaagaggaaggcagaggaggcgagcauaccccccaccucccaccaaccucccugacccuaggagacugggaaagauaucacaggguguggucuguaugucaucuaagcuagcucccaaagaggugccccagggucauacagacaggccuccuuaguuccuuuaaaaucugauuucuggcugggcgcuguagcucaugccuguaaucccagcacuuugggaagaucauuugaggccaggaguucaaguccagccuggccaacacagcaaaaccccaucucuacuaaaaauacaaaaaauuaggcagguguggugguacgcgccuguagucccagcugccugggagucugaggcaugagaauugcuugaaccugggagguggagguugcagugagcuaagaucgugccacugcacuccagccugggugacaaaguaagaaucugucucaaaaaaaaaaaaaagaaagaaagaaaaacugaucucuauucuuuggccuuucagcacuagguucuuucugcaacccaccugcugcucauaaaccugggcugggccugucauaucaugugccuggaggacagaccugagaucaugugaccugccucaccccagagauugcccaacugcccuaucccauaccuguuccccagaaggccaugguaguaggcaaaguagaccagggaguugucauucugcucauaggaggagaguccauugcccacagccagccccugugaaacacccagggugcucagcucauguggagggcaaaaaggaagagccucccucacccuaccacccagaccuucagcaauccggaagcugaaacccagggugguuuauguaggccgguggguaugagaggccacucaaugcaaaacacagagcuggcagccugacaggugaguuuccugugugggaggcacacagacagaccuagggcagccggugguggggagguuaugcaggaagcuggguuggauggggacauugaccagucagucugaccuugcuaacuguaaggccacagccucaagcuaccucccuucccuccugcagcuacccugcaccugaagguucaugcugggauccugcaugaccagcacggccaggguggggauguagaugccagcauagcucuccccggucaggaaaaguuuguuguucuuguacuccggaaagaggcggaagaaaucuugaagggccucaaaauugcucugggcgaccuggggauggcagagcaagacagagggaaucaggaagcuuugguauuugaacuggaaagaacuucagagauaaugacauuaacccacccuauuugugcaagaggaagugacuggccaccauaccacaauagcauaugacagagcgaaaaguagacuccaaggccaugcucucucucccagcaucaugccauggauggaggaccggggagccuggggcagaugggcaggcaccagacucaccucagugucauuaguugcauaaaacuugucaucggaguaggagaagcccaccccagcuggggacuccagguauaacacauuggcaaucuagaggggagggaaaaauuagcuaaaugccaccccauccaagugcccagacacacccacagcuccagcuauaccagauuccaagaauagggguuguacuccagggugacaccaucuggcuggaccugaggaggaaagagauggcugaguaagucccaagggccagcuggguggagggaaagggccaccaugagaggcacuuuacauguggguaaaaccucugagagguacaggcagcaaagccaauggcauagaggaaaaucccgaggcuuagaaggaaggaaacuuuuuggaaaaucacaaagccccucucucgcuuuccccagccuuuuacuuugggaacugugcuuucccccugcuguccacucaccaggaaggggccaugcucugugaggagcccaucuagugagcugcagccgggacccccauugagccaaagcaccacagggcuguucucgggauccuucugggacuccacaaaccugggaggggggucagggcaggguuggcgcaguuggaggggcccuuuccagcccucccggcucccaggcauccucaggggucugcagaacuaccccccaucccucauccgucaucucuucucccaaucccgcccagaaggcagggcggcagaccaguaguggaggugcuuggagccggagccuuugagguagccggaguacuggcggaaagacggcugcuuggccagcccggggaggcgcuggaucucguccuggucgggggcugccucgccucgggacgcccaggacacuagcagcagcagcagcagcagcagcaggaacagcggcggcggcgcggcucggaucaucuacgggaggcagcagaggggcuguugacucgcuccucagcgcuuccgugcagcagcccccggggaguugcuggcggcgccuccgcgagggaagccccggccccagcgccagcucccacccgcgagccuccucugccgcgcaccgaucccgggcucggggauccccuccagccuccggugccagcucaccucugcucccccgcguccuugcucuccaggaggcgcccggggacuggaagucauguguacgagucacgugaacuccggcgccacgugacagucuuccucccgccccuucuuuggucccuacggaccuggggggcgguggcggucaaugccgggucaagguccgcgggccucgcagaucguagcccgggcgcacgcgaucagaugauccuguuguggacggcuaaguuguaggcgggauggcugagaaagcggcgcuaggacccccgggcagaggcucggggaagggagucaggggggaaaugccuuacaaggucgccuugcggucaccaucauugcccgccgcccaaaauagcccccggcgccagcuggccugcccuauggccgagagauggcugcugccuccgagcccguggauucgggugcacucuggggacucgagcgcccggagcccccucccacccgcuuccaucgggugcacggugccaacauccgcguggaccccucugggacgcgggccacacgcguggagagcuucgcccacggcgugugcuucagccgcgagccgcuggccccgggccaggucuuccuggucgagaucgaggagaaagagcugggcuggugcggacaucugcgucucggucugaccgcgcuggaccccgccagucuggcccccguucccgaguuuucucugcccgaucuggucaaccugggccacaccugggucuucgccaucacgcgccaccacaaccgcgugccccgggagggccgcccggaggcggaggcagcggcccccagccgaccuccaacccuccucguggaaccauaucugcgcauugagcaguuucgcauuccccgggaccgccuggugggccgcagccggccagggcucuacagccaucucuuggaccagcucuaugagcugaacgugcugccuccgaccgcgcgccguagccgccug

SEQ ID NO: 13525 - RNA, 41767 nt, Homo sapiens
cgggcggaggcuggaggagccgccgagcggagacccgggagcaggagcugggccuaggucugcgcccuggugagugaggggcgcccugggggucggggcgcggcaggcgguggagaggggcccggcccgaaagacgcagggaagagaggccgggccgagcguugcggcuagcgucugcuccggaggcugaggggcugagagggcgggccugggcuggaccgcgccggcucgucaggcccccgagggguggcggcccugccggggccuuaggaagggaggagagaccggguccuggacccagaaggggcgucgcguggcggaagagggcgggccaggcagucaggcacgggggcugggcugggcagcggucggagggagaaggagggaggcguugggugggaagaucggggaggggcggcaaggagagggcugggaagaagccggagagcgcucggggcgggcccgcacgaguugaaagcccggggucaugcucaaccuggacccggcugcccgcguccaccaguccgccccguggauccugcuggcucaguagcaccccggugcauguacuuuccaccuccugcgcucacccuugaguucaggccccucucgcuuccugccugggcaguugcaguguguuaacuggucugcccugcgcaggcacaggggcccuucuccugucggccuugcaccgugcccagagaaaccuuuccuuuuuuuuugaaaccuuuccgagacggagucucgcucugccgcccaggcuggagugcaauggcgcgaucucggcucacagcaaccuccgccucccagguuccagcuauucuccugccucagccucccaaguagcugggauuacgggcgccugccaccacgcccagcuaauuuuuguauuuuuaguagagacgggguuucaccguguuaggcuggucucgaacuccugaccucaagugauccgcccgucucggccucccagagugcugggauuacaggcgugagccaccgcgcccagccgagaaaugcagagcagaucuggaugcuuagggcaugaaacuggcccggcgucccaccccuuuguagggucagauccagaaccucacccaggcccuggagauccggucccgcugaccucucccaagucugucuacucguccguccgcuugcucagugcucuccacacacuggccucuuucuguuccuucuacaucccaagcuccugccuuccuuggggccuuuuauuuaguauuccuccucccuggucugcucuuccuccccuggcuuagucuuguaaacucuucuucauccuucagaucuccgcuuaagcaucacuucugcaggggaggcaucccugucccugacuuuucgaccaguaccccacguuuaucacccuggguacuuguccuuaacaacacuugcacaacugcaauuuuacauuuauuuacaaaaguauugauauuucucuguccaucccaccagauuguaagguccacgaagaagauagugucgguuuugcuucauguaguaucucuagcaucucacacagggccaggcaauauaaauauuuaccaaauaaauagaugcaggguuugaauuuggcaagaggaaggggaugugaaucguggucacugauguccuaccugcaggggaaugaaacugacauuuggaaugcuuuuugugugccaggcucuaugcuagagugaugcugcugucuaauagaaauguaaugugagccauagauauaauuuuaaauuuucuaguagccacauuaaaaaauggaacagcugaaauuauuuuaguaauauauuuaacacaauauauuccaaaauuauauuauuauaacauaaucaauauuaaaacauuauuaaugggauauuuuacguucuuguuuuuuguacuaaguuuuugaaaccugguuuguauuuuacacagagggcagccugugccacuuuucaagugcuuaguaaccaccuauggccagggauugugguauugggcuguacagugucacacacuuuguauacccucuagagucuuuugagauaacuguuguuaucugcacuuuacugauaucgauagugaagcuucuaaaagagguugccugccggggauaauucuagaguuuguaaguggaggaggugagauuaggaccucuaucuguucaucuucagucuggucuuucuauauaucugauguggacucuaggaggugcaaaggaaguuugaggguacaggaagucaggaccaaacuucuuuaaaaacuucaguguacagcauauucuagcuuguucugugcucagauaauguguccagauguagcaguaccaccugccaagguggcucagcaagaagcauauuugaugcaguugaagaaaacccugcaaggcaaguccuuugaccuggucaccauaccucggcccagccuggacuaagucuggucccaggaccuggauagaaaaaaacacauaccaugcagcaucucagaggugcugagaauacuaggcuugaguuuauagccuggcuuuucuauuuuuuuuuugagauggaguuuuacucuugucgcccaggcuggagugcaauggugccaucucggcuaacugcaaccuccaccucccacguucaagcgauucuugugccucagccuccugaguggcugggauuacaggugccugccaccgugcccggcugauuuuuguauuuuuaguagagacgggguuucaccauguuggccaggcugguauugaacuccugaucucaagugacccgcccaccucagccucccaaaguucugagauuacaggcgugagccacggcgcccggccuacagccccaguucagcaauugcucacugaguaucuaccacgugaccagcacuguuguaagccauuuuuggugauugggcgguguaugucauagccuucaucuucaggaugcuucagguauacuuggaaagacaagacuggaucacauaaaaugacuagaugguaugcaaggcaucaugagguguaaugaagagccagaaucaguaugggcuggaggcugcaaaguggcugucuuggccaagcugcaugauguguuuuuaaaaauguuggauuuaaacuccucuaggcaaggugguacuuugcaguguuacagacccuacauggaggcugcuuguuuuauuuacuuaccugcuuggcugcccaagacauuugaauuuauaacccuauuaggcaugcuaugcugguuucaugugagucacuagaaaauauuuguugagcacuucuuauuugccaggcauuguauuagcugcugcuuuggaacugaucauaacauuuuccaaaguucuuccacugggaaauaguaauaauaauaguggaacaccaacaaaugcuuugccuuuuguauugacuuuccucccggacugccuucacauaugcucucuuauuuugucaacaauacacaacauaccugccuagcagguagggcuuacuguguuggggaaacgugguuucagagcuuuugcaguuucuucagguucacacgguuagaauucugcuauuaugcuuagugcuuuauuaucccacuugaugcucacaacagcuuuacgggguagaguugaugcuaauccccauuuuacagguaagaaaaucguuagugcuaagauccaaguucaggccuuucccacuccagaacacagcuccuaacuuguuaagcuacacuuccucacuagaaggccaaaguuggaagaaagcucaaaaacaucuaguccagcccccgauguagaucaggaccugagguccagaaaggcuuguguuuguggcaaagcugugcugcaggaggaggacuaaaccagaagugggggccuaggccuucuuuugucccuaacugguggcauggccuugccagcuucucuggacuucaguucccuuauuuauguaaugaaagggcuuggccugauuuuacacugagaacaaugcugugcuguuauggucaguauugaaggaguucacagcccgagauuuuaguuguaacccaggacucuucccagcacaccacacucccucccuacccaagcuccaucuccuugugcaaucacgguuuucuaaaguuuaauucugaaguucaucuguauuuuccaucucaguuucuguuuccucucauuuccaaaaacugagguaagugguuuguaaacacugacuuuuuguaaauucaucucuucagucauugugguuagggauuuggaaaguucuaggcaauuaauaauccucagucaguaguguuuucacucucuucugaaggcauuuaggucuggaggcacccuggagggaauuuuccuguggaauucuguggacacagcuauguggcaggcagugugcugcaaacugggggaagaguagaugggggaauagacuuaggcuucaugaguccuugcccucagguugucaacucuccuggagcugugggucaacccugagcaucugagaguuuauaaaugaccugggguguguguugauggugcacaaccagaguugagaaccacuguuucucggaccuuaucugaucuagagccuaugucccagacuugaacaugcacuugaaccaccucaggaucuuguuugaaggcagauucugauugggugggucugggcucccagggauacugccgcugcugguaugcacaucacaccuaucguagccagggaagagacugcacauagagaauuauaaaucaguaggaucaggaagguauguacagaagacugggaucacagaugaggcugcaauuaauuuucccugaggugagaggauuaggaaagccacauagaagagugauuaucuuagcugggccuugaagguugaguugaaguuugccagcuggacaaggaagaggaaauaauagcacaagcaaacauacagacucagaagagcaugguuuuucagggaacagguggucuggugagaacauggcaucugcaaaagcgaaucugaaagccaguuccaccacagagccacgguggaacuggaguaaguugaaugcucugcuaaggagcuuacuuaagcacuauucuuuaaguauaggaacacuacagaaggugucugugcaggauaagagaagacccaggccauucuuacagcaggaaucaagaugaagaaacccaaauaguuccccugcccccacaccccuucucaccacaccuuugccucuauguaaguuuguggcuuuuuaccaugugugaaugaguccugugucuaacauacuucaacaaaaaggggaaaccucagcugcuguugguauggugguccuucccagggcuuccagcaguaaacauaagaaccuuaaucucugccagucaaauccucccuuuucuguaccucagagucugaucgucauucaguggacugaacuaagggaaguugaaucacuucucagaugagaagauuucagagggggaagccuuuauagagauuguguucucgauuagaaagggcgugacuccaacuugccuucuugaugagguugcauucuguugcaggaaacauaaaccaaacuuacccaugccuccuucaccaaaucaaaagccaaauaacugaacaaaaaguacacauccguucuuauccugaaaggaauagggggaaggaggggagcuggaaaccuggcauucuucaucccaaauuccuuacuaauaggaggagaucaucuuucacuucauuccuuaagauucgguuuccaauccugcucucagaauccagcuccgugaagcagcagucacugcaugggugauugauaaagcuccauggggcuucuguaacagugcugauuuuauaagcacaccuucuagaagccacuuagagacugcuccauuggagacacuaauguuccuauuuuucucuacuuuucccagcucuguguuugaaaaacuggccuuucauucuuaugacuuauaguaaaauugucaucaggucagugugugccugucuccuguuuuguagcauuuugaguuuuccaaaucauccuuauaucuguaaugcuuaaagaggaguggaagguagaaggguggggaguuguuuaauccggaaggggcccucugggccuggauauggaacuacagcucccuuaugcuggugguuugcaauugagcuacaguacugcugaguggcggagcaagaggcuauuuauaacccugagaauuuugcaauguuacugaauuccuuugaccuaauuucuacuuccuuucuagaaugaaaaugaagggaguaagcaaacacgugcuggaaggguucccuauaaggagauccuuuauccugggaauauuaucuggagaacagaauuauuucuagucuccuaucuccugauguuucuuuucgauagggagaaaagcagagggagguuuuccucuuucuuucaacuagaguuaggggugcuaacccugauuuuucaguaagacuuauucuaauguuugauaugaaaacaacaguuuuuuauuuuauuuuuauuuuuuaauagagacaggaucucacuuugucacccaggcuagaguucagugacaugaucauaguucacugcagccucgaacuccugggcucaagcaacucuccugccucagccuccugaguagcuagggacuacaggcacacgccaccaugcccagcuaauuuuuauuuuuuguagagaaaugucucgaacuccuggccugaagugauccuccugccuugaccucccaaagcauugggauuacaggugugagccacugcgcccagccaaaacaaacuguuaaacaauggaaauacuguguaguuagaggguauugggacgcagagggaacaccagacagccugcacaguucaugccugucccugucuguuuggagccagccugguucacaggaguggaagaaaucagagccauuggguuuaagcagacacaggugcuuacugagccuucacuggacaccaagugcugugcuagguuaugagacugcagaguuauaccuguucuggaggaggagcuaguggagauguguaaauauguaacuguaauagaguaugacaaaaucguacucauuaacggaaguaugaacaggaugcugugagaacacagaggccccuguccuauuuacuuuugccagggaaaguagagaaagcuaagacuaguacaaggaggagguaacauccgaacuaggcucugaugcuugaauaggagcucuucugacagucaguaggaggaagagaaugugcaaagguacagaagaauugaaagaacauggccugccuuauagaaauagcccguaguccaggauggcuagauuguaaaggaccaaauagcacacgagggaguguggcccaccuguagacaguggagagcugucuucuguuacaauggugaguucuugcugugaagguuucuuagccucagugugcuuugguuucagauacacaaaccagaaaucuccacaaagcaccugcugcgggucaggugcagagccaccugcuuucucauggcuuuccagcaacaccagacaaccugguaucaaauucuggcugugccacuugcuagcuaugugacacugagccuucuacuuaacuccucugugccuccauuuucuuaucucuaagguggggauaauaacauaccacacagcauugcuguguggauuaaaugaauuaauauauguaaagcccuuaaaauagugccuuagcauuauguaauugcuagcuaaugucaucaucuaaggaaguauuauauagagcgaugagaacucgcuuuggaguccuaagaccuaggcuugagacccaguucugauguguuggguugauuuaguuuuauuucuuuucccucccuucauuuuuuuucuuuccuuccuucuuuuaggagggagguguagaaagagguacauggagaacaaguuugucaauccgucugaacuucaguugccuuaccuguaagguaggaauguuuuucagaguucuuaugagcaucaacuauaauaaugauauagaagugagcaaucaacuauaaagaggcuaccugggcugggcacaguggcucacgccuguaaucccagcacuuugagaggccgaggcagauggaucaccugaggucaggaguucaagaccagccuggccaacauggugaaaccccgucucuacuaaaaauacaaaaauuagcugggcgugguggugaguaucuguaauuccagcuacucaggaagcugaggcaggagaaucgcuugaacccaggagacagagguugaagugagcugaaaucaugccauugcacuucagccuaggcgacaagagcaagacuccaucuuuuaaaaaaaauuuaaaaaaauaaaaauaaagaggcuaccuguacguuacuacuagauauaugauuacuaugaaguuaccauauaaccgaucuguuucaaacaaaucagacuuaucuaguggguaagagcaaacccauggguuuugcucucauuaauucagccauuguuaauuaagugcuuacccaguaccaucaucauaugcuagugaugcugcugucugcucagaccuccguuuuagaguuccugcagagcuugggggcagcuguggucuuaggcguauuaguugcaaugaguagaaacauagacuagcuuaauuuauaggaguuuuauuggcaggauacaguggacuuucagguaccccgagcauaggaaguaauagccacauaaucuggaaaguuagcagguaauggcuuuuccaucucuuucugauuucuggccucaguucauuuagauauuuauggauuccuccugcagaaucacuuccucugaaaggcucuugguuuuuuauucuccauaucuuuggcucguacggaucuuuggcuugccaugguauucgcucugaagcuuacuaugaucuuacuucuccagggucauuaucacccaguucccuuagucugugucuuuuauuuguuuguauguauguauguguguauuuauuuaugauggagucucauuccgucgcccaggcuggagcguaauggugcaaucugugcucacugaaaccuccgccuccuggguucaagcuguccucccugccucagucucccgaguaguugggauuacaggcgcccaccaucaugccuggcuacuuuuuguauuuuuacuagagacgggguuuugccauguuggccaggguggucucaaacuccugaccucaggcgauccacccaccuuggccucccaaagugcugcgauuauagacaugagccaccacgcccagccagucucugucuuuuaaauucaagagaaagaacuggaauaguucagcuaaaguuggguauucacuuuagucccaucagcuauggcaggguuguggagagugucauucaguucagagaggcugccugggcuuugugggaaggacagagucacugagaaugggggcuuauuaauaucuuucaaauaguuuggugguugcaaaucuccaugcuuuaaaauguauacgaauuuuugaacagccgagaaucauucagggcuaacuuuaauaaagagagagucaaucuaggauaugucauauggggucaagagaaaauaauagcuauaaccuaaugagcuuuagcuuaaucuccaaagacggcguucagaaaggaguuaaaaaucaugggguuuguuucuuagcagcaccaucgaaauuaaggaaggguguaacuucauuugguaaggacuuuaaaaugggcauccucacuuggauuuuuuaaauuccacuuaagaaucauggacuuuuagacuuagaaggcaccugagacaugcuuuaguucuacacucacaucuuucaauagaagaaaacugagauuugguuaaagggccauguauacauugugaaagaccuaggauuggguccugaggccuuugguucuaaauccagucacuuguuucagcagggacaauuaucccagcccaguguucuuucuguuguaccuucugugccugcuuauuuuaaaaauaagaagaagccaaacuaaacaaaugaucuaaaaagucauaucguauaguuccauuuauaugaaguacaaaaccaggcaaaacucauggaugaugauaagucagaaauuccccuuuaaaggacuggaaggauugacgggaagaggaaguaugaaguaauuuucuagggugaugaaaauguucagugucucguuuugagugcugguuacagggagaugcauguguauauuuauaugauguauauuuauauauacaaacauauguacccuuaagcccucugcauuuuauuguauguaaauuauaucucaguuuuuaaaauugaccucacaaccgugcaguccugucuacuaauugcagcagcuuugccgauaaggauaaggaugcaucucuaagcauccagagauugauggcgccaccccuagaacaagaacucccugucuugcuguaacuggagcagagcauuuuccccagaaauuaugcagauagggccaguuucuuuucugagguuugucgugugucuaggcacauaaaaauuacaugugaaaaauucugccaugagcugcagaaguuauggaagccuugggggccauaaggccaacccacuucaaucccuuuaggcugcguuuaauugcaguggacagaaguugaggcuggcucaaaggaaaaggggaaagcauuggccgaagccaguccaaguucugucaaccguuaugacuuacuagcugggugaccuugggcacuuaacaaaacacugagcuuuaguugugccaucuucaaauggaggugauaauccuguucugccuaauucguggggcugcugggaggacacaauaaaauaagugaaagcacuuggaaaacuaguuccuuuacauugucauguucuggaaaugcuggcuuuuuaugacaguagacuucugaagcaucccauucugacuaggaaauggucaugaaagcaucccucuuucugaggccgaugggcuugugggggacaggacuuuuacuccuuuucaucuaagagguuuauacuuaccaggcugugagaacugacaucuguguuugggcugaaaaauugauagcauacaugcauaauagccucgcgacagcuaugcuuuguacgccaggagaggcaggugguccccauuagcgaggcaugaauugugggugaauggcuaaaccuggaggaugcagaaaggucuuuuucauuaagagaggggccucuccugaacuuguaggcaaggaguguaaauauacauugaaauaauccaucagccaagugacuucccuucgucagaccuuggagagagaaugcuuuaguuacugcuuggaauaccaguaagcuaucagaguugccuaggauaccagucacaugggcccaucuuccagacuugcucaggaugauuuauuuuccuuuauuuuggagagaagugggggagggggucagagguacuugcaaagccuuguccuuauaagaggggcccuugugugaggauauccuuaccucucuccacuugaguugucagccgcccuugcccuuggcaguagggacgaaaauagcauuuccugucccaguuaucuuccccauuuucugaugucgucccacacagaggaggcuuugcauuguguccuuugaggggaaagggguggcaucgaugaguggggaggaagcaagagagcauguagcugggcccugcugaugcugggaucuuccuaggaugacugcagaaagaaguagccuggcuccuccagcuaaccacucaaccaagaaaaggcugucuauucuuaucugucucggagcauaugcuucucuccucccaaggucucaagacaggaauuugcaguaaauacauuccucuaccacugagucuucuugacucuuaaacugaagugccacauuggcauaucuugcuacuggcugaucuauggaugauagauaguuugucccauuucuucuugcugauuuaaucucaagagacaaaauccuaagcagaaguugugguaugaucuagaaaaauucaaaccagguaguuucauguguuacuuuaugcagugucugucuucaaacucuucaaaacauguaacaagagugaaaaaugaagaaauacucuuuuuccaccuuucugauucuuucuccccaggcagccgugucuguguuuuugucucgcagaauuagagcccauugggaacgaugccaccaccgucagacauugucaaaguggccauugaguggccaggugcuaacgcccagcuccuugaaaucgaccagguaugcuccugaagugagaagcagugguucaaggaaaggcaccuggggagugcauggcagaggacaucuugagggauggggaccaccggcaucaagaguaagaacgagcaacaggaaggcuaagcuuugggccuggcccacccuagggaaggucggucaccauggcuugggagaggcuuccucuucaacaaaagcuguuaggaaagaaguucauucucaugccccagcuugacccugcuuggcaggccucuugucagaaccuuggcaugaguaggauguugcugcuguugaaggcuuucucucucucucuuucagaaacggccccuggcauccauuaucaaggaaguuugugauggguagguugaaauggaccucguuuucaacaguggcagcuccgacugaaagagcacuccuacaccuugaggggaguucugggaaggaucuccaguuaggcagguccucagcaugggggucuugggaaucauugucuugggaaggaaguacaguugacaaccauaccccuaagacguuuauacuucuuaauuuuuuccuuaaagucuagcauugcccuauugagguaggaucugagaccccuccucaguucugcacaccuccuauuguggugcucaucuuuacaaaaggcugaggccaugauuuuuucaacaugacaaccuaaagcuuuguuuccacuguauuccaaauaggccacccaaucccuugagcaacucuuuugaaaauuacuuaugagcagcuucugaacaagagaguggccaagugggauauacuguuuuucucuugcauagguggucguugccaaacccagaguauuauacccuccguuaugcagaugguccucagcuguacaucaccgaacagguuaguacagggagaggcaaaaucaauaugggccuugcuuggaauuaaacgacccaaggagacggcacuauuuaucuucacucagcauccagguagcuuccauguguuggguaaagagucacucuccggacagacugggaaacaccagcccuuguucuucccuaguggcuagaaaaagguggcuuuuacuuccugagugcccagggugcuagaggaggaucuuagaaauucuuugccaaggaauaagcaggagaagagggcccgacugaagauccucaguuacaucuacuguaaaaaagacaaaacauuauuguugauucaacuugcuuguaccacuuuaacauuuuaucuuaguuacuuuuuuuguuuauuuuucacuacccagacucgcagugacauuaagaaugggacaaucuuacaacuggcuaucuccccgguagguauucuuucuuccuuaggaguuuauucaugucacaaacaaauaugagcaccuaccaugggccagacucuguucuagaaauaaguacucuggagauaagaaagucagucuuuuuguaucaggaaauaguacaggaaaauaagucugucuugguucucaccaccuaguggggaguaaacaaaugcaauagaaggccugucucaagggucuugagagaaaguugcuuagggagcugugggaacucacaaaggggaccaccuaacucagccuggagauuuccagaaagucuugccagagaaggcgucacuuagcucagauguuaaaggaugagcaagaauuagcuagagaaauaagaaaaggaaaaguauuccagucagagaaaucagcauaugccaaggcacagagguaugcuguguuugggaaaagcaggagugcuggguggcuggaggcuuguagcagucauugagaagccagauauucaagguuccuugauggccuacucguagguuucaacucuguccagaaggaaacuggggacauugaagaauuuuaagcaggaagauauguuauguuuagauuuuaaguuuuagaaagaucacuuuagugaccauguggaagaugggccuuaagaagaagguuggugguaguaggaaccuuugaagaggcuaauaaggaauguuaacagcccagugaaggcaagugguaauggagaugaaaggauggauaugaagaguaucuaggagguaagcuuuaugaguauggugauaugcuagauguggaaggaaaggggagaauggaggaugacccugauuugugcaagagcagcccuuaaaggucacuaaggaagcaaccagaaggguagaaagaacaccaagaaggugaagugacugaggagcuuugggcagggagagugucaggacugaggagaguauggucugcaauuuuuaauaagcagagagauuuaguaaacugagagcagaaaagcugucuaaugacuugggagguuagaggacacuggugauacucacaaaaaaguuaugguggggaggccagguggccacacugaaguggucaaguaaaagaaagguaaaacagugaggacuuugagucuacugcuguaucaagaagcuugguuuuaaaagaaaacacagagaaggugauaaugcgaaggggacguggagucaaaaagaugugcuuuuuaaaagcagguaaagcauucauguguuucacaaaucaaaaauuuucacagagauguagcaaaaggucuccccgcaacuccuguccccaucugcccaguuccccaccuuucugacccuucguguugguuguuucuguugcaauuuuuuaugugcccuuaagaauguguucagauggaagagaggaagguugaaggugcaggaaagcagguaaucaauagaacaggaccuuacuggaccaggagaggaaggacucaaagcccagguagagggaaucacuuugacugcuaggcccaugaagaagacagccaauaugguugcaccuuugguuacauuuguagaagggcagccagaaaauuaagggcaugauggcacuucuuuucuuggugcagagagagacugguucaucugagaggaggggagguaugaagugauaucagccagcguuuacugaaugccuauauuuugcuaaauacuuuguguaauuaaaucaucuaaucuuuacagacaucccaugagauagguacucuugauagccccauucuguaggcaaggaaacugaggguuagagagguuaaauuacuugccacuugucacacagcuaauaaaguagccaagcccgcucucagacccaggucugucugacucuaggcccauauuccucccaucauguucuucugccucccccucuucuccugaacucuucucaucuuaaggacuucauucuucccuccuaagcucugguaauuuaauaugacagucugggaguuacucacuuuuauggaagugccgacacauuucacagaccucuugcacaguguaguugacuuucccagaagcacaucucucuggagcgggaggcagcagcccagaaaugcugucucaggaggaaaauugacauuuggaguuggagguuucuaagugggaugcagaccagugcucuucagauuguucuaugcuaugaccuuuucccguggcgcacauuuucuccacuguagagauagcgagggcuucuguauugcagagagcacugugcuuugaagggccagcuuuguaauaguaaaagaggagaggcaaaggggagagggccagcaggccugacuccuuggcggcagcaggaauugggcuccagucacuugcuuaacacugagaaaaaggaaagaagacagguguguuuuuguucuuaagucucuugcuuucuaguggagaacauuaaauuaacacccaaaaaacagagaaugaugaaacaauaaauugugaggcacuauguaguaaugagcucagcggaaggaaagcccagugaauacuagaggagggauuuuagccgcagcuugcagaaaaggaggcaggcauccugcuaggaaaaguucaugugcuaggaggagguuuugucuucaccagccuucauuuucaaaaaacaauugggaaauuguuucuggcuccuugauguucuuaaaguuuccccagaacugucacuuugaggaacaaucauauggauucuaagagaaaguuuuuaaaaaauugccaggcuuuucacauuuuaggauuaaaagggaccuuagaggacaucagauuaaauucuucacccaaugcaagaaucccuucuacagcgucuuugacaggugguuguccagauucuccuugauugcuucugcugacagggagcuuaauaccucaagagaaaccucuucugcugucuaacaguuuuauaaauuuuauuuuauuuuauuuuauuuuuuuugagauggagucucacucuguugcccaggcuggagugcaguggcaugaucuuggcucacugcagccuccaccuccuggguucaagcaauuuuccugccucagccuccugaguagcugggauuacaggcgcaugccaccaugcccagcuaauuuuuguguuuuuaguagagacgggguuucaucauguuggucagguuggucucgaacuccugaccucgugaucugcccgccuuggccucccaaagugcugggauuacagguguaagccacuguaccugaccaauuuuauuuucuuuuuuauuuuugagagagagucuugcucuguuacccgggcugcagugcaguggugcaguccuagcucacugcaaccuugaauuccugggcucaagcagucuucccaccucagccuccugaguagcuaggacuacaggugugcaccaccacaccuggcucauuuuaaaaaauuuuuugggagucagggugucacucuguuggccaggcuggugucuaacuccuggcuucaagcaauccugccuuggccuuucaaagccuugggauuacaugcaugagccacgcacccagcaagacagcuuaaauagaaaaccuuccucuauuaaaccaguaucuguuucucugugacuuaccaucguuagugggccucccagaugccuccaguauucccuugguaggaauuuuuuaaauccauaggccaaagcgguacagaaaagaugcagauaacuacagauugguuuuggcauacuaauaacucccugauugauuccacaaacauuuauuuagcaacuccuaagcugugugaaaaaacuaguucugccucagguuuggauguccacagaagggccucugugagcuauccacagaguaguaaccugcuccaaggagcagauggcacauaucuugucccuggccuccuagucccgggcugcacgccagcugauggagaggacccagucauccaacauggagacccggcuggaugccaugaaggagcuggccaagcucucugccgacgugacuuucgcuacugaguucaucaacauggauggcaucauugugcugacaaggcucguggaaaguggaaccaagcucuugucccagugaguaugacuaaggucucguuccaaggacuucgacgauuuacuacaucccacagggcauccuagucucauuucccuugagucaaauaaggaguuuauugaauaccaccugugugcagagcagugugccaagcacuagaguccauaccaagauauauaauuccauauugugauucuaaaucguguagucuauuugggcucucacaaauuaaauaacaguacaaaacaguacugugccaagugagcagugaaaauaggggcuagagaagucaggaggagagcagucacgucgugacagaccuguuaauugcuggaaauguuugguuugaugaggguuagugagcagaugguccaguaucucccaggugucuguuuguaaucauccccugcuccucccucuucagucaccucccagcccauacacacacacacacacacacacacacgccuuccuuuguguuuaccacaggugucaaccuacccauucaccaucucccugccacacuuuugcacagggaggaggagaccagaacuuugugauacccacaagcaucuucaucauaccccagaguucacaugcaugcggugggcagcugugccuugugagcagcagucaguaaacaggugcuuggagccuaaccugccaaagagggagucagaaaucuucucagcccauagaucaacuauugaaauuguuagccaaaucgaguaacuaaucauagauauuuguuuuacauauuggaucuuccagcuguauugaaguccugaagccuucagcugccaucagcacugacauaguucuacagucucccaaggguacaggguuagacuggccuuaguuucacucucuucagccugaggauaauaauagcuaccuugcaguauuauugugagaaguauuguuaaugagaaugugucugaacaugcuuuguaaauaggaauaucaucuguuaauucuagagcacuguacagauguauaaaggauuaaauguauaaggagaagagaaaaaagagaaaacauuuuaauccuuauucucuaccagcacuagaauaagagcuuugcauacaucaucaucuugucgucuccacaacccugugagguuaacgcugugagacuaacuugauuuuacagaggaagaaauugaauuuugaaaagauaaaauuugcuugguuaguaagguggacaggaacugaacccaucucuugcacucuacugccucuuggcccaaagguuaacauggcacuuacacuuccuuagguucucccaacagguguuggaguuugacaaagguccaaugucuucuuuggucuugggaaauagauaagugauucugugucccugggaugaagcauauggagaaggaagaucuaauuacccagcaacauuuuuuuuuuuuuuuuuuuuugcagcgauagauaccugggcugaaucugcucuacacuggcuaggugugcacacaggcacuuacaguuacaguugcaucgacugauuucccaugggguguucacauuaaaauucaucuuuuuuguggcugcccucacaccuguguuucccgaucugaaucuuugucuauuuuguguguguguugcacgugucucagcuacagugagaugcuggcauucacccugacugccuuccuagagcucauggaccauggcauugucuccugggacaugguuucaaucaccuuuauuaagcaggugaggccuccaacauucugucuuucucuccucccucagcugccaguucacaaggcuuaaggggagauacaggcaauaucgccauucuggugagaucagcuuuauauucccuggggccagauuuuucauccucaagcucuagucuucuguggcuucugaaagauuugcauuuuguuauauucucagggccugcacugagauggaacuggaccgucagaacuaaauaugaucaaaguagaauuagauugucagugagacuggggauaaagccagccagucaaccaguacuagcccugagucuuuugaccgacuuccugagcucucucuucuuuuuguauauauauaaaaaaaauuugcauuucauuuguaaauuugccuucuauuuacaaaucugcaagguagccuguuuggauugucagacuaaguucaguggguaggagaggguacuucugguuuuacccuccuuucuuuuacacaaaggagcagugucaauucagaauacugaacuaaaaccaaugaauaauauuguaucugcugcccuagaacuucagcuaucauuggcuuaggacauugggacuccccgacacuggacacaagugaaaugaccaugugucaaggauauuauaauggggacugagaagaaggauuagaguaaaaggcuucaagguccuuucuaccucucaaagucuaaguguguuuagggggagugugugucaggggagguacauggagauaaaaugagaucccaguaucaguaaaauccucugcuuuuuuauaccccacuuucucaaacuggaacccuuauuuugauaaaaagaauuaagcuuuuagauuuugaggaaacacaauuaaguggauacuauaaucugagauuaagguauccaugccaagggaaucccuggcacauuggccaggguagccguaaaccagauaccacuauccaccuagcaacagcugcccaaaugugaagcagagagagcuucaagggcuagcaucagaugcuaagcuucuaucuuucuugggcccugagcuucucaauugaugugccaucucugggucuagauugcaggguaugugagccagcccaugguggacgugucaauccuucagaggucccuggccauccuggagagcauggucuugaacagccagagucuguaccagaagauagccgaggaaaucaccgugggacagcucaucucacaccuccaggugugaguaaaaaacccuacaccucccucccuucacuugucuguccucuuuucuccucuuauuuuaagucuuccaauccuacucuccuuugcuuauauuccaagcuguugguuggcuucuucauucaucaccucuuccacacuccugccagaauuucucccaucauucagacuugaucaugucaugcuccugcccaaaauccucuguaacucucucugccccuuagguuaaaaugaagauuuucccagucuucccauaccagggugguaccaggcaaaauuagaugcuuucucacaugggcccaguagucucuguaccuaugauaauuauauaaaauacuggauuuuuauuaucuguugcccauuuugaacauagagcccccuugaaacagagaccaaucauuguuguauccccuguuuugauuuaaguagaggcucaauuagugcuuguugaaugaaugcucacugaaccgacgaugcacugugggugauuuguaagaaauaucacacaggugugaguuuggaauaucaguucaaauccaggcucuucugcauacuaggucucugccaucagcaaguaaccuagucucuucuggccucaguuucuucaucucuagaauagguuaaucaccuucaccucucacacugugaggaucaaaggagauuuuaaaaagguccagcauagaggccaaccuggguuagguauucaguaaauucaggggcuuuuuuccuuuguuuguuuguuaagacucuuaucacauccuaaaacauuuuaccagauacugagaccauaugacaaaugaacccauuggagcaauguuucucccgucuccgcuguuuuuaccucacuuccaaccaaccuacaccauguaaggaagcuggacuuugcaaaacagugguggcacuccuguugauucucuucugacuguuguucacuucuguuuuuuagacauugucagaauguugccagaaucccccaccaguucgaggggaagucauagcucccagauuugggaguuuauaguggcccugucuucacucagcuaugcucccaacuuguuuuuccccacuaauccaaguaaaaagaaagcacaauuauuucuuugcaacucugauuucuccuugucacuuuuaaggaauuuucagccucagcuuucuuugcuuuucuuuuuugagacagggucucacucugccguccaagcuggagcgcaguggcaugaucauaacucacugcaggcucaagcgauccuccccaucucagccucccgaguagcuggaaucacaggcacacuccacaacaccuggcuaguuuuuuuuuuuuuuuuauuuuuguagagacagggucucgcuguguuguccaggcuggucucaaacuguugggcucaagcaguccucccaccccagccuccugaguagcugggacuacaggugugagucaccaugccuggucuagccucagcuuucauacccagcgagccaccaagguugauuaaggugagagggacauuauaaacuccagauagagaauucugauuuuccuguaaccucacaucuacuucucugguuuuuuuuuuugucucugaauucagaguggccccaguugccucccuagggaugauaggggaacauggcauuucauaggagccaauacuuucagcccacagcugucaccagaacuuauaugcuuuccuuuuugggcugagggauacuuagugcccucuguuagacucccuggguaccaugugacuaaccaggaagcccaucagacccucuggaaagacagccacagaaugcacccaagacauggcagguggagaugucaaguaccaggauuguaagauuccagagaaugauuguaguuauuuuguuuguucauaauaaaauaaguuuauagucaaagacuuuaaaaauacagaaaaacgcaaaauuauuugcccauuaucucaccuccagacauacccacuguuaaacauuaaauugaaugucccuucaguauuuuuaugcauauuuuuaacaaaaucgggaucucauuauauauacuauguguaccuugauuuuuuuuaacugaauaauacaccuugaacauuucuccaugucaaagauuuuucuaaaaggguaguucuaagucuuuuuugcaaccuagacaccuuugaaaaucugguaacaaguauauacucucaccaguuuggaaaaaauaccacuuaguuggcaaacuacauagaauaauuucuguaucauuccugggguucacaaauacucuaagcucaucccugaaucccagguuaagaaucuuuacccuaaaacaugacuuuuaauaacuacuuaagauucucauauguauaaauguuggcuaaugugaccauuuggauuacuuuccauucuuuuuuaaguaguacuuuaaugaaacgccuugucaguaaaucuugcauagcucucugauuacugucuuaggauaaauuccuauuagugaaauugcugggucaagagcaugcccacuuugaaugcuuuugagacugagcuccagaucauuauuugcuuauaaucugugagugauuguuuuaaaccauuucuaagcaucaucuugcuguucagucuucuaaucucccucucucuucuuucuccauugacacagcuccaaccaggagauucagaccuacgccauugcacugauuaaugcacuuuuucugaaggcuccugaggacaaacgacaggucuguggcugccuuuucacauuuuucaucugggcucuucugagauaauucucaccccaugcacucuuugcuaugcagagagcacaaauccagcaauuuucccaagaguucuuccucuuagcugucuggucuggagcccaggaggguggcuuugcuaaggaagacccagggaagaccuaugaggggaaaccagcugggucuuagaugagagcagggcccuucaaacuuuuuccucuaaagggccagagaauaaauauguuugacuuuaugggccauauggucuaugugauagcuacucaaccuugccauuguagccaaaagcagccucggccaguagguaaaugaauggguauggcugucuuccaauaaaaucuuauuuacaaaaacaggcaacaggccuaauauggccauaguuugccaacuccuggguuacagaaucaagaauaaggaagaggagacccuguggcuacccugaguccaaggaguccaauaugaaugggauuucacacuaaaucuuagguuuaaagguucucugauggagauucuaaacaucuuccuuccccuguucauuaacugugacauuaugcagauagcucugccucugugaaccuuaguuuccucaccugucacaugggagcaacaacaucugccuuguuuaccucacaaggaugucugaggaaaaacaagaucccuguuucacaaauaaggaaacuaagaaucagcugggugguggaacaaacacugaccuaagagccgaggggccugggacuaaguauucucccugcugcuggcuggacaaguguuuguaaccucuuuuugggucucaguuucucuuucuguaaaaugaaagggccaguuuaaaugaucucugacagcccuuccaauacuaacauucuagauuucucugagaaaagcccaagugguguuaaaaguaagacauuuuaguucucugacaaucucaugggcucaguaagaugaaauucaagugggaucauguauguacccagcucuugguagauucuagagggaagaccagaagcaucugugguucugucuguccuugucuuucuuggauggcuuggcucuguuaaucugccuucccgguccuuguuugaauguaagcugaaagcucauuccgucugcuucucucugugcuuuugcuuucugccggcaggacaagcaccuuaauccucuagaccugccugucacuguaaguagcacugccauguggaaagggccccagcucuugcagguggggaagucaaagcuaggcaagaaucucauggucugaucuagauguucagggcaugccaagacccagggaaagguugugugcugugaaucuccuuugucaggacacuuagggaaguacugcagauuagagucacagaaaggauuaaggggguaccugccccagggaguguggccccagccuuccuuuauaacuugccuuugcaugggucuguaguucaacuagggcagaccagacucagaaacagcucguaacuuugaucuagacaauaccauggaugcgucaccuucuuacuugcuuuaguggaagagaaaagguauccgugcccuuuuuggacucuuacuagaccgugggaauccgaaaagguuuagacaaucgacaaaagggaauuuggaugcucauuucuucauuauagggagcuuuagagaggucagcuuugcgaggagaugaaaggggauaagugccucccccugacaccacagagaagcuuuuggucuaagaccuuuauauucuagcugcagaccacugucaauuacccaccuuaugaguuguccacagcaagauuuaaucucagucgaccuccuauaguuaccagagaaguuucuaggccacuguccuccucugcuagccaguauguauucagagaaugcaaaguaaaauuuaauguuccuggcagcauuagccauuuggaauauggcuagaaauccagaagugugacagaggggccuuucagcucugagaaaaaugacacagagcucacagauacuacuccauaggagaggugugacagcucccucaggcccacugauuuaggauucucuauaaaauuaaaugaaggcagcaguuuagaaaaugaagucaugguaauuaacaucaguaagaagugauggucgacacuggaaggaggagacaagaauuaugaaaagcugucagaaaaauuaaaggcauuguaaucugggaccauuuuguuuaugggaaaauagcuucacaucucaguagcuccucaggguaucacagugucacaacacagaauaaucacugauguucuuuuugaugaagccgacuccuuagcagugauuaaauuaucacuguagucacuucagaaauaaauguauauaauaugucuuuaaaagauuugcauaagaauggucaaaauaaugauucugagagaacccuuaaagcuuugcucccuggaagauucauuuauguaggaaacuugauuuccugggugggcuaaauaaauaaagcauaacuaucaaagucuggaucaaauauuauaaaaaaggugagccuguuauaaaaaauuacccaaaacaccagacucauuguucucuaagccaguuagaacggaauccuagacuacuuacuguuguagagcguccagaccccagccgucugcuguagggugggaggggguugcuggaccaaagcccuuccuuguuuggagucagugcuucacuagaguuccuucuagccuuagcaguggggucuaccuggcacgaugcauguggcuuagaaaccaucacacugcucuguguccaugugcaauguccuugugacacaagcgucucaucuucaagcaguccucaucucucuuugaagacaguggaguugauugugccauuaggaaaggaaauccuauuugaauuaauuugcacucacaaaaauagggaauguugcagaguguaaaauacaucugauggucaguggauuuucguucauucacccacuuuucauuugggaggaaaaaaauuuaagaaagcaaaaaaggcccagaauuuugacaucaccuuccucucgauaguagucacaggugugugccugccacccugccuuauauuugcuuauuuuccuccacaggauauggcaaaugcauuugcacagaagcaucuccggucuauaauccugaaugugaguuccuggaacaugcuguauuuuauuacuauuaacaacaauuauuacuguuauuguuaauauauuauuauugaaauuauuaaugagugaggaggacacacagaggaaccuuaucaauagguaaauaccucuugaacugaauagcuuuuucccgcgauccucugugagcagaguugccucuaggcagccaucucaccagcaauugcagugcguccagggagggaccaaggccagcucuacuguuuguugcccugcaacuccagaauuuuuauccagagggaauauguuaaaauaggcacaaagggggaaaauaacucauccaacugacacugauuaaaaaucugaauuguguagggcacugacagaacuaaguaagcaaguguauuugcucucaaagaccuucuggccugguaggaaagacuagugaucauaguggggugugaucuggguuuguggucuaggaaaggauggaggaggaacagugauuucugccuugaagaagaguguuuccggaaacuuuuagaggaaugucuucaggugacccuuagaggaugaguaggcagaccgggaauaacaggaauuucagucagagggcagccagaacccagaaggagugugugauuaggcacagagcaaggagcaaguagaugaggaggcuagagagguagcgaggaccagaucaggaaagguuagucucauuccuaaggacagcugagggcauuuaauugagcuugugaaguaaccagauuugcauuuuagaaagagcacaugaaagacauguguuugcuaagggguaccugagggaggagagcagagcaggagcuggcagggggaucuggaaagagguauaaaucccuguuaccaccugugggguggaguagggcugauguugggagguggggccggugggaguggaggaggagagccaaggaucugaauuaaaaggaggcaacuuuggccggacgugguggcucacaccuguaaucccagcauuuugggaggcugaggcggguggauugccugaggucaggaguucgagaccagccugaccgacauggugaaaccuugucuuuacuaaaaauacaaaaauuagccgggcguggugauaggcgccuguaaucccagcuacucaggaggcugaggcaggagaauugcuugaaacccgggagguggagguugcagugagccgagaccaggccauugcgcucuagccuggacaacaagagcgaaacucugucucaaaaaaaaaggaggcaacuuuaucaacugucagaaacaagggaaaccugggagaccacagugaagggaauaaaaugaaaaauuagaagucaaguuuaagacuuaagcuaaacauggacuuuggagucugccauuuuccaaucuuugaucuugagcauuucacauaacuucucuggacuucaguuugcucaucuggauaugaggacuaagugagcuaauauaauacugugcuuagcagggugucuggcacucaguaagcacuuugcucguauuggcagaacaggaugcagaggugauaggauugaagaaguaagcucugagcacuugugaagcugagcagucagcugcucuaaaaugcagagucugccagacuucaccuugcagaaccagcuucucccugcuggcugcuucccuggucacacccagcuaccagccuggcaggaggggccccaagcccacaagugacaggaguacacagguucccacacauuccugccuacacuccugagcagcuguccuggucacccucuucugcauguguggggaugagugcgcccuucugaaggaaauuuaauuauguuugagacuuacuauuuaaucggguuagaaguucaacucauuucuggacaaaccuugugaacaaguaaagauuucacuauagaaggcaguucagcaucaggacucaggacuuaaguggccuggcaggaaauggcuaaugcauggucacugaaguccagggauuucacugagucaagccagagaacuaagacccugagauacuugacagucaagugagacuucagguaaaaccucaaacugucacucaucagacuggagcuguacuucuuuaagccauugaugcuaggauaauuaauuaccuuccugcccugauguuucuuaaguuggagaaagagaauuaaagagaaugaaaaucagaaucacauuaacuuccaccucuauucaaagcuguuuuauaaauuagggagaagagugaggagagaggaauaggauagacgaagguagagagagggagcaguggagaagaaaaccucagagugaggcaaaggaagaggugugaaggggaaaagaaguggcgauggcagggaagagccccuggccaugagagagacuggggggagugggaaggaagggaaguuauggggcagggggcacagagcagagaacaagagaguaaggcuagagagaugaaagaaacagugagacugagcuaagaagagcgaucucacgcuuaagagacagagggcgugccugugacagggcgggagcuacaggacuggacaugaucaccgauucagggggagggagggaugcaggcagaggccuaacuccagcauguuagcaugugcuauggaagugcuguccacaaugguggccaccagucauguguaguacuuuaaauaagucuguuguggcugaggaccuaauuuguaauuuuaauuucauuuuaaauuuaaauauccguauguggcucauggcugcuguauuaggaaguguagaucuagagaaacagcuagaaaaaggagagagcacuggagucacaguaggggaagaggucuagagcaggaccguccaguggacauagaacccaaaccaugcacaugauuuuaaacauuuuaguagcagcaugaaaaaggaauagggacauuaaguucaauaauauauuuuauucagcccaugauaucgaaaacguuaccauuucaacaaguaauaaauaugaaauauuauuaauaagacauuuuacauuuucuuuuuuccuacuaaggcuucaagauccgguaugcauuuacacucacagcaccucucaguuuggccuaacauuucaugggccugggggcuaccaaacuggaccucacaggucuaaagagauugaucuagagucagagcaaacucuagggagagcugauccaaaguuagaaggagcuuuaaaaagauacugagucagauaccucucuaaagucagagcgcucuagagcauugcuauucaguagaacucuguuaauggaaguguuccguaucugcauugcuguagccgcuagccacggugacuacuaagcacuuaaaauguggcuggugcaacuaaggaaccaaauuuucaacuuaaauuuguuuuaacugauuuaaaugcaaauagcugcauauggcuaguggcugcuauacuggacagcacagcccuagagacagagcuacugaguagggaaauugaaggacauaguggugguacauguggaaaauggaggagagccucauuugggcaagaaagaaccaagagggacaggauucauaauggugggugagacagagggagugacaaauacaagggagcaagaagggaagcaggauauugugggagugaggacaggauggugagagacaggaauguaaucaaggguugaucagcuaggacagaccgagggagacauagcaugcaagagaaagacagagacagaacaugagacaggaccaggggaccuaaaguggggugugggcaucagagggacaaaggaggaggugaugaaccgacaggggaaugugggggcacagagacaguggggagggagagucaggagggagagggacauggugugggcggcacagggagcagggacagagugauaggagagaggagaggacaagugagaggaaggaaggaaggagagggccgugggagggagcugguaggagagugaacuguuccuccuuuguguugcuaucucaguaucauugaaagaaaauggccuuucccaaagccucucugcugggugaagccauccaaaacauuuuauuuuucuaagggaaaaacaacucugccuccaugcacaccaucuauuguuuugcauuuaguaggccugugaaaugccugauuggaggaagguccagcccccaauguucuguaucauagccuugauggaguagccucccccauuucuggugugguuggguauagccccugccuucacucugcuuccccugcccaggggaaugcagaggaagggauggcgccuuucaggccugcagugagucaucucugccugaaccaagcccauucaugcuccaucgccuucuagaauaugaaguccucgugugugggaggaaagcucuguucccuucccaacauacauuccuuuuccuuagcauggauguggcccuucauuaaaagagaucaguucaguccccugcucccugccugugcuuuuucuagcaugugauccgagggaaccgccccaucaaaacugagauggcccaucagcuauauguccuucaaguccuaaccuuuaaccuucuggaagaaaggaugaugaccaagauggaccccaaugaccagguaggugcuaaguggggcagcuguuuucucauggcuguggugcaguccagccuuagucuaugugccaggcacugugcuuggucuuugucugcagaaguaguuugcaucugcccuagaaaaucuagcaugaucugcaccaugagccaagcccauuucuguccugcugugguagaggugaugccuccuaagggauugauuggggccaaaguuuggcccagaaaagccugacccacuguuucuuuuccuugcucccuugguuagccgauucaccugcugacugucuguuucaccucgcaggcucaaagggacaucauauuugaacugaggaggauugcauuugacgcagagucugauccuagcaaugccccugggagugggaccgaaaaacgcaaagccauguacacaaaggacuacaaaaugcugggauuuaccguaaguaccucagagcauagacggugguaggcccucuccccugaugggaagucaauggucccacccagacagagcucugacaaccaaccccaugguggcccuggaauagaugacaguuaggaagcugguggagcuuuaaugcuugcuuugcuuuguugauggugagucugugaguuuaugugcaaaguuuggcccugugaaacgaauccaucuguagggggguugcggucagcuagaguggguagagaggggaccuguccucuuacccaaacugcuagguucuuugcaaagcuagugugaauauuuugugauagaguagggcuugaggaugggguuaacuggaagaaguauuucuugcguaccuacucagugugcagcagcaugugaaguagguucugggaugcauggugaggcagccaccguccagcacucaagagcucacaguucagugguggugaugggugugaaaagagcuaggacagaggugggugcugagugguagcagcaucaagaggagaggcgagagggcauccccucaggucccugcauacacggagacugccgcaucucaaauugggugucuuuauuucucuagaaccacaucaauccagccauggacuuuacccagacuccuccuggaaugcuggccuuggacaacaugcuguacuuggcuaaaguccaccaggacaccuacauccggguaaaggcaggggagcuggccuucucaguccuggugccacaucuccugccuuccuccuucaucucccuaauccucccuuucucuucccccgacagauugucuuggagaacaguagccgggaagacaaacaugaaugccccuuuggccgcagugccauugagcucaccaaaaugcucugugaaauccugcagguuggggaacuacguaagucucugcagcucccucuucuucagccauuccuugucaucaagagcucagugagacucaaaauuauaaacaguuacaugucaguggggucgggcguggugguucacaccuguaaucucagcacuuugggagacugaggcaggaggaucacuugagcccaggaguccaaaaccagucugggcaacauagugagaccccaucucuaaaaaaaaaaaaaaaaaaaaaaaaaaccaaaaauuagccaacugguagugcaugccucuggucccaacuacucaggaagcugaggcaggaggaucacugugucaggaggucaaggcuauggugagcauagucaugccacugcauuccagccugggcgacagagugagacucuaucuuaaaaaaaaaaaaaaaaaaaagaugucagugggacuagacaaccuuagguggguuuuuaauuuuguuuuuuguuuuaaaucacugcaucagcugauaauuccaucuuauccuuauuuaugggaaucaugguuguugcuuuguuugaacuggcaauuugaaucauauuccaaagcuaccccaugccuguggguaagggcuggcugagucuguaacaggguagagggaaggcaagaaaaugcacccuggagaagaaagcuaaggacgugagaaacgcccaucccacgcucccuguuaauugcgcgccuuaggcugcuuuuguuccucgggacuuuggugcaaaguuuccagacaugagcucccaggcccuuguggacagaggcuucaucuucucccuguuuuuucacuuccacagcaaaugaaggacgcaaugacuaccacccgauguucuuuacccaugaccgagccuuugaagagcucuuuggaaucugcauccagcuguugaacaagaccuggaaggagaugagggcaacagcagaggacuucaacaaggucagugucuccgggcugcucugaggcccacgggaggagaccaucacacgacagccuuugacagcuggcuggcaccuggagaaucccugagcuggaaaagcagcuuggucugcagaacugagucacaagacugaggcacuggggagccucagccccaucugguuguugcucccucugugaccuugagcuugucuuccacuuggugccguaggcccucauuuguccauugaaguuagcaccugucccucccguccuccagagaggucaggaggauaagcauuagaagacucacugugguuuauugagugcuuacugugcagguacugcuguaguuuugugaacugggaagguuaggagagaagaguggacuggcaugaugugcacacccuggguacuuaaucgauaguuaucccucggugcuuucaguccucacucuaugcagagcacuguugugccaggcccucaaaagcugaucaucuaggggucgaguguuuugaaguugaucaucucaucauaaaaaauuuggaaaguauaaagaauaaaaaguuaccuguauuuacaccauccagugacaaacauuuuuguuuuccucuagucuuuuuuauccccuacagguuuuuccuucauuagcaagaucauacugcgcaugcagugugguauccuguuguuuucuuuaauaguuguuuuaaggggaccaaugcauuuuuuuaaaacaccacagcgugccagaacugcgcuugccuuucuauucuuuuguuuguuuuuuugagacagaguuucacucuugucacccaggcuggagugcaguggcacugucucggcucacugcaaccuccaccuccgagguugaagugauccuucuacuucagccuccugaguagcugggacuacaggcgugagccaccacaccuggcuaauuuuuguauuuuuaguagagacgggguuucaccauguuggccaggcuggucucaaacuccugaccucaggugauccgccugccucagccucccaaagcaugagcuacugcaaccggcugguaucucauauucuuuauggcaacaccuaucaggagaugugucuuccuuucucucgguuuagagaugaguagaugcacaccuaaggauguuaagugacuugcugaagggacagagucaagaugugaacccauuucuuucugacuacaaaaauccaugcucauuucccccacaccauugaccaauugaaauauaugggaaauaaagcaucuaucagugucagucaugugaccugaauaaccaucuaagaagguauaccuuacucacccagcagaugucuguagugccugcccugcucaagacccuggggcaggaaagagccuuggugcuccauaauaggccuguccauuucucaagaguaguggugugaguuggcuggguucuucuccucuuagguuaugcaagucguccgagagcaaaucacucgagcuuugcccuccaaacccaacucuuuggaucaguucaagagcaaauugcguagccugaguuacucugagauucuacgacugcgccagucugagaggaugagucaggaugacuuccaguccccgccaauuguguaaguuccaucucaggggaggcuggcgggggagguggcugccagcucugcuuuccuuccagagcuccacuguccccaugaccuuccgcucacuccaguguguguccaccccagggagcugagggagaagauccagcccgagauccuugagcugaucaagcagcagcgccugaaccggcucugugagggcagcagcuuccgaaagauugggaaccgccgaaggcaaggugagaggagacggggcaauccuuggugccgggaagagccugccuggauggccccuuuugugcccaggccuuucccaguacugucguugcucaccuguuuggcuucccuuguguuccagaacgguucugguacugccgguuggcacugaaccacaagguccuucacuauggugacuuggaugacaacccacaaggggaggugacauuugaaucccugcaggagaaaaguagguucauuucucuguugaugugucaugguugcuggacuugucaggagacaggaguucuaguccagcuguuuguagcugaucaucugggcuuguaccuguuaccucucuggaccuguuuccuuaucugucagcgauuuccucuaccuggccuacucgguggggugguuuggagaaacaaugaguucacaggugugaauguauuguguagacuguaaagggugguacaugacuaagucgaaaggcaguaguuaagaggagaagcugugaagccagacugcccacauucaaauccuggcuuugcuccuaauuaacuugaauucuaauuaauugcaaguucuccccucugccuugguuucuucuccuguaaagugggaauaauagccacacuuuccuccuaagaggauugcaugaguaauguaugcaaagcacuuagaagagugguuggcagguagucagcauaacuguuagcagcugccacugcuguuggcgaugauggcaucaucaucgccauuauugugaaggagaggggaagggagucaccaaggucccguuccuuggggauauaaauccaagagcccugaagugacccucaguuagcuuugacacagccucacugggcuguggucuacaggagugaccaagacggagggaacaguacaaggccauccuccccaccacccucacugagcucauacagcagcccuuggaguuuggggcugaggcuuccuaugcaucugccccaguaccucccuuccagcacugauguaggcacugaccagcuugcagcaugaacuuccagagacuaauucccaucauuuaucaguuccuguugcagacauuaaggccauugucacugggaaagauuguccccacaugaaagagaaaagugcucugaaacagaacaaggugaguagagaggccaguuugaguagcuggcccagugauacuuggagagugccauugguggugguuuuuuccaggugcauucuuggcaucuuccccucucuauuccugaauguuuuauuaagaauuuugaacauacacaaaaauagauggaaccucuguauacacaucacccagacucagcaaccauggccaguucugcccauccacuuguuucucuccuuuaucgcuuugaagaaagucccaaguaucacacuguuucaucuguaaauauuuaguguacaucguauaguguauaacauugccaccaguccauuagcacacauaacaggaaaugaaaguaguuauuucagaucaaauauuccacugauggugacuuucuaccaauugucuuauaaaugucauaauuucucuacagauauauaaauguuuauauggauacacacacacacacacacacacacacacacacacacacacacacccccauacccaucuugucuaaaccagagucuaagacuggucuuuuaaguuucuuaauucauaaguucccccgcccccccaucccccaccaucuuuuccuuugcaguuuauuagcugaagaaccagauugcuuguuugguaguuuccuagcaucugaauuuugcugauuguuuccccgugguacaguuuaacuuguuccucugucccagaucuguacauuggaagagggaucuagagguuugauccaguucagguuuaacuuuuuuccuggccagugucaucagugguauuauguucuaucaagaggcacauaacgucugguggucucuccuuuugugauaauuagcagacuguugaagcucagugccucauuccaucagucaacuaagguuugcaaacucaugauauuuugaugcagucauugcuuuucauuuaugagcugaaccaugaaacuugcccuuaucuacuauugguuucccagugguacaguuuauauaggaaacgagaauaaaugcugauucuucuuuuauguacuuacuuucaaaauaaugaguuaguuccuugguaucaugcaacagugaccaauuuuguguguguguguguuuuguuuuguuuuuuaauuguuaagacauuccuaugccaaauacagcacgauagaaguuguuagucaucuugguaauauaaaaacuuuuaggauaacuuacagucauggaucgugaccuuccaggguucugaguguugaaaaugacuuuuuuccaaucuuaaaaauaucacaacaucuuugaugugacuugggcagggaguggguaaguuaagguugauuuaugcugggccucaucuccagccacacuuguggccgccuaggagcauugaugacauucaucugaaucagcauguuuggugaugaugccgagucacuaggacuuuggccaagaucuugaugugcagaccccaggcuguuccaucgcucuaauuuaaacccuuucuccuucaggagguguuggaauuggccuucuccauccuguaugacccugaugagaccuuaaacuucaucgcaccuaauaaauaugaggugagcaguguggcgcugccuuagacaacagagcuauuucuguaacucuucaguugguggcaggaaugagcaaaacaggaaaguccccugugguggguggcugcaguguauauugaagccuaggaaggcuuugagaagaagguggcauuucaauaggaugggaaugucucaaaggaggagcugugguugggggggcacccagaugaagcagcagguaucauuacauaaugcuggaccugagguuccuccaggcgcauuggguggcugccaaggaucugucacacucuggauuguuuaucugugagcugggcucuccacauuacucuucagcagcagccauagguugucauuacaaagauaaggucaacuaggaaugagucauuuaccugggacugggaaaauucuccccuuuucaguuucucuguggucagcuacccaagagaacuugacagauccuuccuccuaggggcuccuggucacauguuguaauggauccaguguggacuuugaagccagauggaacugguccuucugacaagggcccuguaguuccaucugcagcacuggaagauacuagauauuaaaugagugauugcauuugagacccuaugugccuggugagcucugagagccaucacugggaacuagaggugggacuucuggcagaggagacacuugggcagggccugagcugccgcuaguggaauuugguugagaggaaaugaagaacaagcaaguggggaaccaggugagcaacgguguggaaaaaggaaaauggcagcagaggaagcaggaagagucagggagcggugggaucagaaggcuuccuggucacccccucuuagcaugagacccaccaguuccauuucuuuaguauuuacucuuuaauauguauugacuggauuauuuuuaauuuuguuuucgggggggcggggcacaaaauugagaucccacagugacuucuguuugugucuugcuucuuuucaccuaauacauauuucccuucucucgcuucugauuuuggguaacuucagguagaugaugccccaguacucagaucucauuuugcuguauucguuuauugcauuuuuagguucuccuucauauuauuguaaggaguuguaauauaaaaccccuuauaaaaaccagaucucuugagaaagugaaggaucaccuccuaauuuaucuuugcuaucauuccaaaucaguuuugccuauacugauuaguuccaaaaggaacuguugugagccccaucagaaaagagaccuuggcaggaucuccugcugaccaggggucacgaugugacauuuugcaacuugcuccccacaguacugcaucuggauugauggccucagugcccuucuggggaaggacauguccagugagcugaccaagagugaccuggacacccugcugagcauggagaugaagcugcggcuccuggaccuggagaacauccagauucccgaagccccaccccccauccccaaggagcccagcagcuaugacuuugucuaucacuauggcugagccuggagccagaaacgacgguacccaggagaagggauuuugggcccaggagaaacacuuacauucuggugccuugucuuuugcuuguacagaaucuguagugauuuugguggccaguaaaugccagccauuucucaaacccaccucggaccacccagaguuuccucuuggucccugucuacuaagagucaugaaggcagggugcucugcccacuccaucaccaugaagccugggauugggccacgaggaacaaacagcagaugcccuugccuuccaguccaagaaacugcuucuugaaauggauuuaacaacagccacucaccuuuuccuccugagccugcucucugaucagcuggauccccacgugagcaacagcuggcccaggaaaggcugccugcagaggacagguguguugggcguguugagagccuugaagugacuaccuguaucuuagaucugaguacaagccugaggcuuuugcuuuugucuuuuuugaugagggcucacuccagcuucauauggugccaagacguugcugcuucugagguuggcucuaacaucucuggucuuuagagccaccagaucucucuggcccauacagauaucagagcagacggaaauuucucccugcaagcgcucagucucaucccagcaagucaaagaccuccuggccaaguccugcccucuuaagucuccaggaacgcugcagggaaaacccagcugaggccugggccuagacuguggugaggucacuagauucuacugcucuucccccacauuaauaccuuuuccuuccucagagagaaaucuccccuaaccugaauugcagcccccuccaguuugcuuuccuuuggccuuccagaccccaggaaguuggccuucccuuccuagugcuaugguuucugccauuggccaugauuucagggagcuggcugaggccggcugaggccacaccugugccaguggggcuucccuggugcugcagcacuuguaaaccacacacacagccucucucccuggacauacguuagcacauuggcauucaguauugguggccuggcaugguagguacuacccaaugaagaguguacuauauauuuucauuacuauaggccauacuuauacagacguguauauauauuuauauaagaucuaccuaucuuaggauggaaccuuggggaaaaauaaaauugaggggaaguaaaaaguauguaacacuuccaguugugagccaagauuguaaccagagagcagccaggagcuuccugucaguaaccauguuuucaauaaauacucuuucauguacaaacugugguuccuguuaacagcuguuugucuguacuugcccccugcccaauggugaagauuucaccuugacaagacuugaucuccauguaucugggagacucuggagagcuccagcuggagcccuuagucaccuuccaagagucccuuccuccucaucauucgcuccucccacacauacacacacacagacacacaccugcugguuaagaguguucacagauugcugcacugggacgaagcguuuucugcucaacccugcuggguacagcaagguaaggcauacuguacacccccaugaacacauccucccucuucucccugccagggacacagccagggaacagcucgaguacuugugccuuacaaagaagacacgcucuuuacccuguguguugccugugcauagugcccagccuuccagcugguguuuuaggcuguugcuccaaaccuuggccuugguagcugggagacuuaaaugaggguggugaugaaaauagaucucuugccucugagagagaagggugugaggacaggcucuuucaaaaggcauagaaagugcaugcaauacaagccugaggacugaauaaagccaagaccuugggcagugauggguaccauuguaggugcuugguaagcacugaaugaacuaaugccugcaugaugccagcuggcggcggugacagccgcaguuugcauaaaacacugcuuacacucuggccuugagccuucuguucagaggggccagggaucccagcugagucacuuguaaggauccauguuugcagcuggucuuacugccagagagcccaggaggaggcuagaggagggcgaaaggcacaaaacugggucugaaugugcaacccuagcuugcccuggccuaauguucuugacugcaaaugcugcccuuuuaauccaucccgcaagaugaagaaaaucugaacucccuaggcuggcauuuuggggccacugcaaccugccucuuggcuacuuuaaccaccacaguuacaaacaaccugugagccccaggcacggcuggagcuuucucacccuccuuuaggauucucccauuuccucuaucugggaugcucucucccuacucaaccuauugaaguugagauaauucuuagaaaguuucauacagaaaauauuucacaaauguuucguauuacuucuggaucgcccaaguuuuaaguuguaaugg

SEQ ID NO: 13526 - RNA, 3279 nt, Homo sapiens
agaaauauauuugacaucaaaacucagcacauauccuuggucuauauauacacgugaaaguuucauaaaacaauacacugauauuuuccaugcuguauucuauuucauuuuuuaaaaugcugguuguaucccauuaaacugguuucaaaauaaauauaacauguacacaacaacaacaaaaaaaaacacuggguuagagggccaguaagcucagcgaguaucagcaacugagacuucauccuugucucacaaggacuaaaaagagaauaauguucucauuaugugguucaaugccacacccauguaucugagauauacaugucacaaucugggagaagccuguccucaauuuacuuuaaauacccaauucugccuagaacaugacuuagacacauaguaagcucuugagugaagugcagaugauaaugacacgaucacauaccacuuaaaaauaucuuaacaccuuuacuuagaucucaucucauacuuguagcauuucuucaaauuuacuuugaaaaaagagcuucacugugugugguugucauacacauucuucuacccaaccauggaccucuuucuuccucucaggcgcacuucaucuaauuuuuuuagcacuggccuggccuuuuuggaggagguggaguagcucuucagaaaggcuucaaacacaguuucaguguugggauggguacugaggaaggccuucuccaggacauagaggucuacucccuuauccucuggaagugcugaaaugaaacucagcccaaagucuaugagcacaauguucagcuguuccaggggggguuucaggagcauguuggagguggugagaucaccaugaaugaggucuucaucgugcauucgagccaaaaccugcccaauugucuuggcuaaguuggagagacccuggggaguuuuuucagucuccauaguggacugaauauaaucucgaacagucacugagccuucaauuucuuccauauauaagcaguuggaagcauaguccacaaaaaagacaacuggggcagauauuccugaaaucaagacauaagugguuauuggguuggauuuuuuuuaacggguaaacuuaauuuucaaagauuaagccaguuuuuccaucuauaucuacuuauuucaggacuauugaggaaugcuacaggaaaugguacaacugaacucaucuggaauauuccccugcucaugcccacugcaggacuaugccugggaacaccccacagcuaaacugaggaggccauagcuuccuccucccuuccaaaccacccuuucucacuggacuucauuugucacacucacucucuaaaaaacaaacaaaacaaaggccgggugugguggcucaugccuguaaucccagcacuuugggaggcggaggcaggcggaucacuugaggucagaaguucgagacccccaucucuacuaaaaauacaaaaauuagccaggugugguggcucacgccuguagucccagcuacucgggaggcugaggcaggagaauagcuugaacucagggagcguaaguugcagugagcugagauugugccacugcaccacuccagccugggugacaaagugagacacugucucaaaaaacaaaaacaaagagcaaggcacagcccagucagagcaguuucuacugaugaggacacaaacaggaggccaagcagugugcuagcuucgagguucaucuucguagucagagaggacaggguucaaaucccagcugcuuuucuuauuaguugucuaaucuaaucuuaaaauuacauuaacuucucuaagccucaguuucugcuacuauacaaggaacaauagcuccaauaaacucaaugaaucuuuacugaaagucaaccaggcucaguauacuuuucuagaaacugagagauguuaucaauggggauacagcaauaaacaagccagcuauaauacaaucucugcuuaacgaaacagaucaugaggcugaaaacagaaauaugaauacacaaauaacuucaugaaaucuuaagucucugaaagggcagcaauguguccgcuuguuggcuacugaauaucccccacccagaucucccagcacuuaacaauguccugguacccacugguaccuaaaaaauacugauaaaagaaaggcaagaagcguaaaaguaaaaagccagggcuucugagucagaggcauaaggagcugagggccuggaccggccacuuaguaaccguguaaccuugggcaaguuacuucucucugagugucacuuucucaucugaggacaaaguuuauggugcuggcgcacaaugauguuuaaugaaaaaauaggcaauuuaaugaaauccaacauuuauugggcacuaugugccaggcacacauuugaacauaauacgugacacacauaccuccucuaauggucacaacaucccuaugacauggauacugcuacuaugucucccauuuuacaggugagaaaaccgaggcugagaggcuaaauaacuuguugaaaggcuacacaagcagcagaguuaguauuucaacccagggagccuggcuccaguggggcaaguacuugucauuacauguuucuuaaaacuaauaaauggaaagauaaugaucgaaaauugaaacgagucaaauggggaaaccaaggcucagggaaguuaaacauguucaacauugagcaauaaugacagaucccagauuugaaccaggcagaacggccucaggacaaaagcuugacgcugcauggccacgugguuucuuaagacuuaacgaaugaaaaaagggaugaaagaauaacauuuccgaaaggccggacaccgcagaaggcacagaaggagaaacugagggaaauccagcuucggagcgcaggggagucccucacccgcccaggccccagagccucggggccgcccacgccgggaucccggcccaccuuaccagcgcggcgacagcggaggagcgcccgggccuccugcaccguccgccgucugccaagccgcgccuccagcgccgggugccgguagcccuuggggaagcggugcuugaucaccgccgcgcggcccuggaagcggccacggaacacgcgcgccucggcacccugcuucaccagcuccaggccgcucaagaagcggcugcuccgcucccgggcugcggccagagccucagccuccggggcgggcuccucgccaucggccggcguaguagcucuggccgccgccaugacugcucggcgcaacagcuccaaccgaucagcugucucugaaaacugucgcgaugcuucgg

SEQ ID NO: 13527 - RNA, 2160 nt, Homo sapiens
gacagggagaguuugugaagucacagguuccuaaggaaaagccuucucuuguagauccugagccuucaacaugaggcucugugaugaggcccccuugcccucaaauuagguggguagaagguuaggaaucgugcagccccguggcacaaacugcagacggacaggugucugugcaaacacaaaaauguucccagggagcagccugggggaaggcaaggaggaagcccggucccccuucucuucucagucuauuagaaaccagcuuugcauccauaccaaaaaggcgcuagguaaaaugaaagugcuucaaggacagcaggcaucugaaaagccaagcuaaagggcugcaccucagucuacggcaaagguaaaauaaaaaggcuguuuauaagccugcaaacagccaccaaauacccagcccucugaagcagccaguccuaagacaguuaacaucaaggaaagacaauccgagucugcagaggagaaacacaaggaaaacauucccuuauccaaugcacaggauacucacaaauuagauuucugaccacccccaacagagccugagaauuaacaauggguuuugcaaaacccgcuuucagaggccgaacuaacagccugaguggauaacgucauuuacuguuacaggucugagcauuggccucagaacuccucuggugcugggagugaggaguuucaaggugacugcuuuuuagcuccaggggagaaaggagggcacagugcccaaggccaugccagggcaaggacgggccacuggcccccgccggccgguagguaagguaaucgggaugggggggacaggcuggcagcacacuggcugcagagcuggcauggccacugccuguuuguuugucugcaaggagagugggaaguagcggggagggugaccauaaccuuagcaaccugaagccaagggugaacccuugcucagaucuugcauuuuaagaguaaccaaaggguucugaaacauauucccuuuuuaaaucucugcugugcaguagcgaaggccccuuugaauguaucuuucuuuccagagucaaccagaggcaaagccagauugaggguucccaggcugacaaaugucugcugccucugccacaggagagagaaggggaaagagggcaaaagaaacaaagacaucacgcguugcaaguggcuggacuuuuaaaaaccuaccuuugccuccaggguuuucuagguuacugucaccccacuuccuaaaaagugucuccccccucauccuauuuaagaccugaugcagucuccccacugguucucccagggaaagaaaaggggaaauguuuuguugaaaauaaaagggaugacaagaaagaaaggaaaaaaagcuauuguuuucaucccuaauuuauaauccaagaggcccccaauuguuucuuucugacucaaaucuuugagcuguuaauuauaaaaguaacuggacuuggcgccaacgggcuaacuaugaucaggcucagcaauuagaaaaacucuguagaaaguuuacugagugauuauauauaauuaauuccuaguuacagacugaacacugaccauuuucuggagcuaauaaaagcaguuacucccccucccccacgugaaugccacuuaauuucccaaagcagaaagugaauccauccuggagggucuugaaggaaaaaaaaggagaggaaucaaaagcuucagugugucuguguuugcuccuugcagcuguguauccucuuuggggacugaggaggcagaaggaaaaaggaaaacagcccaacauucuguuccuccuucugcaauuuacaaacguggcagagagaacauucuaccuugaugagaaaaagaagggggguuggggggaagcagggaagggagaugaccuaggaauggaagguaggagacgcuucugcuuggcagaucugcuuuuccuaaaaggaacaaagaugguagaaauuuccagaaggcccguucuuaguucggccacugcaauugucaaucuuuaaccuuuccuccaagucuauugguuuaaaagcuagaguagaagaaccccauugggcugcucugggagccaguacugccgucccuaccuaguccugcugcaaugcagacauuuauuuuuuucccccuuuccugaaacuggaaaauaaugcuacuuug

SEQ ID NO: 13528 - RNA, 2160 nt, Homo sapiens
caaaguagcauuauuuuccaguuucaggaaagggggaaaaaaauaaaugucugcauugcagcaggacuagguagggacggcaguacuggcucccagagcagcccaaugggguucuucuacucuagcuuuuaaaccaauagacuuggaggaaagguuaaagauugacaauugcaguggccgaacuaagaacgggccuucuggaaauuucuaccaucuuuguuccuuuuaggaaaagcagaucugccaagcagaagcgucuccuaccuuccauuccuaggucaucucccuucccugcuuccccccaaccccccuucuuuuucucaucaagguagaauguucucucugccacguuuguaaauugcagaaggaggaacagaauguugggcuguuuuccuuuuuccuucugccuccucaguccccaaagaggauacacagcugcaaggagcaaacacagacacacugaagcuuuugauuccucuccuuuuuuuuccuucaagacccuccaggauggauucacuuucugcuuugggaaauuaaguggcauucacgugggggagggggaguaacugcuuuuauuagcuccagaaaauggucaguguucagucuguaacuaggaauuaauuauauauaaucacucaguaaacuuucuacagaguuuuucuaauugcugagccugaucauaguuagcccguuggcgccaaguccaguuacuuuuauaauuaacagcucaaagauuugagucagaaagaaacaauugggggccucuuggauuauaaauuagggaugaaaacaauagcuuuuuuuccuuucuuucuugucaucccuuuuauuuucaacaaaacauuuccccuuuucuuucccugggagaaccaguggggagacugcaucaggucuuaaauaggaugaggggggagacacuuuuuaggaaguggggugacaguaaccuagaaaacccuggaggcaaagguagguuuuuaaaaguccagccacuugcaacgcgugaugucuuuguuucuuuugcccucuuuccccuucucucuccuguggcagaggcagcagacauuugucagccugggaacccucaaucuggcuuugccucugguugacucuggaaagaaagauacauucaaaggggccuucgcuacugcacagcagagauuuaaaaagggaauauguuucagaacccuuugguuacucuuaaaaugcaagaucugagcaaggguucacccuuggcuucagguugcuaagguuauggucacccuccccgcuacuucccacucuccuugcagacaaacaaacaggcaguggccaugccagcucugcagccagugugcugccagccugucccccccaucccgauuaccuuaccuaccggccggcgggggccaguggcccguccuugcccuggcauggccuugggcacugugcccuccuuucuccccuggagcuaaaaagcagucaccuugaaacuccucacucccagcaccagaggaguucugaggccaaugcucagaccuguaacaguaaaugacguuauccacucaggcuguuaguucggccucugaaagcggguuuugcaaaacccauuguuaauucucaggcucuguuggggguggucagaaaucuaauuugugaguauccugugcauuggauaagggaauguuuuccuuguguuucuccucugcagacucggauugucuuuccuugauguuaacugucuuaggacuggcugcuucagagggcuggguauuugguggcuguuugcaggcuuauaaacagccuuuuuauuuuaccuuugccguagacugaggugcagcccuuuagcuuggcuuuucagaugccugcuguccuugaagcacuuucauuuuaccuagcgccuuuuugguauggaugcaaagcugguuucuaauagacugagaagagaagggggaccgggcuuccuccuugccuucccccaggcugcucccugggaacauuuuuguguuugcacagacaccuguccgucugcaguuugugccacggggcugcacgauuccuaaccuucuacccaccuaauuugagggcaagggggccucaucacagagccucauguugaaggcucaggaucuacaagagaaggcuuuuccuuaggaaccugugacuucacaaacucucccuguc

SEQ ID NO: 13529 - RNA, 1305 nt, Homo sapiens
cuacagcauccuccccgccucccucccucucucugaucacuugaucacuugaaauguuuucuggggcaaagagcaggaagcugcuggcuuauucuggcagcucugcucuguuugaggaaugcuguuggcauucggguaggucugagguuaucuggaaaacagcaauucggcuggggacagacacaaaaguaugguggcagauggaauccugggaggaacacagauugaaaagaaagccuggggcaggccuacgaagggcugguccugggcuucauggaauguggcugauaagcaggaaauaaaaccaaauguugcaggucucaaucuagaaauccauucagcagcuccucuuaaagccccacugcagugaguaucccagcaguuacuucuaaauuagugcuuuacauagacugauuccugaaguagguggcauuguuagaaaccuggaacuaagcccagagaggugaagugagcugcccaaggucacacagcugggaagugccagagaucagauguccaccccguuagcacuucacaucccuaaacucuguaccuucuccuggcucuaaagaaagaagcaaaagcaaagccgaaccaagcacagcagaaacaaugaggcugaaaccuacgaacagcaacugcauaaucuguguuuucuuuuaggagguagaccaguuuuuugcuuuuuuguuuuuugauacagugucucgcucugucgcccaggcuugagugcaguggcaucaucacaacucaaugcugcaaccugaagacccacccuuuugagguggguuuucaguauugaaugauggcgcugaaggaaacuuuuagauuagacucauucaaaugccccucauuacagauugaggcccagaggaagcgacccucucccucccaaccuccagcaagaugcaagaugucaagggggaacacuuugccaucucuaaaauuaggcuuuuauauucccugaaaccagugguucaaccauggggggauuugcccuucagggggcauuuggcaaugcuuggagacguguggguugucacaguuagggagguuguauuaccgguauccaguggguagaggccaaggaugaugcaaaacauccuauaaguacacaagaccagccccgccacaacaaggaaguaucugauccaaaauguccaagguugggaaacccuggcuuuaagcccuuuaaggaaagggaagaaaacaguccaaucauucugccucuggcuagaaaagccagcacaggccuaaacaagcagguucuuuggugauauuaauaagcaaugagcuaauaaaaau

SEQ ID NO: 13530 - RNA, 804 nt, Homo sapiens
aagacaggcaaauacaaggugaagucagugacaaauaaacaaugcuauuuaggcauugagaguuuguuuuuguguuuguguuuuuuugcuaauuaauuccaccugguagaggagggcgaggggaaagaggaagggagaaguuuccuggcagggcugagaggcagaauggugccugcaccuccuggagugcacggcaauggucuggcucugcugccuucuauggguaagggcccaccgguuuuuuuucugggacuuaagucaccugggcuuauacugagcagcccucagcaagcucuucucacuugccccugccacccagagcuccaggaugcccuaguuccugccccucaaagaccugggacuccugcuccugggaccuucuggucgguucugcuuuuccuugcuucaggaccuuacguggauucugucaccugccaccucagaacucugagcgacacacccacugcaugucacccaggacagguucacccaagucuuucaucccaagaagguccuuccuggcaccuugugggcugacagcaucuccagggaaccacaggacuucgagggggccugggaagcaucaagagcuucaggaggggagucugucacagguggggauuacggagcccugcagggacccuuagaacaggugggucgggguggggcugaggucucgacgccuugauucagguuccuggcuuaugucgaccugucugaaaucucccacccacagccaagccacuggccaccccacugcugcccugugucacccuguuuugauggagagcucaccaggcucuc

SEQ ID NO: 13531 - RNA, 4264 nt, Homo sapiens
acaccggugcccuuccugacagaugaccuucuggcauggcuucaugcauuggaacuccuugugugaagagucauaaggguggcaggcacgggugcagacaugcccacagcccaggcggaacucgcagggcaggcugcagccuccuucggguacuuuuuggaagucagaagcuuuggauacuaagguguggguuucagggugguucuggcagcagagccggagcauggggccuauuugauuguucucucgaaguguaugaaugaucuugcuccacaggggcaccuuggccagcaucugcauguuuccgaugcaguacauucccuucuuggcucgggacaaggccacacagaugcgguuggauaucugcagaaaacccaccuugccuucuugguugcuccgcacuagcgagaggaggaugaugucauucucuuccccuugguauuuguccacaacauggacccugacgccagcaaaugucuuggcaggcaucaguuugcgcaggcagaagagcugcccgguauagguagugaggauggugaucugggaaggcagguauuccuggcacaggaaguacuugcacagcucuaccacaaagugagccucaugcugguucugauggcuuuugcccucuuggauuuccuguucaggaaaguuguguucuacaaagaaaagguuggaagacacccccugacagggaaaagaagugacauguuaaaagguucacucauggcacuuguuuuuuucuuccucucuugacaugcacuggccacuuacucugcuccagagagagaccuuggaaagcuuuuuguccacucaacaucacuaucuuuaguucuuuaguuagucauugugugcuucauuuuggggccacagcaaguuaugaaaauaaaagauuaugucucuuucaguuuucaagauacuuguuugauguuaauauuuaaaaaagcuggcuggguacaguggcucacgucuguaaucccagcacuuugagaggccgagguggguggaucaccugaggucaggaguuugagaccagccuggcccacauggugaaaccccgucucuacuaaaaauacaaaaauuagcugggcgugguagugggcgccuauaaucccagcuauucaggaggcugagaugggagaauaguuugaacccaggaugcagagauugcagugagccgagaucaugccacugcacuccagccugggugacagacagagugagacuccaucucaaaaaaaauagaaaauaaaacagccauccacaauccaaccauuauagcugaaagaacaagcagugcugugaggaggaugaugauaaugacagagcagcuaacuuacugagcacuccacugugcugacugcuuuauauacauuaccuccuuccauacaguaaugggauauggcaggagccauuauucuuauuguccagaagaaccugauacucagaauuuauuuauuuauuuuaaaaaaagagacagucuugcuaugugccccagccugguuuugaacucuuggccucagcugacaauuuuuuuuuuuugagacagaguucacucuuguugcguaggcugaaguacaguggcacggucuuguuggcucaccacaaccuccacuucccagguucaagcgauccucucgccucagccucccaaguagcugggauuacaggcgcccaccaccaugcccaguuaauuuuuguauuuuuaguagagacgggguuucaccauguuggccaggcuagucuccaacuccugaccucaggugauccacccaucuuggccuccgaaagugcugagauuauaggcaugagccaccacacccagccaggcacaugccaccgcacccagcuaauuuuuguauuuuuaguagagaugggauuucaccauguuggccaggauggucuugaucccuugaccuugugauucgcccgccucggccucacaaagcucugggauuacaggcguaagccaccgcgccuggccagaauucuuauauaacuugcuuaagguuacauggcuaacaggcagaauugggauuaaaaaacccuggucuguauuucaauuuucucccaguaaccagcuuuuaaaaagcuggcucuacucccuucugaaggcuuucuuuuuuuuuuugacagggagucucucuccgcugcccagccuggagugcaguagcauggcacgaucucagcucacugcaaccuccaccuccuggguucaagcaauucucccaccucagccuucugaguagcugggauuacaggugcuugccaccaugcucagcuaguuuuuguauuuuaguagagacaggguuucaccauguuaguuaggcuggucucgaacucugaccucaagugaucugcccaccucagcuucccaaagugcugggauuacaggugugagccaccgcgccuggccgcugaaaagcuuuuuuaucuugaggaaauuauagccuuuuuagguugcugacaccauccaagaaagaucggguaagacagacucaccuuaaucuucucauacuuaagaacagauggaugauucuccagauccugguaaauguggggggucaaaaggcgggcaauuucagggcacauacggugcugaaaaaacacaugcaugucauuagaaacaugggcagagcacacacggacaauuucuuuaaagauaagguugcuguuagaaaauuuagggagggccaguugugauggcuuguaucuguaaucccaucacuuugggaagccaaggcaggaggaucacuucaggucaggauuucaagaccagccuggcaacauagugagcccucaucucuauuuuucuuucuuuuuuuuuuuuuuuugagacgugucaccaaggcuggggugcaguggcgcaaucucagcucauugcaaccucugccucccagguucuagugauucuccugccucagccuuccaaaaguagcugggacuacaggcaugaggcaccacgccuggcuaauuuuuuguauuuuuagcagagacaguguuucgccauguuggcgaggcuggucacgagcuccugaacucaagggauccgcccgccuuggccucccaaagugcuaggauuaaggugugagccaccacaccuggccucuauuuuucuuuucuuuuuuuuuuuucugagacagaaucuagcucuauugccaggcuggaguacaguggcaugaucucggcucacugcaaccaccgccucccagguucaagcaauucuccugccucagccuccugaguagcugggauuacaggugcccaccaccaugcccggcuaauuuuugcauuuuuaguagagacaggcuuucaccauguuggccaggcuggucucgaacuccugaccucaggugaucugcccaccuuggccucccaaagugcugggauugcaggugugagccaccgcaccuggccucuauuuuucuuaaaaaaaaaaaggaaagaaaaucuagagagauagagauuaucauuugaaaaaaauaaggagaaagcauaacauaaacagcuccuuuguccaacaaaaacucaacacggugaucuugugguguuuuaaaacagaaaauguaagguugacagagucauuucaguauuaaauuauuuuuauuuauaugagaccucuuuugcuggcaacuggcagcuucccaggagcuuucuccugggcauuugguaacaacagaggcccagcuucucaccugguaauucagacggacaaagggaauguuuacuuucacuagccguucaaaaagggacaccucaagguugaaguucuuggccagaucauacacguuggcacuggggcgcagcugagaagagaaacauggcugaggauucucuacugauaaagucauuuaaccauccauacuuccauccauccaaccaaccaucaaauguuuuucaaguguugacuaugugccaggcacuauucuacauacucacaguuuaaggauuaauaaugacaaggguuaaggauuaguagaacuaaaggugauaugacagagugccccaugguggguuuuuucuagcuaggccucugaacagugacaucugaguagacacuagcauggcagaaguugccaguucuucagucauuugaaaagcaagauccauaauggggagcggaaaggacacagugggacaccaagagcaaaugggaugaagucagagaaauaagcugaaaccugaucacauaagccuuugugggccacuuuaagaagcuugauuuuuaugcaagugcaaugggacaccacuggaggguuuucag

SEQ ID NO: 13532 - RNA, 4264 nt, Homo sapiens
cugaaaacccuccaguggugucccauugcacuugcauaaaaaucaagcuucuuaaaguggcccacaaaggcuuaugugaucagguuucagcuuauuucucugacuucaucccauuugcucuuggugucccacuguguccuuuccgcuccccauuauggaucuugcuuuucaaaugacugaagaacuggcaacuucugccaugcuagugucuacucagaugucacuguucagaggccuagcuagaaaaaacccaccauggggcacucugucauaucaccuuuaguucuacuaauccuuaacccuugucauuauuaauccuuaaacugugaguauguagaauagugccuggcacauagucaacacuugaaaaacauuugaugguugguuggauggauggaaguauggaugguuaaaugacuuuaucaguagagaauccucagccauguuucucuucucagcugcgccccagugccaacguguaugaucuggccaagaacuucaaccuugaggugucccuuuuugaacggcuagugaaaguaaacauucccuuuguccgucugaauuaccaggugagaagcugggccucuguuguuaccaaaugcccaggagaaagcuccugggaagcugccaguugccagcaaaagaggucucauauaaauaaaaauaauuuaauacugaaaugacucugucaaccuuacauuuucuguuuuaaaacaccacaagaucaccguguugaguuuuuguuggacaaaggagcuguuuauguuaugcuuucuccuuauuuuuuucaaaugauaaucucuaucucucuagauuuucuuuccuuuuuuuuuuuaagaaaaauagaggccaggugcgguggcucacaccugcaaucccagcacuuugggaggccaaggugggcagaucaccugaggucaggaguucgagaccagccuggccaacauggugaaagccugucucuacuaaaaaugcaaaaauuagccgggcaugguggugggcaccuguaaucccagcuacucaggaggcugaggcaggagaauugcuugaaccugggaggcggugguugcagugagccgagaucaugccacuguacuccagccuggcaauagagcuagauucugucucagaaaaaaaaaaaagaaaagaaaaauagaggccaggugugguggcucacaccuuaauccuagcacuuugggaggccaaggcgggcggaucccuugaguucaggagcucgugaccagccucgccaacauggcgaaacacugucucugcuaaaaauacaaaaaauuagccaggcguggugccucaugccuguagucccagcuacuuuuggaaggcugaggcaggagaaucacuagaaccugggaggcagagguugcaaugagcugagauugcgccacugcaccccagccuuggugacacgucucaaaaaaaaaaaaaaaagaaagaaaaauagagaugagggcucacuauguugccaggcuggucuugaaauccugaccugaagugauccuccugccuuggcuucccaaagugaugggauuacagauacaagccaucacaacuggcccucccuaaauuuucuaacagcaaccuuaucuuuaaagaaauuguccgugugugcucugcccauguuucuaaugacaugcauguguuuuuucagcaccguaugugcccugaaauugcccgccuuuugaccccccacauuuaccaggaucuggagaaucauccaucuguucuuaaguaugagaagauuaaggugagucugucuuacccgaucuuucuuggauggugucagcaaccuaaaaaggcuauaauuuccucaagauaaaaaagcuuuucagcggccaggcgcgguggcucacaccuguaaucccagcacuuugggaagcugaggugggcagaucacuugaggucagaguucgagaccagccuaacuaacauggugaaacccugucucuacuaaaauacaaaaacuagcugagcaugguggcaagcaccuguaaucccagcuacucagaaggcugaggugggagaauugcuugaacccaggagguggagguugcagugagcugagaucgugccaugcuacugcacuccaggcugggcagcggagagagacucccugucaaaaaaaaaaagaaagccuucagaagggaguagagccagcuuuuuaaaagcugguuacugggagaaaauugaaauacagaccaggguuuuuuaaucccaauucugccuguuagccauguaaccuuaagcaaguuauauaagaauucuggccaggcgcgguggcuuacgccuguaaucccagagcuuugugaggccgaggcgggcgaaucacaaggucaagggaucaagaccauccuggccaacauggugaaaucccaucucuacuaaaaauacaaaaauuagcugggugcgguggcaugugccuggcugggugugguggcucaugccuauaaucucagcacuuucggaggccaagauggguggaucaccugaggucaggaguuggagacuagccuggccaacauggugaaaccccgucucuacuaaaaauacaaaaauuaacugggcaugguggugggcgccuguaaucccagcuacuugggaggcugaggcgagaggaucgcuugaaccugggaaguggagguuguggugagccaacaagaccgugccacuguacuucagccuacgcaacaagagugaacucugucucaaaaaaaaaaaauugucagcugaggccaagaguucaaaaccaggcuggggcacauagcaagacugucucuuuuuuuaaaauaaauaaauaaauucugaguaucagguucuucuggacaauaagaauaauggcuccugccauaucccauuacuguauggaaggagguaauguauauaaagcagucagcacaguggagugcucaguaaguuagcugcucugucauuaucaucauccuccucacagcacugcuuguucuuucagcuauaaugguuggauuguggauggcuguuuuauuuucuauuuuuuuugagauggagucucacucugucugucacccaggcuggagugcaguggcaugaucucggcucacugcaaucucugcauccuggguucaaacuauucucccaucucagccuccugaauagcugggauuauaggcgcccacuaccacgcccagcuaauuuuuguauuuuuaguagagacgggguuucaccaugugggccaggcuggucucaaacuccugaccucaggugauccacccaccucggccucucaaagugcugggauuacagacgugagccacuguacccagccagcuuuuuuaaauauuaacaucaaacaaguaucuugaaaacugaaagagacauaaucuuuuauuuucauaacuugcuguggccccaaaaugaagcacacaaugacuaacuaaagaacuaaagauagugauguugaguggacaaaaagcuuuccaaggucucucucuggagcagaguaaguggccagugcaugucaagagaggaagaaaaaaacaagugccaugagugaaccuuuuaacaugucacuucuuuucccugucagggggugucuuccaaccuuuucuuuguagaacacaacuuuccugaacaggaaauccaagagggcaaaagccaucagaaccagcaugaggcucacuuugugguagagcugugcaaguacuuccugugccaggaauaccugccuucccagaucaccauccucacuaccuauaccgggcagcucuucugccugcgcaaacugaugccugccaagacauuugcuggcgucaggguccauguuguggacaaauaccaaggggaagagaaugacaucauccuccucucgcuagugcggagcaaccaagaaggcaagguggguuuucugcagauauccaaccgcaucuguguggccuugucccgagccaagaagggaauguacugcaucggaaacaugcagaugcuggccaaggugccccuguggagcaagaucauucauacacuucgagagaacaaucaaauaggccccaugcuccggcucugcugccagaaccacccugaaacccacaccuuaguauccaaagcuucugacuuccaaaaaguacccgaaggaggcugcagccugcccugcgaguuccgccugggcugugggcaugucugcacccgugccugccacccuuaugacucuucacacaaggaguuccaaugcaugaagccaugccagaaggucaucugucaggaagggcaccggugu

SEQ ID NO: 13533 - RNA, 6424 nt, Homo sapiens
aauuggugcaacucuccuuguaaccaaaggcccuuucugccuucuguggucauguaggaccuggcccuuccuuccuuguguauuuuguccaaccguaaaguagcauuuuauugagucacuuuugaaggacgaauucagaaguaucauuaagaaccuaccuuuucaggcuucauagccagaguccuauagaguucuuauagaaacagaauaauugaaauucagcauauacuaugcuuagaaaguauuuuguuuggguuugauuggguuuuuuuuucuuuuacuuguguguguauguacugggggaguauagcuuuuauucugugcucaauucgaaagagaguauuauaaguuuucccagcccauccacccgcuaaaaaagaacauauccaaauuuuaauauguauacacccaaccuguaccuauguacgugaauauacaugcacugggaaaucuacuuaagagucuucacugagaaguucacucgauagaaaggucuugauagagaagagaagaggaaagcaauggucugaaggcaaauccugcuuuaacuuggugguccauuucccauucauuccugaaccaaugagagcagaaagaaacaagucaacccaaacaagcaaacuaggggcuggacgcggcgaauggaugcuggucaguuuggcaaauucacugaaacucaucaagaacccagcugaacuugcauuccaacuuccacaauuaucugaaagggcuagggaccagguagccaugugucccaaucacacgggggagagucugccaccggcggugagagagguggggaagcuuuggaggagacaguauauucaccuuuuuaucuuuggguaaaagaaaccaacaggacuuuggugcaguagauuucucagugccuucuuuaggaauucuaucuuaagcacacuucaaggggaaagaaaaaaggaggagagaacauuuguucccgugaagucccuuucuccaaaggacuggggaucaagaaggaagaagaguaagaaggaaaaacaacaaaauccugaggaggccauuucuuuuaacccacccagcuugccccugaaaacugcuggugauacaaacuuuuucaaacugacuuccagcuucuccaugugucuugguaacuguagccucgucucugcccuuucuccuaauaagauccauguuucuaaggagaaaaacaaaacaguauucucuucuguaaaacuguaauguauuguugauauuuguaacuauuguauauuucugucuugcuccagucccagcuggagugucuaguuccauggacaaggggauauuuaaaauucaccacggacaagagccacuaaagccaggucucuaucgcuaaucucucuccuauucuuauuucucuaccaacuaaucucaaguaacaauaccccaggcuuuuuuucagccucaauucaaguaacuuugaaucaaaagagagcaaggcaaaaagccuccggacaugcuucuuugggaaaggacuuuuucuguagcugcagagugggcaggagggagaaggggcuccccugagaccccggcaggacaauggaaagcuuccagccccgagcugauguuuccucaccuaucacugcuuauaggacagcauccaaaugcuuucaugucacucagcccaggcaacccaaaccaguccuggcuacacccagaaauaagaguuaccucugcauuuucuguugccauuuuucuggcucuagaaguaucugaugcgcgacuaugucauagaauguccacgcaucucagaguagucuauuuuucuguucagauaaaauauauauauauauguauuuuuagcaaauuuauaauagggcaauugagucuaauuucuucuuuuguaauacagaacaauaucuuaggaguuucauuguuggucauuaucguagcugauguuuucuggucuuuugcaguuccuaccauugucccuugggcuguuuggguuuucuuccuuuugauucugauuucuugaggguggggaaagacuuugggguuugacuuccuuguguaggcauuucuugacacuaggccuggacucugucaaugcugugacuuuccucauucauuucuguguguuucucccauucguuguucuuaagaauccagggcaugaaugcaggaaugagacccagggaagcagagcuacagauggcccucaaaaucaggaugggaugugggcugguuucacuuauaucccacaccccuuuagggaucugaagggacugaguuuucucauccccagagaucuuggaaccaaaaaucucaugcaagcaaacucaucacuggcauuucugagauccagaacacaugugagucccuccuggcugggcugcucccacauguccagcacccugucggccuguaacaucaaucagagcugaaggucagagguuuuucagguucucgugaaccucacaagaacaugcugggccuccgaucucaccaacuuguuuaucaguuccuuguuucgaucuguuuauuuauuuauuuuuuuguuauuauuauuuugagacaaagucuugcucuguugcccaggcugcagugcaauggcgcaaucucggcucacugcaaccuccuccacccagguucaagugauucucaugucucagccuccugaguaacugggauuacaagagcgcaccaucacgcccagcuaauuuuuguauuuuuaguagaggcagaguuucuccauguuggccaggcuggucuugaacuccugaccucaggugaucugccugccucggccucccagugcuaggauuacaggugugagccaccacugcacccaguccauuucaauccauuucuaacagcuucaccaaaaaacaguggccagacacccuugcagccaaacccugagaagagauguccccgaaucugcuagcucaucuccccuucccuugccagcugccuggcuccauagagcaggagguguguggcaaggacaggggcaguuuuccagcuuccaccuauccacgccugggggaguuuuuggacuguccugauaauuaauuccagaggcaguuuucaguccugggugggcggaggacaucucacuaggcaggaucuucagcagaaagugauucuccauccgucaacucaugcaggaagaugaagaaagcccagauaaucuccaacuugcauucguuuagguuuugguauaccacccaccucacugucagcugcagggcuuggggcucugccuagaaucagaaauuugagccaaacugggacccucagauggcagugagccaucccaucagauaacucccaagaggaagccaacucaaauaugaauuuuauuauucuggacuaugacccugaucagaguucucccaccccgaaaaccucugauagucugguuugaaccagagucaaauaaaacagacaagauuuuuuuuuccucugcacaaaagcaaaaaaacaaaacaaaaaaaagucugccaguaguuuccuggguuugaugcccagauaagcaaacacuguugccuauggcuguugcuguuuucaucaagaaagagguuauauaguuugcauuuccauccacucucccugauuuuaucuuaaccuagaauuucuccugaacuaccccaaaugccaacuugaauuuggguagggcucuguuaaucgagggaacccucaucuucacuuauaaaccuaauucucuguuccucccuccaaagauccugaaaagaucuccuaaaggcuggccaggaugggguggaguggggcagugcaccugaagaaaaaaacuuagcugccagcuggcuguaugcaaguucuccgaaaauuucuauuguaugaaagggauggggucaauugcagcucaaauuaaggaagcccuccuaacaggcuggguugucugaccauggagcucaaugccaugguggacagugagcucccuuauaucacagguguuuaaagagaggcuggcuagaugguguaaaaaaugggcauugcagaggggcccuagcauugcauggaaacugggcugaacaaccacagaaauuccucuuuguuucuuggaguguguguguguguguguguguguguguguguguguguguguguaggugguuucaacacucuggauauaagcucaagccacugaggcaaaggcaugcagcacaauuagcaggaaugcaacuucugggcuuuggagcucucagaggggguguccaagagacaagucugcuuccuuccggcuccgucuuggaacauuuuaaugacugucagucaccaauccaacccauccccaguggccuaccaggcaccacauugggaugagacucaugcuacccuuccccaggccagccaaggagcaauccacgcugucccccaucccuggcuggcugucuuauggugcuucagccccuccgcccagcuccugugcccucaugagccuggggcuuucuguauaaaagaugcaaugauaucuguuccccacuagccauccccacaaugaacaacuucccaggcaauagcaaauggcuccauuccaaaagggcuuguuuuuuugguaaaucaaauaagagaccccacucaagaccuuugaaaguccccgucaaugaaaaaaauccagaagggucaaaagagaaaggcagcuuuuaauccaguuucacagcaaaaccaggcucuuggcugccuccaagcagaaugccacucuccugcagcuguggccuccaucccaaaucauccugcauacugcauucucuaaggaaagcauuugacaagagaggguuuauguaugguggauugggagaaagugagacuucaaccucagggugaaccgaagacugguuugucuuugguuguuuuaguaugagguugggcaggaugauauguuuggauggguagaaugagcagccgccuuccucugaaaccaaaauaaaauaaaaaccaguuuucaagauuccucccaacuccucacuggaggcucugcccugcagaaucacucaaguugcaacaacacaaggagacaaaaauaggauauuucaugaaaauauaagaaacucccaauuccgucccauuaggaugcccucaaggggccaugcagggaucuucccauacuuccugcuucccugaucugaaccaagauuggaaagaggcaggcagcagagaagaugcccaagaaacucugacauauccacagcuuggcucugccccuugggcuucacugggguuugggccucccucuugguugagcugagugugccugaguggguggggacagggaggauucuccaggucuaucuugauuucauagguccuucucaauccaaggucaaaaacugagaaucuuauuuucugcaccaggaacucaggguuauccccaaccuaugccgcuggcacaugauggucauccaaccuguguuuuugugagugagugaaugugugacugguuggccucugaguggaugacuggaugcgugaaugugugagugaaugggggaguuaaugaaucccuaccuaacugugaagagaagaaaaaugaggagccccucucccacugaaacccauaacugccccaucaaggucaucuuucuuugacucaagaugacaucucaauuugaugcuuguaggccccaagcugauaagggccacagcccucucagagccacacuuccugggggcccacagagcagcucugcccuccuuccucuuccccuacccugcauuucucagccucauguucuauuuuagcucacacacgacccaugggggggaccaccaagugguuuuccaauggacuaagccaaggguucgaaguugggacuuccuuuggucugggacuuccuggggcagaaacauaggagccaacaucuggaaacuggauugcauucccugagccaugggaguccagcuggauauuaaggccagccugcccuccagcuuuuagagccgaagaucuuuuuuucugagccccaaagccgucaugauaguaugcccccagaucccaucagcuaagacccugucucucccaggaacccgucgugugagguuggggcuuuucugccaguaaagccauucugaucaccucacccuugacaggggccaagccaaucacauuagccauaaaugaccaauguccucagccacucuuuucucgggggugcauucguggguccuauucaucucucgucaguuaaugucucuaguccuuccuguaaaggugaaaauaagcauugcgcaugugcgcaacacacacgcacacacacacacacacacacacacacaaaucccagugucuuuuuaugcauguggugagaugaaauugugaucuuugugugaccuccagcugcugucuugucuuguaaaauauguccaaauguuuaagaauuucuaagcaaauggucccuuaaugaagucugcagaguucaauaaaagguauggaaaaaacaag

SEQ ID NO: 13534 - RNA, 3702 nt, Homo sapiens
ucauuugcacuugcuguuuccuccaccuggaaugcauuucccucauucuccccauggcuagucccuucuuaucuuucaaucucuauuaaucuccucugagacacccuuccugaccacccuguguaacacuagcagcuuggucucucuuuuuccaccccaucaugauguuccauuuccuuuauaacaaucacuguagccugaaacucucucuuuaaaaauuuacuuuuuuaguuaccugucuuccuccacuggucuacaagcucagaaaggggggcgggcugaauuagggcaauaggccagaaguuuagguuuuagucuaaagcaagggaaagucuugggaagguuuuaagcagaugagaaacaugguccaacauuucaugguccaugaaauguagcaguuguuuugguggccauggggagaaugaacuguaggaggccaagaugggagccaggcaugggagccagggaugaggccaagaugggagccaaguugcagggagguugcagggagacaagacgaugguaccuuggacaagggucaugaugguggagaugauaaguggacaaguaaaaaauauauaauaauauuaugugcaacucuauggaaauuauggaaaugaaccccuuaauuuuagaaaggaagaaaagggccagagaggaaccuguguuggaacacuguaucuuguucaguuuuuguccuccagggcaggggagcucacugcuguacccauccccggcacuuuuuuuuuucuuuuuuuuuuuuugcaacagggucucacuuuguuauccaggcugaaaugcagaggugcaaucacagcuuauaguggcuuugaccuccugggcucaagugauccuccugccucagccuccugaguagcugagaccacagguaagcagcaccaugcccagcuaauuuuuuauuuuuuggcagagaugggucucacuauguugcccaggcuggucuccaacuccugggcucaagccauccucccgccucagucucccaaagugcugagauuacaggcaugagccacugugcccggccgcugacaccuauuuacuuaucaugcaguaaaugaauauuugaaagaauaaaugaguaaacacaaggcccaucuguggcauccuuagagaacccuugccugccucuccagguaccuccuccaguuuucauuucugggauuaugugauggguuuugccucccccacuggauggggagcuccagggggaagacuuucccuucacggagccuggcauucugcuugcacauaggaagcugucaauaaccagauguccaacuuaacaugaauaaaugaaugaaugaaugaaugaaugaaucaccagacuauauaaaccagcucacucuucacccucucuuccccauaccucgcuuuauuuuucuucuuagcgguuaucaccaccugccacauugcauauguacugauguauucauuguccgccuccgucccccacccccgaccccccgcuaaaaucuagaauggaagcucaugaaagcaagggcuauuuacaguuccgaucugcccccucccacccucugacccuuccuccuguuucauuauuucccccagcgcuugucaccgccucauauauccuuucgcuuuuuuguuuaugaucuguuuccaaccagcuccacgagggccggauguuuguguuugauucacagcuguaucucagacgccugucaccgugcccugcaccgcggcucgcgcacaggaggcguucaacacacguuguugacgggacgaaggaaggcgggaucgcgaggccagcugugcagguggccuggguggagagggaugcacggccacgcgcgucuccuuggcccgaucccggagcccgcccccggccuccccggcaggcugggccgggcaggcaggaguuaagccgcgcucgcuuccgacccgcagguggcgccguccugccuuggugcccggcuccgggcgcuccgaagugcgggacagaauagcagcgagcgcggagccgaagcucagccccgacuuguugaucucgcccaggcagccgccgccgccgccgccgcgggagcaggaggaggaggagguggaggaggugccgcgcggccgcgguccugcccccgcgcccccggcgcccgccggcgccccccgccucggagagcgcgccccggccccgcggcgccugcagcccgggcgaguugccugcccggccgggguaggcccggcucagcccggccccgggaccgccgcugcccacgggcgggggcgcccgggcggccgggacgaugcgcggucccuggccccaggaggcggccgcccugggggugaguguuggggcguacggccuuccgugggggugcauggggacacggacaggggguuugccugccgcagcucggccuguuggucugcucgggcuccgcagcuccaggcuggaggggagcggggugggaggcaggcaagggcugaggccugaggggacgcgcaauccccauucuggggcuaaggcgugagcccuacaugcagggggugcucaggggaaccccccgaaaucacuagugcgcgguaggaggauggcaccuuuugaaaaggccagaaaauuuagcucauuuccccgccucccaccucccccaccccuucccuuccaagcccggggaaaggcgcagaacccggaguuauaaaaagccaucgcgggagaggaacgaggaggaggaguaggaggaggaggaggaggaggaggaagaggaggaggagggggagaaggaagaggagggggaggagaaggaggagaagggggcggggaaggagcgaggggaggacggagcaggcggaucccgaggacucugcccgccccuccugcgguaggguugggggcucagagggagaggcgagagcgggcuuuuccuccucgcggcucaccuugucgcuggagcaaucucaggagaugcuccaguguuugggaagaggggucgcuccaggacagaggggcuguugugcacaccccgucuguugugaccucggacaggugggcaccuggaacccccggaauucccccaaaucuuuuaagauuuggaaaaaagcccgcugccauucccccacccccaaaaucuugauuaucucgagaaggggaaggaaaagaagagaacucguuaaaaaaaaaaaaaagaaggaaagaagaagaagaaagaaagaaaaagauaaagaaagaaaguuuucaugcagcucccccucucuccccauggcggggccagguucgggacucgaucgggagacccauaaugaagagaguuucagcacucuaaggggcggacagcgccccgggcggcugggucgcgccugggccgcagaagcccaggguggggccucccgggcuccaggggcaucucuuggggcccucuccccgccccgaggggcggccccucccuccauccauggggugcggcggacuucagcaccggcgggagggacagcgaccauccguccuaccccacugagccgcuuaagcgcgggggaaggucaaggccggcugggagccugguggagagguggggggcggggggacagcaugcccagcuccccguuugcugacccgcguccgcuuucgcuuucugccucgcagccgucgggauggaggugagaagacggccgugacgcgcgcccgcggggcccccugcacccccagcagcccacagcgcucccugccccccu

SEQ ID NO: 13535 - RNA, 12180 nt, Homo sapiens
uuuccgggccgaguguuuccgggucgcugcuggcccccggguacuggucucaguaccccugcagccggccggagaggcuagagcccgacggggcccggcuccggcggcagccgcgccucucgcuugcuucccucggccgggccguccucggcggcagugucagggugagugacgggcggccgcgggcggaaacugccuucggggcuuccccaggcggagggggcgccagacagcggcagggcucggcuggcccgggagcgggguacccucacggcaggcaggacuacaggugggcccgcuguuucggcgcucccgggacccccagccuauccucaggacccccauucucccgggagcugccucgcaggcuccugggacccgccgaggguggcucagggccgcccaagaggaacaccccucuucggcgacuggccaaacagaaggacaccccgauuucgccacgaggcaguuaccgcgcagggguucccaguucaggcucuggcggcacaccuggguuuguacucacugugugaccuuggauaagucacuucaucuuaagagccucaguugccuauuuaagugauugaaccugguugcuagggcuggaguggagauggaaugagaucaugcagggccucuggcauacagcaggcguccaauaagugauaguuccuguuacuucauucaauucacgaagccguagggggggccagaauuugagacugggcuguuuuucacaacugacguggccccccgaggcuguaggaaugaccgagcugggacuuagcagccgccagcuucuguccccugcagggagggaaacagcuuccuucagagcuucuccgagagaggcagcugccacuagggaagcuucuuucagcaccgcugagguuauuuucagagguuuggaaggacucugugugaauuucuuuggaaucuaguaggaguguggggaccuucugguguuucacagccaguggaaggugccuuggauguuucucggagccucuugcuuggaacgagugcauugguguggguggggagguggaggggguugaacugacuuccccgucuccuguuuggaggcugauggagcuagaccagggauguguaaaccuguggacaggggcagugcacagaccaaaauaggucugccugugcagagagggggcgccuucaaaugcugcuuggggaacauuucugcuugaaugggccagcugagguaaagccaagcuaaugcuuagcuacucggaaucacuucacuuccaugcagugggacucuaaacagauacagcuuuccucuuagauguucaaaaaauaacuaaagaagccacuggcucccugacugugcaauaucucuuuuuccauugacuugcuuuucaagaagguaccuagauugugggugcaggaggugcugacuggagccguugacucugggcaccugccugucucuguguucaggauauucacagugcuguuuuuuuguuuuuuggguuuuuuuuuuuuuuuuuuuccaccagacuggcacggcuuggcguuccaauccuuggguugcuuggagaaauuagcagcuucugucgcugggcugucucggucuccuguaaccacgauguuuuugcagagagcguauuuuguuguucuugcagagugcugggaaugaauugcuggcucugugcucagaaaaaacaccagcuaugaccagcuacaaggcaucuuguauucucagaaaauguuuucagcagggaugaugucagcugcuucaucacuggccgaugucucugaccagccucuuuccuuggcccuugagcuuacaucauauagagauuagcucuccuagccccauucggugugggaagaugggaauuuugcuacuacaggaauuuuuguaacucaacucugcucgcgccgccauaaggcauucuaacuuagccaaacacuuucgaguagagcuguccagcagaugcagcaggauggcuuugcaagagucggaguuuuggcguuagaccuagguucagagcucagauccacuucuuccuagccuuacgacuuaggguaagugaguuggccucuccgagccucaguuuccucuuuaaccuuggaucuauccuguggauuucauugguuuucacagagcaguuagcagagggaugccacacaguaaucccuugguaaaugguacugauguaacaauaaaugagugagguaaauuggagaaagcccaggcaucaagggccucccagcaagaguucagauuccagcucugacccuuucaaacucuguugggcagguuguuuuaaugggaagagccuguuuuccuuauagaguugugaggauuaaaugggaugauguagguaaagugggaagcccaaugcuuagcacauaguagaaccucaguaauuguuagucucuuucuuuccuuuccuuauugacugauugagacaaggucuugcucugucacccaggccggagugcaguggugccaucauagcucacugcagccucaaacuccugggcucaguggauccccccaccucagacucccaaguagcuaagacuacaggugggugucaccacacccaccuaauuuuuuuuuuuuuuuuuuuuguagagacggagucuaacuauguuguccaggcuugucuugcccuuaauuaucuuuuagcuuuuacuuucuuccgccuuuucccucaccuacccagguugguuugagauuuguuuuagauaggcuuccuguccuuauugugaguauuuugaacaucagcugggcuguuuggaucccuuuccuuuauuuauuguuuuucagcaacaaacaaggguguggacuguggugcgauuauagagcagcagacgcugagccgagcuugagacuggcugacuuuguaaaaaaucagucucuuugaguucaaggcugacuuccuuggagaaaaauuacagcaguauucggaagcuuaaugucucuguguuugaaugguucucagacuaccaaaaaacagacccuggggccagaggcgugauggcagcuucucuuagauaagucaagaaugguaaaugcaugugugacuauccucuccaguggugcaauacauuuauuuauguagagauggaguuuuugcucuguugcccaggcuggagugcaauggcacgaucucagcucacugcaaccucucccuccuggguucacgccauucuccugccucagccuccugaguagcugggauuacagguguucguccagcuaauuuuuguauuuuuaguagaggcgggguuucgcuauguuggccaggcuagucucaaacucccaaucucaggcgauccacccaccuuggccucccagaguuguaggauuacaggcgugagccaccgcgccuggccugcauuuuuauuuuuuaagagaauauacauuuuaaauuguuuauuuuuuuauggacagaacaguaugaaguuagagcacauaccuacuuugauacuaggugguaugcucuuccagcuagagcugcaggcaggaugugucuccuuuauugcuguccucuaccugucccacccauccccauuccccgacuggguccagcucaggcagagggugggggcugcagaaaugcuugcuggacaugggaaucgugggguggugagaggaauacagguuccaagucagaaggccaggcuuggauuaucggguccaucaucugcuaaccuugagcuacuugucguaccucaugccaucuuucugagcccguuucuuugcucuccagcugaucucccaggauucuugggagguaccaaugagaaacuaaagugauggcaucgugaaugcagacauccuuugcagcauccauuucucuuuuucucuuuucuuuuucuuuuucuuuuuuuuuuuuuagagacggagucucgcucuguugcccaggcuggagugcaauggggcgaucucggcucacugcagccuccgccuccuggguucuagcaauucuccugccucagccucccgaguagcugugauuacaggcgcaugcugccacacccgucuaauuuuuuuuuaaauuuugguagagacgggguuucaccguguugcccaggcuggucucgaacuccugagcucaggcaauccaccugccucggccucccaaagugcuaagauuacaggcgugagccaccgugccuggcugcagcauccauuucaccuacuuuaucaagcacaggcaggcucuguguuaggcaucguggugaacaacacagacaugguccuugccuuuauggagcuuaccacgagcuuaccagcuuaccagggagggugagggguggacaaagagaggaagcuaaugaaugaaugaaguugauaguuucagauugugguuaucguaggagaaugugacaguguggaacugggaaggugagauagggugguaccucuagaggcugauguuugagcugaggccugaaugaugagaaucuuccugaagcagaauuuuaucccaaguggauuuuguuuucuuuuguaaagacaggguauugcuauguugcccaggcuggucucgaacuccuggccuugagcaauccuccugccuuggccuuccaaaguuuagggauuacaggcgugagcccccgcaccuggccccuaaauggauguguuugccuccuguacuccucagccuuauuugucacuguagcacugggcucccucagcagugcaguguguuggagacaguggccucucugugucccuaguuuugcuacacaucccaccucucaccgcaccauuaguacucccaggagucuccuccuggggacaaaaucuguggaggagccagacuacuggcucuuugagaugaggaugauuuuguugaccuccugauaguugcugggcucguaggaccuuccuagcugaacacaggucugcuaaaggagucccccacaugccaggcccaguccugcugcagcuucucucagccccuugcugucucccacacucagcagacaugaagcacacaggucaccuuacugagcaagauggucacaggccugcacccacggagcuucugggcaggagcagcaggaccagagcaugugaaaaugcacaucuaccacccagucagagguauuugccccacucagagaaggccuguccacuuagggguacagcaccuucagacaacagcaauggccaucaaggacuucccggagccggcucucugagcagcuucauauuccaucaugcauaauccucucgccagcucuggacagaggcgcuauuauuaaccccguuuuauaggagaaaaccgacacccagggagguggagcaauuugcccaaguaaccuggagaagcagcccuggccucacucgcaggugccuggccuuggaccccguguccgugacccugcgcguguugucuccccuggcccuggcagugucccuccauuaauccggauucgcucccagcguuguggugacaagaauauugcuggaucugugccuguucuacuaacaaguggcuaagcagaugacaagauuguguaaagccugugucccagcucagaacauucuauccucucccaacagggggcugucaagcgcucuggugauaaaggggccgcaggcugucaaaggccgguaacagcacuccaggggccgguagccacgguggccucuuuugaaaauuguaaauaagaccguaucucucuccccucgcuguaaacucuucaguggcuucacguggcucuuuguauaaaauaucgaauucugaaugugcucuugcggccuuggggcugagggucccgcugaugcuggcaucugccucuccucaugccccugcccucguggccucggccucacuggcugcaguucuguuacuguuccaggcuuccugccucaggaaagcagggugugguggguaagggcauggacuuuggagccagauugccuggguucugagcucagcuucucugccuccugagaguucuauaaccuuggacaguuucuuuuucuuaaaaauuuuuuuguauuuuuguagagacgugguuucaccguguuucccaggcuggucucgagcuccuggacucaagccauccucccccgucagccucccaaaguucaggaauuacaggugugagccacugugccuggccuaccuugagcaguuucuaaugucugugucucaguuugcacaugguccacuggggcugccuguagcgucucucuccuaggauuguuuaagaagaaaaagugaggcuggguaugggggcucacaccuguaauccuggcacuuugggaggccaaggcugguggaucacuugaggucaggaguucgagaccagccuggccaacauggugaaaccccaucuugacuaaaaauacaaaaauuaaccaggcgugguggcaggugccuguaaucccagcuacuugggaggcugaggcaggagaaucgcuugaacccgggaggcggagguugcagugagcugagaucacgccacugcacuccagccugggcuacagagcaaggauccaucucaaaaaaaaaguaagcgaguuagugugugugaagcucgucacgugucuggagccucugguacuauuagcucagggccuuccucuacugcgacuccuuccccggccucuuggccuggcagacuccucauccuucaggucuguugcugucucaagagggcuuuccuaaacucgcccuuccccaacgaaaccaggacaggagcuccugcuguacucacccgaauuucucuuucaggaauauuaaucguauuuuucauuugugagcacaacaaagucaagguccaucucucucuggccucuguuguaacccugcuuguaguacaugcucuguagugugcugcugggguccaguguagcccaggccaguucugcuguucauuuugccucagcgaccugaagccgaagcgcgaccguaucgaggaaugacaugcuucuuguuccccuccuuccagagcacuccgcugguccaggcggcaacauguccaugcuuuuagugaugucccugccucuaauccagaagccauggaggagauaagguagccccccucgaucggauggggaagcccaguucaauggauacuaaauucaaggaugacuuauuucggaaguacgugcaguuccaugagagcaaaguggauaccaccaccagcaggcagcggccuggcagcgaugagugccugcggguggcagccucaacccugcucagccugcacaagguggaucccuuuuaucgauuccggcugauccaguucuaugaggugguggagagcuccuugcgcucgcucagcuccucuagccugcgggcucugcacggcgccuucagcaugcuggagacggugggcaucaaccucuuccucuacccguggaagaaggaauucagaagcaucaaggugagguccuggagcagccuccauacaggcccuccuucucucuuccugccccuggcagucccuccugagaggcuaugccagucugaucccauccauccugugcucucagauccuuccgggcuccgaaccuuccccgucucuccagcaucaccucugaaccguuucuggcccggcugccacaccuuaagcagagaagcugggaaggcaggggcagccagguuaugcagggucuuguggcccagggcaaggcuuggauuuguucugaguaggcggggaaggaggcagugugggaucuggcuugcaucugaagagggucauucuggcugugguaugggaaguaggcuguagagggguggggggaggugggagggauggggagagcaguuaggaagcuucucagcggucccagcaagcugagggguguucuguacuaagugggaacaguagaggaggagggggaauugagagagggauccugaaucagaccacgcgggggauggcacaggagagcugucaccuagccaggcuucuucauucugccaugggaggagugguaaucaagagaggggauggcacaggagagcugucaccuagccaggcccuucagucugccguguuacucagccccucauggaaauaccagagaggaacguucugauugucaccgcguucugccuguaaucuggccccuuuauucagccauguuugcccaggcucucucuucauauggaguagagucuucgugccccacuaggaagcgagagguuuugcuuccuguguuuaacaaaguagcugcugccaggcgcgguggcucacaccuguaaucccagcacauugggaggccgaggcggguggaucacgaggucaggaguuugagaccagcuugaccagcacggugaaaccccaucucuacuaaaaacagaaaaauuagcugggcguguuggcgggcgccuguaaucccagcuauucaggaggcugaggcaggagaaucgcuugaacccaggaggcggagguugcagugagccaagaucgcaccaccgcacuccacccugggcaaaagagcgagacuccgucucaaacaaaagaaaggagcugcugggucauuuccuugcacaauuccugagugcuuagcaagccccagcuccugcgucuucugccucccgcagggugaggcugucgagauccuucccugcccugcccucuccccgccgccccacuucagagcuggacauccuuugcuuugacauagucucugucuugugucucugacagaaaaccccaccuuucuuuucuacucccucccuucuagaccuacacgggcccuuuuguuuauuaugucaagucgacauuacuggaagaggacauccgagccauccugagcugcaugggcuacacaccugagcugggcacugcauacaagcucagagagcucguggagacccuccaggugaagauggucuccuuugagcucuuucuggccaaagucgagugugagcagaugcuagaaauccacucacaagugaaggacaagggcuacuccgagcuggacauugugagcgagcgcaagagcagugcagaggaugugcgcggcugcucggacgcccugcggcggcgggcagagggccgggagcaccugacggccuccaugucacgaguggcacuccagaagucggccagcgagcgggcggccaaggacuacuacaagccccgcgugaccaagcccucgaggucaguggaugccuaugacagcuacugggagagccggaagccaccccugaaggccucauugagucuucggaaggagccuguggcaacggaugugggggacgaccucaaggaugagaucauccgcccauccccuucgcugcugaccauggccagcuccccccacggcagcccggaugugcuuccacccgccucccccagcaacggcccggcccugcugcgcgguaccuacuucuccacucaggaugacguggaucuguacacagacucugaacccagggccaccuaccgucggcaggaugcucugcggccggauguguggcugcucagaaacgaugcccacucccucuaccacaagcgcucgcccccugccaaagaguccgcccucuccaagugccaaagcugcgggcuguccugcagcuccucccucugccagcgcugugacagccugcucaccuguccuccagcuuccaagcccagcgccuuccccagcaaggccucgacucaugacagccuggcccacggggcaucucugcgggagaaguacccaggccagacucagggccucgaccgccucccgcaccuucacuccaaauccaagcccuccaccacgcccacuucccgcuguggcuucugcaaccgcccaggcgccaccaacaccugcacccaguguucaaaagucucaugugacgccugccucagcgcuuaccauuaugaccccugcuacaaaaagagugagcugcacaaguucaugcccaacaaccagcugaacuacaaguccacccagcucucccaucucguguacagauagaccggccucgccccuuccagcuccaagggcuacaucaaccgaccuuucggguuucacggugaagaaguacuaacgcauugaucucagaggcggaggccugcacuugaccauguagguggcagagaucgugggcuggcuguguccacgugggaguucacuuagcgacucagauaucucaaccaauggcugcuuuguugucugacaagggagaagguggcacuuccguucagauucauuuugcuaaucucuccacucccuguucaguugguucuuuuuuugggguuuuguuuuguuuuguuuuguuguuuuguuuuuuccuuuaaagaggauuucugucucugggacccucgcugcaccuaccccucccauugcaaagccaacuuggacugggaagggcccuucaggucaccaaacauccaccuggagcggcgagcuagaggccuguuggcuugugaaaugagcccuccugccacacggggccucucccaaaggcucaucccuuggccgcccccuuccuaaacacaaggauccccagcuggacuccccacccccuggcuuccccaccucuccaggugucaaaggugaaccgaguccaguauuagcugaaugucauuucguacaccacagcucagucagcccauggccuucgugaacuuugcuccaacacacugaugugugggcuucccacagcaggacugacuucccccuuucuguuguuugcacaugccccucuuacuguacugucaauagauauuuuugagauuuauuuuuaaauaaauauucaacuugcuguguguuucaacgugguuaaaaaaaugaauuauguagcuauuuauuaaaugcccuggguucuuuagucuuccaagggagggccucgcgcccauucguguuguauccuccacucacuauggcccgaggggagaggagaguuuggggcagggaggaacagacaugaagccuccuuuucuugagcugguggagagccacugucuucccugcaguaacuaucuauacaccuaccuccagugugcacuuagggggugagcgcgggugucgaggucugugugucugcagacugcuaaccuaugacaauucagggaccucaccugucggaccuauagcuugcugagcaggaaccuugcacuucacacuucuugagucucguuucagaaggaaaaucauuugggauuccuacugccccuccaucucaauccucuucucuucaccaguuuccaggacucaucugcaacauuugcaaucuuuuugcacuaaaagugggcaggagucggcaugugcccaucagagagacggcuccucagaugcucagcuaagccuaagcgcuuccaagccugaaggccccuucagcuucucaugugaauuaccaaccccuggauuuuccuuguggggguacaagagcaggaguggggcaagaguuugaaaauaaagccgcuuccuugugaacuaacuauauuuuagccauaacuguuugugauguacacaauguuaagggauuuauaugcagugggcuuuucugggagaaaguuauucagcucuugagcaaguuuaagucuggcugaauccugaggccacugugaauuugcugauguucuuccaacucaguugagugauuuuaagguuuuccaaaucuucuauggcucucuuuuuaauauauauauauauauauauauauauauauauauauauauauauauauaucuaucugguagaucacauguagauguacaguguguauauuaagcugaauuucaaccaacuuuauuacuaagaccagccuagcagggcauucaucuuugauguucuuccuuuucacauuucagaaucggcaaugccuggcccacuccugagagcucuaguuuucuaguuuuccauuuccagauugcgccagcauuacaguaacuaacucuuucuaaccaaccgugaugccacguaacuuacccuauggacaaaagcaggaaugacuaacacauccuaggagggaaaguccaguguaccugucaucacggacgcacuguggucacagacuggaauacgaaauacuacagcccugcucccaggugugcaucuuacuggaugagguugcugugauugagauaguuaaauacaugcuaauuuaaaaaugcagauguuuuacauuugauuucuaccaagaguugaaauguugagagaugauuaaaaauaauaauaauaaagugucuuccauuguuaaaugaaguguuugggguuuuauguccccu

SEQ ID NO: 13536 - RNA, 6089 nt, Homo sapiens
cauugcugacuucuugucuggccugguacacuggggugcugacacauggggcucuguggagcugcccauuguggggaaggugaguauguugaccuaaccauguccucaagaaggagguugggcuguauggccuugagugaguccccuuucuucucuaagacuguuucccuaucugaaagaugggaaccaucauugcagccugucccucaccccugugcugcaagacuagaacaggagucccuugggauuuuggaagcaaaagcaucaggcuugggaugguccaagaguuuagauaugugccugccucaucagaaccccugaauuugggggugucuugcuuuuccauugucuccccugcugcuucuugcuguuuuaacugcauuuuauccuguauuagucacuuuuuugguuuugacagaaaaucuaaacuggcuuaggcaaacaaggguacugauucauguaacugaagauuucaggguuagagccaaauuaaggaauggcugcauccaguaggaccgacagaccacauucuucaggcccagucuucuuccaucucuaucucuacuuuccccucauaagguggccagugugcuuucucaccgcccagagauccauccuuccagcucccaagaaaagagaacuguccuucuccuuccaggagaacagcauuucuccuucccuguaguuuccgccaacugaagucccacggcucacucccauuggcccagauugggucacgugcugggcccucaggcagucacuggcuagagggaggagaugcuaugauuggccaggccuggucacguguucuuucucagcccggggcgaggucagccuugucagaagagccuggacuaaggaggggaggcuguuaccccagcaggugcaggggguccagagggucccaccuuuuacuuagagggaccuccucaacugccuugggguggggaggaagggcggagguugucuccaagcccccuuacagcacagguagggagacugaggcccagaggcagacagugccaacccaaagcccuuccagggucauuucggcucaucuccccaaaggcuggauggggucugugucuggcagugggccaggugggaauguucaagcaucccggguggaggaaacuuaggaucaaaggcgggaggugagcccagggugaauguguuuagggggcuguggagagcagcugaccaccuuaggcugacugcuggggcugugucccccucaacuccaggcuuucauccgacccuuccgggagcaccacauugacccgacagcuaucacacggcacgacuucaucgagaccaacggggacaacugccuggugacacugcugccgcugcuaaacauggccuacaaguuccgcacccacagcccuggugagacacccagcuaguggugggcugggagggggccuugggggcagaggccgacccccaggagccuucuggggcuuauguguuuggcuccuuaugguauuuuaaaagaguuuucauucauugucuucauguaaaaucaggaaaccugacaugaagauggagguuuccagcuucucuugcacaaucugcucuggccccccuggguccauguucccaccuggccucacugggugggagcugagcugcagccacugccuuugacaggacgcgucuuuccaguuuaccaccguccccacuauuccuugcuucccugcacccaacccaccuuguucauuuguguuaccugccuggcagggcuucugggguuuugcuaccguggccuaguggaaaaugucuaggcugugaaaacagggccugccuauuuuuagagggacuggucccaaaguaagugauuucaccacucugagccucaguugccuuaucugucagguggagguagguuggggcccgguccuguuccagcaccuuaacacccauuuguucuucaggcagccuccgguggguagagguggugaggacguguaguguagugggugcuauggcacccugcccauccccuucccugggggugcacccagccccugcuucugugagugguggcugcugacagcucccagcuucuccagggauggaggggaggucccaccugucuccuugggauaaggcuggagccagugacugaaacgccuccgacgcuagucccuuugccucugagugggucuaauucuaaagagccguuaacaccucagagcuccuugcaggaacagacugagacaggacgccacccaccccaucuuugcucugcucuuccccugccgugucuugcuucccucccucccuucgagguuuuuuccugaagaggcucccuugauaaaucacaugcacaagaaccuguuucaggcuccgcuucuagggaaccugggugaaggcaucauucccauuuuccugauggggaaauuaagcuucuuagaggcagagucaccgauccagcccauacugccaagaaaugucggcagagaucggaacccagcuccagcugacuccggucuacauucccagccauugccaugcuuaugccauuauccuauuacaccauuacgccugcuuccugagcaggaggaaagccugaagcccagggcagcaccugagcuugccugcggcccugcaggggguggaagagaauccugggugcuugcccagcucaggagccgcccaggagcagguggugagggccauuugggguggguuccccgucccgagugacagcugugccggcccccccucuccccaaccugcagaagcccuggagcagcuauaccccugggagugcuucgucuucugccugaucaucuucggcaccuucaccaaccagauccacaaguggucgcacacguacuuugggcugccacgcugggucacccuccugcaggacuggcaugucauccugccacguaaacaccaucgcauccaccacgucucaccccacgagaccuacuucugcaucaccacaggugcggccaccaguggcguggaaugggcuuuccccaccccagccacugcaccaucuucgaggucaggagggcagagaucacagcaggaggucacacaguccuugcccucugggaacagucucucaggucaugcauuuauugagcaccuacugugugccaggcacuauucuaggugcugaggacacaguaaaugagacugacaaagcccucucccucgacuucauggcguugugauuccagccacccaucaucccguauuuauugagcaccuaccacaugccauggugcuuugggcguaggcuccugcagcaaacaaaauagcaugaaucagcugggcgcaguggcucaugccuggaaucccagcacuuugggaggccaaggcggguggaucacuugaggucaggaguuggagaccagccuggccaacauggugaaaccccaucucuacuaaaaauacgaaaaaaaauuaauugggcuugguggcaggcaccuguaaucccagcuacucgggaggcugaggcaagagaauugcuugaaccugggagguggagguugcaguaagcugaaaucgcaccacugcacuccagccuaggugacagagacugucucaaaaaaaaaaaaaaaaaaaaaaaaaccagaaaacacggauccuugcccuuguggcacucaccaucuagugagggagcuggaacgaaugaauaaaauguguagcguggcuaauggugcuaacugcuauggaggaaaauaaagcaggggugggagaaggaagugggggcuuugccucuuaaaucggguggucagggaaggugacacuugaacaaagaccccgaggagcugagggacaaagccgugcagaccucugugggaggcacucuaggcagcaggaacaguaggugcgaaggcccugaggcuggccuuugcuugcuugguguguuuccggaauggcaaagaggcuccugacuggaguugaggcagagcaauggaagagggagaagcgggcagagcaguggaagagggaggagagaagggggcagagcaacugaagagggaggagagaagugugggagggcccugaagauagaugagcacagauuagagcaaagguaacaggaagcagcaggccagaggcaggaacaugcccagugcaguggaggaagggaaaggaggcccacgugccaugcucaguuagcagccagugcgaaagaggugaggugaacugggaguuucucuggagccagcugggcugcuuucaagguuaaguguaucaggugcugucaagucuaacucaggccuaacucucagcuucuccacaugugccuuuaggcaacucacaaaccucccuggggaccgcuuuucuccuuacaaaauagggcugcagccgccuccuucauauaucaccuucuuagggccauagugggaauggcaaaugcgguguuuggcauauaguagguacuugauaaauuacagcuacuauuuuuuuuuaggucuuucuggaaacagaacugagaaccacaaaaaaacauucuuuuucauguccucaauuugugcuccuuggaaggcagguggagggauuagaauucaggcuauuuaggagauggguuaacuacuuaggcagggcugaguuccaauccugguuuggccaccugcuaauugggaaacucuucucuaagccucagugugcucauguggaaaaugggacugauauuaguaucuaccucauggugagcuggaaggcuguaagauugugagcaauauuuauucagcaccuacucugcgccuggcuguauucuaagcacugaggaucagcagugaaagaacaugguguuuugcauuuuggggauaacguuccaguuggggauuggggggugaacaaacacagaacaggaaaauagagaauuaacgaagaugguuacagguuaucauaaaggcuauaaagaaaugaaagaggguggccugucauggugguucacgcguguaaucccagcacuuuaggaagccaaggcgagaggauugcuugagcccaggaguucaagaccagccuauauaagacaagaccccaucugcauuaaaaaaauuguaaauagagccaggcucagugguucaugccuguaaucccagcaguuugggaggccgaggcggguggaucacgaggucaagagaucgagaccauccuggccaacauggugaaaccuagucucuacuaaaaauacaaaacuuagcugggcaugguggugugcaccuguagucucagcuacucggaggcugaggcaggagagucacuugaacccgggagguggagguugcagugagccgagaucgccccacugcacuccagccuggccacagagugagacucugucucaaauaaauagauagauaaaugauagauagauagauagauagauagauagauagauagauagauagauaaaggguaaugugagaaaccuggggugcugcuuaaguggaugaucagggaaggcuuccuggcagagguagcauuugagcugagugauaaggccaccacagugccugguauauaguaagugcucaaauauaaguaagugccugguauauaguaagaaaguagaggaauauggggguuggaggccugaguggccccaggcccauuggugggaggcccccacuuccaguuccuuggccggucccuguguccuauccuguacugacucacuccucauugggccccuccagcccagugaaggucagcucucuuccaauguccccuugacuacucucucccauucaaacucccgcugccauuucuacugcaggcuggcucaacuacccucuggagaagauaggcuucuggcgacgccuggaggaccucauccagggccugacgggcgagaagccucgggcagaugacaugaaaugggcccagaagaucaaauaacuucuccgagccugcuaccugguugccaaccuucccuagcccccaaaccgaagccaucugccaaauuccagccucuuugagcuggccccuccagauggagaggacaucuccugggcugggcccagguaccccagcccaccccucaugacacagaauacuugagccacugauuuuucauuucuuuuuuuuuuuuuuccucggccccuccucag

SEQ ID NO: 13537 - RNA, 75004 nt, Homo sapiens
gcaggaguuccuugauacuucgggaaacacugaaaaucauuccauccccauccauucauuccugcagcacccaaguggaaauucugcguuucagacagggacacuacccuuagagagcagugggcuuccccagcagcguagugaaacaugauacuccugaguuucaugaaaaaagggcagacaucuggccagagcugggaggcaggaaauagagcacggugcccuccucccauacuccagcuuggauuacugaggcuggggcccaggcccugcaggaaaggaggugcaugacuacuuuaaggccacucacucugugacucaacgggccgggucggggcuggaacucaaugcccucccgggccuggagagcccacgcgccgugggcggggcucccggggucgccuaggcaacaggcgcgcgccgcgcccgagcccagagccccaaagcggaggagggaacgcgcgcuauuagauaucucgcggugcuggggccacuuccccuagcaccgcccccggcuccuccccgcggaagugcuugucgaaauucucgaucgcugauugguccuucugcuucaggggcggagccccuggcaggcgugaugcguaguuccggcugccgguugacaugaagaagcagcagcggcuagggcggcgguagcugcaggggucggggauugcagcgggccucggggcuaagagcgcgacgcggccuagagcggcagacggcgcagugggccgagaaggaggcgcagcagccgcccuggcccgucauggagauggaaaaggaguucgagcagaucgacaaguccgggagcugggcggccauuuaccaggugcgggagcgccccggagcguggcgggcccuucgcuuaggccgcuugaacauccccucagaccuccaggccccagacucccucugggucuugcccucugccucgcuccuacugcuugaggauucgaugggacagcgacgcacugcguccccccacccuuuguccccggggcgggcguguuucucgccgcagcgucggagcccccuucgaucccccaccucccuucuguucuccagcucgggugaucucucaagccgggggaccgccggucugugcucucaacgcgaaucccucgcaccccgaccccgcccccugccuguccacucuuuguccccuggggugauuuagcacccccacuauuuccuuuucuggaguggaccaccucagacucucuuccuuugucucccugggggaaaagguuacuccccccgucccuccuucacauuuccuuuccccuagucucagugugcgucgagucccagagaugacaguccccuuuccccuuucuguucauucauuuauuggauaggaguuggcaagcuuauucugugcuaggcaccgcuuaggcauuggaggugguguuugcuaaucaggacaggcaagauccuagccuuaguggggccuagagucgaauagggcaaucaaacacaaaagcaaauaauuucagauagugacaggugcugugaagagaacgacuuccuaacgggguacagggugacugcauagaaggccggcugucuuagagaaggggaucagggaaggccugucaaaggaggagacauuugcuuugugagcugaaccaagaggagcagaaagccgugagaauauggggcuaaagaaccuucuagccaggaggccugcgguacccacuccauuggggccaugauauuauucuuucaggcagggacucaggaagguuaacguuuuaacccucucuaaaauagcaucuuuccucaaugagcagcuuagucuuuggucguggcagagaugaccuugucuuaggagucaucuccuuguguguuaaaaaguuaggaaaggaggguuucucauauaucuauaaaacaaguaguuaaaaacacaaagagcucuuccuuucacaagcagcugaauaagauacauacucccaauuaaaugucauugcggggguuguuaagauuaacuaaaaccacacuugcacaguaucuuaaauaagcgauauacagaauagagagauuuuguuacuuguguaaagggagacagcagaugauucuguuuucagcuuauaggcucaaaaggcaaauugugagauccaucagcuguaguauuaaaaucuauuuugagcuccgcuuagaaaggaaaaaagguuuaagcaguucuuugguaugcuugacuaacaaaagccuuuuuuuuuggcagccuugauuuucauguggauuuacaucaagcuuauuugacaggauucuuuuuauuuggacuguaguguguauauuaguuucugcuagacuaauauuucuaaccacuguaaucuauauacuaauaaguaugauugaucaguauauaaaauuuguaugccauaucuggucucugaauuagcugaaugaauuccauaagggacuuugagacuguguagacaaauuuucugcaucaguuuaaugcaguagagucuaaaaugucuuuaaaugaaaauuguuggucugaaguguuggaguugauuaugauacaccccaucacaguggaagcauuguggagagaagucuuuuccacugaaauugacugaguugacaacaagaaauacguauuguaacuuaguucuuaguugaauuuuauuucuuacaauuuuaagccagaguggguugaccugucacccaagcaugguuaaaauuguauucagcaugcaacuagcauggagugugucagucuucaauucauuuccuucauuguucuuaaguuuuucugccacaauuaaaccccacaaguuagucaagguguugagauuuucacugcuucuuaauggauugccacauucccugagguaguuucuuuuggucuuagagaauugucagggccagcuuuucucaccuccacuguauggauauuuuucuuuucuaagaucuugaaaucagaagcuuuucuccuaaguguaaaaguagcucuuugucauacaacuguagcguuuucugaaacagaguucagaugaccuugagucuaaaguggcuaacuuuccaagguguguaucgcuuuaccaaaaccauuauuuuucaaggauucaaagaauguguuuacaauugauagaaaauggaaguuuaaaaaaauuaauacuuuauagcauguugaaaugagggcagccuuauacaaagucauacuuugagcuugccuagccuauugugaucagagaauaauguaauuuuugcuuacaacuugguaagcaggucaguuauucuaacuuauuuucugauuagaacaaaaagauguaaaaacuugaaaacuauugggaaaagaacaaagagugaagaggacuuuugagugcugaggaauguggcagcuuggaaaacaaacuuuuuaggcagagauucuuugcuaggucaguuugauaaagugagcauaaccguauuuuuaaucuuuaaugcuaaugaauagcauagaugcuaauaagcaucuaggucuauaaaaagucagcuuugauaguguauauagauggcuuuaaacauuguuuucuagcauuuaaacacuuucaaaucauccgguugcuugauugggccuagcugucuaagaggagagaaugagcccagaugaggaaaagagauugauuuuacugagcuagaaugagaggagagaggguugagugaaugaaaagaauagcucaugugcuccccuccaucuguaguuuaagagggguuggguccgguguuuugcuuguuuucucgucuguaaauucuuugauucucugacaccacucacuauauuucauugugaaugauuugauuguuucagauaaaggggacugcaauaauaccuugugacaugaaggcaagauuuauucauguuagaggcaggcuuuguaaaaugggccacucuuccaauugacauuuguuuuuauagcuguuuucauuaugaaauacaaucuaaugccugacuagguuaaaaccauguuguaacaauaguucacuaaaauuccuuacugauauacagcuuauguuguuauauuccaaaaagaugaauauuaaaauuugccaauaauguuuauuuaaauacuauuuucuucagaggaaaaaaaacuauuuuaugcaaaggagaaagaucuauacacuaugacucacuucacuuaaaaaaaaaaagacuaacggaaaugacauggagagacugggaaguucuagucaucuugagugacccauuagaucuaaauguucuuguuuagcccugguuugagugaacuaaauuuaggugucugaucaguacuuuggaaaugguguaaaugccuuuguaauugucuggacugauauuagauuaacugggagcacaaguagaaauagugaaggaaagaacuuuuugcuauuguuauuugacaucacuggcauauuuauaggaauacuuugguguuuuuggaaguaaguaaaccaaccagugguucuaaaaagucagcugggggauaaugguaaugccgcuguuucuuagcugcaaguuaucugccguuacuucuccuccauuuugcauuuuaucuugaauagcuccucaaaaccuauuaaaauaccugguauugaauaauguaauugaauguguacugaauuucacaguggaaaugaauaagaaauuuccuguggagguuuuuugacuuagcuacugaaauaacggccuuuuguugugugauucuuucccuuuucucuuuguuaaagaaaacugucuugugaucuuguagauuacagaauccuuuuggcaauuucuguuccuagcacugcuuuuucuuucuuucuuucuuuuaaauagaaaugggguuuugcuguguugcccagguuggucuugaacuccuggcuucaagcgauccucccaccuuggccuccugaaguugggauugcaggcgugagcagguacuuuuucugaggccugccugagccuauauauauuuugcacaauuuggcauuccucccuacaguguuuaugcugauuuguuucugguaacaacuaauacuggcaaaucggcugggcauguuacuuuaugcugcccauauucaggaaaauuggaauucuagcugggucauuguucccagaugauguaguuuggcaccagccauuccauguucacauuuugaguauccaggagggcuggggacuuuggaguaguuggugauucccucugccacauuucacugguuggucacuauggcauccuuuccaccacacuaguagucuagguucucagauguugcuuaugagccugcaaugguuucuaguuucacacugcagaaaugagugaagccgguuacccguuaauauggucccaucaucacuagaguaauucauuguucuaaaaccagaucugagucucucacuccucugcaacuacuucugauucuuucauaacacuuguaaaguccaaacuccucuuuagcauggcagccagcuuccaguccuucccuccuauguggcuuccauucuagccagacaagaaagggcagcguucuccaaacucauccucgcccuucauuccucuauaccauugcugagcacuuuguugaggaugccucucccguucaaucuagcuugcaucuuccagcucgaaugugugcuuccuugcaccagaguuuuguuccgucaccuguguguuuucauacaagcuggcacauaucucuucuaaagcccugcugucauuguagcugcgucuuuacaaacauuuuuuuuuuaaauuuuuauaaagucaaggucucacuauauugcccaggcuggucucaaacuccugggcucaagugauccuccugccuuggccucccagagugcugggauuauagguaugagacacugugcccagcuguagcugcuacuuuauaucccaggucuaucuccaauggagcccaagcuuccugaggccaccuguuguaucuuucucauucaucuugaaguccucugcuccuggcacagaguagguaccuaacaagaguugggauugaauugauggucaguacuuugcuagccugaugguauaaagauguacaaaacauguuccuggcucccacucuaggggggcaaugauggaaacaaauagauuagcccacauuaguaccaauaguagaggucacucugggagaaggcccccaccacauuuugagucauggccuaaugagguaauuuaguauugccugcugcaguggcuuuggaagaaaggcuggcauucuuagccaguagaagcugauaccacugauuuguuucacagaagcuuuaaauauaacaauaaauuugugcuuggccuacggugaacuuuacaggcaacuuggagguaauauguuugucucucuaagaauuguugaauuccucuucccucaucccuccugacugguucucacaagccuagcgggccuuugcaugugguugguucauaaaauacuuuuugauuuugggauauaaaauauaguucuccauaaaauaacgacuguuaccaagucuuugauuuuuuuuuucaaacuauaaaugguaaugacauucuuuggccuuugaucagaccacccuuaggggcaagagaguaguuucauguuuugcuuuuucuaguguccccugugucuggguauaguugcagucucagcugucauacuaacagugcugagugagucccuuacuuucuuuggguuuugguuucucccuuguaaaaaugauccuggacuaacugaucauuaaguucaggucaaguaauaaaaauccuuaauguacucacaaauacaauuuaauguuccugaauaauccuuguaaaaacugcagcaguuacucaguuuuguaaggugugguuggguacuauuaggcucaaaaguuuauaggagcuuugugaguauaguuaacaacucaaaagaaugggguguuuuuucccgaggggcaugaaauguuuuugauaaauagaguucauuugacuugguaauguggaaaaugaguagcccugacacguacgcuaugcuuuugcaguuuuucucucaaguagcaauuggguggcuuuuccuguaaaagauagaggaacugauucuugagaauuuacgaaagcuucaacccuaacuagguaugcaaagaauaguugcccuuuauguuguaauuuuaggaagaaaccuacaucuggucuaaguuucauuugaauaauaugauaguuuacacaucugccauauuugagaagaaaguaccuaagucuccagcauuuuagaaauaaugcuuuacuuuguguagaaauggucuuuagaguuuaauagcugcugcccucuccuuuuucaaagcagcuugacauaaucaugaguaucuugcugacagcuuguaaauuuugauuguaugaaaacugaaaauaagaccauuucacauggaagauucccuccugcccugaaacagccaaagaaaacuguagccaucaaaucuauugaucucugggcuuugguacaagucacacuacuacaaauaaaauaauaccaaguacuuauaaaugauuuucaguccuuuuaaaguuuauuuuuuuaauauuuuuuuugagauggggucuugcugugucguccaggcuggagugcaguggcacaaucuuggcucacugcaaccuccaccuccugggcucaagugauccucccaccucaggcucccaaguagcugagacuacaggcaugugccaucacgcccagcuaauuuuuguauuuuuuuggaguagagaugggauuuugcuguguugcccaggcuggucuugaacuccugggcuuaagccaucugucugccucaggcucccaaaguguugggauuacaggugugagccacugugcccggcccagcccuuuuuuuaagagaaaaacguaugacaucguucgauuuacugagugcuuaugguuuuacuaaggcaguaagguuuuauggauacccuaugguaauuagauagaauuagugcucugaagucagcucuguaauauggacucagaguaaacauggcaaagggacacuuaaggucugcauuuucucugggaaauaaacguauucuuuacuacucugaaucuagugcugggaaauucuaaauccuucuugaggauuaaccacuugaaguaaaguuuugggucccaaguaggcuugugucccugucuccuucucuuuacuuuucagauguuucuuccuagagacugagguauauuuuacuuuuacagaugaagaaggaagccucggcuguguuuguggcuuuugugggugagcaacaucacuugcaaagauaagaugagcauagcaaaacuaggcuuucaaaauaauuuuuaaaaauuucuuagugauuagaaaaggaaaacucuucccuugucucuguuaagaaacguuuuucgacuuuuuuccuuucuuaauggaucuuuuauuggcacuucucuuccuuuugcagaaucuuacuuaaaagucacuacguuacauuacagcaaacagcuuagcuaauuuuuauccagaugggccccgguuacaggauuguacacuauugcgaauuucuuacaggaaagugaacaucaaguaauuauuccaaauagaguucucuuaagaacgugaguuacuuaaaaaugucuaaggaugaagucacuucugaauauaacuucacucaagagaacaaauaagcaaacugcauuuagcauaacaugguaaauuagcuuuaacucuccuugauguuugaacauuugucgcuguuaacuacuguuucacuuuucaaauagucagggcuuaguuugcuucuguaaggauaaagggaaaauacgccuucacugagucauaaauauuuuuguggcuaacuuuugcacagagaaaagaggccucuaagaagguacccagugaauuuuuuuuucggggcagggagagaauaugucauuuuuugguuuguuguuguuguugucauuguuuugcuuuguuguuuuuacucugaacugaacuguaucuugacagcacuuuugaauuaagagcauuacucuuauuguucucuacuaccuggacgccaccucccuguugccauaguguuaaggaucaugcuccgagguggggugaggcagaauggggccaagaucagaaaguuacauuaagcuacaucagguuuauacaagcauaaaaccaaauuuuuggagcaguccccagaauacaaccugguuuagccacaccuaaagguugcucuugaauauuccuugagaauccacaucccuagaaugcuggguuucaaugggcccuuuauguaccuaucauggugucauuucugagcauuucuaaauauuccuucaugucuuacugacaguuuuucuugaauaaaucuuaggaauauuagugccauuaucaguauuuuguuuggucuguucacaccacaaauaacuacccaggucugcuacuugccccuauuucucuaccugcuaaugaaaaugcuuuugaaaguuugaguaacaguauuggagugugcacagugguauugguagguucuguacucauccuuaaccacuuguuuucauccuuugugagcuugaaguuucuccaaaaaauuuaucacaaaacuuaucagacauaguuaauacacucagagagagaaucacugaaaaaguagauguaguuuaacaaacccagugccuuuuuuuuacccaugaauacauauuugucaacuaaaccucauuuugcaacuuguuccacuacucgaaugguaacaaacuuuugguuucccaauagauuuggaagauguugcuuuugaaaguaggaaauagauggcuuuagaagauggaagaauauuuuguuugaagugggagcgugguauguccuuagcugucugugaaaugcagcugaagaugggugugggccuucaucugcauuucccaucuucaguuugaggagguaguuacccuucuaaccacuuaagaacugcaugguacaugcuguuuuauuuacagggcaaaacugugcucccguaguuucccuggugcuugccuucacguuaacacagugucaucguuuggcaguguuuaugugccaggguccauguuagaaggaggaaagguauagcgaaguuaaagggugcaguuggccucccaccuuuaguuuuguaagugccuuuaaaguuugauuuuuguagguugaucauaaggaagugauaaguauguuagguuauuugugguuugagcuaauuuuagucucuuuuuacagcuugcuuuguauccuuugccauuaaaacaugcuuucuagaaagacaacuuuugaauguaggacacagucuauauucuauacuuggcuacauuucaaaaaauauuuucucaguacuuuggaaguuggacaguuggaagcauagugacaguauuuaaaaaucuuugauuccggccgggcaugguggcucacgccuguaaucccagcacuuugggaggccgagguggguggaucacuugagguccggaguucaggaccagccugaccaacauggugaaacccugucucuacuaaaaauacaaaauuagccgagcguggugguacaugccuguaaucccagcuacucaggaggcugaggcaggagaaucgcuugaaucugggaggcggagguugcauugagccgagaucauaccauugcacuacagccugggggacaagagugaaacucugucucaaaaaaaaaaaaaaaauuaagugauuucuuugcuuugugacacuucuacuuuuccagcaaguaaauuauauucuuucauacagguaugaaauucuuguuccaagcuagugguuaaaaaggcacaguugauauuagaggauuuguaaaagauuaugaccacgccugcaauguacugaagcaaggcuuugcugggcuguguauaggaaaccuuccccagccugugcccuugcuugauagaacauuuugcuccuaaggguaggugccuguaucugucuccaguacugguuaguuucacacagaacaguuguguuucagagcuuuagucucaagcugcccugcuccccugaagcagccacccugagcaugugcacucacaggaggggacaugugaggucauggaagaagacgacucaggaagaagaagacuuggguuuggguucugacucugccuuugacuguugugggauuuugaggaguugcauacaggaucuguaaaauguagucauuagacuagacuagacagccauauagcauuaccuagauguaacuuucuacaaagacauggucacaggagaagaccagaggguggggugaucuuucuggaaaaauuggggcuucaugccuuacucaugcuagauaugguagcauuauauggcugugccugaucccccuaaucuaaaagugggacagaacuuuaaaauuucauauuaacucaaauuaaaacuugaaaaaaacccauuauuuccuuaaaaauaauaaaaugcccugugggggcauaagucacauuauauuuuaaaauuccugaaugccacauggaugaauguaguuccuuuugaaauucuucuuuugucuaaagaggaauguuggauuuuguaauuggacuaaaaaaucuuccauuugagagagaaacagucugcugcauguucuacccuuguucaggauaaaacccacuaauagcuaacauuuauugaauucuguguugugccucaggcacugugcaaaguccuuuacaugcaaugcuguuuauuauauacugucaauuggucuauaacagcaggaaauguuucaggaggacaaugaggucccagacccucagucuucuccuguguccuggauucagcuucacaauagcacuauggcaguguggccacugcuucagcuuccacauacauggcugugaagagagacaggggauugugcuaagccuccccgauuuauuaggacauaggaggagagaguuuguaguuuuugaccuuugccuaguuuucuaaccucuuuccuagaugucacaaauuggccacccacagucauauuuugcuugcuucacgcaaugcuuuuuaaaaaagagaagaguuuaauuugugccauuguuuauaaaugaaucaggagaaaugacaugcaacucuggauucuggccucucuugaaaaaucugaaaaucacaccgucugagcuuacacuggcaguggucugcuggacugagggacacaacuccuuuuggauguacaugugugcguugcagaguuuaccacagucccacagugggucacacuguccuugucgguguacacuaccuagcacuugaguuugcaaccccuaccccaagcugaguuuucucgucaagcuugauguuaauguuaugugaugcuuggccuuguagguauuugguauauuaucguuagauaaaauugaagcaaagggcuaaaggguugguggccugagggagugcccuugacaguaaagucuaggauaaaaucauuggccagguacuccuucccuucccgcccuuccucuuuucucuuuauccucagccuccuucugcuauuuugaggaaguuagaagccaccaccauuuuuucccaccucaggcaacugaguguggcuguauuucugucccauguucaguuauuuccaggaacuauuuuugaugaccaacuugaaguuacauugggugggccuaaugggggcugauaaaagaaugaggugaccaaauaugcuugcacugagacggcuacgaaguaagguuuuuaaugacuugcuuugugacuuggucaggagugauaccauuugucauguguccaacuucaugacuaaaugguugcucuaccuuauccucauagcuauaauaaaauaaaauaaauacauacauugcagggaggaauguaucuuguuaaaggucucucccuuuuagcaacaaaaguacauauuauguuguagaacaugcuuuuucuuugauccuucuugaacaccuauuacucuauagagguauguuguguauggcaaauuagaacaagcaauagauaaggaugauucuuuaccauuauaacccagucaaggucuuuguccuaaguuuuguaccuuucuccagagggaaagguauuuguauuuauuuauuuauuuuugaggcagaguuuugcucuuguugcccaggcuggggugcaauggcacgaucucagcucacuguaacauccgccucccgaguucaagugauucuccugccucagccucccgaguagcugggauuacaggugccugccacgaugcccggcuaauuuuuuuuuuuuuuuuuguauuuuuaguagagaugggguuucaucauguuggccaggcuggucuugaacuccugaccucaggugauccauccaccucggccucccaaaguguugggauuacaggcaucagccacugccuccggccagguauuuguauuuuuagucucuaugccuuaccgucucagaucaggaggauuuggugauuuaucgaaugugggggaaggggaagaagaggaaacgggaggaauguuccagauuagggaaauagcuagauggaagaugcagccccucaucaagguggggacacaggaaaaggaacgugugcaaagaagauggugaucugguugugaccauguuguuagaggacguccagggaagcaucugguagguggugggguguuuaaauauagaacauucggagaaugcuccgaagcuucagagaacccuucccaaaaggacaaaaccagcucaguguuuuagcacuccgggaucauauggcaugacagcauggcugcuuuauacuuuuuuguguaugugaaauuaaaaccaaccacucaggaccaauuucucugaagcuuuuugucaaucuuucauuugcuuuucucgucuagauuguaagcuccuugcagccagugucuguugauucagucauucaaaaaauaauacaugaacagcuacuagguaccaggcucugugcugggcaguugggauauguggugaggaagacaaacuuggucccugcccuuaggaaguucaguaguccagcagacaaaguggcugaauaaagauaaucucaguucacagugauaagagcucuuacaggccuaggcuccaggugcuguggggaugcucaggaaaagguaucuaauugggauugggagcaggcaaaacaaauaaaggauaguguauaaagguaauaucuaguugaaguucugaagggcaaggaggagugagccuguauauucucugagucucucccuaaucugggauugacuucuuguccgucucuguucauauuaagugucaccuaggcuugaaagggugagaucauauuucacuuccuuccucuuuggucuuaaccuuucucugcuacccccucacacaaugcauaugcauuauucucuuauuguauauauuuuuccucucuuccuuuucauguuuccucugccauuacuuuuaaccucgacugccauauggccucuaaacgcuuccagaaggguagccuaguggagguuauuccaucauggccuugagcucaugcgaccagauagugaaggcaucuguguaggugucuucuccaggagggugauauuuguuucauuguaaauuuuguagcccuagaacaccaacaacagugcacaguaauuaguaggcaggcaguacaggauucauugaagugaagugauaacuuuuauccaaguauguaugcagauaaucuuugauuuguacaaaaaaaauuauauuuuaauauguaaagauuuuuuaaaagaaucuucaaguuuuagccuucccacuaggaauauauugaaaacaugugccuaguucacugacuugcagcugccacuaugagaauaaaggucucauuuaguuguugugaauuuuaagggauauuuucaaugauguuggcugguuuaucccauuauguggucuuuuuuuuuuuuuuuuuuuuuuuuugagguggagucucgcucugucacccaggcuggagugcaguggcgcaaucucgacucacugcaaccuccgccucccggguucaagcgauucugcugucucagccuccuaaguagcugggauuacaggcgccugccacuacgcccagcuaauuuuugguauuuuugguagagaaggguuucaccauguuggucaggcuggucucgaacuccugaccucaugauccacucacuucagccucccaaagugcugggauuacaggcgugagccaccaugcccagccuaugugcucuuauuagcaauucucaguacacagauagcuuugagugauucuuucaagucaaguaccuuauuaaaaaacucaaguguacugauaauuaucuuacuuuuaaauggcuaagugauaagacugaauuuuuagguacuguaacacuucagauuacagauucugauauuuuuaugguuauuuauauuuauuuauuuuugagauggaguuuugcucuugcugccuaggcuggagugcaauggcacgaucucggcucacugcaaccuccgccucccagguucaagcgauucuccugccucagccuccugaguagcugggauuacagucacccgccacuacagccggcuaauuuuuguuauuuuuaauagagacaauguuucaccauguuggccaggguggucucgcacuucugaccucuggcgauccgcccgccucggccucccaaagugcugggauuacaggcgugagccaccgcaccuggccugguuacuuaaauuuaaauacaaaaauuauguugauuaauucugaaugauuuccugauugcuccccguuuaccauucacacauuuauuaaauucuucgcuugccauauagaagcagucucucugccauauaugccauauagauaacagaacuagcugucugcaaaccacugaaauugugaaaacaucuccccuuuuuuccuguuucuaauucuagcuaugaggauuauauacagaaguaguccuggauuugauuuuuuuuuuuuuuugaugauuguuuuuugauaguuguugacuacaaaucauuuaaacgucugaaaggggaaagguuuuccuuaaaaauggaugacaaaggagaauaaaaagguauuuugacuauuuuuuugaaugaugaguuuuuuuuuucucuuucuuguuuucuuuuggagucauuuaugugucacugaguggauaccauggaacauguggcagaaguagauauaugggguaaaagaaccauaguucauaagcuccuugacagaaucacugaaguguagccguuauauggccacugucgcagggggaggcagcaguuuugaagaaggggaugaguaauaaugagugauaaaaaggcauccuggauagaagaccaaacucugcagaagaccccaguuugauuaugcuuuuguuuucugauuugcggaggagagugaaaaugccugaggggugcgggggagcacauaggguguaugugugugugugugcgcgugcagauucucucuuucacuguauguauuuguaugcauguauguaucuuaggacuuaagcuuucuagucaauaaauugccauaguggggaauugcuuaauugcuugccuucuguuguuguauuuaauuuaauuuuauuuuuaaugauuuuuuuggugggguacagggucuuaacuauguuguccaggcuggucuugaacuccuaaacucaagugauccucccgccucgggcucccaaaaugcugggauuacaggugugagccaccaugcccagcuuaguuguauuuuaaaugggccuguuugcagcauucccuacuccccuuaguuuaccuggcucacaaccugucuuuccauaucaaggcuucugucaccccuggcccaugucagugcauuugggcagcccacccagcaucaucaccucaugucccagggaacuuccuguuccucucuuccagcuauuuccuucccuggcaguugagauagucucuaccuuugaccuacuguuaagcucagaccuucugcucucuaguuacagccucugugcugccagauucccucgcucaguugcuuucucuaguuuggguuuucuccuuuauucagauuuccagcuguuucucuccuccccccaccgcagccuccucacuucccuccuuaugcaucugagacuguggucagucacuuuagaugcugccucuccacuguacuuguguccaucuucuuaccuaccaccucuagcccuggagcaggcucuuccccugucuuugucuuccugggcccaggcuccuaagcgcugcuggaaaaaaaaucccccaguauugagccccuagaaauccagucuuuaaucccaaaucugucucccccagcaucuggccaucagaucuaaagcuuaccugccauccuuuccaccucauuucucucacaggggaaaaggagccuuugcuccuagagucugcgcuccugaccccuucccaucucaccuguucaaggcaucuugcaauaagggguuggugacucucgaggaauggaucccaggcccucccuauuaucaucuuauguaugccaguucaacguucucagcuuccuccagccgagacggccccuccagccacugcuuuauacucuccuucucugguugaaauuuuugaaguaaauaggucacucugcccaucguucaucuuccagucacucuguguguuuaucuuccagggaagugaggcucuaugcuaccaagccacugaaauaauuuuuuuuuuuuuccagacugagucuugcucugucacccaggcuggagugcagugccgcagucuuggcucacugcaaccucugccucccggcuucaggcgauucuccugccccagccuccugaguagcugggauuacaggugccugucaucacgccuggcuaauuuuuuguauuuuugguagagauggggcuucaccauguuggccaggcuuguuggcauguugaccauguuggccaggcuagccucaagugauccacccgucagccucccaaagugcugagauuacaggugugagccaccgcaccuggccugaaauaauucuugacaagaucugcuuccuuguuacuaauacaguggauauuuugcauccuaauuuuaaugcaguucagugugguagaccuguauuugcauauugaauauucccuucccuguuuuaauaacucuauuuuuuccuuuucuuuuauaucuccugcuucucuagcuaguccuagaccuuacucaucggugucuucucuguuuguuccucaacuugaggaguuccuacaggguuuacccaaucugcugcuuucauuuagcccuuuuguucuuuuugagccaucucauucacucacccaggauguagcaucggcccuugaauucagugugcacacauacacugugcacuaugggacagccuucagaggcacuuuguuccugaaauugugguggucuuugccucucauggagccuugcauaugcuguuuccucugccuggaauauccuaccuuuuacuuaacugauucucguucuucuuuccagucacauuuuguacauuucuucugggaagcuuucucugauuuccccuuuccacagguccaaguuaacugccuugucuagguccucccauggcccucugaaggccuccuuucauagcaccaugucugaguauacuguaauaacacgcauugcucuguaauagccuguuuacuuaccuauugccaaguaaucuaucaagucuuauaaagggcggggcugcuuuuguucuagucauuuguaucucuuaguacccaauauaguguuuggcauauagaaaauacccaacaaggccagucgcaguggcucauaccuguaauccgagcacuuugguaggcugaggugggcggaucacuugaggucaggaguuugagaccagccuggccaacauggugaaacccugucucuacuaaaaauacaaaaauuagccaggcgugguggcgggugccuguagucccagcuacuugggaggcugaggcaggagaaucacuugaacuggggagguggagguugcagugagcugagaucacuccacugcacuccagccugggugacagagugagacuccaucuuaaaaaaaaaaaagacuccaucuuaaaaaaaaaaaaaaagaaaaaagaaagaaaauacccaauaaguaguuccugaaugaauagaugagaaugcuguuuagaagguucaugaauuggaaaccgugauugcuagggaggcuuugaguugaugguauuguguugaaccauguguuacccaggaucaauuuagauuuuacacuuuguuuucucuguuccuuuuuauaguaauuuucuguaugugguguuuuccccccaugagauuguauaccauuucucagcgagaacuguguguaaugcuugguggcucccucauggugccuugcauggaauuggacuucguuucaguggaucugaucccaguuauguuaaugcucgauggagcuaagucuuaucucgaagcaguccaugucuucaucagcuggcccugccuccaugcccugcacagaccaugccacucuggagagguaguuucccuguggcuuauuagucuuauguuccagugugcuggccaaguaugagagacaucagugguaugagagagucucucucauucaaacuucguagguuuuguagcugggacugaccagugcugacaggaaauagaggcauuuauuaaaagccagagauuuuucaaguugcaggaagcaaagcucuuguuagcuaugauuuugugguggguuugguaguccaauauaaaaguaaaaacuggaugacaaugggaggagcaugcuugggucuccaaaguuagaucauuuuuccuaaguaauuugucuuuaaacuuuuacugguuuggaauuuccugagauuuugaucuugccagaaaguuuauagcaaaaguucugagcagaugacacuuuugcgucugaaaccaaaucauuguuuuuguuuuuaacuuuuuucuuaauauauuauccuuaguucagcccugaagauuauucuguuauuuguggaucucaacuuuccccccaucuccuggaucuuugugaaaugaaugguauuaauugaauagagaaggaagauauaaacauaaacuuagucaaaaacuuguucuugacuaggcaaguugggcuuuauagcuuugagcugaugacaugucuauucuugugaaaaagggauuuuuaguguugguuuggcuucuuguuauauuugauuuauuauuauuaucauuaucauuauuuuugagacagagucuugcucugucgcccaggcuggagugcaguggcucaaucucggcucagugcaaccuccgccucccagguucaagcgauucucgugccucagccucuggaguagcugggauuacaggcgggugccacuacaccuggcuaauauuuguauuuuuaguagagacagguuucaccauguuggcuaggcuggucuugaacuccugaccucaggugauccaccugccuuggccucccaaagugcugggauuacaggccuuagccacugugccuggcugauuuuuuuuuuuuuuuuuuuuuuagguuuguuuuaacuggaacuuuacgugaauguaauugaauuuagaauaaaagcacuuaauuucacagugugcagugaacuuucuguuacuuauuuuaacaguaaaaccccuugcaguaaaugacuuggagcaaagauugcuuuuuuaaaaaauguuuuaauuuguuuuucuuuucuugagauggagucuugcucugucaccaggcuggaguaugguggcgcgaucuuggcucacugcagccuccccgccuccuagguucaagcgaaucuccugccucagccuccugaguagcugggacuacaggcacaugccaccaugcccagcuaauuuuuguauuuuuaguagagacaggguuucaccauguuggucaggauggucuugaucucuugaccccgugauccacccuccucggccucccaaagugcugggauuacaacugcugggauuacaagugcugggauuacaagcgugagccaccacgccuggccaauuuuuuuuuuuuuuuucuuuuugagacagaguuucacucugucacccaggcuggagugcagugucacagucaaaacucacuggcagccuuaaccuccugggcucgaaugauccuccugccucagccucccaaguaacugagacuacaggcauguaccacugugcccagcuaauuguuuuuuuauuuuuuauuuuuuguagggacagggucucgcuauuuugcccaggcuagucuacaacucuugggcucaagcaguccuccugccuugaccucccaaaauguugggauuacagggacaagccacugcaccuggccaaggauuguuuuuuaagugaacugagacccagccuuauuaguggucccagagcagaccugggaccugaagggaacccuuuucuucugguccagcgucuuuccucugaugggcuacuuuccuggagccuuugauugccugucaucagaguaacugaguuugaacagaguagguaguuccucuccagaccaccacacucaccagcuuucauucugcuucucucguuuagacugugguucugaauccucaguucuauuuacugaguguuuuuaaacauaaaaaugccuuuuaaugagauugaaggccagaggugggacaguugaggacaaaguagaaauaaaaccuucaaggcgggguuguuggugggagucuuuuuuuguuuguuuguuuuuugagacugagucucgcucugucacccaggcuggagugcaguggcacaaucucagcucacugcaaccuccgccucccgaguucaagcuauucuccugccucagccuccuuaguagcugggauuucaggcucccgccaccaugcccagcuaauuuuuguauuuuugguagaaacgggguuucaccauguuggccaggcuggucucaaacuccugaccucaggugaucugucugccucagccucccaaagugcugggauuacaggcgugagccacugugccuggcagggagucuuauagaagcugucguggacaaugugggaaguagugagccuuuguauuccaguaugcugggcuccacugugcuugcucuggcccccggucgcucucuguguguuauugaguccccauccacggccauacucuucguccugcuucucuccuuaccauccucuccccgcuagugguaccacggcuaccacuagcaauuacugacaugugggaucuuagggcuacuucccuauaaggcugcagggcaugugguguuggcuacgcgcaugguaaccaugguagcccugugguucuccacaugugcgccuugugaccugggauuggcugcagacuaguaauaaacugcgucuucugguauggaaucugucuguaguuguacuuucuaccucuguauuuaaggggagaucuguaaccuaccaaugccaguugaagaggauggaugauagagauguuaacaaacagcugaaaaacuaacuacaauggccugcaaaauagaacagcagguuuuuguggcaaaacuuuguguccaugaguuuguuuuuuaaauauccucauauaaucuguuuuaaaucgagaggcuuuggguaaaagccauggcuagucuuacaugucauggaguaccuagcuugugagguucacaguuuauuauuuacagaguguccccuuaaaucuucuuugggucgguucagcgaauguugcucagauggacuuuuuuggcugacauagagucaaaaugguaaucaagcaugaaaguacagacaguccuuaacgcacaaaugugucaugcuugaaaaguuggaaaguugguucucuggagcucugauuguauuguccuguagaauccguguugugaauggugguuaaaucccaaaugaguccguagaaccuauauaaucugcaauauaccugcaguauuccaauuaauauguaauucccccauagaacuauguuaaugauuuguauguaugguauuuaauauuauacauaauaaugauuguaugaauaaaaaacauucugggcuccauguggaugauggggugugugugugugucugucuauguguggguggguguguguucauagaucccuuuuccugcaauccuggcacuggaauugguuuuaucauuuccaauuaaguuucauucccaugaauuuuggaguacagacuggguccagguaugcagggcauagauuagagcccugagaaauaggauuaggcuggaauugcuggguuggagaucaguagcuuccaggaacacuuuuugggccuggcugucuucauuauccccuuuuguuuucuccuggggucugcagguauugcccuguuuuguuccucuaauaucacuuuuuuuuuuuuucugcuuuugaccaggguuuuugccucuggucuacaacugaauauccuaucagacucuccugauuuugaaauaaauauauaguuuuuuugagguguucuagcgaauuucuaaaucuaaauguuguggcagaguuauuacauacuaauuuugcuaugagagguuguagaaucccagaugacuaaucuuguaaaccauacacgcauuuccaucuaauucuccauuguauaucauguugcagaaaauaacagccucuagaguuuacauugccuccuuugacuauauuucuuauuuaagauuaguuuucagauaagaccuuuucauggcaguacauaacuguacagagggcuuccaacuugucuugggagcucucaucucugggagacaucacauuacccacugcccccugccccccgcccccagccuggaugcacucagccuguaccccauuucuguccucagccaaacacugcugaaaugcaagagcuuucaauugcuagccagugaagaugcagacuaagggauuuccauguagaagcccgcucuuuucagcuggcucgucgagagcuggaggccccuugcuuguucacaugaggcuuuuugucccugacuugguggcugcuguuucacuucucagcagaaagggacacccuugcccccccccagaaaggaagauuugauguaccacuuccgaaagguucagucgggcaucacuguaaccaagaagauaggucaggugaggcuggagguggaacagggcugcucgcuagaacuccagauuguuccacaagugccuucuggcagagaaugauggaagcuuccgugauuuuuuuuucuccuuaauaguuaugagcacagaagaggagcagauugucuggcuauagaagcugucuuauuuuuuauuuuuguuuuugagauggagucuuucucucuugcccaggcuaaagugcaauggcgcgaucucggcucacugcaaccuccgccucccgaguucaagcgauucuccugccucagccuccugaguagcugggaauuacaggcaugcgccaccaugccagacugauuuuuguauuagagacaggguuucaccauguuggucagucugguuucgaacuccugaccucaagaucugcccaccucagccucccaaaguguugggauuacagguguuagccacugcacccggccgaagcugucauauuaaauagcacuuucugcuuuuagcaaauuuaauccaaaugagacuuuagauuuucuugcucugacuuaccagcaguuccuugaaacacauuuaauuauuuuugccagaaaaucacucaagcacuuacgccauuuuuuuaccgugaaaauaugcugcauuauuuuaaaauauauuagaagucaguaaccauaagauuuuauauguuuucuaauguauucuguaagcuuucugcugcuuuuguuuggaagguguauuuuguaacguagaggacugcuuuaucugcuuguaagcuugauuuuuguuuuuacuguaauuuuuuuuucuuuugcuguauugagaaauacauugaguaauuauaaagucaguggcauguuuauaaguuaauauuuguaucuauuccuuaguuacucuaacucaaaaccuaaaguaaucuucaacucuaauuuacucugacauccaguugacugccaaguccuccaacuuaauccuuauccuuuuuuuuuuaaagagaugcagucuugcuuugucacccaggcuggagugcaguggugcaaucauagcuuacuguaaccucaaauuccugggcucaaaugauccucccacgucagccucuggaguagcuggggcuacaggcucuugcuaccaugcccagcuaacuuuuuauuuuuauuuuuuauagagacagagucucacuguugcucaggcuggccuugaacuccugccuucaggcggaacuccugccuucaggcgguccuccugcauuggccucccaaagugcuggaauuacaggcccaauuuuauucuugggauguaugucugaaacucuuuccuucacuuccuucccaagccuuaguucaggcccuucucaucuguggucuucaaagucgccuucagcugguucagguccuuccuuucugcuguaucuuucaugggaggacauguuauguaucacuguccuacuugaaaacuuccauuccccauugaugaggguguuaccuccagauuccuaacacaggugcugaaggcaugccuggauaaaggcacucccuugaucuccuggccagguccccguacaccugcagcgcaugcuccacauucugucuuuacugaugcugugucuucugccugcggagccacccaccauucuauucacagccccugccucagcggagcacgugccucccucuuccuacacugagcuguccuuucuauugaauccccucuuuuuuguaguaugggaaauauuuuauuaugaauacucuuuucucuguugccuccgugaccacguuaacuuugcccuaauucgccuuaggacuccaucugcuuaggggaaaguuaggauuugguuacagaaagcaagcugcuagaaagaacaguguuuagcuucugacaggcaaaauaggauuuugcaacaugcuuuuccuuuuuaaugcuuagacauuuuauaugaauuaauauuuuuauuugguugcuuauacauuacuuucuuuuuagcuagaaugugaacccuauaggaacauggggauugccuuucacaucuuuguauccucaguaccuaauguucagucacccuguggucuugugucguauauacauuuagccuuccuuaauuaaaccauauguacugguccccgucccccacccccaaauagagagaaagaaauuccuugaauacuacauugccaguaucaaaccacaccuugauauccucuggggaaagggagguaucaguugaaaagagaaaagagguuaaaaucuaggcauuaaaauguguaaggcuuagaugcuggcaauuuaagguauguuuuccugagguuaauuuugauugugugcaaauuuuaccucauaucuaacuguaggauuuagucaccacauaagaugggauaccuccauaaauccuucagaaauguuugugaaauuaaauaaagccuuauugaagacucagcucuugagagucaucuaccuaccuaacaguuauucuugaacagaagagucuuacuuuucccuauaaggcagugugauagccaucuguauauucauauaauuuauguuggcgcuuacuucauuuaaaaauguauuccgugaaugcaguugccaggcggugugcugaucagaaacguguaccaauggccucuuuuauaauuauaagaggaagaccaaccugaaacagucacacaaaugauuaauuuuaauuguggaggagugcugggaaagaaaaauaaaagaugcaaugcaaguguuuacaaaggagcuuugagcuuguuugaagugguccuugggcacuuaagcaaggcuuaaagaaugaugugauuagaaguggcuuagcaauucuaaagaacacagggaaggcguguggccagaacauuggucccuagagcacaucgccuccugacauaccauuuccuuaaguuaauguuuuaccacuauacauaggcccuccccuuuguuuacccagauuuuuuuaauuuuaaggauguuuuuaauaacuuagaauccuguaauuuguugaacaguccuguauucccuuuacuuauauuccuugagauuuuauaaaauauuuuuuacaugucccaagucuugauuauaucuuuuuaccucuuguuaagaaauacuuacuuuucuauuuuuaugcuauauuucauguuuacuguagaaaacaaaaaaaguaaaauuuuucuuuauuccuaucacugcagcuuauaagcacucuaaacauuuugaucuauauuuugccaaucauauauuuuaguuaaaauuguuguugacauaauuguagauuccugugcaguugaaagaaauaauacagagcugagcgcgguggcucacgccuguaaucccagcacuuugggaggccgaggcaggcagaucaugaggucaggaguuugagaccagacuggccaacauggcgaaacccugucucuacuaaaaauacaaaaauuagcugggugugguggcgggcaccuguaaucccagcuaguugggaggcugaggcaggagaaucguuugaacuccggaggcagagguugcagugagccgagaugguaccauuccacuccagccugggcaacaagagcaagacugcaucucaaaaauaauaauaauaauaauaaauaaacuuuaaaaauaaaacagagagaucccaugugcgcuuugccuaguucccccauccacugcccauaacauuuugcagaacugcaguacaguaucacaaccacaauacugacauugauacagucugcucaucuuauucauauuuccccaguguuacucguauccacguguguaugcauuguguuuucaauacucuuuuauuauaaagcuguuuuuaaugugauucaauucuagguuguuuuguucugcccucaaaaagcauucccucuccuaaucauaucuccgucauacccuuguauguuuucuuuaaaccuguuuuaagaaagcagcuaccuguaagagaaaugagauugaaaacagaauugccaaucugcuuguacuuuauaagccuguugauuguuuagauacgguuuagccaguuuauaguuacccugggugcugaaagguaugcuggaugauaccuaaccaacagagaaccauugaaugccguucaaaauggacugaagcaucagcaaugucugaaaaaggccugacaguaauguacaugucaaauggcccguaauuuaagcagaguagaguaaguagaagaauaaacauggggaaaguuccagcaacagaggaggcuuugagcuuuugcucuucaucuugaguggauguuguucucaggugguaauaggccaucgagcuuucuccacuggcugccucucuggggaacaaauaaccgaaaagauacucagcacccugguugguacauagguggucaguugauuuauacuuccugguuuucaguguugcuugaauuuucuaaauggaaacacaguaccuuuauaaucagaaaacaaucccgaguuuugauuugaggguguuguaaaaaguuaaaaaaaaaaaaacagaaaugugaaaaggaaguuguguuagaguauuuggaguugagaaagcaugaaaaggacagaagagaagcugguugucagguugcaugggguagcuacaagcacacugaccagaaagucagcuggaaaaaaaauguagaaacaggagauaaaacggccaaggggcuauacaagcaaacagcaaggaccugagaagaaaaacuaguuaggugugacugucagagugauguguacagugugauccuuucuguguaaaaacaagcaguaagaauucgcuguuuacguuugcguguguuuggagaagaguggggaagaguaggcacugccagacugugaacacugguuagguuauuguuauaucuuuguauuauauacacuggacauguuauuuguauaauaugagaagaaauuuuauaaaucauuaaaucuuuuggcauuuaggaacauuuguguuuucuaauaguugcuucuauacuauuaucuuuauuauaugcccuucaucuucucaguguuuggcuguuguugugauucccuuuugugagcaguguugaaguuagcuaauauucauuucuucucccuucuuucacccuccuccagagucugauuugaaguauuccuagcugcuaccuauaaaagcaauaagcaagauuguuuuacuuuucacaaacucguccuguucugugccucugccucggacauagcuguaguauagaguguugucucccuuacauccuucuaucuuagaccuacuaguaaauauuaaugcucacucuaaguucuucucaauucuuuuuuuuuuuuuuuuuuuuuuuuuugagaaagaguuucgcucuuguugcccaggcuggagugcaacggcacgauuucggcucaccgcaaccuccaccuucuggguuuaagcgacucuccugccucagccuccugaguagcugggauuacagucacgugccaccaccccuggcaaauuuuguauuuuuaguagagacaagguuucuuccauguuggccaggcuggucucaaacucccgaccucaggugauccaccugccucagccuuccaaagugcugggauuccaggcgugagccaccgcgcccagccucuucucucaauucuuccugaagcucuuucugcacuagauuccucaggaagggcuugugggaacaaucuucugugaaucaacaguacauauucauaauaguuugucagcagccuauuauuuuaaggccauuuggucuguauauaaaaauguuuggaucacauuuucuuucuuuaagguaaauauguuauucuguugucuucugguauaaagcauugcuguaaauguuugacagucuaauuaucuuuugcuuauaagugacuuaggguuuuuugucuaugugcccaaaggauuuuuucccucuuucucucuuuuuuuuuuuuuuuuuuuuuuuuuaaacagacaggaucucacccuguugcccaggcuuuagugcagugaggcagucagagcuuacugaaguuuugaacuccugggcuugaggaacaaaggauuuuuuuaaccuuuuaauucaaagucucaucauuuaugcaaccaugucuugguguuggcuguuuuggguuguucucccucaaaaauccaugugcucuuucaauauguaguuuuaaaucuuuuuuuuuuaauuucaggaaaaucuugaauuagaguuuuccguuuuucgucugguacauugcuuggguuuccuucuucaggaacucagccuguuauguguauguuugaucuucuuugccugucgucuguuucuuucacuuccucucacuuuuuuaaacuucauuuauuaaaaaaaaauuuuuuuuucgagacagaguuucgcucuuguugcccaggcuggagugcaauggcgugaucucggcucacugcaaccuccgccucccagguucaagugauucuccugccucagucucccaaguagcugggauuacaggcaugcgccaccacgcccagcuaauuuuuuguauuuuuaguagagacaggguuucuccauguuggucaggcuggucuugaacuccugaccucgugaucugcccgccucagccucccaaagugcugggauuacaggcgugagccacugugcccagccuuauuaaaaauuuuaaaaacauacauuuaaacuuaacagaaaaauuaugagagagaaggggguggugccaggcuuuuuuaaacaaccagcucuuacaugaacucauagagugauaacucauuaccaugaggacggcaucaagccguucaugaaggaucuggccccgugacccagacaccuccuacuagguccauuuuuaacauuggggaucacauuucaacgugagauuuggagggggcaaaacuacaaaccaugucacucagggauuggaggagcaaguaccaccuauacuuuggacucagguagaaaggcaaaauauccaggaaauaagcugcuaccguccaggguucagcagaggugcccaucagccugccaaguacucaagaguccagccucuagggagcuaaucaucauggugagcucuucgaggcacagggagcugggaagacagugcuugccaccccugccugaauaguguuugcacagagaguucuguugugucuugauuggguccuccugccacugggaaugcuguggauuauacuaggucucuaucuggcuuguuucagggcuccaugugaaaaccuucuugauauccuagccauccaccugcucagucccuaguuugcaaggaggcuguggggagccuagauucugugucagauagaauguacuacauuccgucucaggaauguaccacaucagaaaacagugcgaccugcaggagaaguagaggugaagaggcacauucuuccgagaaauguuucucucaacacccagcauucccuggauaucagcaggaaauuacucacugcuagaaaaugccccaugagccuucuguuaaggaggucaagggagagaacagagaaaguucucaaaguugacuuggucacugguacuuucuuaugcgguucuuauuuuguuugccaucgucaucaucaugcuaugucuauuuucucaauccaaauccacugcuuucaccuugguucuuucugaccgguuuggcacacucauucaguaaauccuuauggagagcccaaugucugcauaauugugcugugcugaugaccaagcuagaccuacgagugucggcuccuuugagauguacgggacagcucuucugucaucucuucugggaagccucuccaggcuuggugaacaguggcaagauguuuaacaguuguacaugugucccauguuccuuucuaagagccugggcaaaccagacccggucgcaggucaucguaguauggcgugagcuuccucucuccuuucugaccuuuugugugauggcaagaaccugcagagugacacaagcagcaggcuucugagguugcucuagccucagaauggccgucccuucuccacccuggcccucauugcugagguuuccuuugaagcaacagugccggaacagacuaggggaagcagcuuggacauagcuguaugauuuauuaccacccauugaggccaaccaaagucggcaaggagagguagcaggucaguggugccuggaagcuuccucuuuccuuugcaccagaugugacugcucugcaauuacuccuaaauuugcuacucucguuuuuacuagccaaccuugauguuuuucccuucuuccuguagaauagacuuccccucugaucaguacuuucuacucaacacuauuuguggccacagugggaacucauugaggacagggaccaugacauuacuaccugacccaucaacacuuggcauaacuugaaaugcaaggacaaaaauuggcugcaaguacaauguggucuucacucugaaggugauccuuaaaacuuggcuuuggcaucauauugccuuaauauaccuaggggauuggguaaaaccaguuacuuuaaaagaguuuuacaauucuggccuucuagcuaucuugucuucuuaaacaagagcacaagaugaauguaucuuagugaaauuuuauaugguuugcuuugaguaaucuugcgaagauugauuuuuagcacaguaggaaagacacauucuaauagugauuuuuuuccccgaguuuauguacugcuguugcaugaaaaucugacuagauuuaauguuccuaaaguucuuuguucauccugauuuuugcagguccuagggaaagcuuuguuuuccucuuaaccuaacuuagauguugucauuucaugagcuuuggaggaagaguguauagccaauuguguaaugucuuuaaaggauauuaucucugcaauaguuguuuauaaggccuaaguuauucauguaauaauaguggccccggaucuguuucuagcaauagguauauggauuuugguuccuauauaguuguaguuguggcuuugagauauugagcaagcccuuuuaagaaaggauuuggcaucccucagccuucaaaagcuucucaaaauugaucauauguuauuagcaaagguuuacugccugcuuccauuguauagacaauuuauuuuuuauguauuccguucuaagaaggcagaugaccaaaagaucuugcaucuguugcccaaggcuugugacuagagaggaaagagauaagaauacuuuuuuaaaaucccauuuuacuaaauauguugaggaagugguaagauauauuaauuuguugagauuuuucuguuaugccuauuauaugaaauagguacucugaacauggcuucuuaauuaaauauauuugauaaaauacaacuugcuuccccuggaguuuagaagucagauaacugccauggagagcuaugcuuucuuuguuuuaaagaucugcuuaugaacaugauaaacaggaacaauuuaauguuuucaauauuuucuuguauuuuacugcaaguuuauacacaacauaaauaugggggaagggggaaauguuuauaccagagccauccugcccauucuuuccuuacagaaggacaaaggagcaguauuuauuuuaacuacaaaaauacuauuguagguuuuaaaaauuccguauauuuugauaucuuguguuccucuugaccuuuaauuugcuaaauaguugcaaagaaugaagguaaccugcaucaucuucuuaaaaaccaacucuaucuaauuauaauaguuugucuaucucugaaaaauagugauguguucauucugaaaucagaacuaccggaugcagcugcauuuuguuacuauuugaauuucgggagagggaggaggaugcagccuuucgagcugcugaaauacacaaacacaaagaagacaccaagcauaguagaacuguguuaagcugaccaagccagaagaagcaccuauucucagcauaguaugagacguaaaggcaauauaaugggcauaguugaagaugguagaaggaaaauagacucugaugguuuaauguuaaaugcuuuuuuuaaaaaagugguauuccaauaucgaagaagaagacuuucuacuuuuagaagcaauaaaggaaauugcagaggaaagggucaauagguuggaauacauaaaaauuaaaaacuuuuaaacuuuuuuuuuuugagacagagucucacucugucacccaggcuggagugcaauggugcaaucucggcucgcuacaaccuccgcuuccugaguucaagcaauucuccugccucagccucccgaguagcugggauuacaggcaugggccaccacuccuggcuaauauuuguauuuuuaguagagacaggguuucaccauguuguccaggcugaucucaaacuccugaccucgugauccgccugccucggccucccaaagugcugggauuacaggcaugagccaccgcgccuggacuaaauuguuucaguauuaauuuuuuuuaaaacaagaucuuacuguugcccaggcugaaguacaguggcccaaucauggcuaacugcagccuugacuucugggccucaagggauccucccaccucagcgucccgaguagcugggaccacagacauguaccaccacacccagcuacuuguuuuauuuuuauuuuuguagagaugagguuucaccauguugcccaggcuggucucgaacuccugggcccaagcaauccuccucccuuggccucccaaagugcugguauuacagguguaagccauugcgcccugccugauuuuuuaaaugugcaaacagauaaguuggaaaagugauuuccaauaaagauaaagaguugaugguuuuaaaauacguaaagagcuuauaugaaugagaaaaacacuaacauuccaaaagauuagaaggcaaaggacagaaagaaacaaaucacuaugucugggaagggacaugaaggagcagguucccacugggccagcggggcucaaacccacuggggacguccgagagacugcaagggccaugccuucacauugccguaccugagaagcaaggagcugggguauuuaucucuuucacacuuugggaggcugaggugggcggaucaccugaggucaggaguucgagacuagccuggccaacacagugaaaccccgucucuacuaaaacuagaaauaauuagcugggugugguggcacacaccuguaaucccagcuacuuggaaggcugaggcaugagaauugcuugagcccaggagguagaggcugcagugagcauaaauugcaccacugcacuccagccugggugaaacucugucucaaaaaguaauaauaaucaugauaaauaaaauaacauuagauuguuagcagaaguagccacagguuucucccaccucucugcaaguugcugagugugauucccaucaagagguacaaugucuuuuuauuuuuauuuuauuuauuuuauuuauauugccuauguugucuaggcugguuccaaacuccugagcucaagugauccuucuacgucagccccccaaaguguugggauuacaggcaucagccacugcaccuggcccagauacuuuuucuugaguaggaauuucgagucacccugaacauugcaugccuucguaguggggaagacaauaggaaaccacaggcuguaggcuaaaauggguuguguuucuuguaacgucaugacaaggcauaacccaucuuggcauaguaaauaguaagcacucacugaacugaugauuuuaaaucuuugcuguuuauucagcaauauccuaaauuagcgcuauguuaguggaguugcaucucccucauggauuagucugaaaaagaugagaaaucuguauguagaccaaguuauccuuaaacugcucauaauguaugaugcacgugguuuuacguguacagccugguaccauuguucuuaggcacauuucagugccagaacucuuaauacccaggaagaagcaaaaagaaagauggaggugcagcuagagguuguggccuuugaacgauucauucugccuuaauaagaguggucuggcugagcucgguggcucacaccuguaaucccagcacuuugggaggccaaggcaggcagaucgcuugagcccaggaguucaagaccagcccaggcagcauagcgagacccccccuccccccgucucuacaaaaaaauagaaacaaugagccaggcaugguggaacguagugcguggugccuguagucucagcuacccaguuggcugaggugggaggaucaccugagcccuagaagucgaggcuucagugagcccuuauugugccacugcacuccacucuaggugacagagcgagacagguccugucucgaaaagaaagaagaagaauuaaaaaaagugauuagaucccuuguguuugggacacuuguuggcagcagggaugguagcguuuaugaggguugcauguaacaucgccuagcucagacaucuguuugacugucuuccccccugaagcgcaggcucugugagggcaggucuuuugucuuucuuguuaaucuucauaugcuuagugcuugccacauaguugaugcucagucgauauuuggaugaauugaagggauuaaugcauugaaucugaaccuugcuuucuuaaugcauauggggaguucuuuggaaagccacacagaggagcuugguugccugcuuccucucuuccccagauugucuuuuuauuguuguggcuucacugaagcacucucacuucaaauaauuuugggcauuggucguauuuuauucuuuguuccuucuucauccuuaccccucagaugguauguagaaaaguacacuacaucuagaaaguacuuuauaaacucauuugguugauaauaauacauaugccuuuuccuugguccugguagcagaaucuugugccacucuuggaauacaaacgaaauucuuaaccaaagccaguuucauuuugauguucuauuuuccucccauucacacuccaaauugugcaccaaaguaucauccuaguuuugugaggaugguucuccauacuucaggguaggaguaucauguggauuccuaugauaccuuucucccugggaccauggagggcagcagcuggugauugauagucugauucccggugaggaaagcugugagccuuccacuugcagaugucugccaacuacauguguccuuagucaacuguaccacuguccuccggcaaacagcagaagcccagggccugaaguucuuaagcugucauuauggaaagcagaagguaaacaaaacagaagugaaaguagauuuaauuuuuuagacuguucucuuacaggaaugguuuugugguucucagcauuuuaaaaaaaauagugguuccaauauguuuuauugacaucaauuacuguaagucugauucauuuucugccuauugauuucuacccaaggugaaauucaugacauuuaacagaaagcauaagugauuuuuuaaaagcagacacuauuagggacgguaaaaauaagauuuaaagucgggacacuugaaaaagcaauuuuuauaccuuugguaacgauucuauucugauucuuuguauaaauaauauaaacaaaggcucuagaagcuuacuauaaugaaguuggugugcuguuucuaaauucugguuuaaggcccaaauucauuuuaucugcauuaacuuuuuuuuuuuugagagucucgcucugucacccaggcuagagugcaaugguaugaucucggcucacugcaaccucugccucccggguucaagcgauucuccugccucagccucccgaguagcugggauuauaggugugcgccaccacgcccggcuaauuuuuguauuuuuaguagagacgggguuucacuaugcuggucaggcuggucucaaacuccugaccuugugauccgccugccucggccucccaaagugcugggauuacaggcgugagccacugcacccggccguguuaaaauuuuucagugguagaccacuaugucaauauguugcuuucacugacaacaguauuuucuuaaagauaggauaccccauuucuagaugaaucucauucuagcuggaaaauaauuuuucaguucugaaacuacaucaggccucagggaaucaaaacuagcuauuagccacacacauauaaaguggcuuugcuuuauaaacgauuuagggucaccaucaaugacaauggucccuuuuuauuguauuuuuaagaguuucuuaucuuaaauggcugcauaacuguagaguuuuaaaaaaauuaaguaaaugaccauguuaaugcucuauuaagcuuccaaacaauauuguaauuuacuuugaagauuuuuuuuuauucucaacauccugcagcuugaccguuugccuccgugucucagugcugcuuauuuugagguguggacuggaguccaucugucccccuugccucugaacugcuccguuuuguguuucguaauucuucaugcugcauccugggcgcauuucucuguaguagcuuucaauuugcucaugcuuugacugggcuuagucuagcguuuauccuaucucuuaagguuuuuuaaaaaauuuucaugauuauucauuuauuuccaggauuucucauuucuucagucacaucuccuuguucugguuuuacuucuuccuguuuuuauucauaacaucuuuuuuauacacgauuccuucauguauuucuaaucuuaaguauauuuaauugcuuauuugauucuuuuuuuuuuuuauugagacagggucuuacucugccaccaggccggagugcagugacauagucauagcucacugcagccucaacuacuuggacucaagcgaccuucccaccucagccucccagguagcuaggaauacaggugugagagccgccacacccagcugauuugucuuacuauguugcccaggcuggucuugaauuccugggcucaugugaucugcccuucuuggccuccugaagugcugagauuauaggugugaaccacugcaccuggccaaguauguuuauuuauuuauucuaauuugagagggagucucgcucugucgugcccaggcuguagugcaguggcacaaucccagcucacugcaaccucugccuccuggguucaugcgauucucuugccucagccuccugaguaccugggguuacaguugcgugccaccacaccuagcuaauuuuuguguuuuuaguacaggcgggguuuuacccuguuggccaggcuggucuugaacuugugaccugaagugauccgcccgccuuggccucccaaagugcugggauuacaggcaugagccaccacgcuuggcccaaguauguuuauuuuuaaaguccccaacaagcuauacaauaaauugcauauggaauggauuuuuguucuaguugauuuguugguuaucauuuguagaacuaacuaguugucuucuguguuugauaccuugcuucuaggucauuuugaguugggagccuuuuguuuuguuuuuauucucaugcuguuuuugagccuagcugugccuuuaugguuuucucuaaauuuaauugaccauuguuuuauauuuggagcaguggguguacaucagagugugaaagcagccccacccucuccaccagaaggucuccaugccaguuucacgaagcauuuuucaugcccucauuccugcccuuaucccuugauuuguggggaguuuguaaagcaguugauuguuuuuuuuccacguaguuuuccaagugcacauaauuguucuguuagugacuuguagcuccauuaucuauuaaccuugccccagaccacuguacaagcggacccaacgcuuccuccagcuguggcagggacaguuacuugguauccugcugccuuuucaaugcugaccaguuuugccccuuccuccccucaaccccugucuuucauucaacuaucaccaaaccaaaagauucugguuugcuuuuuaguauguguucuuauucaguacauagucauuuuaaaauuuaaaccaaaacagacuugguacugauuagcuuaauuuuaagcuuuuucuuuauuauuaaacaguguaguuuaucuuagcauuucauauuaaguauaugauuuauuucauauugcuuauaugaauguacacauaaauauaauaaaaauauuuuccuaagguuuuuguaguaaauuauaucguuucauuaacuuucauauauagcauugcuuuugaccuggaagacauugaaccucugaugauuuguauauuccucggaguauacuuuguuacauagaaauuuucucauuuauaaugagauuugugauuaacaaaauuuguucaacaugcauuacuuugaagaucugguuucuaaaauuuuaugcuaguuaccccacccccccuucuauauauaucucccuauucagcgacuacugcaagaguuccaggaaauguacacuguguguucacuuacugcauuuuaaaucauugccuuuacuauauuucugcauuucccuucaaucuagcucugucuguacauuucugaaagccaguagcuucccugaagaaccagguaacaacccgaacaaucaaauuagauaaccauuuguagaauggagguuccgggagaucuuagaagaugugaugggugcuaagggacuuuguaguucccugaaguuccagugaguaaaagguacccuuggaauuuuuuauuccuucagacuuuuaaaacagagaucacuuucaaaaauuacucuuucugcuuugaauccauguuuuaguaacuauuuugacacuguuuggucagaaggcugugugggucaacugcaaauaaauaaaauaaaugugauuucaguaauuuccauuuuguaacaaguaauugagaaaauaggauuggaucagauauuugcuuauacacauucccuuucaggagcacuucuguucuauaaagaauguugguauauuguuaaggacacuucaagcuuugggaaccuuugaaguauccauugauucaguuaacaaaauuauguugagugccuacccugggccugggccuguguuaggaggggacacuaagaugagaguccaaagcacuucuucucagacuccuggcugcuaauggguugcugccucuacuucuucacuuagcagauagcuuuaaaaugaguaaugcauuuuaccauggagcccguaagagacauucacccaguuguggaccgaggagaaggguguuaaacccagauugugauguuucacuugaugaagugcuuaauauaaacauggaaauauuuccgcaaggauaaacuggcuuuuaugccuguguguuuucaggagaaauagaaaucucuaaucaaauauugccagcuuuucacccaaguuugacuuuuugccuaauugaguuugggaggugucugaauaauggauaaugagcuuuccugaauaaauauaaaaauuaauuaacuccaggcucuaauucauucuguuaccagaguuuuguaagcauguuaccccuuuguguucauugggagaucaucuguuaccuucuuaaaugaguggggaaggaugggaaaugaggaagagcuauaaaaacuauucaggugaagaagguuucugccccuccuugccccuuuuaaaaucuccagcucagcagaugcuuuguuuaaacuugaucaagugcuugugaaucuuccuagccuagcuaaaucauaacuuuggaaggacuugcuuuuuucucucaugacaaugguuuaccacagaaaugauucagaucacuuugugugccugaugccuauguaaaaugauacagugaaauggaaaccauuuaccuguaagcuuugggcacacccaagccugcuucaggagcacaugaucaggcgugcacucugggagagccguacacauuugacaucuaugauguguggcguuuuauucuaucacauuucugaaaucuacacuaagagaaaggaggcucuuaaaaaaccacugagguguggacugggggaaggagagauccguaaagaaccuguuuguuaccuguugauacuauuucccauugguaaaauuucuaauuuagugugauccagcccugaaaugcugaggcacacacugaaugacuccugacaucuuuaguguuuuuguucaggggacucuucugggaaucuguuucauggcaaguuuauuauucccuuuugguuuggcucaucaguuuacccagcagucaucuuaaucgguuuuaaaggcuuuuauuuuauuuuguuuucucuguggaaauuuuacacauucaguagauuagaaguaguuauuuaaucuuugguuagcauaauaaaagaucuucuagggacauuuuuugcuugcaguggaaggcuaguuaaauguguucauuagucaugaaucugcuuuuucuauagcuguuggaaacguagcuccccugugauacaguuguagaauacagaaaucucguuuugcuguuacgguacgguagucuacuuacuuucuuccaaaccauuaauguuauaguuaccuuuaauugcguagguccuaucaccccucaauuuuaagacucuaagccuggcauuuuaucuuacaaaaugaaauauaaagacuuguacucagaguauguguguguuuuccauauaccauucuaaaguagagaaagaugagggauucgccagaaacugauuucuaauaaauuauccagaaacugaccccuucucaccucuucuguuacugucacugugguuucagccacagcauccuuugcugcauuguuaccuuaguuuccugacuguauccuuccuuacaccauugaucccugcaaucccaucugcgcguagcagccagaagggauccacuuacugcugugaucagaaauccucagccaggugcaguggcucaugccuguaaucucagcacuaugggaggcugagacuggagaauuauuugagcccaggaguuugagaccagccucaaacuggguaauauaaugagaccucaucucuacaaacaggaaaaaaaaaauuuuuuuuuuuuuuuuaacuagccagguauagugcuaauauaccuguucugggauccagcaugcucucccugaccugcagcuucaucuccaccacuuugccccucacucccaccacaauggcuuucuucucuuccucagacaugccgugcguccuccuaccuggaauauuccccuccaaacauucccauggcucacucccucaccuucaucagaucucuguuccagugucacuuuuacuggaaggucuuuugugaccauccuacuuauuauaaaaaaauaaucugcccaaccuucuccuuuuauuuccucuacuugauuuuucaauuuaguacuuaucagcugacauauauuuugucucucugucucucucugucucucauagaagguaaauucuauaaaggaaggaauuuuuauguuugguucuuugcuguagcuccaauauucaaaacagugccugacacacaguaggcccuuuauauuuguugaauaaauguugacacucugauaucuaauuuuugucuggugacuaauacgaaaacuauagagugauaauaaaagcauuaccuuaguagacuggaaagggaugagcgcuaggaugaacuuucugccuggcgaucuugcugaauuuaggaggcagauugggguucaaaggaggcugaaauggcuaggauuugcagagcaggguacuaaggaugagcaggcuaugacagaaagaacuccagaaaucugcaaagggaucaccuugagucuggcuggauacaguguacacuuuguagggugucucuucaugagcuuggauaaagaacaacuguuggggaguggauaauucccagcacucauucaagcuugcaucggccagaacggagagagacagaccucuguaauacguaggauauuugguagaaacauucaaccgaaaaccaucagauaugcaaaaaguaauaauaauaaguaaacaaugugaugcauagcuagaagaaaaaucagacauuagaagcaagcccagaaaugacagaugauaaauuagcagauaaggacauuaaaacagcuauuauaaauaacuuagcagauuuaaagaaaaacaacauaaugaggauaauggaagaaaaacaaccgaauaccauuucuaaagaagaaaaauacaauaucugaaaugagaauuuagcuggauaggauuaauaguuuaggcacugcagaagaaaaaaacagcaucuauaugagaauauacccaagggaaguacagagaggaaaaaaauguggauuggggggugccucagugacauauggaacaauauuaaacaagucugcccccaaaauacuugaaggaauaagguucaaguuuuuuccagguuuaaugaaaacuauaagccuacagauucaagcauuucaacaaaccuucagcaaaauaaacaaaaccacaguaggccuggcacacugucucaugccugcaaucccagcacuuugggagccugagucaggaggauugcuugagaucugcuugggcaacauagccagacccugucucuacaaaaaauaaaaugaaauaaauuagcuggauguggagguccacaccuguaacucuagcuagccuggaggcuaagaagggaggauugccugagcccaguaguucaaggcuggagugagcuaggacugcaucacugcacuccagccuaggcaacagcaagaccacaucucucucucucucucucucucucucucaaaaggcagugaaauaacgacuuauuuggggaaaaaauaaaggcagagaauuuguugccagcagacuagcauaaaaaaaaggaaguccuugaaacagaagagaaaugauaaaagauggaaauuuggauauauacuaaagaaugaggauugcuaaaagugacauacauagauaaauaugaaauauauuuuuauuuuaaaauuuauuuaaagcaaaaauaaaaauacaucauauuuauaacauagaaauaaaaaauguaugauaauagcauaaaggauaaguggacaaaugcuguugucguauuuuugguaaaaugcacuauuauuugaaaguagaccaucgugaauucgaugcauauuguaaaccaaauagaacacuaaaaaaugaaaauaaagagauauggcuaaugugccaaugguggagauaagauagaugcaaaaaaagaaaaacauucaaaagaaggcagagacagaggaaaaaaggaccaaagaucaaaugagucaaauagaaagcagcuaaacuagcaauauggcagauuuaaaucuagccaugucaauaguuauauuaaauguaaauguucuaaauaccugaauuaaaggaugaagauugucagauuagauugaaaaagcaugacccaacuacaugcugucuguaagaaauuagaaaaagaacaaauuaaauccaaaguaagaagaaaggaaauagaguagaaguuagugaaguauaaaacaaagagcaaagaaaaucaauuaaaugaaaagcugguucuuuguaaagaucaguaaaauugauaaauuucuagcuaaacuggccaagaaaaaagaaaagacauacaaauuaacaguaucaggaagaaaaacagagaauucaaaggaguguaaugcaaacuuuaugcuaguaaaugcaauaaguuagaugguauggaaaaaaaugugaacaauacaaagcagacugugguugccuuugguggcaguagcggggugggaguggaagguugaauugacuggaaccagaagcacaagugaacuuuuuggggugauggaaauguuuuguaucuugguugcauugauaguuaaaugguuguagacauugcuuaaaacucacugaacacuuaaguggguauguuuuauuauuuguaaaauauaccucaaaagcaguuuuaaaaauguauucaaguacauacuuaagaucuuugcauuuuacucugaguauaccuuaauuuuaaaaucuguuuuuuaaaaaguauuauguagauaccuuuuauuuucccaaugucuuuauuaaaugacaucuccacguuuugcuucuuaccucuauuuuuuuuuuuuuauuucucugucucucaggcaugcacacacacacaccaaaaaaaguacauaugcauaauccuuuuggcugaauaaaaucaguugcaacuguuauuucggcccuuauuugcuccggguaaauauucguuagcugagugguuuaucuguaucagauauuucuuacaucuucauccagucacaccagcuggacugaccagauuguuuuucacuucaagggcagaauuuguacucacugcugaaugcuuccaaaugauacguagaauaacaaauuuaagacuuagauuuuuacuuuuucaggucuuuuuuuuuuuuucugugcuguauagcauuucccugaaagcuuaaucucaucuguaagugaugcaguggauguguuacuauuggauuaauuuauuuacucuuagguagguuuguaaucugucaucaugcuguuguuuuuuuguguggguuuguuuuugguuuugagacagggucucacucugcugcccaggcuggagaggcuagagugcagugauguguuuaugggucacugcagauucaaucuccugggcucaagugaucuuccugccucaaccccuuguguagauggaagcacaggugcacgccaccacacccggcuauuuuuuuaaauguauuguagagacgaggcaucauuuuuuugcccaaggcugaucuugaacuccugggcucaaacaauccucccaccucggcucccaaagugcugggauuacagaugugaaccaccacucgagcuccaucauucuguuauuaguuguucucuaguaugagucaaaaacucuuaccugcccuuuuacaguuuuauaaauaaguaagcagaauagcagaauguggacauuuuuuaaauccaaauugaauaugcacaugacucaaggagucaaauaguaccguaaucgguuuaugauaaaauccagugguuuggcugggugucguggcucacacuuguaaucccagcaccuugggaggcugaggcagguggaucaccugaagucaggaguuugagaccagucugaccuacauggugaaacuacuaaaauacaaaauuagcugggcaugguggugcaugccuguaaucccagcuacuugggaggcugaggcaggagaauugcuucaacccgggaggcagagguuguggugagccgauaucgcauuauuucagaacaauuuuccacaagaucagugagugcuguccaauagacauauaauacaacccacauacaugacuuuacauuuucuuguagccauaguagaaaaggucaaaagaagcagaugaaauuaauagccugggcaacaagagcaaaaccccaucuuuuaaaaaauaaaauaaaauauggugguuugcuguccccaccucagaccauuucucuggucuuucucauugaccaccacucccaaucuuuguucugcugauugauuacagcuuguauauaucuccauauuucuaagcaaaauguuuaucuuuuuuaaauuuauaaauucuuuuuauuauuuuucagagacagggucuuaacucugucgcccaggcuggaguacaguggcaccaucguagcucacuguagccucgaacuccugggcucaagcagucuuccugccuccgccucucagguagcugagacuacgcuacaggcacauaccaccaugcccagcucaaaauguuuaucuuuugauacauuauucgagaccauuauuaagguggaugauuuaguuuucuuaaacagccauccccuuucuuuuccuccccucugcuucaccgcccccauuuucccaauguuuuaccuuuugguuaaaucaguacucauuguuuacauuauuugccucugcacauagucacagauaguauuguacuguacuguacuguguuucuuuuuuaaacauuauuucuguuguuaauaauugacuuuuuaauuuuuuuccuauuuuguuuuuuaaagagauggggucuuacuauauugcccaggcuagaguucaguggcucuucgcgggcaugaucccacugcugaucaguacaggaauuuccaccugcuccauuuccaaccuggaccaguucaccccuucuuaggcaaccugguggucccccauucccgggaggucagcauauugaugccaaacuuagugcggacacccgaucggcauaacgcaugcagcccaggacuccugggcucaagcaguccucccgggcucaagcaguccucccaccuaagccucccgcguagcugagacuacagacacuugccaccacaccagguuaauuuuuguguuuuuuguagaggugggguuuugccauguuguccagacucaucucaaacuucucagcucaagugagccuccugccucagcuucccaaguagcugggauuauagacgcaugccaccacaccccaugauaauugccuuuuuuuuuaauuugcauaauuuucuuuguagcuuuugcuaauguucccauaucuucuuauagccuuacagaaugauuuuccacaagaucagugagugcuguccaguagacauauaauacaacccacauacaugauuuuaccuuuuuuuguagccauaguaaaaaaggucaaaagaagcagaugaaauuaauaguaucuuuuacuuaacccaguucauucaaaauguuauuucaauaaauggucaauauuuaaaauacuugagauauuuugcuuuuauuuauuucuuuuguuacuaagucuucaaaauccaauguguauuuuacacuuacagaacaucucuuuuuagacuggccacauguagcucaggguuacuguauuggacagagugguuucaguuucaaguuuuuccuuggagacauccuacuugaaauuuccauucuccauguaucugggugguuggucuauagacuugccacucacagcugucaucuugagacuuucuuugcuuuucuucucuauuggauauucaguuuccuggauuucaggucuucucauuuuccucuaguaguuuuguuaggucaugguugguauggcaugguugggauagcguguucacacagcuaucucgugagucauacuccuccaauccagccugcucgcuucccgugucugucauguaguugucacccugcuaucucucccuccaguuuuugcagaaauuuccuuugucuucacucuuggucuuccucucccaucccccauguauccuauaucuuucucuuucuugguuuauuucaucacucagguggaaaagaugcuccaguggauuacugggaaaagggggagcauggaugauaaagguauugagaccuuacacgucagggaauuuuuuuuuuuuuuuuuuuuugagacggaguuuugcucuuguccagguuggagugcaguggcgccaacucggcucacugcaaccuccaccuccuggguucaagugauucuccugccucagccuccugaguagcugggauuacaggugcccgccaccacgcccagcuaauuuuuuguauuuuuaauagagacgagguuucacuguguuggccaggcuggucuugaacuccuacuucaggcaauccacccaccucggaauguuuuuauugucccuucucauuucaugacugcugggcuagguauagaauuccagaaucauuguucuuagaaucucgaaggcauugcuucauugcuggccagcuuucaguguucuugcaaagucugaagcugugcuaaucaccucauccuuugaaagugaacuguuuuuucuucccagaaacuuacagaacauucucuuuguccgcagaauucugggauugcaauuacugugccuuagaaugggucuguuuuuaucauuaugaagaguacuggaugggucgggagguuuucuugaauuacuucuugauguuuucuuuccuuguauuuuuuuguuugcuaauuuucuauuuuuuuuucuugguuuacuuucuugggcagggggauuucuucuacuuauauuugauucuucaguugagcuugucauuuuugcuaucuuguuuuuaaguuucgagagacaucuuuguuuuauauaacauucuguucuuaauacauagaugcaagaucuuuucuuucugaguauauuaauauguauuugaaaucuuucuauucucugcaguuuguuucccccaaggguuuuuuuuuuuuucugguuuuuguuuuuuguuuuuauguuagagacuuuccuguuauaucuggucaucagugguaccugcaugugguggagaguaggggcuuauuggaguaugagaaccuugagcagguguaaggagccugucaacacugcgcuggccucagggccucuagggaggcugccaguugugcauucugaggauaccuuuugguugugccuuuugucuggucagauuaucuagagaugcucugccuccuaccuggaggagaagggucuagcugccagcggugugagugucucuuggggaaaaggacucgaguuccugguguuuggcuuguguauggccgcuuaccccauuuuugguggagcgcucacaucuuccacugugccaacagucuugcugcaguucauagaccuucugguuuacauuuuuccagaaaguaugucuuuagauuucugcagaagucugaggagcauggaaggagcuuggggaaugagauggcaauccaggucuucccagauggcucuaccuuuauccccugcagggaaucccacuccuccuuccugacugggagcacagccagagccuugggaggaaucuggaguggaaaucucgggcggucuggcuuucuuacuguucacuuguaauuuugcuuucucacaacugccaaccacuaaucagccugauuuccagcuuccagaauucuauugcuguugucugcucuccuauucccaccguaggggauggggcugucuuuuuuuuuuuuuuuaauuuugguaaaacauacaaaacauaaaguguuccauuuuagccauuuuuagguacacaguucaguggcaguaaguacauucacguuguguguauuuguuuuuuuaguaauaaacaauauaaaauuuuuuaaguaauaaaacacaaauaaaagauuguuuaaugugauuaucguggaauuuuaggugugaucaggagccaugguguagucuucuguugaaacagggugauaggauuuguuuaccaccuccuaggaaagcaguuggauaguuuguuggcauaaaaguacauuuuaucuauuuuuaauaaucguagcuuuauagaaauugcaguuggaacucccaggccuggcauucaaggcucucugagaucugggcuacccacccauguccuccagccgucugucgcaccuccuacugcccacucacuguuccuggcaugagaugugaucuccagcccccaugccuuugcugugcaggguguuccagagugaauugucccuccugucugucucucugcccucuuccucgucuuuccaucuuccugccccacaucacugccuccuacccaaggccugugcucauuccuccucgguuuucccccauggccugguacauaccucugaauuaucaccuugcauuucccauauugcccggcucucuuugaugucuguuucuuugcugggucuuccucagugucugacggucaguuaaaugucuuuauucuuuuuuguaggauauccgacaugaagccagugacuucccauguagaguggccaagcuuccuaagaacaaaaaccgaaauagguacagagacgucagucccuguaaguauccacguggccgguaccagucuugcucuuccuuugcugcaggccuuuuuagucaagacuccuuucgccucaggguuuaguauaauaauaaaucaauguagcagagguuuaugacgcgauuguuuccuauaguaaaggcauuagagacuuauaguaauagcucauuuuuccaccauuauagaagggcucagguuucaguuucuggaaaauucagugaaguucaaagcacuuuucuuaagcuuugacuguuuuugugaugaaucauuuuccuaccagcugaagcagaguauagcaggcauaauaaaaccuuuucuggaugacucagcagcagcgucauuagggcaugagcacuguguuccgcuguaaugaagccccgcacaggcauucggggugggcacugucguccccugcgcugaauaugcaaggcagcucugucuggaguccccaccgccuccacccccgccaaccucaucauuuuucucccucuuuccugcuguuaguucuuccuaggauugucagugugccugcuggccuguggcagcccuguccgccuucugagugauuggcugucagucugccgguagcugaaaaguaaauaacuuaacauguuagaauuugcauaaaguaaggaaaacuggagcugaguacaggacuugaacugcgccaucuccucuaggccacagaggccuuuuugacccccuuccaggucuuuagacauugucaggcagugaggggucguagcugccagugucuccaugguagcgugcucugccagggaugcagaagauucuccagucauuccuccagugggcacuuccugcagguccugugcccauggcugggagugguggcugucauuguucucugccagaaggguuagcagugcauccugaccugacuuauguggcgcccagauuccuggaaggggucuaaaaauggaccuagacuugguguagaacgugugccucuuggccugccaccaugguucccugccugguuuugugugucagcucugccgcuuaagaacugaguggcuucgggcaaguuguucucucucauaggagugugugaagaugaagcaacauaagcugcuuagcccagcgcccaguaccucacgcagacauaagugcucaguaaauguugucugugguggggaugguugucaccaacaucugaagugcacuucuaggucaucaggugacaugauuggcgccaacacaugguacucuugauuuagcacaucucagcugaggcaccucauugauauuuguuuaaaaacaaaaacaaaaaaccuuggugauucugcugugaaguccuggccagaaaccuccagaccgcugaucaacacgcaacagaaccaucaccguucaccucuuugacauggugccaggauacccuggaucucuagcuuuugcuauaguugcucuaauuagggaauaaucuugucuuuaauauuccuuugcuacauuuuuuaacauuucuuaucuaaaugguuuuaugaaucaguuuuacagagaaaaaaaaccaguauuuaaaauauucuuccaggggcugguccaaguacaguaguguuuacaacuaugugaucacaaccaguuacagauuucuuuguuccuucuccauccccacugcuuuacuugacuagccaaaaaaaaaaaaaaaaaaaguuauuccagggaaacaauucuccaacuuuuucacucccaaucucacuccucuuaucuuccucccguacuccuauccuccucccguacuccuauccuccuccccuacuccuauccuccaguagaaacagucauuugcugugaagguuaugggggagaaugagucaagguagaaggucaccugcugcccagcucacagugcugcuggugaugacagcaguccacaguuacaggcacuugcugaacgaggggcucuguauacaccucagcucauugacucuucccacaacccucuugucaccuaccauuuagcaaaugaaaaaaccaaggcucugaggugaguuguuugcccagagucacccagugcuguuugaacccacucacauaaccaaccaauaccauuauguaauuuuugaggucuuuuaucucugugauccacuuaaaaauuauccaaguaucuuuauuuguacuaagccuccauaaugagaaacaguguuccagaugguggcuaguuuucaaagacaucucucuuuggaauucuucuuuagaacaaaaagccccagaccacuuauccccauucauauccccuuuggaccuagggagaagguacuauuuauaggugaucaccugaguuuauugucccuugugcugugccagaaauaaagguccccaccugcucuuauuagcucuacuaacaggauaaggaaaguggcccucagagagcuacugcuuuugugacaaacaaaugauacaagaaaaaaaaaguggcuuuuuaauuuuagugaccuggggcaggacuuccaaaugaaaguuuauuucuaaaaacuaaaagguaaauuuaauauacuuucaguguuugggcuuaaauucucuuucaagugucuuugugauaugcucugaauuuuaaaaauuuagaaucauugaaguucauuauacuugaacuuuaaaaaaaaaaaacaaaaaccucguauaaaggucaagguaugacuucaugcugcuguguacuuaggucauuuaaucuucaaaccacuggauagagguuagguugaaguucgaucuuaaauccuaccuacuguagcucauuguaccagcaacagcuguagggacuagguggaauucaugguggguuuuguucccuuuuaaagauugaagccaccauauuuucugcccucuaaaaguuuaugucagccaggcauggguggcucacacuuguaaucccagcacuuuggggaggcugagguggguggaucacuugaggccaggaguucgagaccagccuggccaacauggugaaaccccaucucuacuaaaaauagaaaaauuaggugagcaugguggccugcgccuguaaucccagcuacucgggaggcugaggcaggagaaacauuugaauccgggagauggaggcugcagugagcugagaacaugccacugcacuccagccugggugacagagugagacucuugacucaaaaaaaaaaguuaugcaucagagaacagauccuuugaugcccuccucugcccugaaagguuuuugggggagaguaauaaguaucacaacaagauaugaccugagaacagauuucccagauaggacaugauccauguuuuaauauggcuuacugcuguugcuucauagugugaagcuucagacacuucugaaaacccuuucagaaaaucccagucgccccauacugaugacuaaucucaacuaaaacagggcuucagccagugugaaugccacuaaugccaccaacucaccuuugcuuuucuguagggugugcaccuguauguacacauucagcuuuuccgggauuaaccucugaguucugguuugucuuucaguugaccauagucggauuaaacuacaucaagaagauaaugacuauaucaacgcuaguuugauaaaaauggaagaagcccaaaggaguuacauucuuacccagguaagcagauugucugaauuuucuauuuaaugucaauuuaagaguuugagagugcuguuauccacaccucaaauaaaaucugccacauccuuuagaaggucaggauuucagcauaccaaaaagcagcaaggaagggggaaaaaucauccuucaaagguucaguuugguuauaaggaacgcuaaucuuuucugggaagcauaagaugacauugcuggaaaugagagcuuauagaaaacaacauuaaaaugccagaguugccuguguggucuguuggcagagacagcagagccauggcuggaggagggucuguaccuguguugcuuccagaaguauuugucguagagcacuugugauggcaaaucuaagaacguuagcaguagaccaggaaucucuguccagagccauucagaguagcucagcaugguucucauucuuuggccagaagaaaggcaucauuggaucaugugaacaagcaugaaaaaugacuuaaaauuucuguuggcuuuuggcaucuuuauggaaacaaaauccugaaagugguuuaauaauugagccucuuguaaaacacucaguggcaugugaccaaaaggguaucugggaaagaggauaaaaagaguuucuuuuuaauuaaucuucucaagucuuaacuuguuaccuguaaguuggucuaaaaagacuggguuucuuauuuuguuuuucaucauaauuuuuguuucucauuccaugucagcuuucagucuuauauggcuuuaggccacagggcgauuuugaacauuuguaauuuugcuuaauaauuaggaaauuaaaauucuggggaagacagaaugcucuaugaagaaaggcugcuuugagcaaggagcuaggucagggcgcguucaacugaggccuuucuucacugccuuuuugucuugucccaguuccuccccauuuaugacuaaaaucagcccagaugcuucucgucaucugggaugcagagcaucagcccagcuguguucaguccuauggggccauugaguaaguucuuggugcauggauacagggcaggccuuuaccaggcccugagccccugguccucccagcaccucugggguauuuaggggaggcugaugggggaggggguugauaaggcgggagaugucuggggaugagguugaggcaaaagugacuucuugaggacuuugcuuuuuggagaagucaaauuuccuacuucuugauuucagcccuucaacucugguauggagucaggaagcccuuuaaauaccuguugucggguguaucaugucaaguguugcauuagcaaaugaccauguauccuugugcuacuguccugccuaccccgcauccuagcgcuuccuugggacaugagaagcucugucugguuugugagguggcacuggggauguugagaaacuguuuacacaguuucccuuugcccuggggauuuacuaaaggagucgaggcagccugaccccaaagcaucaccccuggacacuaugaccgaaacauuuccccagugcccaaaccaagaacacccuucccauuuuuuuuucagugguguucauuauguaauaauacaagucucucuucucauuuuuuaaaagucagaaguacagaagagcagagaauaauguccaaggggcccuccuucaccucccccgugcagugucagcuaaguguggugcguguccuugcagaucuuaggggauugugauccuucagaccauucuaaacugggguggugcugggaguuagggaaggcaugaagggaguaguggagagcugcagugacuggggucuucaugccaggguggagaaugcaaggcccagguggccagccaugugccacgggauuucuggcugccaagagcuguuuaucuguucacuggggagggaagaguuaaauguggucugcuuuucuccgagucccuucagcacagggagugcugacuugucuuguucagguaguaaguucaagaugagcucaggaaagaaagugagaggacacugagggcuagugguugagccaagugugaugggacuuaaagggagaagauuuaaagaauaaggagcuuaugggccggggacgguggcuuacgccuguaaucccagcacuuugggaggcugaagcagguggaucacuugggucaggaguucgaggccagccuggccaacauggugaaaccccgucucuacuaaaaauacagaaauuagcugggugugguagugugcaccuguaaucccagcuacuugggaggcugagacaggagaaucgcuugagcccaggaggcagagguugcagugagccaggauugcgccccuguacuccagccugggugauggagcgagacucugccucaaaaaaaauuaaaaaaaaauaaagagguuaggugaaaauagaugagaauggaaaccaugagaagaagugaugcuggccaaggacaugacagguucugauguggaggugauaggcaaugucucuuccagccacugcuaauaauugagacaaacucaaggcauucauacccuguguccaguaaacaucugugcccauugccaggugagcuggauugaaaugggccagcugcucagcagacacccucaugccccagugacucuguuccccuugggccaccucauugaccauuuauguuucuacaucuccuaaguuuguugggccaaggauggaggcugucugccgucaggguccucauugcugaugguaggaauaguugcugauguuucauuggauguugcuguauucuagggacugugcuaaguacuuuauagaaaugaacauacuucauuuucacaguuuuaugaauagggacuauuauuagucaaguaagcgauggggaaacuggggcagggagcgaugaagugacuugcgcaaggucacaagaugaugugauuggaaccaagagaaguguugugguuggccacgcccccacacugccucucaucugcaccaaggaguuuugucccauagcccaagggccuuggggacgaaucucaguggaggcccuuagcgggccugccugagccagaaagcagaaucggcauuuuucuguccuugguuggcccagcccugaacugagaugcggaaaucgccuuucgcugccugguagaaaauggagcugcaguuacugaccaccaggcagagagaggugggucccugucccagccucagccaccacucugccuaagcuguggggacugagggcgcugucguuagcugacugcagaaggugagcacacgcuguagcauguuauguuucagaugucacauguuguguuauugugucuuugcagggcccuuugccuaacacaugcggucacuuuugggagauggugugggagcagaaaagcaggggugucgucaugcucaacagagugauggagaaagguucgguaagucucggcuucauuugcuguguaugugaucaugcauaccacuccauauaguuaccauuuucguccagauuuuuaaauuauuuuucuugccuuuguauuuccuuuacguaguauuuuuauuuaaaaaaauuaaaacagcagcauauaaaugcauguugguugucaaccaguuaaugaagugaauaaaagggaggaggcggaagaacugcacggaccucuucgcccccgccuucuccuguguggugcguguggcgcuccgcccaccugugcugccugugcggcucucaucacaguguggaguuguguguggaguuauggagaccugcuuuuaucuugaaaagcaaguucuuagugcaucuucauggugucugauuuuuuggcuggugagaguguggcuaccucugcggagcugugggagcggcugacuagaugagauuugccuccauucaguaccuagacucuugcccugccacaccucuucggagugagcauugacuucaggaugugugucauucuaaguuccugcaacuuuucaaacaccccucgggcuagcguguggcugcacgguguccauuugugcaggccaccacuccucuugcaucugggucuagccaccucuccuucuugacuuaccauaguucauuuuguaccaugcuuucagaaugagcuuucucaaauccaagucucaccacgguucuucccagcugaaaacccuugugcgguucccuuugccucacaggauaauacaugguguggcuuacggaacccugcaggucuggcccuaggccccuggacacagaccucucaccacucuuggaacuuuagccaggacaaaguuuucuguuuuuaguuucuuaccauguucucugggccgaggagucccagugcccacguucaucccacuugcaggcaccccuggacggcugcccccagcuccccaacugccugcauucuccccugcccuccucacucuguuggaauagcugagaauagccgauuucugggcagccggccuccuguguagacuguccuguguagacuguccuguguagauugucuguguagacuguccuguguagauugucuguguagacuguccuguguagacuguccauguaaacuguccuguguagauugucuguguagacuguccuguguagacuguccuguguagauugucuguguagacugucucuguagaccgucguguauagacuguccuguguagacugucucuguagaccgucguguauagacuguccuguguagacugucucuguagaccguccuguguagauugucuguguagaccauccuguguagaccaucccauuuagaccaucugccugugcaggcgcaggccaguguucagcagggccacaggcuccucggccucccugcccucgcugcuccccaacacugccaacccugcugcgggguccaggaggagaugggcugaggaucguggagaccagcaggagcguguggcccaggagcagggaacuggguguccuugggccuugccagguccaggcucagcuaggacacggcucucacagcuguccugguugccuccggccacagaagaaggugagggcuccagagaggccaccuuuccaaaaaaagcacagucauggcccuagaauguaaaaaauccaaguguuaagaaggaacacaucaaaggaaacuucagcagugaaaacuugaagcauuaaccacgaagccucugccuccaccacacacaaagaaacggcuuuaguuacucgcagaaagucuuccucuuaggacagcgcguguuuaaaaucauagggguuugguuuguuuuguuuugggguugggguuuuuuggggguuuuuuacccuugccuacuuuuuaaaaaaugaaaguguuuauuugcccaacaauaacagacagggagcuugccuaaguguucuguugaugauauaauguaucuugucuuagaaaaaaacuuuuucagugaaaggugguuuuuaaauuuuuucuucccuccuuaguagcuugauuaguaaaaugugaaguuacaaaugugaagcaaacccccacccuucaccacuagucagcaauuuugaguaaagaaacaaagcaucaggugcucacagcacacacugucuuagagggaaggggaagccugguggccuguggaagccuucagcauagcuccaucugcaggcuucugacccucagcacuacugacacuugggcuggaucauugucugcuagggauccgggcagggaguggcugugcugggcgcuguaggaaguuuagcagcaucucuggccucuauccaccagaugccaguagcacccccuccccagauguggcagucagauguguuucugucuagacuccagacuuuguccaacguccccugguaggccaaauugcccccgguugagaaccaccgcucuagaugguauugaggguugggaauuuuaaaucaagacauuuauucagaaauuaccagauauaguagcauuugcuucuuauuuauuucuuuguugcuaaguguuuggcaaaaccucuuugcugugagcacaagguuugcuuuagcaauuguugucacauuacagcaaggagugguguccagcgcuguaguuauguauuugagcaguguccagugcuguaguuauguguuccagccucaccaggcccugugcuucauugucucccacucaagacugaccacaaauggcccacagauccacugugacaaccuuucccuuuggguuacugugguggcaucgagaacauggcugguuggcuuugcuguaguuuacugugauaacugugccagcagucccugcuuuccuuuguuaaguaucccauuccacuggaggauuacuugggcgugcagauuggcaugaaaagcaauguaugguuugagauuguuaaaguuucuuugggaucaacauuuucaauucuguaucagcauuaucccucccagagggcuggcugggagaaaucaugagaaguuacaguaucuuauuugcucagcuaaucuaauuauaaaugauccacacagcuugugguaaaaccagcuuuuggggaguuuucauuuaaugcauacuugucuucugauuuccuuccuucaccaaauaguguaggaugcucccucuuauuuuuggcaaacaugccuguuaucuuuugggacccugggcuuccuggaaaccaguuaugcagaagaugauuguguguguuagacuggggucauccagauggcuagaguucucacugguucuguuuaaggauugacuuuagacaccucaguguaggcugcaccauggcguaaggguugggauuguuguuuagaagggggaaguaagcaaggugaguuuaauuggccauugcagaaucucacccguaucucccuccugaaauccucacuaaagcugccguuugcuuucaggugcuuucaugcacaagacacugcauuuuguaucacaggguccauauaauucauuuuucucucguacuuaguucucuguguuaagaauuacuuacuuaguucucuguguuaauaauuuuuggcgaaaccaaauuacccgucacaggguuacuguagaugucuuucauagguuuuccaaacaccacuugcccacuuguuugggaaggccccaaggacuguuuaacaucugccuucaugguggaaacagcaacuaugagagaugcuagcauguuggcacugccauguuccucugguaccagcccaagauaggacucaauuugaggccuggugaaguacuguguucuaauaaaaauccaucuacuuuucauggccguauauaucaauguaauaggguaacuggaaaugugaucuugugccuuuuaaaaauuuuguguguuuaaaacaaaaauuucuauuggaaaugacagagcauagcuuguugcuguagacaccugagaguccuuaaaaauaaauauuggguuauugacacuuaguugcaugacagaauuccucacuuguacaguuccaaagucuuagucuuuacccagauuacagaggguuauuaagcauuagguuugguuuugaaagugagugcuugcugucuggaggugagcuuuaagacucgucugcccugcuuaugagaugaggaaggguggccucuuccuccugcauuucuguucuucgcuuccuucucugucugcucacucuguggaaugcccaccccagcacgggugggguggaaccugucagaucagucucuuguuucuggggucuugaggcauuauaagaucuaguuguuagaagugugggauuaauucaucuuuucacauucuucuaaguuccugcuuuuagcugccacacccacuuuggcuaagugggggucuugccauguaauuagcgccuccaugccaaguggcagaauugcuucaauggugacagauuguccccauucaagaguucacuuuuggcaacucaucauugauccaggaaggugacauggaugaaacuggcuaagacuucagacaggcuuguguccagacucuugagaaagcucuguuggcuucuggucuggcacugugaaguuugcugugaugcuggcaccacaaccugguguuuccuaauuuguuucucccacauuuugcuuugguuuugucuuuugggcagcuuccagcuccaguagagcaggaccaauaggcauuugugguucuauauucacccuccucacgugcuuccuggcuccucauugcccccagaugaugccacaggucccugggccugcugccagucgucugugaucugggccucugcuggccccuucuccagcugcucuuuucagccucuuauuugcagucacugccuaggaaauccuagucauccuucaaaaccugccucuugcacagagcuuucucugaucucucuuuucuguaaccuuggcugaccugaaacauuucccucuucugaauuccugcugcauguccguagcauuucccccucagcccucccccauaguccaccuugucacugcugggcacagcagugucuucugacagacagcuggcccugaagugguucccuucacccacaccauccuuugccccagaggagguauugagugggucagugcacgugaacugccagugucauuugccaaagagcuguugacacacgcugacauuucuuuugcugaaaaucauaagggcuuugagcuucccucuguccaggcacauggucaggcugacccgguagcucugccccugcugaccugccauuuuuguccacaacaguuauccaugagcagaaacauuuguguaacugaggcagaaacuuaguucaaguaaaaugucacuaaauucgagucaguuuuugucuuagacccuaaaugaaaccaaauuuucauaaauuuucuuguuuuaaagaaaaauuuaaugagcuacauuuaaacugagaacaucagauagugucugagauuaucaaaauagaacaucaaaaguauuuuucugaaugaacugaaccaaaccagaaugaaagggcaagcccuggggagccugucuccaagccuucucugaaagggagucuguauuuggugauaacugcucagccucuccaaagggccucaccugcugucucucccaguuuuauuuuuaauugccugugaguuuucugugcaggguaaggcaccuacauucuaugccagcagccugaucagguccuggguaauguuugaaauggcuacacagaggaguuucaaagccuuuuguucaaucuggcuucaccucguagacggugagaaagcgucagagcccugcaggaucccguugccacguuugaccggggagccgauggguuuggaagucugagcccugucugcacaaccugccccggucagcagcuucgugcccccacccccaucuccccaugaggcaggcaucugugcugaccauggcuuccauguucagaaacccccaggccuuugaguuaucaugaagcuugugggaugugcuccaagccuccugccauagaaaaacugccauauugcucacaauaauucacuauuauuuguuuccccaguuaaaaugcgcacaauacuggccacaaaaagaagaaaaagagaugaucuuugaagacacaaauuugaaauuaacauugaucucugaagauaucaagucauauuauacagugcgacagcuagaauuggaaaaccuuacagugaguauagcacacacuucagcacuucaggcggcuacugguucacaugccucuuccuuuaucccuugggugauauuaccuaaugucaguguuccuggcuuuuguauaccccgagcaagaugugguuugggcacuguggugagcggagcuuacuuguguaccuaccaagugcccagggaggguggaggccacagugcucucucugaccuuuaacaacaguuaacaccaguucuuagggaaaggagaguuucuuacccaaaagacugguuccugcuugugcagcugcagagggacuggagcggcagccugcaagucccagugaagcaugcugccuucuuugugguccucagucuucgagucugaagagagggaagaagggguauaggggcucacuccaguuucauagcuagugaaaguuuucugggccaggucuuggguuuuuuuguugugggaagaguuuauaacaccagcuacuugcuugguaaaaguuggucuuggaacauggcaaggcauuguggcaagcagcacugccgcugaacgcgcugcuccuggggcuuuggaauaauuccccuggauccguaacuuggggguguucaugucauucuggggaacaguggagggagugcgcggcagcaccugggggcaccagugaagaguggccagccaccaaccucuagaaccuaacuggggucgaauccuggccccaccuuacuagcucaucacagugucuccguuuccucuucugucaaacucagguuuugcgaggguucugggagguccuauacgggaaggguuagcaguuaccauggguguguagcacgggcuuuaucugaagggaagguggagccguagggagaccauguggaguggggcuccagggcuguguggguggggagggaucugcuucuggguuaccccaugccuccccuucucaaguacuacuuuuuaaucaucauggcuccugccauucauuucauaguugauguaagccaggugcgguggcucacgucuuuaaucccagcacuuggggaggcugaggccaggaggaucacucgaggccaggaguucaagaccagcuugggcaacauagugagacccccgucucuacaaaaaaacaaaaacaguuagucagacaucguggugcuccccuauaguccagcuacucaggaggcugaggcaggaggauugcuugugcccgggaguucaaggcugcagugagcuaugcuugcaccacugcacucuagccugggugacagagcaagacccugucucaaaaauaaauaaauaaaaaaaauaguagaaguaagaucuagaauguagcacagguuaccaggacguaggcaagggguucgggcugccuggcucuugaggaugguagcagugcagcugaugugagugcuuucugcccucugguggugaccgcgccggagucaccagcccugccauagcccugauggggcagaggguucugaguacgguggauggaggugcuuucuggaagauucucaggaguaacaugggcaguguguuggaaugugcuagaggauuuaugcaguagccuuuuaaaagaaugcuuuuuagcauuugcaagccugacauuaagagugacuucugggaaacuauuugcuuguugagggaaacugaauuucaacagagcagaagagcugugcgcuuuuugcuuggcagagugaauacagccagcucagagguuuugauguuaggaucuguuugcuccaacagacuuuguuuuuaaaaggcuuuucucagccauagcugucuguucuagcacaaggcuggaaugaguuccuugugaaagaggugagcaggugugagggagggugucagugggcgguaacccacaccuucaaggauuaaaggaaaacuugcauuuggcaugcuugcuucuuauucaauuuuaaaauacauuuuaacggccgggcacgguggcuaacaccuguaaucccagcacuuugaggggcugaggugggugguucacgaggccagggguucaagaccagccuggccaagauggugaaaccccaucucuacuaaaaauacaaaaaaaaaaaaaauuagccgggcgugguggcgggcaccuguaaucccagcuacucgggaggcugaggcagagaauugcuugaacccaggaggcggagguugcauugagccgagaucaugccacugcauuccagccugggcggcagagcaagacucugucucaaaauaauaauaauaauuuuuuaaaaauacauuuuaaguccuuuucuuccccaccugccuccacccaccaaauagaagagguauuucuucuucuuuaaugucauuaagguuauauggauaccauuuucuagagaggaaagaaugauggaauugccuagugugagucuagcaauuauccuaacauacacaaauuucuccuuguucugugccaagauacuguauuuaauauuuaaugaacauuaaauauuauuuacuaguguauuuaauggcugaggcaggguuaaauauguauuauuuucaucccagcagaguugggggagguccuaguaacuaugccaugagcucugugagggugagguggugucuuugcccccgccucccuggcacagugacuggcacaugauuggcauaguguggacauucgucaagugaaggaaggcaucaugagcagaucucuggccugaauccuucugccaucagcugcucgccagguggcccuggcacugggccacagggaaacucuccaggcugguaugguuccugucuguggcugucuucccgggcccauguuaggagacuuucacuuccagagcccuuucccucucagggccuugcuuaccaagugacugguucccauuuacuaggagcucuuaggucauugaagauguugcguacuccccccagugagggcugccuuuugaucacagccgccagaagccucaaggaaggagcagagcuggaaacagacgccaggccauugcuucuguuccucuggggcagacccagccacggaagagacauucugggacaagggcugggguccaccuuucaaacgugucugcagcaggcucucagcauggacucucugccuccaaacauccaccuccucaucggaaaauggaugggagugccugccuggagcagcuggugggagagcgcagcgccagcacguaggacacacucgguucaugggcugaugccguucgcauugacugccucuucagcuggguguugagccacaccuuggagucaccagucuuuggagaccaagucugcuacuuuuuucucuaaagugacaauccucugaaaccuccagaucaucuugaagcccccgucugaaaguugcccagagccagugccucaccugcuguuccuuguucacuuuuucacgggaggccuugcagggcuuuaugacaagauuuuauggguggcugcccagcaucauugugacucgugagacagagagaaaccaguuguaaccauguagacaguggaagugauagggagaaaagaggugaggggacucuucaauccgaagggaaaugaagucuaagcaggcgcacccugcagguucagugucaagcccagggccuggccccagggugugguauuuguugacuggguguguggacccugggagaaagucugagaaugaauguuccucuuagagguagagaguggaaggugacucuguguguacuuggaauuagugauuucuguacagaugauucuuuuagaaucaucaugaguauuuuucucuuucagacccaagaaacucgagagaucuuacauuuccacuauaccacauggccugacuuuggagucccugaaucaccagccucauucuugaacuuucuuuucaaaguccgagagucagggucacucagcccggagcacgggcccguuguggugcacugcagugcaggcaucggcaggucuggaaccuucugucuggcugauaccugccucuugcugguaaggaggcccucgcgggugcccuggggagcuccucuaccugcucugcugugauguuuuuuccuaaguagaaacugaagcgcuccucuuccaaaauacagagacucacuguguuagucuguuuuugcguuacuaauaaaggcguaccugagacucgguaauuuguaaagaaaagagguuuaacuggcucccgguucugcaggcuguacaagcauggcaccagcaucugcucggcuccuggggaggccucagggagcuuccagucaugguggaaggugaaggggagcaggagcaagagaugggggaggucccagacucuuaaccagcucucuugugaaugcauugccucagggagggcaccaagccuuucaugagggaccugucccccugacccagacaccucccacccagccccaccuccaacacuagggaucacauuucagcaugagauugggaggggacagacaucuaacgguguuauuaacguugcccuugagaauuggaccuggcugacuuauaucuccucucuggcuuucagauggacaagaggaaagacccuucuuccguugauaucaagaaagugcuguuagaaaugaggaaguuucggauggggcugauccagacagccgaccagcugcgcuucuccuaccuggcugugaucgaaggugccaaauucaucaugggggacucuuccgugcaggucagcauugccuuuguuugaauccaggugugaccauuuuaacuuuuuugucuuugaaggaggcugucaguuguaaaaguucaaacaccgucuggugucaggggaaauagcuacccuucauguuuaaaauagcuagaaaguugucaaaauguucaccauguugcacuuugugccuuugaagugcucacauagagagcauugauaggaagacgagacuuuauuuucaaaagauuucaucuuccaaguacauggcugcagcccugagaggccgagagccccucgccaagccgucaccucugcucaugcaaagggauuuccugacaaaccagccgaagugaacacuaauaggacuuccucuugcugcucuuucaaggaucaguggaaggagcuuucccacgaggaccuggagcccccacccgagcauauccccccaccuccccggccacccaaacgaauccuggagccacacaaugggaaaugcagggaguucuucccaaaucaccagugggugaaggaagagacccaggaggauaaagacugccccaucaaggaagaaaaaggaagccccuuaaaugccgcacccuacggcaucgaaagguaauaugauugggucccagcuuguuggggugaggggaaaugacuuucuguucuagaaacacacgcugguacugaaacccuguggaugcagccuccuguuggcaagcagcgcuuccgcauccuuggggaacagggcgcguggaccacagccacuccacuccuggcugcuggagguccgguauugggcacaggguggccgcaggacaugagccacuucugugggcuucuagugccaccuuguggugcuuguuggaaugaggggcucggagccaccgaguaggguuuuucugcccccccugacgacagcgcccucccccagguuuccggacaguccugaaaugugauguccaggcuugagugcccucaguccccacagugguccuuuggggaauguaaccuuuuuuauguggucuugauuaaaucccauuuuacuuccuugcagguuaacaaccauuauugaguaccuauugauaugugugguguacugaguuaacuagaacauguccccuggucuguguucuagaccaucuugcugggaaaaaggcagacccaaagcauauuuuggugggggcccauggacagugaugugauagagguguccgcugagguggucagggaaggcugcuugcaguagguggccgugcacggaaaguuugcagaaugagcagguguuaguuccagcuggagaugacugccggcugugcccuugguaccugcuuucuggagggaaguuuuaagacgugugcauacuugacccagcaguuguauacauggagaaauuuacuuugcagcaacucucaaaacaagcguguaaagauguguauagguaguuguguuuguuguggcauuguuuguaguagugaaaaauuagagacaggccaaugauauaaccagggaccugaucaauuauguucucucccgguguugggauauucuguagcucuuaaagaaugagaucuggguguacugauguggccagacauugcaauugcaguacaugagaaggcaaaucauacaguaguguguacaccagugaguccuccagccagauaaauccucacagugaccagucgcccaggcaccuugugaacccuacccugggugugggugcuaucugaaguaccugggggagggggugacaaguggacuucaggcugaugugggcccuggccuggcccucccuccaagcagagggggcuggcucgcuggaagguuaacaucauccaacucugucuacacguggcuuguuuuuuccuagaauuccugccacaauagcagcauccuugccauucauuuucuccaaagugaguaacccaucucugcccucugauuccucagcaugagucaagacacugaaguuagaagucgggucguggggggaagucuucgaggugcccaggcugccuccccagccaaaggggagccgucacugcccgagaaggacgaggaccaugcacugaguuacuggaagcccuuccuggucaacaugugcguggcuacgguccucacggccggcgcuuaccucugcuacaggguauguuuccacugacagacgcgcuggcgagaugcucgugugcagagagcacuggccgcuagcccgaugguaggauucaguucuguggugcaucugagccagucucagaagaaacagaucaaagguuuuuaaagucuggaacuguggaagggcuaacaagagaauuaaggaucgaugcacugggguuuuaaggagcccucuggucccaagaauauaagagucuaaucucagggccuuaaccuauucaggaguaaguagagaaaaugccaaauacgucuguuucucucucucuuuuuuuuuuuauuccuuuguuuuuggaaaaaaauagaguuacaacacauuguuguuuuuaaccuuuauaaaaagcagcuuuuuguuauuucuggaacaaaaaaaaacaaaguaggcacuuaugaaacuuucucauacccuuaggugauguaaucagccauauaauuuauauuugauuucccagggaaggaaucccaaacuuuuacgaauguaaacucccuuggagaagaggguuaggacgcuguugcgcucaagccccccucagcugugugcacacugagccaggacagggucuuugagcuuucccacuauaagaagaacagcaacaaaaggccgucuagaaaaacagaaccugccucugcuucugcucaggguguccccgcuggguuuccauuguccuuucuccauugcucccuccugugacagccaucuugcucauguaccagcccucaucaccccauccccauaaauggguguccucgaggccucugccugggggucagaggucaccacaggguggccauuggcaugucaacccgcuguuaauucagagaagugggcuccaccucauugggagaagugccauuucagcagaaauucacacguuagacguguguugcuguuaaguaaggggaagagagaggacuagccucagagcucuggccauggaaaugaccuccuaagacuuuuucgugguuuuaaauauuuuaccucuuuccagguggcaucugaguacaucagaugguuuugcaaaaugcaaacaauuuuuuccuuggggaugauuuuuggggagagggggcuacuguaaaaaauaaaaccaaaacccccuuugcucccucggagguugaaguugccgggggguguggccggggucaugcaugaggcgacagcucugcaggugcgggucugggcucaucugaacuguuugguuucauuccaguuccuguucaacagcaacacauagccugacccuccuccacuccaccuccacccacuguccgccucugcccgcagagcccacgcccgacuagcaggcaugccgcgguagguaagggccgccggaccgcguagagagccgggccccggacggacguugguucugcacuaaaacccaucuuccccggaugugugucucaccccucauccuuuuacuuuuugccccuuccacuuugaguaccaaauccacaagccauuuuuugaggagagugaaagagaguaccaugcuggcggcgcagagggaaggggccuacacccgucuuggggcucgccccacccagggcucccuccuggagcaucccaggcgggcggcacgccaacagccccccccuugaaucugcagggagcaacucuccacuccauauuuauuuaaacaauuuuuuccccaaaggcauccauagugcacuagcauuuucuugaaccaauaauguauuaaaauuuuuugaugucagccuugcaucaagggcuuuaucaaaaaguacaauaauaaauccucagguaguacugggaauggaaggcuuugccaugggccugcugcgucagaccaguacugggaaggaggacgguuguaagcaguuguuauuuagugauauuguggguaacgugagaagauagaacaaugcuauaauauauaaugaacacguggguauuuaauaagaaacaugaugugagauuacuuugucccgcuuauucuccucccuguuaucugcuagaucuaguucucaaucacugcucccccguguguauuagaaugcauguaaggucuucuuguguccugaugaaaaauaugugcuugaaaugagaaacuuugaucucugcuuacuaaugugccccauguccaaguccaaccugccugugcaugaccugaucauuacauggcugugguuccuaagccuguugcugaagucauugucgcucagcaauagggugcaguuuuccaggaauaggcauuugccuaauuccuggcaugacacucuagugacuuccuggugaggcccagccuguccugguacagcagggucuugcuguaacucagacauuccaaggguaugggaagccauauucacaccucacgcucuggacaugauuuagggaagcagggacaccccccgccccccaccuuugggaucagccuccgccauuccaagucaacacucuucuugagcagaccgugauuuggaagagaggcaccugcuggaaaccacacuucuugaaacagccugggugacgguccuuuaggcagccugccgccgucucugucccgguucaccuugccgagagaggcgcgucugccccacccucaaacccuguggggccugauggugcucacgacucuuccugcaaagggaacugaagaccuccacauuaaguggcuuuuuaacaugaaaaacacggcagcuguagcucccgagcuacucucuugccagcauuuucacauuuugccuuucucgugguagaagccaguacagagaaauucuguggugggaacauucgaggugucacccugcagagcuauggugagguguggauaaggcuuaggugccaggcuguaagcauucugagcugggcuuguuguuuuuaaguccuguauauguauguaguaguuuggguguguauauauaguagcauuucaaaauggacguacugguuuaaccuccuauccuuggagagcagcuggcucuccaccuuguuacacauuauguuagagagguagcgagcugcucugcuauaugccuuaagccaauauuuacucaucaggucauuauuuuuuacaauggccauggaauaaaccauuuuuacaaaaauaaaaacaaaaaaagcaagguguuuugguauaauaccuuuucagguguguguggauacguggcugcaugaccgggugggugggggggagugucucagggucuucugugaccucacagaacugucagacuguacaguuuuccaacuugccauauucaugauggguuugcauuuuagcugcaacaauaaaauuuuuuucuaaagaacaugaa

SEQ ID NO: 13538 - RNA, 2759 nt, Homo sapiens
gggaugaccugugugauugaucgcuaguucuucuagggccauugcgugguucaauuagaaauauucuggauuuauacaucuuugaaguuuaaucugaagguuucuucaggaaguaaauaucuauucaucaccuuuucccaagcuccauaaaguuuuuuaguuuaucccagucgcuaggagacagaagacggaagcggaaaugccuuucacgacaacuuccggaagaggucgccauggcuucccgggaggagguacucgccuuacaagcugaaguugcccaacgugaggaggaauugaauucgcugaagcagaagcuggcgucggcucuuuuggcugagcaggaaccgcagccagaacggcugguuccggugucgccgcugccgccgaaggccgcucugucccgagaugagauucugcgcuauagccggcagcuagugcugcccgagcugggcgugcacggacagcugcgccuggggaccgcgugcgugcuaaucgugggcugcggugggcucggcuguccacuagcgcaguacuuggcagcggccggcgugggccgccuuggccuuguggacuaugacgugguagagaugagcaaccuggcccgccaagugcugcauggcgaggcacuggcuggccaggccaaggccuuuucggccgccgccucgcugcgccgccucaauucggcaguggaaugcgugccguacacucaggcccuuacgccagccacugcccuagaccugguccgccgauaugaugugguggcugacugcucggacaacgugcccacucgcuaccugguuaaugacgcaugugugcuggcgggucggccccucgugucugccagugccuugcgcuucgagggccaaaucacagucuaccauuaugacgguggcccuugcuaucgcugcauauucccccaaccacccccagcggagacagugaccaacugcgcggacggcggggugcucggugucguuaccgggguccugggcugccugcaggccuuggaagugcugaaaaucgcugcgggucugggccccucuuacaguggcagcuuguugcucuuugaugcccugagagggcauuuccgcucuauucggcugcggagccgcaggcucgacugugcagcuugcggggaacggcccacugugacugaucugcuggacuaugaagccuucuguggcuccucagccacugauaaaugccgcucccugcaacuacugagcccagaggagcguguuucugucaccgacuauaagcgacugcuggauucuggggcauuccaccuguugcuggacgucaggccucagguggagguggacauuugucguuugccucaugcccuacacaucccucugaaacauuuggaacgcagggaugcggagagccugaaacucuuaaaagaagcaaucugggaagagaagcagggcacacaagaaggggcugcuguccccauuuaugugauuugcaaacugggaaaugacucacagaaagccgugaagauccuccaguccuuaucagcagcucaagaguuagacccuuuaacaguucgggauguuguggggggccucauggccugggcugccaaaaucgauggaacauuuccacaguacugaggugacugguauagucugaugagaaagauguggauugccauaauaccucaaagauacacuuguuugcauuuuucgguaauauacauaggagcuggggauucuacaguaucugugaauacguggacuccuuuuuauaaggaguuuuaaaaauuguuauguauuggaugaaugacuuauuaauggauuauaccguuucugagaaccaucauuuuuuuuuucagcacacggaggaugucuuggacaugugagauguaacgugacaggauuuugcauuuuaaacugcagaucauuuacauguccuuauuuuccaccucccccagucaaaaugcuuucuaaaucauuuucacagauuauauacuucggaucuguuuacuguucaguuaagaaauucuuggaucuuauuaauauuucagaugauagaauacauccuacagaaauacauguuuaaaauguaaauuguuuuaauuauucagaaagagggucauucuauuuggccuuuugaauuaguaucaaaaugagauuuuuuuuuuuuuuuugagauggaaucucucucuguugcccaggcuggaguguaguggugcgaucucagcucacugcaaccuccgccucccagguucaagcgauucuccugccucagccuccugaguagcugggauuacaggcgcacgccaccacgccuggcuaauuuuuguauuuuuaguacagaggggguuucaccauguuugucaggcuggucucgaacuccugaccucgugauccgccugccucgacuucccagagugcugggauuacaggcgugagccaccacacccucccgagaucuuuaaaguuuaccaaaauaaaggaaaccaccuuuguagucugucagugucucuuauaaauugcuacuguuuucuuaaaguuaacuucaggguccaccuuauguugcacacauaucacaucguuuaaauugcauacuaugguuugacuugcuuuggaauuuucaagucaaagucccaacccuuugccucucccccuuuaauuugccuuuucucuuuugauuuaauguuuuuuuauuccagcauuuuauacuaauguaaaauguuuuuauguuuguuuacuuaacauuuucauaaaauaguagguagucucaccaacuuccaa

SEQ ID NO: 13539 - RNA, 21286 nt, Homo sapiens
gugagaaaaaaaaacauucaaauuuuauuuuccaacagacagacagcaucagcagguacaacuacagggguuucuccguagaucauacauucacaaggcauuauuagcucaacagugagaaagccacugguguguuuucuguaacaauauccacuucacaguguaaacagguacuauuaucguguucacuuacaauuccagaaggaaaggcacaacuuggcaaaaaaaaaaaaaaaaaaaaaaaaggggggcggaauccuaaagucaggugcaacgaugaagagacaacacuuuggcuaaucgucuuggaugcauauuuccgucaggaccuuccacauagaggggaaagacuuuucucccagaaauuagaguuuuuuucuuucuuucuuguuaaaccaagagcaauguuucguuugcucaauaucacauuuacaaaggaaacuacaaaaaaaaaaggcaucacaaaaucaucuugaacguucaccucuucccaccaauacaucaacucuuaggcuuuagacagggccugggaauacuucagcggucuuaaaauaggaaaauagacacuauggcuacaaaaaauaaaaaauaaaugagguagauaaauuaaagcuuucacacccaggacgugccuguucuaacuucguagccuucaugaaauauucagcaaggaaacaaaacaaaacaaaaaaucgucauaauuacuuggcauaagucgcaccaaggaaauucaacaaaagcaaucaguaugugaaccugugaugggaaacacgcccuuccacgaguuucuucucgagcaugaaaacccaguucuucaauagaguaggcacuggcaaacuaagucaccugagauuccccgcucaggugcccaccucuucugggauuugggaagaggaaggcauccaagagguguggggaaaacauuggcacucucggggcuccaacugaacuguauuuaaauaagcagcaacacacacauugacucccuaaggacuaacguaaguccauuugagggccuccuacuuaagguucuaagguugaagcaguuuuauaauucuacaacccuaguuuuuuguuguuccuuuuuuaaguacauucaaaaaaaaacaauaagauggggacaggguuggggcauauaaaacaggucccuaaagagaugacagaccuuguccuuuuacccguguccaguuaccaguaaguauacaguacccaucuccccucaaugaggcuguguaguugucuuuuccacuguuguucaguaaguuccaacgauucuaccuugaaauagguaacagucuuuggaaaaagucacucuagguuguacaaagguucuauguauacgucuguuacaaguaacaaagcuacuuugcaagacccgcuucuuuccaaaauuagaaaaaaaaaaaaaaagugccaggcgugguagcucaugccuguaaucccagcacuuugggaggccaaggcggguggaucacgaggucagcaguucgagaccagccugaccaacauggugaaacccagucucuacucaaaauacaaaauuagccgggcgugguggcaccugccuguaaucccagcuacucuggaggcuaaggcaggagaaucacuugaacccagaauggggagguugcagugagccgagaucaugccacugcacuccagccugggugauagagcgagacuccaucucaaaaaaaaagagucuguauuuguuuugguaugcauuuuuuuuuuauuuuuucaacuuuuugcaaagcagcauagcaacaaucgugauuguagcacuugccugagguuguggucacaaccaacguaguaaacaucauuugcauaucaguaagaaaaagaaaacaggaggagaugaguucuuacaaaacaaagcagauucuagagauuucacugugucugcauugcuccuuccacgcaaguucucccuuagcugaccgcaaucuuguuuucuuccaggaagugaggaaacugguguuugggaacgccgucaguagcacuugguuuuuccacaucugcacugauacccgacugggagccauccaucuuggagacaguggcguuauucacaacggagguggcccccaaggaaaccgggaggguaggaacccccccacucuggaucacagagaucucauuggucuucacggccagaccgccauugagcaugcugguguacugguuccacacaacaggguccacauucacugaaggggccaggauuuccuugggaaagauuucugagacucuuuuuccguccguaccuaacagagccaugguguucucgauggccaacuuccuuccacggcgggcugaguuauuguucgccccgugugucauguagugaaccuaugggaacaggacagaaagguuuuuaccaaaauagagauuugaagcucacuggcaagccaagaaucaaucugcauauggauuucauucuacccaguguuuuaacauauagaugauccuugacuuacagcgggguuaugcccagauaaacugauugaaaguagaaaauauucuuagucuaaaaugcauuuaauaccccuaacuagccaaacaucauagcucaguuuagccuaccucaaacacacucagaacauuugcauuagcuuacaguuaggcaaaaucaucuaacgcaaagccuauuuuauuuuauacaugagcacugaaacagcucauguaggccaggcacgguggcucacgccuguaaucccagcacuuugggaagcugaggugggcagaucacuugaggucaggaguucaagaccagcccggccaacaugaugaaacccugucuacuaaaaauacaaaaaguagccaggcaugguggcacaugccuguaaucccagcugcucgcgaggcugaggcacgagaaucgcuugaaccugggaggcggagguugcagugagccaagaucaugccacugcacuccagccugggugacaaagcaagacuccaucucaaaaaaaaauaaaaaauaaaaaauuagcucauagcucaugugauugagcauguacugaaagugagaaacagaaugguuguaugggugcucaaagucugaucucuacugaaugccuaucacuuuuguaucaucguaaaucaaaccaucuuaagucagggacugucugcacuuuauauuuagaaaaucagauuucuuauaucaccuaacaaacauuccuccccagagcaaccaagauggggcuuauagucuccaacugucucugcuccaccaaucauggguguaccuaugugaaaaccuacuauauccugggcauugauccaagugccaggguuaacauuuuuuuuugaguccuuuuuuuuuugagacggagucucgcucugucgcccaggcuggagugcaguggcgcaaucucggcucgcugcaaccuccgccucccggguucaagcgauucuccugccucagccuccugaauagcugggacuacaggcacgcgccaccaugcccggcuaauuuuuguauuuuuaguagagacgggguuucaccauguuggccaggauggucuugaucucgugaccucgugguccgccugccucggccucccaaagugcuggaauuacaggcgugagccaccacguccggccuuuuuuuugagucuuaaucugucacccaggcuacagugcaguggcacagcucacugcagccucaaccuccaaggcucaagcaacccacccaccucagcuuccugaguaccugggacuacaggugcacaccaccaugcccagcuaauuguuuuuuuuuuuuuuugagacagagucucgcucugucgcccaggcuggaguacgguggaaugaucuuggcucaaugcaagcuccaccucccggguucacaccauucuccugccucagccucccgaguagcugggacuacaggcgcccaccgccaccacgcccggcuaauuuuuucuauuuuguuuuuaguagagacaggguuucaucguguuagccaggauggucaggaucuccugaccuugugauccgcccaccucggccucccaaagugcugggauuacaggcgugagccacugcaccuggccggcuaauuuauuuuuauuuguagagacuggaucuccuuauguugcucaagcuggucucgaacuccuggccucaagcaauccucccaccuuguccucccaaagugcugggauuacaggcaugagccacugcacccagccuagaguuaacauuuuuaaaaugcacaaaccuacgcagguaauaaaacuguagagugcacaacaugcacaccugaguacaaguaaaaugggaaaaucugaauguugauuguaacaaugucaauaucuugauuaugcuacaauguugauacuaccguuuugcaaagugcuaccaauggggaaaacugggcaaagcauacaaggaugucucuguauuacuuuucaaaaguccagugaaaaucuauacuuauuuaaguaaaaauuucaguuaaaaacaauuugugggcagggcacaguggcucacgccuauaaucccauuacuuugggaggcugaggcaggcagaucaccugaggucaggaguuugagacgagccuggccaacauggugaaaccccaucucuacuaaaaauacaaacaguagccggguaugguggcacacgccugaagucccagcuacucaggaggcugaggcaggagaaucgcuugaacccaggaggcggagguugcagugagucaagauggcaccacugcacuccagccugggcaacaagagcaaaacugucucagaaacaaacaaacaaacaaaacaaaccaaaacaaaacaaauuuuggggcaggacgcaguggcucacaccuacaauccaggacuuugggaggucagagcagguggaucaccugaggucuggaguucgagaucagcguggccaacaucgugaaaccucgacucuacuaaaaauauacaaaaauuagccgggcaugauggcgggcgccuguaauuccagccacucaagaggcugaggcaggagaauugcuugaacccgggaggcagagguugcaaugagccgagauugcaccguugcacuccagccugggugacagagcaaaacgaccauucccugaugcagcugacaucuaaauauagagaacaucaaugucucuaauaauugcuacagagaaaaauguaucuggcugggaaagcuacagaaggccauggugggaauaggaugcuauuuaaucuaaggugguaggcaaggcuucugcugaagaagggaccuuacuagcaccuggcugcuuucuuuaauuauuuuuccugucuggcuuucaaguuuugaaauccuuuucagcuucuuuuuuuuuuauuuauaugaauuuaauuuuuguagagauggcaucuugcuauguugcccaggcuggucuucaacuccuggggucaagugauccucgcaccaccaccucccaaagugcugagaguacaggcaugagccacugcguccggcccuuuucagcuucuuaagaguuuaaaacucuuaagagacagggucuuacucucuugcccaggcuggagugcaguggugugaucacagcucacagaagccucgaccucccagguucaagugauccucccacuucagccucccaaguagcugggccuacaggcgcaugccaccacgcccaucuaauuuuuauuuuuauuuuguagugacagggucuccuuauguuacccaggcuggucucaaacuccugggcucaagcaauccaccugccuuggccucucaaaguacucagauuaugggugcugagccacugcacccagguaguauuucuaauuuuuaaaauuaaaauguaaacauuuuaauuuuuuuaagagacaaggucucacuuuguuuucuaagcuggagugcaguggcaugaucacagaucacugcagccuugaucucucaggcucaagugguccucccacuucagcuucccaauuggcggggacccaagcaugcaacaccaugcccaacuaauuuguguguguguguguguguguguguguguguguguaaagacguugucucccuauguugccaggcuggucucaaacuccuggacucagcugggugcaguggcucaugccuguaaucccagcacuuugggaggccgaggcaggcggaucacgagaucaggagaucgagaccauccuggcuaacgcggugaaaccccaccucuacuaaaaauacaaaaaaauuagccggccaugguggcggacgccuguagucccagcuacucaggaggcugaggcaggagaauggcaugaacccgggaggaggagcuugcagugagcuugagcuugagauggcgccacugcacuccagucugggcgacagagugagacuccgucucaaaaauaaauaaauaaauaaacaaacuccuggacucaagcaauccucccaccucggccucccaaaggaggaauggaaggauggaagaacucaucacggcuugugccaauaagaagacaccuggugccuagcccccauccugcugaaagcccacacaaacccaccuuuaaguugccuuuggugguaaaagcucgcccacaaauguugcacacaaaaggcuucucuccagugugaguccgcucguggaucugaagagcgcuagcagacgagaaguucuucccacaccgugugcagccauguugcuuggccugucggcguggcugggcugcuaacaaaggggucaucccuggggacaaugucgagggucccacaaaugugccaggaacuucaaccuugacauaggucggcggggcucggauaaacguggaagggagacugcuccgaccuaguacacagaggggaaaaaagccagaccuuuaucauccaaccuucauucuuucucuucaaagcaaaagagaucuuuaaaaauaacugccugcuaguuugagagucuggagcuggcuuuguaaguaauuaacaccuuccccuuugaauuguuuaucugcacaaagaauaaagcuucaaaugcuugggaaaagguaucacuuuggguuuuuuuuuuuuaaaggcaugggcaacauauaaacacauauguaauuuaaguucaaauuucugcauaagaaacuaccuuuaaagcauaugcccagacaccaucuuucuuugauucuuugauacagcuuuucccuuauuuuaccauuaaugacaucaacaaaccucucaauagauaugugcauuuaaaauggguucaucuuucccugcuucaagaguggcuaauuugugaacauuacaucaggcaguggggccucagagucagggaaccacggcuuauuucaguggucaaaaagcaguggccacuuccucaaacauacucuuaagacacccauauacagaaucauaguguggagaaacaaaaagaaaaaaacuauaacaaaauagaacgacuacccaccccuaugucccaaggggcucaaagacaaaaauaaaaaccaacaaaaaagguaugcuguccauacccauuuugcauuaaccaucauaaauuaaaagcauguucguuacuaggauagaggcaguuacuauugcccucuacccagaaguaaagaaaagcuaauugcccuauagaaggggcugcuucaagucauacucuccguuuguaaaguucaacccaggcuccuuuuugaugaccuugagcccaaaauggacauaaguuaaauccaaagcucuaucaccuuccaucucagugcggcuguucucggagcucucugcuuugcucccagcaucgggagacuuugacuugaugcuuucggcuugacuauuggccggggagagugccuggaaggaugugguuuccaggauaucugggcuucggcucugauacuccuggucucccaucagcgaggaugagucguuggucaagccaucgcucuccacggaaccguuuucucugcugcccuggcgcugcagguuaaaaggggcaggacccacuuucccuggggcaucuaaggaagccaucauggcaaacccuagcgugggugaugccgaguggaugcugggaagaggcguggggaccuuggaggagcugcugggagccuccugggagcugacuuccucuacaucgaugcuuucgaugacaucaucauggcagauagcgccggugcugccguucucacccacggucauuggcucagaacccguaaagucacagggauucucuggcaggggcguguugggaaucugaccgcccaugugcauccgaauauguugcugcagcaucacggcauuagugaacuucuucuggcagauggggcacgaaugcugcgucuuaauggauguguugguucggugaaccccaaggugugucuucagguuaccuuugguagaaaaggcucggccacagaucuuacacuggaacggucucuccccggugugggugcgauaaugcaucuugagggagcucugacagcuuaagacucgguggcaaaugagacauucguugggaucagugguggccuugucaauguucuccaccaacugcugcaauuucagggucucugacccuggcucaggggucccacucccuuggaagccaccagcccuuggggaauuauaguuuggucccaccccagggaguguggguccacccucacuuucuggagaaggcccaggcugcaggucaccgggcaaggagccacccgugagguccuugggauuaguccccgaagaaagauucugagguagcccuacagaggugguuacaaggacagguuugcugucuaaagaaagacucgguucaucuauggggucagguacagagagugcauaggggaugccauugccggccgccacuuuguccuggaacucggcaaacagcuggggguuugccuucaccuggggaugucggugaaagugcaccuugagguugcccuugguggugaagcgaugaccacagacagagcacacgaagggucucucuccagugugggagcggagguggaucugcaaggagcuaucagucccaaaaaccuugcuacaguacuuacacuugugcuuguagagggccgccucgucuuuggguuugacauccaccgcggagauguucgguggcuuccccuucccuuucuuggaugugucuagcgccacaguggagaaagggcucuggaagagcaccgagcccggggccugaggaagcaaagcgcucgggaggcgggacaugacguucgggagcacccgggucccauccggcuucagagugaagggugccagcccuggggacagggagcugguggcagaagggauguuggcgugagguagcuuggcuuguuucaaggcauccagagacagaccuuggcuuccagcuuucuggcugagcaaagccacagcugcagaaaccugcugagacauguggcugcccaaggucuucagagugucggccccugccccgcuugaguggagggcgugggaggcccacauguucaccuggaugcggaucugcucggugagcuggaucugcuguagcugcugcugcugcagacacaagaucugcucgaggacccacgggaugcuguuggcaccaggcacgggggcagggagugcauccgcgcuccgcugauucaccgccaccuuggugccccguagugccugcaaggucacauuaguguuggccacuuugccuuuggcuaaauagcuuauguccugggggguggguggcagggcugucucugucuuuagguacaccacagacuccgcauccggcuucuccuucauguccucugagcugccgccauucucccugugacaguccuuacugccgggacuggugggcugguggcucaguacagcuccggagaagucuucugaaggcacaggccccucgcugucauucaugaugaggacagguggauuuuuagugcaauuuuucuuauguuccaggaacucagagaugcugaagaacuccgcacagcauuucucacagacgugcgucuccucccgacgaagccgcuuuacuguggcuucauccucacucgccaccucgucauucccugggugguucacuggagcaccuguaacaagacagaaaaagcuaaggacucugcccaaguaaaagauguggggggagccgggcaccgucgcucacaucuauaauccuagcacuuugggaggcugaggugggcagaucaccugagguugggaauucaagaccagucuggccaacauggugagacccugucacuacuaaaaacacaaaaauuagcugggcaugguggugggcuccuguggucccagcuacucgggaggcugaggcucaagaauugcuugaacccaggaggcagagguugcagugagcugagaucccgccauugcacuccagccugagcgacagagcgagacuccaucucaaaaaaaaaaaaaaaaaaaaaggcaaaaaggcugaucccugaauuucuuuuguaacuggggcuuacuuacuuuaggguuagugccagccuacacauugcaacuccgaacuugggacuguguuuuagccagaugcugggguccuucacaugaugccuggaagucucucgaagcuacuucauuguucucaccucccugcuguccucucagguauaccccaucaucaagauaucaauggagcuuggggccacaggacaaagacaggcauaucucagacccagcagcuaagccuauaaaucuaaaccacacaagacauucacacgagcauacaaugaucuagguuuucuuguuuuuucagaaauguucacagcagcaaagaaguaaauuuuggcccacccacccauagugugagaaauaugcagaauuucuguaugccacagaaauuaagugaaagaaacggguugcgcaacaauauguacaacaugaccauuuugcuuaaaacaaaaccuguguuugaaauguacaaauguggcugggugcaguggcucgcaccagucaucccagcacuuugaggccacuuuugagaggccgggaguuugaaaccagcaacacagugacaccccgucucuauaaaaaaaauaagaagauaaaaauagcugagcauggcagcguccauguauaguucaagcaacuccagaggcugaggcaggagaaccgcuugagccugggaagucaagccacuccagccugggugacagagugagacccugucuggaaaaaaaaaguacaaaugcacaaggaaaaggccaggaagggcuggagugcaguggcccaaucuuggcucacuguaaccuccgccuccuggauucaagcuauucucaugccucagucucccgaguagcuggcuaauuuuuguauuuuuaguagagaugggguuucaccauguuggccaggcuggucucaaacuccugggugcaagugauccgucugccucagccucccaaagugcucggauuacaggcaugagccaccgugcccagccaaagccacggacuuuugacagcacaguccacccacggguuuccaggaggggcugaucuugaagcauggccuuaacaaacugauuuaaucuuuacuuauuucagacugggucacaauaugaagucuugcaagguauguguaggcugggggugggucaggggaagagacaacagccaugggcaggucuggccugccagaguuaagaaagcuaggcagggccaaccuagccuugccuaucaauaacagguaguuauugauaggcaagucggcacaccccuaagaaagccuacugggcacgcguaaucgcgagaugacaaccucgugauuagaugauuagguagaugccuggauuuacugauucaaccaggacugcugagaacaaugccuuacaauaaaacaauguaaugccucucguuccacaauacuaaccuccuacugcgugcaaagcagggguuggggacccaauggugaaaagaugagccccauuaucuuccuauaauucagauuuuguaccagcagaugcccauacuguaaucauucaauccuauuaaauaucagcuccauuaaaggcugggcgugauggcucacaccugugaucccagcacuuugggaggcugagaguucgaaaccagccugaccaauauggugaaacuccaucucuacuaaaacuauaaacuuagcccagcgugguggcgcaugccuaaucccagcuacucaggaggcugaggcaggagaaucacuugaacccaggaggcggagguugcagugaacugagauugugccauuguacuccagccugggcaacaaaagcgaaacuccaucucaaaaaauaaauaaauaaauaaugaaaaaauaaagaugugaaaaacagagacucugagaaauaaugucacucgugcaacauaacaaaaguuauugacagauaacuuuugagcacuuacuuuguaugugccagguaugauucuaaacaauuuguuauauuaacaacucugaaauagaaacuauuacccuauuugacagaaggggaaacugaggcacagaggacaugaacuugcccaagcuaacauguuaaguaaacugcagagccaguauuaaaccccagacaugcaguucccacacccucuauuggaacccuucauuuguaccccucugaucauguuucuucuguaaagauugcaacuuucuuuccucucacagagauguuaagaugggacaggaaagccugggagguugccuugguuaggaaggggugggagucgaccacccauuccugucucauuucuaggacuuccagaaguugcucugaaaguguuaagaugcagugcgaugcugcuacuuccagguagaguucuaguagcagguaccagcacaaacucuccuuucuuaaggccccaauacugcugcgaaucugccucacuucagugauccagauaaaaauguucggccgggcacgguggcucacaaggucaggagaucaagaccauccuggcuaacacggugaaacuccaucucuacuaacaauacaaaaaauuagccgagcacgguggugggcgccuguagucccagcuacuggggaggcugaggcaggagaauggcgugaacccgggaggcagagguugcagugagccgagacagugccacugcacuccagccugggcgacagagcgagacuccgugucaaaaaaacaaaaacaaaaacagauaaaaauguucgucaauucccagaacccuggcaacuauuuaucugggaaccgccaacucucagauaaauaguaucuaucuguaugauuuuccaagacuggaaaccagcacuagugggagugcuagguggcacaaucuuucuagaaaagcaauuuugacaauuaugugucaagaauguuaagaagugaaacuuuuuaaaacaguuucucuuguuagggaaggaaauacacgcugcugguacgaguguauagacagauacagcucuuucagggagucaucuggcaacaucuucauuuuaguacaauuuuccuuugacccagcaauuccugcuuuaggaauuuccucaauguacuugcagcauuucucauguuaacaaacagcaacaaaauggaugcaccuugguccaucaguaagauuuugguuaaauaaguuagggugcagaaaaggcgaacgcuuuauagccuccagaaauaaagaagaccaaggcugggcacaguggcucacaccuguaaucccagcacuuugggaggccgagguggguggaucaccuggguucaggaguuugagaccagccuggccaacauggugaaacucugucucuacuaaaaauagaaaaauuagccaggugugauggugugcgcaucgcuggaaucccagcuacucgggaggcugaggugggagaauugcuugaacccgggagguggagguugcagugagccgagauugcgccacugcacuccagccugggcaacagaacaagacugucucaaaaaaaaaaaaaaaaagaaagaaagaaagaaaagaaaagaaaaaaaaaacccucaauaaagcccaugcaaaaacauuaaccacuccauacuacuuuuuagaggccaaagcuaaccaccaccaaccucuccaagcaagaacaaaaacauacuucauacucuuacaccuuaaggcaagcuuguccaaaccaggcccaggccagcuuugaauucagcccaacacaaauucauaaacuuucuuaaaacgugagauaguuuuacaauuuguuuuaagcucaucagcuaucauuacuguccgugucuuuuauguguggcccaagauaauccuucuuccaauguggaccagggaagccaaaagauuagacacccuugccuuaggucgcuuaucuucauagccacauaaucaaacaagcuccuuuguuuccauuuugcagauguggaaaacaggcucagaacuaaauggcucaagaugacauacugcuugcuagucacaauacagaggugacuuaaauacuauuuaacagcacuaaaauuaguggcccaauucauaaucguuucuucuagagcggaguuucuccccucugugggagaaacuuuuuuauuuugccccucuauggaggcuuuuaaguuauuuuucccuaauagcuccccacuuauaaaguucuaauaucacaaacauauuauauacauuuaucuccuuuggaaggccacaaaccacuguacuaucaauaaaacguuuucaucccauuggugaaaauaucacuugauugaaaaugcauguucuauuuaacacaggcauuuuuaaacagggggucuaugaaauuagauaagaaaaaaauacuaauuuucacuaagcugaacuaaaauucaaccuuucuuucaaugaugaauauaagcaacauaccacagugguauuaauagaacuugugacuuugucaucaguggagaccacagauauuuucauauaguguuacaaguuguuaugacuuggaaauucuuguuaucugacaggcuacuagaucuuguuauuuauuguauuaauaaaguagcugauauuacuaaguuaaaaauguuuucauuuuugaugacuguauuucaaugcaauuuauuuccuuggucaucuauguauuuuauacacuauguugagaagggaucuauggcacaaaaaagguuaagcucccuccccuagaaggauccagcaguucccagagugauuuacagccugaauaccagcuugccuuugcuguauacacaagcuugccucuucuguagccuccaccagcaacaucccacuugacucuuaaaacagcagcagcucuguuugcuugugcaguaaaaagugcuucuacauccaggccaccacugguaaauaccgcaacuguauuugccaaggaguaagaagauucuguuaugaacaauugcugggcaugcuuaaguuaaccaaaaaggaaaaaaaaaaagcaaaguucagagggauuacacagcaacuaguucuuccauuucuccaccccacccccaccccgaauuuuaggaauguuaucuugcagcaucuaguuauccaauaaguuggaagaaugcaguaaacccagcaggggucuuagauucaaucacugccaaauggauagaaaauacucuuacuauuguauaggaagaaaguucaucuacuaguggccaaucaaauucuggagacacugaaaugcuuaaaaaguaaaaccuguauaucuugauaaaagcauuaugacucaagcuuaucuuuuuuucauuccuacauuuaaagaacgacaaugaguagauuaucuaaagcacacaacaucuucuacccucccccaaccccaggauaauugcuuaccaaaaaacaaaaggaaauuaugugccuucuuaaguauuuaaccaguugaaagaaaacugccucuuuagcagcuuaauuuuagcagucaaaaagccuucaacucaauucauagaaggcagauaagacuuuaaguuuccaccuaauuaagaucuaaaaaaggcaaaguuucaaacagccuugaaccaaaauucggggaugcugcuggagaggaaaaaaagaguaaauggcucaaagaaaguuucacaggcgcuaaggcgugugacuucuguuugcuuccaagguuagggaagugucccacucguccccaacuagagaucaggcaaguuugcaaacuccaugagggcagggguuuuugucgccugucuccagagccccccugaacaaauccugacacagacauacaauuuguuggggcggggguggggggggauuguggugacuggcgaugcaguucuuaucuggauuuaguggcuuuuaaaaauguuuagacauuuuaaaaaauagucaaaaguacuguaggcuaaaggugaugaggaagggacaacuucuggaacucuuuucgccaucaauuuuuccaggguaguacaacccagagaagccgaccaaacuccaacauuguuuuauuucugggaccucuucaucuaaaccgugugaaggcacaucccaacauuuaagauggcagaggagaggccaccaaacccaaccagccaagcaccaaucacggcucccuugucgaagaugccaaaaagaacaucucaucacaucaccaacugaccuaagguuauuuuuaaaaaaccaauaaaaacaaaacaaaacaaaacaaaacaaaacaaaaaaaacaguuccuugggcucuggggcgaggcaggacaagacaccaugggccaucaagcagggcaaggcaccacgggcaaagccauuucaaacaggugcugcaauuuaaaaugaguaaaaacaugacuaucacuuuuggucuuuaauaucuugaauuaaagauagcgcacucgaguccccagccuggugucuggcaggcagcacacugccauuucugcuagauugccucaacuggcagcucaacaccaucuugacacaauaaacacaaauaaaaacauuuugguauuuugaacaaaauuaagacugaucacauucccaauucauaguagcccuucuauaguugaaauuaucuaaacagggcauuuuaucacugcuauauagaggaggaacccaaaaacucagaaaaaacaaaaaaacagaaaacgccaccaagcuggcuucaagguuacacagcugaaagucacacagccacaguggaacgcggaucccauucuaaaaccugacuucccaggcaucaaccuaacacuucacauuuuaaaaaaggaaaugcuaacugccuucugccucccaagaugguuccccaacccacagcccaggaggaagcucacuaacagcagcacgaaugacaaaguaucauuugcuucugcacugcacauuuuuauucaacaaaaggagcuguuuggcaaauuguagcuucucucccuaugggaaacccacaugaagucuaacguagaaaguugaccugaaacguuaacuaacgucaaaauccuucuaagccagcguaggucauuuuggugaguaauuggaaauaggaaguuauucgaaacuugggaauccuaaucguugauguuuguaauccaguuuagcacaaagggcauuugaaacucuuuugagaaaaugcuaauuuuuccuguauguaguguuagcccugcgaccaccugcagauuuuuugaucugcuaauugaucgccagacgucauuuuccucccucaaaaacugcauucucgaauggcuuugcaaaauaagaccagcucaaucugcauucuaaaaaauuaugugagacauauacauacaucuaaguuagauauguaugucuacauuauauaccuaacacauauaauuuuaggcagcucaaaugcaaacaacccaaacgcagccauuaaaaacgcacugcuugggaaaacaaccuucucucccaaggaggcaauuggaggcucugcaaacacauucuagccgccaggaguuauuaccaagaauuccacacuuggcaaagaacagcgggcacagacgacgaucaagcaggcgaccggcacgaauccccuaggguacccauccuuggcccagcccagcacucuccauucacccccacaacccgucccacccaccaggugugagccaguaccugcgaagggaccccgccucccagcaaagggcuaggcuucaagcugggccuccagggggcgcccgcgcgcaagccgggugggcuguccgcgacaacccuggugaucaauagccaacuccccucccucccaaaucgcaguggcagcgcacggccaggcccgagguuuuagcucagcucagguugacucugauuccaaacuccaaccaucguuaauuucagaagcccucucguaacaagcuucccucccgaaaggugccaaacaccaccaaaagccccacgugugugcgcccacccaaaaugaagggggaaggggaggucagcguaggaccaggggaggggucagaaccaggagcucgccccuccucuccggaggaagcaggcgggcugaggguuaacccuuuuguuccaggugggccaggccacgaagccuucacgcuccccucaacccccaccccaccccgcccccaaccaaggcacaaagagagucccuccaggcgccugggaccucgggugcgcgcugcgcugaccacccggcgccccgaaaacgcccagccauccccuccgucaagccgauccuuuuaauuugcccuggaaaaauguuaaacggggaauucuauugacguauuauaaacuugggaaauguauuacauucagucuccgacaaaaaggcggggauacggaagccaaaaaguggcgaccgucuucucgggaaaccccggguaucagagauggucucugagaguccuccgggguugccgcgcacacccgucugcugcagggaaauuagaaagcaggcggggagcggagcgacgaacaaggccggagaggaggcuacaaauccccccuccccccacgcgcacgcuaaaaacuuaucaggcgacaauuuggcgggccgggauggagacgagauaguggaaaaccgccucgcuccuaaaaccuccgcggugaagugaugaagugggaacagaguuggccccgccguuccuggcgcggcuggggucccgaacuccccucgaucugggaaacgcuggccgcggaagcgugggccaggucagccgcgggaguucgcucuggccccccaccucuccccuuucacacccaagcgcaaauguggaaagccgagcgcuccagaaaagccacgcaaaacgggaggccggugcaccccaguggggcugccgcgcgcccgccaccccggccacugggggcucgcacccucgggcuugccgcgguuauuuuuaggaagucggaaaucaaagauggcuggaggucaggccccgaaagguuagggcgaagaucggcaggcggcgcagcccgggcagaaaaggcgaaauccagaaaagaaaaaaauuuuaaagggaaacauugagcccuccucccccaccucucugggcccuccaauccccugcgcagcgcggguggcccgcaccccagcuccugaggguggggagaggucgcgcccccuccccccacuuggcccgggaggggcgcgugcaacagaucguccuccuccggggggucuuccaggggugcgccccuccuccagccuccaagaaaagccccaaggggcugguggagaggguggggaucccccgggguucuuucuuuugagagcgacgcgagggagggggaccuaaguuacaagggggggggguaacaccagugaggggaguggaaccaauuaagugaggggcagaggacaaggagaagggaaccuuucgggagcgagaacagaggagcgagugggggucaauuuuacaauuaggggagaaagcugggggugaaacuuacacaagaggggagaagaggaaaaaagugugaaaugugcaaaaggcggggugguggggagaggaggagaccucuccucccgggcacugagcccccaaaucucggcuccugaauuugcgcuggacgccgcccgcuccccgaagccugcgcccucgaggaucccgcguacguccgggaagcuccccuccccgggcgggcgccccagccccacucacccagcucccccgccgcgggcgccgcuggggccgcaucugcaaacuccggggucugcugcugcggcugcugcucgcccugguccuccuccgaguugaugugcugggguuucgccugcuugcgccucgacauggugcgagcaucggggcgccgggagagccgcaguuauuugcccucuccgccacaaauuccuggaguugggaaauuuaccccccuucggccggaacgcgcaugucccaguaauuauuauuaucaauaaugcauugcgauuuaucaugagcccugacagcugauuggccuggguccaagaccucagagaucauuuaaauaagcccucauugaucagggaggggugaggcauucugggcuuuguaguccgggccuacuugugacaaaggcguguucaucaggggagcgcagcuaauuagcauccgggcucagauuggcuggggcggggacgaaaucagagggggacccauccuugcuccagcuaucucaguccuuggagaggaaaagaaaauggggagaaaugcguacucauuaaaaaguaggagcuuacguagaaguuuuggaacggcuuuauuugguaguuacuugcuccaaagauuacuugguaagguugauguccaccagccgagaagggagaucucuucacaguggaauauuuuggcucaguuuucacaucuacacgcacacacauucccccaaaccugagaugugacccguguccccucccaucuuuuugauuaaaaauguuuaaguugagucucgagauaacugaagaaugaugaauggugguguuuucagcccucccacccaucucaacucuuaaagugagcucggaacuuccaaaauuucagauaccccaccaccaccaugacuuaccuccuuuaaaagcugauuaauagccuccaggauuccuguucacaaagacugguuugugguuacaaugcaaaccuugauuuuuuuuuaacuucaaaaugacuggcuacuaaauauagaaauggcaaaugauaagcaagcauagucagagauaauaucaaaacagcaagcaauugcauuuuuuuccccaggagccauaaaugccugauaacaucauauuuuauuacugagacaaugcucuugcaucucccauggaauggcaauggggcacugucacaguaucugguuguuacuaaucacuauuggaauuuuuuugugcaauacacacauuauuacagaaaagguguaucguucaaagugauuguaucauugacacaugaugccuggaauuuuuuaaaguggggcuuguguguguguauaugauauauuacauguauacacauuuauaccguaaauu

SEQ ID NO: 13540 - RNA, 2098 nt, Homo sapiens
aagucggaaaucaaagauggcuggaggucaggccccgaaagguuagggcgaagaucggcaggcggcgcagcccgggcagaaaaggcgaaauccagaaaagaaaaaaauuuuaaagggaaacauugagcccuccucccccaccucucugggcccuccaauccccugcgcagcgcggguggcccgcaccccagcuccugaggguggggagaggucgcgcccccuccccccacuuggcccgggaggggcgcgugcaacagaucguccuccuccggggggucuuccaggggugcgccccuccuccagccuccaagaaaagccccaaggggcugguggagaggguggggaucccccgggguucuuucuuuugagagcgacgcgagggagggggaccuaaguuacaagggggggggguaacaccagugaggggaguggaaccaauuaagugaggggcagaggacaaggagaagggaaccuuucgggagcgagaacagaggagcgagugggggucaauuuuacaauuaggggagaaagcugggggugaaacuuacacaagaggggagaagaggaaaaaagugugaaaugugcaaaaggcggggugguggggagaggaggagaccucuccucccgggcacugagcccccaaaucucggcuccugaauuugcgcuggacgccgcccgcuccccgaagccugcgcccucgaggaucccgcguacguccgggaagcuccccuccccgggcgggcgccccagccccacucacccagcucccccgccgcgggcgccgcuggggccgcaucugcaaacuccggggucugcugcugcggcugcugcucgcccugguccuccuccgaguugaugugcugggguuucgccugcuugcgccucgacauggugcgagcaucggggcgccgggagagccgcaguuauuugcccucuccgccacaaauuccuggaguugggaaauuuaccccccuucggccggaacgcgcaugucccaguaauuauuauuaucaauaaugcauugcgauuuaucaugagcccugacagcugauuggccuggguccaagaccucagagaucauuuaaauaagcccucauugaucagggaggggugaggcauucugggcuuuguaguccgggccuacuugugacaaaggcguguucaucaggggagcgcagcuaauuagcauccgggcucagauuggcuggggcggggacgaaaucagagggggacccauccuugcuccagcuaucucaguccuuggagaggaaaagaaaauggggagaaaugcguacucauuaaaaaguaggagcuuacguagaaguuuuggaacggcuuuauuugguaguuacuugcuccaaagauuacuugguaagguugauguccaccagccgagaagggagaucucuucacaguggaauauuuuggcucaguuuucacaucuacacgcacacacauucccccaaaccugagaugugacccguguccccucccaucuuuuugauuaaaaauguuuaaguugagucucgagauaacugaagaaugaugaauggugguguuuucagcccucccacccaucucaacucuuaaagugagcucggaacuuccaaaauuucagauaccccaccaccaccaugacuuaccuccuuuaaaagcugauuaauagccuccaggauuccuguucacaaagacugguuugugguuacaaugcaaaccuugauuuuuuuuuaacuucaaaaugacuggcuacuaaauauagaaauggcaaaugauaagcaagcauagucagagauaauaucaaaacagcaagcaauugcauuuuuuuccccaggagccauaaaugccugauaacaucauauuuuauuacugagacaaugcucuugcaucucccauggaauggcaauggggcacugucacaguaucugguuguuacuaaucacuauuggaauuuuuuugugcaauacacacauuauuacagaaaagguguaucguucaaagugauuguaucauugacacaugaugccuggaauuuuuuaaaguggggcuuguguguguguauaugauauauuacauguauacacauuuauaccguaaauuc

SEQ ID NO: 13541 - RNA, 2098 nt, Homo sapiens
gaauuuacgguauaaauguguauacauguaauauaucauauacacacacacaagccccacuuuaaaaaauuccaggcaucaugugucaaugauacaaucacuuugaacgauacaccuuuucuguaauaauguguguauugcacaaaaaaauuccaauagugauuaguaacaaccagauacugugacagugccccauugccauuccaugggagaugcaagagcauugucucaguaauaaaauaugauguuaucaggcauuuauggcuccuggggaaaaaaaugcaauugcuugcuguuuugauauuaucucugacuaugcuugcuuaucauuugccauuucuauauuuaguagccagucauuuugaaguuaaaaaaaaaucaagguuugcauuguaaccacaaaccagucuuugugaacaggaauccuggaggcuauuaaucagcuuuuaaaggagguaagucauggugguggugggguaucugaaauuuuggaaguuccgagcucacuuuaagaguugagaugggugggagggcugaaaacaccaccauucaucauucuucaguuaucucgagacucaacuuaaacauuuuuaaucaaaaagaugggaggggacacgggucacaucucagguuugggggaaugugugugcguguagaugugaaaacugagccaaaauauuccacugugaagagaucucccuucucggcugguggacaucaaccuuaccaaguaaucuuuggagcaaguaacuaccaaauaaagccguuccaaaacuucuacguaagcuccuacuuuuuaaugaguacgcauuucuccccauuuucuuuuccucuccaaggacugagauagcuggagcaaggaugggucccccucugauuucguccccgccccagccaaucugagcccggaugcuaauuagcugcgcuccccugaugaacacgccuuugucacaaguaggcccggacuacaaagcccagaaugccucaccccucccugaucaaugagggcuuauuuaaaugaucucugaggucuuggacccaggccaaucagcugucagggcucaugauaaaucgcaaugcauuauugauaauaauaauuacugggacaugcgcguuccggccgaagggggguaaauuucccaacuccaggaauuuguggcggagagggcaaauaacugcggcucucccggcgccccgaugcucgcaccaugucgaggcgcaagcaggcgaaaccccagcacaucaacucggaggaggaccagggcgagcagcagccgcagcagcagaccccggaguuugcagaugcggccccagcggcgcccgcggcgggggagcugggugaguggggcuggggcgcccgcccggggaggggagcuucccggacguacgcgggauccucgagggcgcaggcuucggggagcgggcggcguccagcgcaaauucaggagccgagauuugggggcucagugcccgggaggagaggucuccuccucuccccaccaccccgccuuuugcacauuucacacuuuuuuccucuucuccccucuuguguaaguuucacccccagcuuucuccccuaauuguaaaauugacccccacucgcuccucuguucucgcucccgaaagguucccuucuccuuguccucugccccucacuuaauugguuccacuccccucacugguguuaccccccccccuuguaacuuaggucccccucccucgcgucgcucucaaaagaaagaaccccgggggauccccacccucuccaccagccccuuggggcuuuucuuggaggcuggaggaggggcgcaccccuggaagaccccccggaggaggacgaucuguugcacgcgccccucccgggccaaguggggggagggggcgcgaccucuccccacccucaggagcuggggugcgggccacccgcgcugcgcaggggauuggagggcccagagaggugggggaggagggcucaauguuucccuuuaaaauuuuuuucuuuucuggauuucgccuuuucugcccgggcugcgccgccugccgaucuucgcccuaaccuuucggggccugaccuccagccaucuuugauuuccgacuu

SEQ ID NO: 13542 - RNA, 1102 nt, Homo sapiens
cuggagggguucaaagauuccaguucuaauaugggaaugagccucuuugaucucuuccggggcuuuuucggcuuuccuggaccucagagcuacagagaucccuuuuuuggagggaugacucgagaugaagaugaugaugaggaagaagaggaagaagggggcucauggggcugugggaacccaagguucgauaauccucagcaucccgccccuccccgccgcccccccuccgcccccacaacaaggaauuuggcuuugacuucagcuucagcccaggaggagggauacguuuccacgauaacuucggcuuugaugaccuaguacaagauuucaauagcaucuucagcaauaugggggccuggaccuugccuucccauccuccugaacuuccagguucugagucagagacaccuggugagagacugcgggagggacaggcacuucgagaaucaaugcuuaaguauccagauagucaccagcccaggaucuuugagggggucuuggagagugaugcaagaagugaaucccccaaaccagcaccagauugaggcucccagagaccauuucauggguuugaugacguauggccuguggacccccauccuagaaccagagaggacaaugaucuugauucccggguuucccaggagcgucuuggcccgguucuacagccccagcccagaucuacuucaagagcaucucugugaccaaaaucacuaagccagaugggauaguggaggagcgcuggacugugguggacagugagggccagacagagaccgcaguaacccaacacgaagcagauagcaguccuaggaugauccaaaaucaccaagaccuccagcucuggaugaugccuucuccauccuggacuuauuccuaggaugcugguuccggucccgguagccuuguuaacccucagaggccuucaaguccuuuccaccucucacccauugcccaccaucaauaagcuuagcuucuccucuugcccccucagggucuuggcuauguggaauagugaauugggggcaugucaguuugucacucacccaaacugaccaauaaaaccuuuauuuaugcuaaaaaagagaauaauaauaug

SEQ ID NO: 13543 - RNA, 385 nt, Homo sapiens
uacuuuuucuuugugagcagcaacugaggugccagauaauauaggucaccugaaggacaagccgucagaauuggagaucagagccgcucaggccggccgccagcucguuagggaaccgcacacucagcucccacccagcucgggacgcccagcgggagcuucccuugcaaacaccagcagacaccauuuugcagaacucuuaagaaacgcggguuaaauguguuagguacaacgcaugcagccaagacgggcauggagagcgagagggcuggcccgggggggaagcaaaccuccugaugaugggauugcucuugcugggggcuuuguaaacagccuugcaucucacaccucugccaggcaacaaaauggugguggcuagaaaaaa

SEQ ID NO: 13544 - RNA, 500 nt, Homo sapiens
agcaagagaacgucugggacagagugacugaugggcuucccuucugaggaugcgaaguuuagaaucaucuuuaucccaacccugacaguuuuggcucuucauuuuucuagcaaugaaugagagcucuucuggaaaagcugggaagccuccguguggagccacaaagagguccaucgcugacagugaagaaucggaggccuacaagucccucuuuaccacucacagcuccgccaagcgcuccaaggaggagucugcccacugggucacccacacguccuacugcuucugaagcccgcacugccaccgcuccugccccagaagguuguuuaguuuccacguaggcaggucgcuuugugccucugagugcgcugcuguguguucucucuauaguucugugucauaaagcuguccuggccagccuucaagcugguguggccacucuugaugugaggcgugucgguuccaggggggacaugggaggggcugcacaguggcccgag

SEQ ID NO: 13545 - RNA, 14200 nt, Homo sapiens
cgacucggcccucggggaacucuuuuucuacgucucuccuacucuuaaacuccucaacucacagaggguuggagagcuggcaccaugagcuuccaguuccuacgggugagaaaagaggugucuguguggagggcaggugcgaccccgggggcuagcagagaggagaggcugcgggaggacucgcugcgaagggcgagggguggcgcugggugggacgggcgccuggggccgugcaggguggcuccugggugcugcccgggcugccugucgcccaguacuggcgcaggaagacggguccgcgcagcgucuggcaacaguggccugcuccacgccuggaggcgaccaaguucugaguuaaaggcgccgggcuuagccgggaaguguauggcgacccagaacacggagcggagaaggccucaggggacacgaggcuaccgccuuaguccucgggccugcgcuccgagcgguuagggugcguacggaugggcuccgggauguuaguggagaggugacaggagucuaccaucccacggccaagcgugugaggccuccggcgggcgggggucccccccggggcagggcagggggagagucaggcaugucucuaacgggcucccuaguagaaccgcuaggaaaguggccuucaacccuaggcaccuuuguggcuuucagguaguugggcgacuaaaaauucacuuuugccugcugugaaaugggacaggugguugucagguuagagacugugcccacgaagucucguuuggcgggccgggacugacguggacccgggcccuccucggaagcuugggaaccugugagccccucagcuccucgccucacuuugccuguuugaaaaaaggaguuguuugagaggaagaguuaaggcucaaaagguucuaaacgaagagcaugcggccugacgcggagcgcaaagaagcgagcagugaacugaaucuggugggacugagaccagaggcgucuguaugcggcggccgcuucgcgcccuauuaaagcaaucuguuauuuacgauaaucauuuuuguaauuauuuuggaguggcugugacuugaugucuguggugccccagggcaugcccuuacuggacauagauacuucagggugcccuuugacgccagugucgguccagugggugccagugccgcgaagggaggguggcgggcgugaaugcccccuccuccuggguuugccgcaggccccggccuuuccaccuugcuugauccuggcgggucugccacuuacugaggucccuaccggcgcucacguugucccgagaggcgggacaaacguccggcgcguggcgcggagucugcgaaagcgcucgggggccuccaucuucugcucgggaguccccucccuggggcgggaagaggagucgcagaucugcccgaaucuugcucuacccgccuggccgccuucuuccgucuggggugggggcagggguggcggaugacucaggccuggggccgggagcccuguuuccaaaggcaccaccucgcgccucuuuggaaguggcgcgcuguuggggcgcucccgcuguugcagaggccugguuugcgguuucauaggggcguggguccagggcuuccagggaguaagugaguuuaggcucccuagggggcgguagaggggaacccccgacaaccuuccauccucuucuccaggcggcugcgaggccuccgggguuccagagggguccccuucugccggugccggcugucuugagcgcggccacgcaguccgcgucuucacgugggcaaggggcggggacguuggagggaggcugucuuggaugcuggagccuucgguucccggcucugcugagcagaaaaguugaagucaaggaaggguugaggcuuccucacaagggcgcgcgcgugccugggugccggcccagaagccgagaaugugcguauuggggaagggucucccgugccgagaagacagaggauuuguucuagcugccuuccguacagagggcgcggagguugcgcuccaguucgaacgcuuacccauuggaaagagggcagcgccgggguccagggaagcuccuugggaaugaauggccuuugccaagcgguuccggauccucuggguccuuugggcccacggcacggugcugcgcgagcccucagugcccaucggcucccuucgccuccugcguagacgcucccaggcggggaggcauaucgguuccuccgggcagcuuuggcuaguguugcugugggaaaggagagccagggccugggaugggggaugagcaccuucuugcccauuccgggccccagcgugcaggagguaaacuugccagcacagacaagacagcuuguucaagcugcaccucaggccgggucagagaauaaaaccgagggcuagaaggcccagaaugucggacagcccagcggcacccgucagggagucccaggcgcccgaaagaggcgccgcaccucuggcgagucuaggacccaucuuccuggaccugugcucuggagugccugcgggccugggucuaauuucugcuucuggcaggugucccccucccccgccgcuaauaccaggagcgcugcuucugcgguaacuuauuuuacccccagaagccuguuuugggaccgaagugucaggguccugugugucuuuuuaugcacuguucuccuuagugcaaagcccugcagauaugcuuggccgaaaagucucagugguuucaacuuccagauuuuguucccgcguccggucggaaaaucaccugggauuuggcugcugucuaaggccgggggaaaguuucccuuggaggacgccuauuauuauuauuuucuuuuaggcccaccugggucuaaauaaaugcuaaaguucaaacgaacccgagaaggaacagcgaggcaguggaugccgccauuccguggaugggagagucaugucuacugcaggugcggacaccguacugauaggcauugauuauugcaaaaucguauucaguaucaaauagaaauagucuuguccucuaauccccacagaauguuuaaauccagcccagggagccaguuggggcgucccaacaaauacgcccucgagaauuagcgauguuccccuuacaaugaaagucaauugcugcauaauaacugggccaaagaauuucguuaguuuaaauuuuaaaaauuaguauugcacuuugcuuucaaguuuggguggcaaguaccgaaggggagagggaagcagcguuuguguggaaggaaguuucguuuucugucuaaacaugugggaccugggugucuaccucuccagucgagagcucucugcaggcucucucccaacuuccugcaccuccucacccucaccuuacccguggcgcucggguuuuauuccugcccggcgcuucuuucccagggcgaguagaggcuucugagugaccggcccgccagaggcagcugcagagccggcguuccgcagggcagggcagggccgggccgcugggcugguccagugcgcgcggguucccccuggccucagccagccgcgggagaugccacuucgggcgacagcggcgagacgccgcuguccgcaacuccugggcggguaggaccgucugcugccucugcggcccuuggggcagacuccccaggagucccuuccucucuccucccgcccgggggccgggaccgcgcugugcccacggagggaacugggcgucucuggcgcacuggggcuccagcugcaugaucccagcucagaccuuaagccucagugggguguaggugggaugggauguguuuuuaggagaugaggagaccccgguuguugagucgcuccccaaaugcgcaguuucuuaacuccaggugacauccgucuuuuggaggaacgagugaaggccguuuaggcgaaagagggguggguuucaguauuuggaucccuucccccagcucugccaaucucagguguguuuacgguggaggugacagaaggaaggcgcgucgggggacccaggccucgcaggucuucggcugucaacgaggcaccgcccacugacuccgcgcuucgucccucacagcguggggcucggcgcugcgccaggcccgggugcggggcggagcuaggcugggacuggcugggggccgccccgcccggcgccugggccuccgcgccggcccccggggaggaguuaugauaauuuccuucucauuaaggcgcucgggucccccggcuaucgccaggacacacuguucgggcgcggcuuuccccguccgcggagcggucuugacacucgcggcggcagcaucuacgcucgcagagccgccgaugcguguccagugacccggacagcaaggcccgcgcgcggcgggggcggcggcagacgccuggucaccgugaccccgauuuuggauuuaccgcuugggggcuggggggauccuggauuuaacuggcgacuguuuugggggacgccggacgccauguuguggaaaauaaccgauaaugucaaguacgaagaggacugcgaggugagcuggggcuccggggugcagccccgccccgccgaggacaguccgggaggcaggggccacuggaccgaggucggggacgagggcauaggagcccuggccucucggugggacgggauccacuucuccggacaccccuuaguccauuucugcggggccccuuuccuguauagggccuuuuccuaaauagccuccccucgggaacgaggccuggaaagagaauggcaaaucccacccacacagcuuaccgggcgcuuuccuaagcggcaaacagcccugcuucccguuuucucggaaaagugccccgucugcaacccucagacguggcuuuuacgcacgaagucucuguccaaaggggucagaugaggcuaccugcuagcgacaccuuggcggacacuccuccaaggccggcuugucaccugccccgcuaccuccucggggaagcacgaaaacaaccgaaguuuggcuuucaaaagaagugggggcuggggagugguggugggggugcccgaggccagauggggccguaagagcucgcgagugcuccagccugucggacagguugagcuagaguuucggagagugggagggaagaaggaggcggcgagcgggaagaggaagaagacgcaggcagcgcuaggcgagcucaggggcgccgggagcgcggagcucgggcuacggacucgcgggaguucacugcgccuccgggcccuggagggcugccccugcccgcaggcccgggcgcuuccgccaggaggcgacagcgccauguuccuccagguucccggcgccccgagaccccugggcagauggggacgcauccuuuagaaacugagucgggccgcccaggggcgagggaacgugcgcgggcaaggcugcccaauuuccaggguucuucaugcccccucugcgccccgacgugcgagaacacugcccuuggcagugcagggcgcccccacuuauuacuccccucggcugggcccggccagcagggagggccgcccugugcgcgcgcucccucuucacuucccagggcggcgcaggguggcgggcccugcuuuccgagcgccgcccgcucggaggucuuugucccgagggcguggaagggagggucccgggggcgggggaggugcgcauuucccgcgccgcgcacucuauccgcgccugccgcgcugccaccuccagcagucccugcgucaugggcgggcuccacgagauagcucugcaccgggcguccggcuccuucgccccgggcucuggcuccuucgccccgggcuccggccacggacuuuucuggcccaagacccaggguucggacuuggcgccuccaagcgccucgggcuugggagcagcgccuagaccuucgccgccgggcuuugagaacucguucccccaggucuuucaccagacucuccucccuccccgcacucuuugcuuacaacgaaauccucggggcgcauugcccccggguaccuuccgacccugggcaagccccgccgggcggggugcgguuggucccccggggcccucugcguagcccggcgaugccggccaguucgcaguagcgggguuucgcacuaacggggucuccuguuuuuuuuuuucccuccaggaucgccacgacgggagcagcaaugggaauccgcgggucccccaccucuccuccgccgggcagcaccucuacagccccgcgccaccccucucccacacuggagucgccgaauaucagccgccacccuacuuucccccucccuaccagcagcuggccuacucccagucggccgaccccuacucgcaucugggggaagcguacgccgccgccaucaacccccugcaccagccggcgcccacaggcagccagcagcaggccuggcccggccgccagagccaggagggagcggggcugcccucgcaccacgggcgcccggccggccuacugccccaccucuccgggcuggaggcgggcgcggugagcgcccgcagggaugccuaccgccgcuccgaccugcugcugccccacgcacacgcccuggaugccgcgggccuggccgagaaccuggggcuccacgacaugccucaccagauggacgaggugcaggugagcggcgcugcggcuccugaccggaccuguucacccuacggccuucugcccccaccccgcacuccucuaggcucccccgaacuuaagggaauuuuguccucucucccccagaaugucgacgaccagcaccuguugcugcacgaucagacagucauucgcaaagguaaauagcaagguggcaucgucuaacucuggucacacgaucugggcuugugaaguugacuggcaagguuggggguauuugguggccagcgugggacauuugugguagaagggacugaaagggauucauggaagcuagauuuuaggagugacagaaagggauuucccuccgaccuccuaggagcugucucuucaucuccggaguuguuacugccuaguuuuuuuucuuggaaaaauguccaugaauuccaguggguguuucacaaugugagagaaagucuuccagagcgagugaacacugauuuaacuugaaaaacaacaagaaaaaagucacaggcacaccuucguugagugguugguucuguaacaauuuuaauuguugaauaaguugugauuuuauuuuugauuucaaacacguguauggaaaaccuccuuaauucugaccugcaagaaaaguuuugaagcaauuuggccuaccaaaugaauaccuguaaaaggaacagagcuuggaaugaucugucagagggagaguuuugcaggauggggaggaggggauuuggaaaauuggauuacuuggugagugagugguuuaugaaauuaaguuacuuaacugacaggauuaccaggauuaccauuuugacuguuuugggaaauagaguaggccuaaauugaagguaguuuuggccuguuacuugaacugcuuaaauggauugaggauggaggaaaaauggauuuuaaagaaaaacucagaaaagacuacaaauuuucaguaaacuuagaacguauuaguuuggaugauuaaauuuacugugaucaacugcacugaaaaauuuuggaaagaaucuuaauguguccuaugauuuugguuguucuugaggggaaaaaacucaccguuuauuuaguauugaagcagucuucugaaaacaaauguucuaauuaaauaguuuucagcagcugcuaggaaaaaaaaaaaaagaaacccuccaagcuuuggaucuucacuaauuaacuucccaagguguuaacuugugaauuucagauuagauuugucucugaaguagggggcuuuuuuaaaaagucagccauggccaggugcaguggcugacaccucuaaucccagcacuuugggaggccaaggugggcagaucacuugaggucaggaguuugagaccagccuggcuaacauggugaaacuccaucucuacuaaaaauacaaaaaauuagcuggauguaguggugggcaccugcuggagaauuacuugagcccgcaagcugaggcugcagugagcagagaucacaccacugcacuccagccugggccacagagugagacucuuauuauuuuuuuuuuuuaaauaaagucagccugcaguugaucguggggugugcaaugaugcuugucuaaagaucacuuucagcuuugguuauugguuuugaaaaggucucuuuugcucagagagagcucuugugacugccagcucugaccuucauucacaggucccauuuccaugaccaagaacccucugaaccuccccugucagaaggagcuggugggggccguaaugaaccccacugaggucuucugcucagucccuggaagauugucgcuccucagcucuacgucuaaauacaaagugacaguggcugaaguacagaggcgacuguccccaccugaaugcuuaaaugccucguuacugggagguguucucagaagguacuuggggcacaauucuaggcauagugguuggguaguugaaggugaguguaucagaggcccaggagguauuuuuaacauuuaugugacuuuaugccuaacacugaauucuaaucggguuagaguuuuaguacauuucuucuccuuuagaaagugccaaaugugggaggaagugcuaaaacgacgcucacaaauucucacuugguuagaauuugaucccauguaugaagugauagcaucuguauugaggggagguggggggagcacccuggguuuguuccccagggaguuuuuguggggccguuguaguuucacaagugaaaauuugucugcucccauacaauuugaaauauucggugaugcagaguuggaugcuaggaaagauugauuuuguaucuuacggggacuaauugaaagaggacccugcuaucacuuuucauuaugguucacgugauguagauagucuuugauggguuucagcuuugacagcagcacuuuaggaguuuagaauuuuuaaagugugcguguguauguguuuuuguuuuugagaguagccagagucaauuuuucuuuuucuuagagccaaaucgaaaaauggaggccgguccuugcgggagaaguuggacaagauuggguugaaucuuccggccgggaggcggaaagccgcucaugugacucuccugacauccuuaguagaaggucagugggguuuuguuuuugguucgugauguuuuuaauuugugccugugucuuuaauacuuauugcagaaaaacuggaaaacaacucuuaaaacuugguugcaaguagagaugaaagcaauuggaauuguucucuaaguuuauuggaaugaaucacaguuaauuuuaucgaauaaguuaacauuuaaguaucugguugcucagguaggcucuucuguauucccccagagaaucaauguuggaaagaaacugguuuuccuaaccuaagaaaucacacucuaggggugucggcauuuccuguuaaaugaaccaguuuuuuuggaagauaacagcugaucauuugguacaccuugaguaaaagcugguuacuuacuggugagcagaaguacugcuucuguuuuuuguagcuguggguuauuuuguagcuggggauuguggucagugaagagaaccucuuguauacaauacgacuggcccgauucacaauucuauucuucccucccauccaaagaaaaaaacuaaucgaaccccuggcccacgcacaaguuccucuugccagugcuaagauaguaggacauagcauuucaguuucuugaauggggggccccuuuaccccaaccuggacaguagccaagaaugcaacacaaccuuuaaaaggagcugaagggaaaguaaaauaauuuuuuaaaaacaaaacaaagcauguuguuacugcucccgggaagaguuggacgcugagagaggcuuagggcucucacuaugggcaggggaagccaaggagaaacgggcuccccguggcaguacccucuuuugaagacuuucuuuccuugcucugauggcgugacguggugcucaaagagacuuggcagagucccugcuuuaccuuuuacgagugccuuuggaggucagggcaaggagaaaggagcugccugucugagaacagcuguccugccuguagaaucggcgguucugcugggguuucuugcuagccaggcagggugauugaauaagaaagugugcuccagaacaauggcucuccaaggcugcuucagucaacccagggggccccuccaccaucuggguuuuugcaaagcucaccaguccugcacccuggagccagggaagguaccucuugggugggagaaacucucuugguugccucccuuagcucuuccacugacuuggacagggaaaagggugcuccaaguugguuuuuaggagaaacaucccucccaucuuuuuuaaaagaaacauucuagagaucugccccuucaguaaaaaggcacuauuaaaaaaaaaguaagcugucagaugucaccauuuuauagagaagugacuaguuugcuuuugucaaacauguuuauagcccuuaaauuuuccuacuuccccaaaaugauacuacuuaauauaaagagaaaacauggguauguuugauuaucuguugagcagaggacugguaaacauuuuucaaguuuacucaucucaguauccauggggcacugguuccaggucccauaccaaaaccugaggauguucaaaauguuauauuuguauauaaccuacacacauccuuccguauaguuuaaaucaucucugcaucacuuacuuauaauaccuaauacuauguaaaugcuauguaaauaguuguuacauuguauugcucagggaauaauggcaaaagucuguguguguucaguacagacacaaccauucauuauuucccccccgaaucuuuucaaucugaguuuggaugaauacagauucugaacccacggauacagagggcugacuugauugugcaguuagaaguuucagggucuuuucugcucacauugugugaucuccacccucuauuccugggguggaggaccuacugagaaucccuagaaaguucuaccuaccagcugaguugucugcccuguauaugauuucguucuugcaugcaacguaugacugguagacaaugaauacuacuagaaagagagaaaaugggggcugggugcuguggcucaugucuauaaucccuggcaugagccauugguugagaccaggagcucaagaccagcuggccaauguggcaaaacccuguaucuacuaaaaauacaaaaauuagcuggguaugguggugcaugucuguaaucccagcuauucaggggcugaggcacgagaauugcuugaauuccggagguggagguugcagugagcagagaucgggccacugcacuccagccugggcaacagagcgagacuccgugucaaaaaaaaaaaaaaagagagaggaaaagggcaguuuggccucagugaccacagccauccuaaaagcuguugcugauuauucuaggugaagcuguucauuuggcuagggacuuugccuaugucugugaagccgaauuuccuaguaaaccaguggcagaauauuuaaccagaccucaucuuggaggacgaaaugagauggcagcuaggaagaacaugcuauuggcggcccaguaaguaucugaacuugaauuugaugaugacucaaugcucuagaccuugagguugagaagauucccccuccacagucccgauggcucaacaaagaaauauucuugaaauaaauuaggguggagcaaaagaaaauggcaagggagcuucuuuuacaaagucaaauacauuaacuuuuuguaugauuuagaagagugcaugacucagccaugaguauuuuugagcugcuuaguuauucaacccaaaguaguugagcugcccuuucauuauuguguuagcauaucuuacaaaaauguguugaaaacccgauuuguuuugucacaaccaguaaagagagauugugugccuucuaccuccugauagcaagacuuuugucuuucaaauguaaagaucaggguggauuugugggcaaauuaacugucuccaaaacgacuuaaugcagcuguggguuuucucauagaaaccaacaguaaguugauuugaaaaugaugguaaaugaagcagaacuagucgagccaggaaaugggguaaaagagagcgcagugaaccaggcugugucaggagucagaauuucagggggaugcuuccuucucccgguuccucacggaauuuguuuauuggaaccaacuuguaccaagguaaacugucccuuaagcucauggguuggaauccaggccccauuacuuuuaccaguccuggugaccuuggccaguuagcugggguuaaguuaauccuguugucuuuucuaauugcagugaggauuaaauaagauagugcuuuaaaacagcuuaacucagagccuggcgcagaauaguugcuaagcgcagcaguuggcuauuaguauuaaauucuccuuccucggguugaagcaguugugcuugccucccgggcgccagccucaguguaguugguucugugcucuugaccuguaaggagcuagauggaacucaucgagucaacugacugucuucacaggcaacuguguaaagaauucacagaacuucucagccaagaccggacaccccaugggaccagcaggcucgccccagucuuggagacgaacauacagaacugcuugucucauuucagccugauuacccacggguuuggcagccaggccaucugugccgcggugucugcccugcagaacuacaucaaagaagcccugauugucauagacaaauccuacaugaacccuggagaccagaguccagcugauucuaacaaaacccuggagaaaauggagaaacacaggaaauaaaauuggaacgaagaaagguuaggagaguagggaaggaacaggacugcaaaaauccuucuccaccgcacagacugggaaccccuccuggccugggggaagaguuuguuaccuaccuuacuauuuaaagagccuucacugguucugcaucacccgccccuggacuucuuaguuguuucucuagcgcugagcuaucuccuaacuuuggaccuauuaucagaaggugacaaguacuggcucuuuauucauuaagcuuuuuuuuuuugaaccccauucuuuccuucucugaaaguggugcuauaaguuuuagaaucuuuuaaauacauucccugggccaacagacccacacacuuagccauugaaaugucaaauugaugugcccuagaucaacagaucaacaauaccuuuuuuuucaguguuaagguaaugguugguuuuuguguccgcuaaauauuuaccuugaaaaaaagaaaaguguguaucuagcuucuucagagaucaaguccucugguaggaggcaaagguucuaucugcuuagcaacuaguuaauaagugguaucugacacacucuaaaccccguguucaaacgggggccuucugguuuuaggaaacuuguagaaacgaagccugcugauugauuuuuuucuccuuuuuuuuuuuuuuuuuuuuuaacuuugaaaguuaacucuucaaaugggagacucuuugaaaugacauguuccuuuaagguacugaagcuuuauuugcauauuuauuucagauguuucgaguaaacuugaaaaggguaggcacgaagcaauuuguugcugcuugucacccccaaguccccguggagguucuguauuuuaagaaacagugcguugaguguacagauuuuauuuaugcguaauuuaauggggucuguaaauacuggugcacuucuuacgacuuuuuugagacaugggauccaauuuuaauauuaacuuuuaauggugaugggguaaucuauaacacaucauaagguuuuauucauauauauacaggguauuaagaauuaagaggaugcugggcucuguucuuggcuuggaagauucuauuuaauugaaacucucuguucagaaagcaauaacuuugucucguuccuguugggcugaacccuaaggugagugugcaguacagugugugugggugaaauggagauuuggaauugaacucucugccuguaaauguuccccaaauaauuguuguguguaugauacguguauaauaaaaguauucuuguuagaaucugaaag

SEQ ID NO: 13546 - RNA, 1576 nt, Homo sapiens
uggcaggggguaucugugggggcgaagguggagacugaugguggguggugacuuuggccacaauuugcuccaagguccacauccuuguacuugacccucgguggugcauaucuaacacaauuaaauuauagaaaugcugggccaggugugguggcucaugccuauaaucccagcacuuugggaggccgaggugggcugaucaccugagguugggagcuggagaccagccugaccaacauggagaacccccaucucuacuaaaacuacaaaauuagccgggcaugguggcacaugccuguaaugccagcuacucaggaggcaggggcagcagaaucacuugaacccgggaggcagaaggguugcggugagccaagauugcaccguugcacuccagccugggcaacaagagcgaaacucugucucgaaagaaaaaaaaagaaagaaagaaaaaagaaaugcugaguaaaaacgguuucgaaugcuaaagccagcagagaaauuacauauuugagcucugacccuuuguaacagaauccagaucugugguaucucuauuuugggagguuuuagcauaagccaucuuacacauucccucucaccaagaguuaggcagcaaugucuuuguccuuccaccuugcaaggucacucugaccugugggugggucacccagaggugcugugagugggacagaaauagcugcucugagcaaaugccuuucccagcagucucuggggaggaugauacuccagcuuggcagagccccuccagcccugcaaacaagugcuggucucuguuugacccuuauuuagcgugucgaugaaggaaggaaugacagaugacccaggccccaauccuggccuguccuuugaguggucccuaaaauaauaccauuaguggggccaggcacagcuucuuaucuguggagugggugcacugauaacacugagcagguccucacggaagcccugggugaggagggguagcagcugcgggccuuggacauguugcgaaggucuucgccuccuggcuggccugcugauguuccaagggguauaaauaguccgacgggcuccacgucugauugugcaggcauggcggcagcggcagagccuggcacaccugguaugugacacccaaccaaagccacggugcacaggcaccugcugcugccucugccgccauguccucagccagagugggcccugugaacuccuccucccagccuugcccagccgugaccuccuugucccugcuucagggacagggauauugaagggugcucaccuucaauaucgugccuuaagcauuucuguggcugcccacaguucaucaucagaaugcuucuuuuguucacauuuauuauucuugguccuagauuuggaaauaaagaacggcacacaggaaaagguaaaaaaaaaaaaauuguccuuaaaucugaccuucuccuuccacuggauauuagcuauacuuauuuuuagacuuuuuuucuauccauacuuacauuguuuugcuguuguuuuaauacaaaagggauuauacucaauuuuuguagccuucucucuucacuuacugaau

SEQ ID NO: 13547 - RNA, 1228 nt, Homo sapiens
aaaaaggaggucauuuucuuccaaagucugaaauaauaaggagccaaagcagcccuguucuucaguaguagucucugcuuuuuaucuacucucaaaucuuuuggagggaucuucacaagcaggugaggcugggggcaggggcagcaggucuuggugcuacaauuuacauaugaaacaacugauccgucagugucuaagcaaggauucuaguuuacccuucuuugugcaucucaccugagccuauucugagccuggcacacagcaggugcucaauuaguaccuguugaaugaauaguaauaagcacagccaaaaccuaaagagaccgguugacugagggcugacugugcaggcgccaagcuaaggcaucucccagaucccucaccccagcaacccuuccucugagacgccaucuuuucucaugcaagaggaagagacaacaugcucuucauauccaagaccucaagagauaagguuuccucugaagucccacaaacccccauuuagccuuaucuuuucugugauccaugcuuggugggggggucuuucuuuucccuguuuccuccccgagaggcauccccaagacugcaccaggcccucagugaaugccgaaugaaugaaugaaugaaugaaugaaugaaugaaugaaaaccggcaagcaagaaauaucuggcugggagugcauccgaugccaguuugggagcugagcccaccaccagaaaaggcuuugagauugccgagggcaagucuuguguggaggagguagccugggcacuggagccugcccagccgcauucacacuccagcucugucucuuccagcugugcaccaugggcaagggacuuaaccucucuacaccucaguucccccaucuguaaaauggggugacugauagcgccugucuucugggaucgcugugagguugcagaacuuaauucauggaaagggcuuugcacagugccuggaacacagagaaaacccuugauaaauguuauuguguuaccaucuggaugaaaaggaaaauaugguaacaggaaagccuccugaguuacaaaauaacaacaaaacuuuucaugauggucugcuuuuuggccaagcagagaaaagcagauguauccugacucugagagcaagagcaaaaguaccagagcaaaagagagagugaaguggaagggaacaugagagaugaaaaggucaucacugcauuccaauccucacauugugccuagg

SEQ ID NO: 13548 - RNA, 1228 nt, Homo sapiens
ccuaggcacaaugugaggauuggaaugcagugaugaccuuuucaucucucauguucccuuccacuucacucucucuuuugcucugguacuuuugcucuugcucucagagucaggauacaucugcuuuucucugcuuggccaaaaagcagaccaucaugaaaaguuuuguuguuauuuuguaacucaggaggcuuuccuguuaccauauuuuccuuuucauccagaugguaacacaauaacauuuaucaaggguuuucucuguguuccaggcacugugcaaagcccuuuccaugaauuaaguucugcaaccucacagcgaucccagaagacaggcgcuaucagucaccccauuuuacagaugggggaacugagguguagagagguuaagucccuugcccauggugcacagcuggaagagacagagcuggagugugaaugcggcugggcaggcuccagugcccaggcuaccuccuccacacaagacuugcccucggcaaucucaaagccuuuucugguggugggcucagcucccaaacuggcaucggaugcacucccagccagauauuucuugcuugccgguuuucauucauucauucauucauucauucauucauucauucggcauucacugagggccuggugcagucuuggggaugccucucggggaggaaacagggaaaagaaagacccccccaccaagcauggaucacagaaaagauaaggcuaaauggggguuugugggacuucagaggaaaccuuaucucuugaggucuuggauaugaagagcauguugucucuuccucuugcaugagaaaagauggcgucucagaggaaggguugcuggggugagggaucugggagaugccuuagcuuggcgccugcacagucagcccucagucaaccggucucuuuagguuuuggcugugcuuauuacuauucauucaacagguacuaauugagcaccugcugugugccaggcucagaauaggcucaggugagaugcacaaagaaggguaaacuagaauccuugcuuagacacugacggaucaguuguuucauauguaaauuguagcaccaagaccugcugccccugcccccagccucaccugcuugugaagaucccuccaaaagauuugagaguagauaaaaagcagagacuacuacugaagaacagggcugcuuuggcuccuuauuauuucagacuuuggaagaaaaugaccuccuuuuu

SEQ ID NO: 13549 - RNA, 586 nt, Homo sapiens
uuucggccggaaccgccaucuuccaguaauucgccaaaaugacgaacacaaagggaaagaggagaggcacccgauauauguucucuaggccuuuuagaaaacauggaguuguuccuuuggccacauauaugcgaaucuauaagaaaggugauauuguagacaucaagggaauggguacuguucaaaaaggaaugccccacaaguguuaccauggcaaaacuggaagagucuacaauguuacccagcaugcuguuggcauuguuguaaacaaacaaguuaagggcaagauucuugccaagagaauuaaugugcguauugagcacauuaagcacucuaagagccgagauagcuuccugaaacgugugaaggaaaaugaucagaaaaagaaagaagccaaagagaaagguaccuggguucaacuaaagcgccagccugcuccacccagagaagcacacuuugugagaaccaaugggaaggagccugagcugcuggaaccuauucccuaugaauucauggcauaauagguguuaaaaaaaaaaauaaaggaccucugggcuacaaaaaaaaaaaaaaaaaaagaaugaac

SEQ ID NO: 13550 - RNA, 18147 nt, Homo sapiens
ugcagcgcucuucagagcccuucaggagagccuccacccaacccucugaauuaggcacaacaggauugagggggggcccucuggaaggguccuuucuccucaccucccacaugaggcugggccugauuucacaauuucacucaggaucuucccuccucaauccucccagcccugucccaucucaguggccugugguggaccccagauccacagacacaggcccucuccgcacaagggcucacgugguccccagccaaggccccuacagcacuuucuacggagcccucuucccaaacaugcacauccagcuugccucucagccaccccgccuccaucucagcuccaaggaggccuuggcagcaggcucggggcgccauggaacgguucacugcgucucugcccuggccucacgugcugccggcuggccuugccauucaucuucugaaggcuauucucugauggcucugcuggccaccuugaucugaguggcaggucugugcuaacaguguuuuguguggggcccugggagaagaguccaugaaccacugccuaacucaagugcugccacggugaagcaccccugccuaguucugaacagacgcagcacaucaaaggggagccggcagcucacuccugagcaaagcagcaggcuaguuccucacagucaaggaaaaccacugggagaaccucccugcuucugcugaagaccugagcugcuucucccgggucccccagugcugacaggccucuagcaucagguccauguggcugauucuggagaucuuuaggaggaugggacuggcuguugagaacugucaguaugagucugucuggcuacucugccugggaacauucacugagacauaaagaagauauuaaauagcuggaaaauuaggaacccagcuagggcuggaggggaggucuuagaggaucauucuguaagugcugccggggaaggaacaacggugagggcucaggcuggcucucucuaggguccuccacaggaggaagaagaccacaaaucuaaccagccuagcagccccagauacacagagcacauguggacaaagcuguggcugccugcauuccaugggaucaucuuguaugcagcaguaagaagggucuguucuaugacugcucugcugccuuuuuuuuuuuuuuaacagcagcugguuuggagucucccacguauugccugaggugguuuggugguaaccagcuaacaaaaauccuuucauuuuaggugccugugggugguguggucgccaccaagaaugagucaagccauuucuaaagaauccacaguaggcucugucugacagggugcaucugggagggccugccgggccuuuauucaacacuagauacgccccaucuccaauucuaauggacaugugcagaaaaugugauacagaaaccugcagagcagccaguucccagcggacgucagagaucagcucuuaccucaaggaucuugcucaccaaacucucuuugcuuaucaaaccuuucuuucagagggcaaagguuaacucccaucuagaagagguugaaguacuaugguuuucaaaccaggaacguggcacuaaugaggcggagcucuggagaggcacagcugcagaagguuccagggacccuuggaagcagacagggacccuugggagcagacagguuuggaauaaaaacaaagagaaaaacagggcaaaggauuaacaacagaaaugaaaccaggcgcacacacacucaccugcggcaugaucgccugcggucacacuccaacuugauaucuugcuuccaacggccagaacggccaucaguggaacuuacuuucacgggcaaucuuuaggcuguuguuuauuguugauuuaagagagaagcaguuaugguuuugaaaacauggcccuuuuucugauggggggagagcagguuucaaugaaauggguguggagucccaaucuccaaggccuuugugucugaucugagagaagccaucugccagagucaaauucuucagggcccucaagaacagagggcaagaagccaggcuuagauaagccuuuucugaagcccucuggcuggccagagaaaggaggcagggcuauggugcuccacugauccuguagggccggggcaaggaaugggaacccaagcagaaaccaggcaaccaaccaggauuguuuccaucaugaaacaauagagcaggcaaacccaucuaccucuggucccaaccuuugucacggacaaaaaacccagacccacacaggugaccacgaccucagugugagguagaacagcugggacccggacucagguccaacaggugcccagggcaaagggguccucgcaccccgccccaggugacccucccagaaaaggggugcugaaugcucauccguacugccucugcggccgugccaucuaguggggaggggcuugggcacucugugccccaccagagcccccagguucucaaucuccagaguucagacgcccgcuccagugggggcaccaggaauggcaaagagaugccuucacgguguugauggugugcgccagccacccaugcacaugaccugguguuucugucguggaacuggagaugcggccuuaggugcugaccgcugagccacacagguggggcucacuuucucaccuaucaagaaauauacaugggaaacccacagagcccugccuccuggcccagcugccaagacgaggcugagccgagccucuagaagcaccagguagacgaagggagggaggcaccacaguaaccggagccauaccuggcaccuggacaccuacccgagggagcucuccaagggugccccaccuaaggccuaaggaaccagcucugacuauaggcugagucccaaagggccaaggaagauuccagaagcacuagugaaccuucucuacacugccaagccagaggccucagagaaaggcagccucucccagauggacccuguauuaguccguuuucacacugcugauaaaaacaaaccugagacugggcaauuuacaaaagaaagagguuuaauuggacuuacaguuccaugugacuggggaagccccacaaucauggcagaaggcaaggaggagcaagucacaucuuacauggauggcagcaggcaaagagagagagcgcuugcgcaggcaaacucccguuuuuuaaaaccaucagaucucaugagacucgcuaucaugagaacagcacaggaaagacccacccccauacuucaaucaccucccacccaguuccucccaugacacgugggaauugugagaguuacaauucaagaugagaucuggguggggacacagagccaaaccauaucagauccccuucagugaaaagaccccagcuacccaauguggggcagcucagcuccugcucuccccgcucucuucuugccacaagaaucccaucuccuagucagggagaccuucaagccagcagggcccugcucagaagccucagggcuucccgcugcacuugcaaucagaccccagugccauggccgugggcugcccuuauggugcugccuccucagcuaccccagcuccuucccuggccccugcucacuuccugcagccagacugguuuccugcuucccuacagcucauggccagcucuuucccaccucagggcccuuccacuggcuguccccucuguccagugugcucuuuccccagcuccugugacuuggcaggcuccugacucaccagagccaucaccucggacuccuccaucagcuccaucauuuuccaggcagcauuugaaaggcgaccucuggagccugaccagccacuggaguucaaauccggacuccacgauuuuccugcuguguggccuugggcaagcuaucugaccugugcguaccucaguuuucccauauguuugcuaugaagaguaaauuaaugcauuucucuaaugccuagaacaugguaggcaccauaaaucaguaagaggaagggcuucucugugccaagaagccugaguguggggcaggcugugcaaguauggcuaacccuagcgucccuuggaagccuacaggaggagacucacacuucuucagaagaugaggggaucuucugagccuucauguacauggcucugaaggaguuaaggccuagcuguggucacaacuaccauggauucuucucugaggccuggaugagcaagagagaacucugacccacuaaggaaaaggagggaauucugaauacgaauacggauuaacucaggggccgccugaggcccacaacagccccaacagaaacuccccuccucccucaccuccucuccucuugaaauccuugugcugaaaagcaaggcccagguuucauagcagccugggccuccucuggcuuuccuaagucaucccuaucccgacgagaaugagggaggccgagggaugcacagacguuaaguggcuaugguaacugcccuagccauuuuguguuucugcucagcuuacuaaggggcccaccaggaggaaggcaggcagccaugauggcuccccagacccggccauucaaugcucauccaucagcccaggucuuccagaccaaugucacagcaaaggcaaggaggccccggccagaacucaguugcugggucccugcccaauucugaugaugacccuuguuucuuauaagauaauaauagcuccacuuuacugcagggagaacaagugcaaaugccuaaggaggccaggccccacucagagaugagugacaggcacaagugguggcaggcacaggggugugugugcugcuggccgaaagggggcggccgcaccccagcuacgguugucuauggacaggaagaggcaggccccagaaaacuagaggcuccacuagaccaggagaagucaaauggccaaaggcuucuguaaaaucugcggacaccuaaacguuggcggucaucaucauucauccuuaaaagaacuccuguguggucgaaacauaccauguaucugggugagagcaggccuggagagcagcuuccggcuccaucccacaauggaggcuggucacccauuaauuuguacuauuaauaaagguggcgaacauuuagggacacuuuucugagugucaggugcugcuuguucuuacuuaauucucuccuggccccuucccugaagucaggaaacugccuuggcagauaaauaagucgccccaaggccccggaguggaaagcagggugcugagguuagcgcucacaucucucugaugccacaacagggcccugaaccaccagcucugcucccuacguguucccgaccuagggcugggcucugaccuggcuccucuggcccuguccuuggugcuuucacacaguucuguccgccccuggccccagcaccugcgcucuugccugcccgccaccccuggcgccuacuguuuccucauaugauccucccugcucccucuucacgggcacuucccaggcuggcuucuucccaagccuuaaucccacucagcucuccuggccauaucuagccacggcaaugcaguggccuccaaaucccccugccccuccauccugcugccaacugagcuuccauuuggccugugacauuuaaaaauaucuguccagccuuggcguauagaaccuaauauccccagcuguuuaaauaccacugccucauucggcccccaugccugugcguccaauaaaagcagaaacugacccugaacacggggccacuggaacccucuauuccaaucaugccauucuuaauuuggcuccuuugucaaaugggucaucagugcgagccaguuccugccccuacaaggagaaggcuggcaggggcuuggggggcuuuggagaggcaggucaagguguggccaucuguaugccugugacgggcgcacgugccuggagcaugcggugauguccgccacagcuguccuccaucccccccgucucccgaccccagugggccccauggccuugcuauuaauacagugcaaagaggcccagcagcuggccggggccaggucuuuccacauggauggugacaacugccaucacccuggaugugggcucugcacguucccaaugugccuucugucagaaggggcagagcugcaguccgcugggguacugucugcugaaaauguccacucugacuuggcaaugggggaaaucaccaaugaucaacuugggagucgugaaagggggcucaaaagaugaguggucgcuuuagagcacuccuagugcucacaggaacaagggucugcuccccuaaccgcgccaucagccugcauuugcauggaggccccaggccacaggcuucuucucucaucaucgauacauagguccagcacaaugcccagcacaaacaugcagccaaguacacaccuaugcagcgaggaaaucccccacagggagauacagagaaaggcuucauuuuccugacacgcucucuuuggggaggaagaggucggcuucaacauauccuaaaagaacccaugaagaacgaacuguuagguggaucagagccacaaauccagaagagaagaacccagucuacuguccaaaacugccaggggugaaacacuaugauuucugggauuugcugugaagggcuccagaagaaaagguguggugacagaggaaaccagagcagcagaagcugacgggcagcgcagcugcgcuggccuccucucugccuuggugugcuugaaaauuuccauaacaacaaguuuaaaaauacacaugugaaaaauuguucaacaaauauuuacugagggccuaauaugugcuaagaacucuucugaggguucuuaauuuguauagaaagaagaaaggugagcaaagucccaccaugcuggucagcagcagcucagccucaaaacaaccuccuuuugccauagcacagcaggcccacccccaaaugcccuggguugguuucagcugucccaugccacugacccauggaggcaguccgaauacguacuuuuaaaauuuaguauuuaaaaauacuaucauucaaccccugugacccuaugcagcccaacccgagaaagaacacagccaagaacuucaucuagcagaauguccuucucccacuccuuguggucuccccugccagaagaaaccaaaugcagaagcugaguuuaucauaugcucgcuguaaacauuuuaucaugcaugcauuacuugguuuugccugcuuuugaacuugaugaagagagcauuguacuuucuggcauccuaucaagaacugagagcacuaugggagaacagacccagcuccccucacccaauccccagaaaagcugggagugagaacagaggugaguggauggguucugugagaggccuucuggcuggaacacugcuucagagcaugccagcaggaagugagaagugcccgggcucaucucgcuggggcuugggacacagcucuaccgacugucucuuggcugcguccgcaaacauaaacacgugaagugggagcaaaugucaugguaaaggcagaucaagacaacuccaucuguugacuuauuauuagacaacaaaugucaugggaagaaaaugugccccaaguaauuuagccccguugaaacucaacaggcuuccgcugguuggaaugagaacucuuccuaccucuccuuagcuaagaggcaccugaccagacacugggagcaaaaccucauuuauccccuuuggugggaaaucuuuguguccuagaagaccaucucucaccaucucuccuagaguccagaugagcauuucucaggucaaugaagagacuggguggauggggacaggaucaaggaggugcucagggcugcaccuggagggacaucagccacgcugccauuuccagagcaugcacuugucuucaugaguauuuuuaaaauacuuaaccagacgccagggauacugguaaucuuucaauagcaguuguauaauuuuccuuuaaaaaccaauguauuuacauaaaaaaacagcugacuuagagagaagugugaagugcaguucaguauuggaauauggcaaaaaccgugaagguggugcgaaaauaauugaagucagcaaaaaugaccucgauauuccuaaagggguggaauuuuuguucuaauuucuaagguacuuuugcgcuuagaugguuuuaacuguagucucugccaacaaaggccacucauaacccccagucugaacggacccuacccuguucaaggcccagagcuguggggcauccuagcccugcuaggagaggcugcaaugcucccggcauggacgagaggggagcauggaagcccagagucccugccacugcugcugcugcacaaagccacgacaacugguggccacaggccuugugucucucaaucagcagccccaagaaaggucucugagagugcgccauucucuuucuccugagcuugcucuuuugcuuaccuuuagacgaugacuucagcgagaaagacagaugagcaaaugucacuuucaugcagauaguucacccaacugcauaagugcucucaaugggagaacuuucagcacacugaagucuauuuaaaaauagugggagaagggaaguuacuucucuuuuaaaagugcuaauaauaauaacauuaauacgaauuauuuguagaguuaugugacugaacauauacauuuuuuugcaauguugucauacuacuauuaacaacacugcugcugucaugacgggagggcugggggcccaaacagccugcucugcugccccugucaucccagcaucccccugguuagcacugccuuucaugcauaaaaaugucccagguggaugacaaauguuaugguaacccuaguuauacaccaugacuaacucaucuaugccuacgacgagugggcagggggaggguuuggggccaaaggggaacagggaccugaauuucaaaggcuggagagcauucuuuaaauuguggccauucccggcuuaaacuguuuagauccuggauuagcagaggggaccuggguuuaaaaugaucagauggugagggagagauacaugauuuauaaucggggagagaugcaugguuuauaauuggggcacuauuaagaguucuccaauggcaguuugaacuauguuacuucuuucuuuucuuccuuuuuuuuucuuuuuuuagacagagucucacucugccacccaggcuggaguguaguggcaugauccuggcuccuggauucaagcaauucgccugccucagccucccgaguagcugggacuacaggcgcgcgccaccaugccuggcuuuuuuuuuuuuuuuuuuuuuguauuuuuaguagagaugguguuucaucauguugccaggcuggucuugaacuccugaccucaagugaucugccugccucggccucccaaagugcugggauuacaggugugaggcaccgcaccuggcugaacuauguuauuucuaaaacagcucagucaccuucaugaaggacuaaaagaaacuggacacagaaccugggauacacuuggccucucuuuucuaacaucuuuuaguuagguuuucccuagcccucuccuuguggcaaauuucugagauauauuucacugaaguucaacuuuucuugacaggcuagagaaaauauugaugaagccaaggucaugggccucagaaacccagccccacaagcagagcaggaaaacagcuccaugcccucucuccugacucauagagggccuggggaugccacaggucuuacugucuccucuaccagaaagaagagggucgugcuagcaggggaugggagacaaauacucaggcccugcugguggggacacacugguugccucguagagaagugcaguguagccaaggcucuguguuggccuaugagcagcagcuccacugcuugauaucaucuccagagaaacacuugugacauuuacauggagguguguacuacgacauggucagcagugcaguuucuaacagggacaaaguggcaagagcugaaugcacgucgacagggaugugacugcugacugucuuuauucagcccagacgaugaggugauggugaaauagaacaaggcaaauccuacaggaaucagcaggaaagggucuccaagauauguagauagaugaaaaggcugcaaugugaagcccaaugaaacacaugaaacuauguuuguguuuuucaagaugacauccucuauggaaacccauuauuugugaaguugguaaccucugggggauuugagaggugauguaugaaaacuguggcuggugcagggucaucaaagcagacauuagccuuagcuuuaucgaauauuuuaaagcuauuagauaauacauguaauucauauaauugcaugcgcaguuacacauuauaguuaagaagucauggcugggagaagcugcugauauguuaucagucacaguguagacaucuugaaaaaggaucucgagaaaaaugaacuucccuuucuuguaccuuaaugcuccuauuuuaggggccaauuuuaaguaauaacuggugcuuuuggaacaaccaagagaaaaagagagugccaccaaguccuacuggcuuuagccuuggccaaacccuucccggcugccauguggacuuugccaggcugauuacuaaagacaugguauagucuauuucuaccuuccaaaccacuucuagccagcucuugcuuugcucuuucuuuaauaaggagcuggaggaaugucaguucuaaagugaucaagaaaagaaugugaagcugugaacuguccauuugguugcugacaaaaaauagaucugauaucaagggggcugacaucugagcccuuggcucauguuccaccuucacgggaagauucucugcuugguguaguaaacaauugagggauagaacuaggacuagaaaaauucagucuaagaguggcuuuaccacuaaccagcuggucccaccucucuaagccucaguuuccuuacuuguaaaauaaaagggcugagacucgaucucuccagugccauccagcuccaggaugacuccuguugauaaugacuuugguuggaaacucaauuuggaguguuccucucuugucucccacuuagcacuagacuuuuucugcuucuaugacagccuuuccacugugcccgagaccuagaacaucuuucuaccugucugauaccuugucuugauaccuugucacgugcagccuaaaggcaccuuguucucaacagaccaaaggcagaacucuuagccccaccaccccacucaacauggcagagcuccuggccccaccgccccacucaacauggcagagcuccuggccccaccgccccacucaacauggcagagcuccuggccccaccgccccacucaacauggcagagcuccuggccccaccgccccacucaacauggcagagcuccuggccccacugccccacucaacauggcagagcuccuggccccaccgccccacucaacauggcagagcucuuggccccaccaccccacucaacauggcagaacucauggccuccugcuaccucacaccugggccucuuucccugcuucucuaccucagugaaaaguacuagcuuccaucuaguucuaccugggugucauccugacacagccaauuccccacauccauguuaucaccaagccuuguaagacacucuccuaaauaacucuaaaagccacucucacuauccucagcuuuauguauuucuaaaaccaaccaccucccuagacccagcuacuaucaacucuagcuuccucucaaauuccauccccguacucuguggccagagaggucuuuaaaauagacaacuugauuuuggucccucauggccaucaggacaaaggcuucccaugguuuauggcuguucaagacaacagaaagacugcaguuuaaccuguugggcccagagaucccugcccagcccuccagauucaucucuguucuccagcucugcugaccugugaguuucccuaacaggcuuagcuucuuuccgccagagagcuggcaaauacacuauuccucgcuuggaacugcaccacccucuggcuacuccucaacuuggaacugcaccaacccccugcugccacaugcucacccuucaguucucagcucaagugugcacguaucacuuuuucaguaaaguauucccugccuugcccaaauauaggguggcuucuucugcuguauacucagggggaaaaaaacaaaagaacaucuuucuuuuccagugcccuuagcuuagguuauaaggagaccuuccuuagcgcgaugacucauuauuuccagaucccccucacugcaugcauucaccauuguauucccagugccucgcagaguacaggaccuagaaugggcauccagugcaguugugcagaccaaacucuacagcuucuaaggcuuuccauuaagaauccacuaaaagagaacuggaaagugaaauuaaaaagaaaaauccaacucgacugccaacuccaacuuuauuuuaggcucuuucugcauggcugggcuccucaaacuccugcccccucacucucucaccucuuggccauuaccaccaccauaccaccaccaccaccacugcuauaccacuaucauaaccaccaccaccacaucaccaucaucaccaccaccaccacaccaccaucaccacaaucaccaccaccaccaucaacgccacaccaucaccaccaccgccacaccaccaucaccaccaccaucaccaccaccaccacaccaucaucaucaccaccaccaucaccaccacaccaccaucaccaccaccacaacaccaucaccacaaucaccaccaccaucacugccacaccaccaucaccaccaccgccacaccaccaucauuaccaccaccaccaucaccaccaccacaccaccaucaucaccaucaccaccaucaccaccacaccaccaucaucaccaccacaccaccaucauaccaucagcaccaccaucaccaccaccaucaccaccaccacaccaccaccaccacaaucaccaccaccaccaucaccaccacaccaccaucaccaccaccgccacaccaccacaccaccaucaccaccaccaccaucaccaucaccacuaccaucacaaccaccacuaccaucaccaccaaugcuacaccaccaucauaaccagcaccaucaccgccaccaggcauagucacuggucagcuagcaagcagaaggaggcaagauuuauauccaggccugugugaucccaaaucuggcuucugguuucucaccuccaaacuuucuguugagcccucucauaagauaccaucuauuuucccuuugaagcccaccuaaauacugucagagaaaagacauuagagaaaaaucccuuuaaaaacagauauaaaacgagggugcccccauuucacccuucucucuccuacacacuuucagaggacaacgcaaggcauagacaaaggaugaagucagagaaagccaaaauaaguaacaaaaacaucaaucuaacuggcacuacuaacuagaagaacccaaaagaauaaacuaaaaaugauuuuaaaauauaaaaagaaguccagauuuaccaaauaucacaacuguaaaacccaaaggacaucgaauuggagguuccuagauuuugagauuuuagaccaaaaucuacgaacaguggcauaagccacugugcccggccagaccacgcuaauauuucaaaagaaauguguggcacucacaucggguugccagcuguuuugcuuuuuuuuaaaaaaaucugcuagauaaagucacugaaaacuaaauaaaagcaaaauuuaaaaaacaacaucagcgggcgcaguggcucaugccuguaaucccagaacuuugggaggccgaggcgggcagaucacgagaucaggagauggagaccauccuggcuaacauggugaaaccucgucucuacuaaaaauacaaaaacaaaauuagccgggagaauggcaugaaccggggagguggagcuugcagugagccgagauugagccacugcauuccagucugggcgauagagcgagacucugucucaaaaacaaaaaaaaacaaaaacaaaaaaagaucuaaaaucuuuuggggaggguagaauucaagcaguuuuauucauucauucauucauucauuuauuauaaggauuucugauuuauuuauuuucaaagacucuaaaaucuuaaagcaaaacaaaaccccuaauuaucaucuacaauccuucuagaaagaaaugauaucaaaauucuaaaaggcaggaagcuuauauagccucaaaaucaagaaucaaaaucaaaagucccuccccugaauaaauuuggcuugaugaaagccccacuacaacaucuuucguuuucucauuucacuguggacuggcauuugggaaccgcugacuuaguucaacucuuucccugaugagguagucucuucuaccaaauccuccagaaaccuucucugaguguuugccugaguaggcugcugguugccucaaaaaccaaccaauucugaaaguggcagaagaugagaaaaacguacaaaaaucaauaccauuucuauaaauacauaauaagaggccugaaaauauaauuaaaaaaagagugcccacucacaaugcaacaaaagcaucuaauacuugggaaauauaugauauauauucacauaucaaacucacauaggauauauuaaaauuacaugaagaaaacacaaauccuuaaugagagaaauagugaccugaacagauugagaggccauacuucuggcuuaagacuaaaugcagaaaagaugauaauauuucccaacuuaauuuauaaauugaacgccauuccagucaaaauaucaccaaggucauuuauaaaacuugauaaaaaugguucuuaaauucauauagaaaaauaaauggacaaaacaucagagaaugcugagauacugugcagugagaaggcauuugccccagcagaucuuaaacuacagucuaaaaucaucauuauuaaggcuguagggcagucacgcuaagauacugggaaaaugucgcaauuucacuaacugagcaggaaugaaaccacuagcaauuaaaacuacagaacccacagaaggccacaacacuccgaggacagagagaugucuugcaaaacucucuuaucucaguuguggacaggaagcuuuuguuuuuguuuuucuaacuaacugagcaaggucaaaaauuuacgaagugacaagaugaagauuuccugacagcauaaaacaagccucuccuuaaguauuuuccaagguucaucucaauccccacacagcaccucauuccuagaaugcuuauggucaaaaaucacacuuuggaaguuaauuaaauucccguuguccucuaauugugagugugagugugugacacaggcuggcggcuacaacuccugucccagaggcucuuuugccagggacccugcaccaucuccaccaggugcccaggcacucaggaggcacugcuggacuucuugcugggccauuggcucccuaaauacacagauuauugcuuaaaggcgaggaucuccuccacuuaagucaaaucucacaugccucaaugccuuuucuuuuuauauguggcuccucacaugccugaaaccaaaucugccauuuggaaaaccggaaagucuucucuugcuccucuucccucccuccucagugaagagcagggagagaagugacggcugcuuccugagggaacuucuagaccaguaaagggaaggacucccaauuuaugaugacuuuuagccgaaacaauggauggggaagcggggguccagaaguaaucaccagccuccagugcauucucauuucugacguugagaggcccuucuuucauucuccuggcuccaugauauuuuaucaugcacaauguaugucacucaugggcccuauuaggaauccuaucauccuagcaguggaggugaccuuguagaccaacccauccaacaccucaggguucucauacacaaggaaagaagaaguggaaagaaaacccugauguggaaaccaaguauccaccacaaggaagccaaggaugcacccggcuagggcacugaucugauuaucaacucguccagaucaaccccacacacaccugacugagaccuaagggguccacacauccuaacaccagcacgaggcaggaccucaucuucacuggacugucuuuuagaaaaaugaagccaagcgaaaauaacaaacaaauaccuuagaauucucuuuaacgcaaagcaaugcuacagugaaugacgccgauuucuccccaguuaucaggauggacugauuacagugcccagauucauuugccugaagauaauugccucaauuauccacuucacuuugcacauauagaaauagucccaaucuacuggagccucagugacuagacauguaaaauuggucuaaucauauuuugaagagcucgagcugcaaggauuucuaugagcgugugccuaaaccgugacaacacuaaggguuucuccccuccgggcucgaggcgcgcucgcucucucccucccagaagucugauggggugagucagauccucagcagauaagaugaaaacaacuuugaggcucucugucagggcuaggggcuagaggaaagauaggauguccaggacagcuggacaaaagacaaagcuaugagccgagagcuuuccugacgguugagugguccuuugcaaucagcaguguuuucacccacagcucacuggcuggcauggcugcuggugggcagggcagagguggacaucuggggccagaaccccguagacuggggguguccugggacaaugaugucucaacuggcugcaggaaagaaccagacaagcucaguguagguccggcugggcagacagccggaacucaagaugaagcaaggcagggugucagaguccagggucugaaccggagaauacagaaugccaagcuccagggccacgggagagaaaugagacaccacguccaagagggccuguaccccucuuggguacugaugcuuugccugagcaagggggcuucuagaugcuucccguuggauccagagucuagaaauugcuccuccuguggcagagggagagagagggagauaggcacuuaucaguaggagaagcucaacagagcacgaagugaagagaaaguaagggagcuccugggaagacagcuccgagcaaucucuacgcacagaacgaaggcuccuuucugauccuacgcccuuuaaaaacgaauggcacaaauacaguauuguaaucccaaaaauggccuggacagaaaccagccaugucaaaaaggugauuauuucccucuauuguuugcuuuuagcucuagauggcauucccccaaaucucaaaaucaggagcucgagguuuucaccauuucuacuggugagagccaauugauaucagcgcagucugaauagcagcaaaauagcacccuagagagcugagccaaaugcuucugcauuguaccugguccucucuggggaacaggcgggaggggccaauaccaaauucucggugggguugagccuuacuggcugauugccacagugagggguagcgagugcugcaaacucccugaauucauuucuguccaaaggaaaguuggaaaagcucuucaucuccaaaaauaguccuuuccaaugauuauccaaaaaauaucuucaagagugauuauacccgcucaccaggcagggcagaaccaauccauuaucuugaguuucaucuuagaaaaugcauugaggucugugggaccucugacaauagccugcaagccuucugagaacccaugauucaucugucucccccagggccacuggcacauggcuuugcacacgguagacacaugguuagaaacaaguggauugaaagcaauucucaugggcuuuuaaaaaucaaaagaaaaucucagagucagacuagguaaagacucaucucuuucugaaaaucacaagaugaacuguaccucugauucuaaccaguuacucaacuucccucccugucuaucugggcuggaauguauuacucuacaccugucagcaaucugguuuuaauauuugggggcacuucacaucaaugugugugauguuggauggcaggaauugcucauccucaauuacuucgaucuccccacagugcccggaau

SEQ ID NO: 13551 - RNA, 18147 nt, Homo sapiens
auuccgggcacuguggggagaucgaaguaauugaggaugagcaauuccugccauccaacaucacacacauugaugugaagugcccccaaauauuaaaaccagauugcugacagguguagaguaauacauuccagcccagauagacagggagggaaguugaguaacugguuagaaucagagguacaguucaucuugugauuuucagaaagagaugagucuuuaccuagucugacucugagauuuucuuuugauuuuuaaaagcccaugagaauugcuuucaauccacuuguuucuaaccaugugucuaccgugugcaaagccaugugccaguggcccugggggagacagaugaaucauggguucucagaaggcuugcaggcuauugucagaggucccacagaccucaaugcauuuucuaagaugaaacucaagauaauggauugguucugcccugccuggugagcggguauaaucacucuugaagauauuuuuuggauaaucauuggaaaggacuauuuuuggagaugaagagcuuuuccaacuuuccuuuggacagaaaugaauucagggaguuugcagcacucgcuaccccucacuguggcaaucagccaguaaggcucaaccccaccgagaauuugguauuggccccucccgccuguuccccagagaggaccagguacaaugcagaagcauuuggcucagcucucuagggugcuauuuugcugcuauucagacugcgcugauaucaauuggcucucaccaguagaaauggugaaaaccucgagcuccugauuuugagauuugggggaaugccaucuagagcuaaaagcaaacaauagagggaaauaaucaccuuuuugacauggcugguuucuguccaggccauuuuugggauuacaauacuguauuugugccauucguuuuuaaagggcguaggaucagaaaggagccuucguucugugcguagagauugcucggagcugucuucccaggagcucccuuacuuucucuucacuucgugcucuguugagcuucuccuacugauaagugccuaucucccucucucucccucugccacaggaggagcaauuucuagacucuggauccaacgggaagcaucuagaagcccccuugcucaggcaaagcaucaguacccaagagggguacaggcccucuuggacguggugucucauuucucucccguggcccuggagcuuggcauucuguauucuccgguucagacccuggacucugacacccugccuugcuucaucuugaguuccggcugucugcccagccggaccuacacugagcuugucugguucuuuccugcagccaguugagacaucauugucccaggacacccccagucuacgggguucuggccccagauguccaccucugcccugcccaccagcagccaugccagccagugagcugugggugaaaacacugcugauugcaaaggaccacucaaccgucaggaaagcucucggcucauagcuuugucuuuuguccagcuguccuggacauccuaucuuuccucuagccccuagcccugacagagagccucaaaguuguuuucaucuuaucugcugaggaucugacucaccccaucagacuucugggagggagagagcgagcgcgccucgagcccggaggggagaaacccuuaguguugucacgguuuaggcacacgcucauagaaauccuugcagcucgagcucuucaaaauaugauuagaccaauuuuacaugucuagucacugaggcuccaguagauugggacuauuucuauaugugcaaagugaaguggauaauugaggcaauuaucuucaggcaaaugaaucugggcacuguaaucaguccauccugauaacuggggagaaaucggcgucauucacuguagcauugcuuugcguuaaagagaauucuaagguauuuguuuguuauuuucgcuuggcuucauuuuucuaaaagacaguccagugaagaugagguccugccucgugcugguguuaggauguguggaccccuuaggucucagucaggugugugugggguugaucuggacgaguugauaaucagaucagugcccuagccgggugcauccuuggcuuccuugugguggauacuugguuuccacaucaggguuuucuuuccacuucuucuuuccuuguguaugagaacccugagguguuggauggguuggucuacaaggucaccuccacugcuaggaugauaggauuccuaauagggcccaugagugacauacauugugcaugauaaaauaucauggagccaggagaaugaaagaagggccucucaacgucagaaaugagaaugcacuggaggcuggugauuacuucuggacccccgcuuccccauccauuguuucggcuaaaagucaucauaaauugggaguccuucccuuuacuggucuagaaguucccucaggaagcagccgucacuucucucccugcucuucacugaggagggagggaagaggagcaagagaagacuuuccgguuuuccaaauggcagauuugguuucaggcaugugaggagccacauauaaaaagaaaaggcauugaggcaugugagauuugacuuaaguggaggagauccucgccuuuaagcaauaaucuguguauuuagggagccaauggcccagcaagaaguccagcagugccuccugagugccugggcaccugguggagauggugcagggucccuggcaaaagagccucugggacaggaguuguagccgccagccugugucacacacucacacucacaauuagaggacaacgggaauuuaauuaacuuccaaagugugauuuuugaccauaagcauucuaggaaugaggugcuguguggggauugagaugaaccuuggaaaauacuuaaggagaggcuuguuuuaugcugucaggaaaucuucaucuugucacuucguaaauuuuugaccuugcucaguuaguuagaaaaacaaaaacaaaagcuuccuguccacaacugagauaagagaguuuugcaagacaucucucuguccucggaguguuguggccuucuguggguucuguaguuuuaauugcuagugguuucauuccugcucaguuagugaaauugcgacauuuucccaguaucuuagcgugacugcccuacagccuuaauaaugaugauuuuagacuguaguuuaagaucugcuggggcaaaugccuucucacugcacaguaucucagcauucucugauguuuuguccauuuauuuuucuauaugaauuuaagaaccauuuuuaucaaguuuuauaaaugaccuuggugauauuuugacuggaauggcguucaauuuauaaauuaaguugggaaauauuaucaucuuuucugcauuuagucuuaagccagaaguauggccucucaaucuguucaggucacuauuucucucauuaaggauuuguguuuucuucauguaauuuuaauauauccuaugugaguuugauaugugaauauauaucauauauuucccaaguauuagaugcuuuuguugcauugugagugggcacucuuuuuuuaauuauauuuucaggccucuuauuauguauuuauagaaaugguauugauuuuuguacguuuuucucaucuucugccacuuucagaauugguugguuuuugaggcaaccagcagccuacucaggcaaacacucagagaagguuucuggaggauuugguagaagagacuaccucaucagggaaagaguugaacuaagucagcgguucccaaaugccaguccacagugaaaugagaaaacgaaagauguuguaguggggcuuucaucaagccaaauuuauucaggggagggacuuuugauuuugauucuugauuuugaggcuauauaagcuuccugccuuuuagaauuuugauaucauuucuuucuagaaggauuguagaugauaauuagggguuuuguuuugcuuuaagauuuuagagucuuugaaaauaaauaaaucagaaauccuuauaauaaaugaaugaaugaaugaaugaauaaaacugcuugaauucuacccuccccaaaagauuuuagaucuuuuuuuguuuuuguuuuuuuuuguuuuugagacagagucucgcucuaucgcccagacuggaaugcaguggcucaaucucggcucacugcaagcuccaccuccccgguucaugccauucucccggcuaauuuuguuuuuguauuuuuaguagagacgagguuucaccauguuagccaggauggucuccaucuccugaucucgugaucugcccgccucggccucccaaaguucugggauuacaggcaugagccacugcgcccgcugauguuguuuuuuaaauuuugcuuuuauuuaguuuucagugacuuuaucuagcagauuuuuuuaaaaaaaagcaaaacagcuggcaacccgaugugagugccacacauuucuuuugaaauauuagcguggucuggccgggcacaguggcuuaugccacuguucguagauuuuggucuaaaaucucaaaaucuaggaaccuccaauucgauguccuuuggguuuuacaguugugauauuugguaaaucuggacuucuuuuuauauuuuaaaaucauuuuuaguuuauucuuuuggguucuucuaguuaguagugccaguuagauugauguuuuuguuacuuauuuuggcuuucucugacuucauccuuugucuaugccuugcguuguccucugaaaguguguaggagagagaagggugaaaugggggcacccucguuuuauaucuguuuuuaaagggauuuuucucuaaugucuuuucucugacaguauuuaggugggcuucaaagggaaaauagaugguaucuuaugagagggcucaacagaaaguuuggaggugagaaaccagaagccagauuugggaucacacaggccuggauauaaaucuugccuccuucugcuugcuagcugaccagugacuaugccugguggcggugauggugcugguuaugauggugguguagcauugguggugaugguaguggugguugugaugguaguggugauggugaugguggugguggugauggugguguggugguguggcggugguggugaugguggugugguggugaugguggugguggugauuguggugguggugguguggugguggugauggugguggugaugguggugcugaugguaugaugguggugugguggugaugaugguggugugguggugaugguggugauggugaugauggugguguggugguggugauggugguggugguaaugauggugguguggcggugguggugauggugguguggcagugauggugguggugauuguggugaugguguuguggugguggugaugguggugugguggugauggugguggugaugaugauggugugguggugguggugauggugguggugauggugguguggcggugguggugaugguguggcguugaugguggugguggugauuguggugaugguggugugguggugguggugaugauggugauguggugguggugguuaugauagugguauagcagugguggugguggugguaugguggugguaauggccaagaggugagagagugagggggcaggaguuugaggagcccagccaugcagaaagagccuaaaauaaaguuggaguuggcagucgaguuggauuuuucuuuuuaauuucacuuuccaguucucuuuuaguggauucuuaauggaaagccuuagaagcuguagaguuuggucugcacaacugcacuggaugcccauucuagguccuguacucugcgaggcacugggaauacaauggugaaugcaugcagugagggggaucuggaaauaaugagucaucgcgcuaaggaaggucuccuuauaaccuaagcuaagggcacuggaaaagaaagauguucuuuuguuuuuuucccccugaguauacagcagaagaagccacccuauauuugggcaaggcagggaauacuuuacugaaaaagugauacgugcacacuugagcugagaacugaagggugagcauguggcagcaggggguuggugcaguuccaaguugaggaguagccagaggguggugcaguuccaagcgaggaauaguguauuugccagcucucuggcggaaagaagcuaagccuguuagggaaacucacaggucagcagagcuggagaacagagaugaaucuggagggcugggcagggaucucugggcccaacagguuaaacugcagucuuucuguugucuugaacagccauaaaccaugggaagccuuuguccugauggccaugagggaccaaaaucaaguugucuauuuuaaagaccucucuggccacagaguacggggauggaauuugagaggaagcuagaguugauaguagcugggucuagggaggugguugguuuuagaaauacauaaagcugaggauagugagaguggcuuuuagaguuauuuaggagagugucuuacaaggcuuggugauaacauggauguggggaauuggcugugucaggaugacacccagguagaacuagauggaagcuaguacuuuucacugagguagagaagcagggaaagaggcccaggugugagguagcaggaggccaugaguucugccauguugaguggggugguggggccaagagcucugccauguugaguggggcgguggggccaggagcucugccauguugaguggggcaguggggccaggagcucugccauguugaguggggcgguggggccaggagcucugccauguugaguggggcgguggggccaggagcucugccauguugaguggggcgguggggccaggagcucugccauguugaguggggcgguggggccaggagcucugccauguugaguggggugguggggcuaagaguucugccuuuggucuguugagaacaaggugccuuuaggcugcacgugacaagguaucaagacaagguaucagacagguagaaagauguucuaggucucgggcacaguggaaaggcugucauagaagcagaaaaagucuagugcuaagugggagacaagagaggaacacuccaaauugaguuuccaaccaaagucauuaucaacaggagucauccuggagcuggauggcacuggagagaucgagucucagcccuuuuauuuuacaaguaaggaaacugaggcuuagagaggugggaccagcugguuagugguaaagccacucuuagacugaauuuuucuaguccuaguucuaucccucaauuguuuacuacaccaagcagagaaucuucccgugaagguggaacaugagccaagggcucagaugucagcccccuugauaucagaucuauuuuuugucagcaaccaaauggacaguucacagcuucacauucuuuucuugaucacuuuagaacugacauuccuccagcuccuuauuaaagaaagagcaaagcaagagcuggcuagaagugguuuggaagguagaaauagacuauaccaugucuuuaguaaucagccuggcaaaguccacauggcagccgggaaggguuuggccaaggcuaaagccaguaggacuugguggcacucucuuuuucucuugguuguuccaaaagcaccaguuauuacuuaaaauuggccccuaaaauaggagcauuaagguacaagaaagggaaguucauuuuucucgagauccuuuuucaagaugucuacacugugacugauaacauaucagcagcuucucccagccaugacuucuuaacuauaauguguaacugcgcaugcaauuauaugaauuacauguauuaucuaauagcuuuaaaauauucgauaaagcuaaggcuaaugucugcuuugaugacccugcaccagccacaguuuucauacaucaccucucaaaucccccagagguuaccaacuucacaaauaauggguuuccauagaggaugucaucuugaaaaacacaaacauaguuucauguguuucauugggcuucacauugcagccuuuucaucuaucuacauaucuuggagacccuuuccugcugauuccuguaggauuugccuuguucuauuucaccaucaccucaucgucugggcugaauaaagacagucagcagucacaucccugucgacgugcauucagcucuugccacuuugucccuguuagaaacugcacugcugaccaugucguaguacacaccuccauguaaaugucacaaguguuucucuggagaugauaucaagcaguggagcugcugcucauaggccaacacagagccuuggcuacacugcacuucucuacgaggcaaccaguguguccccaccagcagggccugaguauuugucucccauccccugcuagcacgacccucuucuuucugguagaggagacaguaagaccuguggcauccccaggcccucuaugagucaggagagagggcauggagcuguuuuccugcucugcuuguggggcuggguuucugaggcccaugaccuuggcuucaucaauauuuucucuagccugucaagaaaaguugaacuucagugaaauauaucucagaaauuugccacaaggagagggcuagggaaaaccuaacuaaaagauguuagaaaagagaggccaaguguaucccagguucuguguccaguuucuuuuaguccuucaugaaggugacugagcuguuuuagaaauaacauaguucagccaggugcggugccucacaccuguaaucccagcacuuugggaggccgaggcaggcagaucacuugaggucaggaguucaagaccagccuggcaacaugaugaaacaccaucucuacuaaaaauacaaaaaaaaaaaaaaaaaaaaagccaggcaugguggcgcgcgccuguagucccagcuacucgggaggcugaggcaggcgaauugcuugaauccaggagccaggaucaugccacuacacuccagccuggguggcagagugagacucugucuaaaaaaagaaaaaaaaaggaagaaaagaaagaaguaacauaguucaaacugccauuggagaacucuuaauagugccccaauuauaaaccaugcaucucuccccgauuauaaaucauguaucucucccucaccaucugaucauuuuaaacccagguccccucugcuaauccaggaucuaaacaguuuaagccgggaauggccacaauuuaaagaaugcucuccagccuuugaaauucaggucccuguuccccuuuggccccaaacccucccccugcccacucgucguaggcauagaugaguuagucaugguguauaacuaggguuaccauaacauuugucauccaccugggacauuuuuaugcaugaaaggcagugcuaaccagggggaugcugggaugacaggggcagcagagcaggcuguuugggcccccagcccucccgucaugacagcagcaguguuguuaauaguaguaugacaacauugcaaaaaaauguauauguucagucacauaacucuacaaauaauucguauuaauguuauuauuauuagcacuuuuaaaagagaaguaacuucccuucucccacuauuuuuaaauagacuucagugugcugaaaguucucccauugagagcacuuaugcaguugggugaacuaucugcaugaaagugacauuugcucaucugucuuucucgcugaagucaucgucuaaagguaagcaaaagagcaagcucaggagaaagagaauggcgcacucucagagaccuuucuuggggcugcugauugagagacacaaggccuguggccaccaguugucguggcuuugugcagcagcagcaguggcagggacucugggcuuccaugcuccccucucguccaugccgggagcauugcagccucuccuagcagggcuaggaugccccacagcucugggccuugaacaggguaggguccguucagacuggggguuaugaguggccuuuguuggcagagacuacaguuaaaaccaucuaagcgcaaaaguaccuuagaaauuagaacaaaaauuccaccccuuuaggaauaucgaggucauuuuugcugacuucaauuauuuucgcaccaccuucacgguuuuugccauauuccaauacugaacugcacuucacacuucucucuaagucagcuguuuuuuuauguaaauacauugguuuuuaaaggaaaauuauacaacugcuauugaaagauuaccaguaucccuggcgucugguuaaguauuuuaaaaauacucaugaagacaagugcaugcucuggaaauggcagcguggcugaugucccuccaggugcagcccugagcaccuccuugauccuguccccauccacccagucucuucauugaccugagaaaugcucaucuggacucuaggagagauggugagagauggucuucuaggacacaaagauuucccaccaaaggggauaaaugagguuuugcucccagugucuggucaggugccucuuagcuaaggagagguaggaagaguucucauuccaaccagcggaagccuguugaguuucaacggggcuaaauuacuuggggcacauuuucuucccaugacauuuguugucuaauaauaagucaacagauggaguugucuugaucugccuuuaccaugacauuugcucccacuucacguguuuauguuugcggacgcagccaagagacagucgguagagcugugucccaagccccagcgagaugagcccgggcacuucucacuuccugcuggcaugcucugaagcaguguuccagccagaaggccucucacagaacccauccacucaccucuguucucacucccagcuuuucuggggauugggugaggggagcugggucuguucucccauagugcucucaguucuugauaggaugccagaaaguacaaugcucucuucaucaaguucaaaagcaggcaaaaccaaguaaugcaugcaugauaaaauguuuacagcgagcauaugauaaacucagcuucugcauuugguuucuucuggcaggggagaccacaaggagugggagaaggacauucugcuagaugaaguucuuggcuguguucuuucucggguugggcugcauagggucacagggguugaaugauaguauuuuuaaauacuaaauuuuaaaaguacguauucggacugccuccaugggucaguggcaugggacagcugaaaccaacccagggcauuugggggugggccugcugugcuauggcaaaaggagguuguuuugaggcugagcugcugcugaccagcauggugggacuuugcucaccuuucuucuuucuauacaaauuaagaacccucagaagaguucuuagcacauauuaggcccucaguaaauauuuguugaacaauuuuucacauguguauuuuuaaacuuguuguuauggaaauuuucaagcacaccaaggcagagaggaggccagcgcagcugcgcugcccgucagcuucugcugcucugguuuccucugucaccacaccuuuucuucuggagcccuucacagcaaaucccagaaaucauaguguuucaccccuggcaguuuuggacaguagacuggguucuucucuucuggauuuguggcucugauccaccuaacaguucguucuucauggguucuuuuaggauauguugaagccgaccucuuccuccccaaagagagcgugucaggaaaaugaagccuuucucuguaucucccugugggggauuuccucgcugcauagguguguacuuggcugcauguuugugcugggcauugugcuggaccuauguaucgaugaugagagaagaagccuguggccuggggccuccaugcaaaugcaggcugauggcgcgguuaggggagcagacccuuguuccugugagcacuaggagugcucuaaagcgaccacucaucuuuugagcccccuuucacgacucccaaguugaucauuggugauuucccccauugccaagucagaguggacauuuucagcagacaguaccccagcggacugcagcucugccccuucugacagaaggcacauugggaacgugcagagcccacauccagggugauggcaguugucaccauccauguggaaagaccuggccccggccagcugcugggccucuuugcacuguauuaauagcaaggccauggggcccacuggggucgggagacgggggggauggaggacagcuguggcggacaucaccgcaugcuccaggcacgugcgcccgucacaggcauacagauggccacaccuugaccugccucuccaaagccccccaagccccugccagccuucuccuuguaggggcaggaacuggcucgcacugaugacccauuugacaaaggagccaaauuaagaauggcaugauuggaauagaggguuccaguggccccguguucagggucaguuucugcuuuuauuggacgcacaggcaugggggccgaaugaggcagugguauuuaaacagcuggggauauuagguucuauacgccaaggcuggacagauauuuuuaaaugucacaggccaaauggaagcucaguuggcagcaggauggaggggcagggggauuuggaggccacugcauugccguggcuagauauggccaggagagcugagugggauuaaggcuugggaagaagccagccugggaagugcccgugaagagggagcagggaggaucauaugaggaaacaguaggcgccagggguggcgggcaggcaagagcgcaggugcuggggccaggggcggacagaacugugugaaagcaccaaggacagggccagaggagccaggucagagcccagcccuaggucgggaacacguagggagcagagcuggugguucagggcccuguuguggcaucagagagaugugagcgcuaaccucagcacccugcuuuccacuccggggccuuggggcgacuuauuuaucugccaaggcaguuuccugacuucagggaaggggccaggagagaauuaaguaagaacaagcagcaccugacacucagaaaagugucccuaaauguucgccaccuuuauuaauaguacaaauuaaugggugaccagccuccauugugggauggagccggaagcugcucuccaggccugcucucacccagauacaugguauguuucgaccacacaggaguucuuuuaaggaugaaugaugaugaccgccaacguuuagguguccgcagauuuuacagaagccuuuggccauuugacuucuccuggucuaguggagccucuaguuuucuggggccugccucuuccuguccauagacaaccguagcuggggugcggccgcccccuuucggccagcagcacacacaccccugugccugccaccacuugugccugucacucaucucugaguggggccuggccuccuuaggcauuugcacuuguucucccugcaguaaaguggagcuauuauuaucuuauaagaaacaagggucaucaucagaauugggcagggacccagcaacugaguucuggccggggccuccuugccuuugcugugacauuggucuggaagaccugggcugauggaugagcauugaauggccgggucuggggagccaucauggcugccugccuuccuccuggugggccccuuaguaagcugagcagaaacacaaaauggcuagggcaguuaccauagccacuuaacgucugugcaucccucggccucccucauucucgucgggauagggaugacuuaggaaagccagaggaggcccaggcugcuaugaaaccugggccuugcuuuucagcacaaggauuucaagaggagaggaggugagggaggaggggaguuucuguuggggcuguugugggccucaggcggccccugaguuaauccguauucguauucagaauucccuccuuuuccuuagugggucagaguucucucuugcucauccaggccucagagaagaauccaugguaguugugaccacagcuaggccuuaacuccuucagagccauguacaugaaggcucagaagauccccucaucuucugaagaagugugagucuccuccuguaggcuuccaagggacgcuaggguuagccauacuugcacagccugccccacacucaggcuucuuggcacagagaagcccuuccucuuacugauuuauggugccuaccauguucuaggcauuagagaaaugcauuaauuuacucuucauagcaaacauaugggaaaacugagguacgcacaggucagauagcuugcccaaggccacacagcaggaaaaucguggaguccggauuugaacuccaguggcuggucaggcuccagaggucgccuuucaaaugcugccuggaaaaugauggagcugauggaggaguccgaggugauggcucuggugagucaggagccugccaagucacaggagcuggggaaagagcacacuggacagaggggacagccaguggaagggcccugaggugggaaagagcuggccaugagcuguagggaagcaggaaaccagucuggcugcaggaagugagcaggggccagggaaggagcugggguagcugaggaggcagcaccauaagggcagcccacggccauggcacuggggucugauugcaagugcagcgggaagcccugaggcuucugagcagggcccugcuggcuugaaggucucccugacuaggagaugggauucuuguggcaagaagagagcggggagagcaggagcugagcugccccacauuggguagcuggggucuuuucacugaaggggaucugauaugguuuggcucuguguccccacccagaucucaucuugaauuguaacucucacaauucccacgugucaugggaggaacugggugggaggugauugaaguaugggggugggucuuuccugugcuguucucaugauagcgagucucaugagaucugaugguuuuaaaaaacgggaguuugccugcgcaagcgcucucucucuuugccugcugccauccauguaagaugugacuugcuccuccuugccuucugccaugauuguggggcuuccccagucacauggaacuguaaguccaauuaaaccucuuucuuuuguaaauugcccagucucagguuuguuuuuaucagcagugugaaaacggacuaauacaggguccaucugggagaggcugccuuucucugaggccucuggcuuggcaguguagagaagguucacuagugcuucuggaaucuuccuuggcccuuugggacucagccuauagucagagcugguuccuuaggccuuagguggggcacccuuggagagcucccucggguagguguccaggugccagguauggcuccgguuacuguggugccucccucccuucgucuaccuggugcuucuagaggcucggcucagccucgucuuggcagcugggccaggaggcagggcucuguggguuucccauguauauuucuugauaggugagaaagugagccccaccuguguggcucagcggucagcaccuaaggccgcaucuccaguuccacgacagaaacaccaggucaugugcauggguggcuggcgcacaccaucaacaccgugaaggcaucucuuugccauuccuggugcccccacuggagcgggcgucugaacucuggagauugagaaccugggggcucugguggggcacagagugcccaagccccuccccacuagauggcacggccgcagaggcaguacggaugagcauucagcaccccuuuucugggagggucaccuggggcggggugcgaggaccccuuugcccugggcaccuguuggaccugaguccgggucccagcuguucuaccucacacugaggucguggucaccugugugggucuggguuuuuuguccgugacaaagguugggaccagagguagauggguuugccugcucuauuguuucaugauggaaacaauccugguugguugccugguuucugcuuggguucccauuccuugccccggcccuacaggaucaguggagcaccauagcccugccuccuuucucuggccagccagagggcuucagaaaaggcuuaucuaagccuggcuucuugcccucuguucuugagggcccugaagaauuugacucuggcagauggcuucucucagaucagacacaaaggccuuggagauugggacuccacacccauuucauugaaaccugcucuccccccaucagaaaaagggccauguuuucaaaaccauaacugcuucucucuuaaaucaacaauaaacaacagccuaaagauugcccgugaaaguaaguuccacugauggccguucuggccguuggaagcaagauaucaaguuggagugugaccgcaggcgaucaugccgcaggugagugugugugcgccugguuucauuucuguuguuaauccuuugcccuguuuuucucuuuguuuuuauuccaaaccugucugcucccaagggucccugucugcuuccaagggucccuggaaccuucugcagcugugccucuccagagcuccgccucauuagugccacguuccugguuugaaaaccauaguacuucaaccucuucuagaugggaguuaaccuuugcccucugaaagaaagguuugauaagcaaagagaguuuggugagcaagauccuugagguaagagcugaucucugacguccgcugggaacuggcugcucugcagguuucuguaucacauuuucugcacauguccauuagaauuggagauggggcguaucuaguguugaauaaaggcccggcaggcccucccagaugcacccugucagacagagccuacuguggauucuuuagaaauggcuugacucauucuugguggcgaccacaccacccacaggcaccuaaaaugaaaggauuuuuguuagcugguuaccaccaaaccaccucaggcaauacgugggagacuccaaaccagcugcuguuaaaaaaaaaaaaaaggcagcagagcagucauagaacagacccuucuuacugcugcauacaagaugaucccauggaaugcaggcagccacagcuuuguccacaugugcucuguguaucuggggcugcuaggcugguuagauuuguggucuucuuccuccuguggaggacccuagagagagccagccugagcccucaccguuguuccuuccccggcagcacuuacagaaugauccucuaagaccuccccuccagcccuagcuggguuccuaauuuuccagcuauuuaauaucuucuuuaugucucagugaauguucccaggcagaguagccagacagacucauacugacaguucucaacagccagucccauccuccuaaagaucuccagaaucagccacauggaccugaugcuagaggccugucagcacugggggacccgggagaagcagcucaggucuucagcagaagcagggagguucucccagugguuuuccuugacugugaggaacuagccugcugcuuugcucaggagugagcugccggcuccccuuugaugugcugcgucuguucagaacuaggcaggggugcuucaccguggcagcacuugaguuaggcagugguucauggacucuucucccagggccccacacaaaacacuguuagcacagaccugccacucagaucaagguggccagcagagccaucagagaauagccuucagaagaugaauggcaaggccagccggcagcacgugaggccagggcagagacgcagugaaccguuccauggcgccccgagccugcugccaaggccuccuuggagcugagauggaggcgggguggcugagaggcaagcuggaugugcauguuugggaagagggcuccguagaaagugcuguaggggccuuggcuggggaccacgugagcccuugugcggagagggccugugucuguggaucugggguccaccacaggccacugagaugggacagggcugggaggauugaggagggaagauccugagugaaauugugaaaucaggcccagccucaugugggaggugaggagaaaggacccuuccagagggcccccccucaauccuguugugccuaauucagaggguuggguggaggcucuccugaagggcucugaagagcgcugca

SEQ ID NO: 13552 - RNA, 15103 nt, Homo sapiens
uuaugauugcuaaauagccaauuucauuuguaauuuccgagacagcuccaggagaggaggcaaagagaaccaauguaauuaacagauggacuugacucauuucuuugcuucaacaagugaugaguuguggagcaaagagccuccacgcccugccuuggugaggaaagcuccacaggccgcuggguccauugcacacaucuguuugcccugucuuaaaacugccaccccaacacuccuuccugucacugagccacuugcacuuucaaugcuuccaaaauaguaaaaagugggggcgggggggaggaucguguccaucaguagagcccccaaacccuucucccacagccuacagaggccuucaauggaaucagaggcuaaccugauaagacugcggugggcaccgaguuccaaccccacuugcucacgcacaccacgaaaaacaucuccagugugugguuaccuguccuuugacuucacauugcuucugacaaagcgccaacuuucugacagcccacuccaugucagauucuucuuuggguugcgcugaaggcuuucugcuacaacuaccaccgauagguucuaauuuugcccucuagagccauauauaauaaaucuuaaggccucuuccacaugaaaauccuuuaaggagcuagagacaauauucuucacaauuuauccgaaucagaagcuuacuguaugauacuguagugagcugggaacugcgcuuuccuguccaacugguuuaggagccucccuccagcagagacccgcaagugauauaugcccauacuuuauuuaccagcagacagagagagccccuuguuccucagcccgguaacaacagaggugguucaucacccacuugcuccuuuuugaaauucacucugcagcgagcacuuuuuaaagucacgcacguaaugcauuuuaaagagcaucugcuguacggcuccauuugcucgaccucggcacuaagugugagauggaauggcaucucagugcagucccccacuccuuccucccagagccuguggugaauguacacugagauguauuuauaacuacacaggacuggggcucaaaaaugcagucuuuuguuaaauguguguuugcugauuaaaaugcaucuugcaaagaaagcgcauugcuaaugcagaaucuaguccaaauauauguauuauguaaugcacauuuuuuaauaaugcaggcaaucucgguguaucuauauuagugaaucagcucugggcugccaucuccuuuauaggcauaaaagcacuccaucugaagaaugaaguacuuucuuauguacacuaaagaaucauaaucuaccucguugcugacagcugacauuaguuuccauucaaagggcauuuacuagcacccauauauuccugauuuuucccccaacgugcccugaaaucagcuugaauaauauauuucuguuccauaugcugucgauggagcugugcuaauuagaagaaauaaagugggugggucaguguaggcagacucucuggaaacgugccccauuaguugggacucagaagcggagaugaggauuugaaauauacagcucuaaaugccccugcccagugucccaugauaauauccacacagugacuacagccacgcaggcaccugugauaauaaaacccuugcuguuccacaggaaaagugguagagcagggcacaacuggaacauagacauuuguccuuuugugggguuugacaagucaauccuacuuuaucagacuaaccucccagguucaagcaauucuuguggcucagccacccgaguagcuggaacuacaagcgugcgucaacacgccuggcuaauuuuuguauuuuuaguagagacaggauuucaccauguuggucaggcuggucuugaacuccuggccucaagugacccacccgccucggccucccaaagugcugggaucauaggugagagccaccaugcccagcccaaucacuauuuuaaugcuacaaacuaacacagagugcaagauacaagcuagacacagccaagaugcagaaaggaaaaccucaacacauccaaagcaguugcuggucucucacugggguaugaacucugcacuuagugguuuuaauacgggugugguguugaaggugugagguuaaguuccaucauggugagaauggcuguggguaccugacugacucuucagacaccaggcagaaguaccaguaccaggagggccuggugggccacccagugguagagccucuuuuuuuaagauuccccauacugacucaagaaggagaaaaggaccacaacccaugacauguguccuaagugaaacaaccuucuugauacucccagggauuuuaggaugauggcuuugcucugaguuguuucgccuuuggacuugucacuauggccaaaaaggcaccccauaaucaucauggagggccagacugaagacacgcacaccucaaaagcagcagccagguuagcucccacuguagggaucuccuccuguaggccaucauuugauuuucuagggccaagaaagagcggcacuauuuacuccaaaucuucagccuugcagaguacaacaacacgaucuaguggugucugaccgcccccuagcccugauccaaucauuuucucauguggaauucaagcuagauuaaacaauguugguggguacagagggauucugacugauucaaucuccugauucacagcaaauuaauccaaaauauccuuuccuuaauacaauacuuuuguuguuguuguucacuacucuaccuucagcaccuaaaacacagcuuggcacaugcaaggcacccaaugaguauugcugaguuaccuuuguuaaaaaccuaucuaggagccgggcgcgguggcucacgccuguaaucccagcacuuugggaggccgaggcgggcggaucacuugaggucaggaguuugaaaccagccuggccaauauggcgaaaccccucucuacuaaaacuacaaaaauuagccgagcguaguggugcacgccuguaaucccagcuacucaggaggcuuagguaggagaaucucuugaagccaggaggcagagguugcagugacccaagaucacaucagugcacuccagcuugggugacagagcaagauucugucucaaaaaaaaaaaaaaaaaaaaaaaaaccuaccuaggaaauggcuguaaggggccuccagugaggauuccgugucacccugaacugccccgcaggagagaagugguugugugaacugagagcgcaggaaagacuucccuuuacccaugcucucagcuccaguccacuuccagcaccaccuucucagcucaaucgagcucagggcaguccucagaugggcuugcagacuugcaaacuacuaccucaaccgugggggcccuuguugaagaagaugagguaauuagccaauucagacuguuugagcacguauuguuuggaaacuuuucuaauuacagucacuauaacagaucugcuaaagguaguuucaugauuaauggcugcccgaaguuaccauccucaaacuauuaagccauuggaaaaugcuagaggcuuaauacucguguauagacagacccucauuccccugaauauuugcuauuugggguucuggguuuuuagcugcucccaggcuguguuuauuuccccaauaacuggggaaacuggggaggggcacgaccccacgggagccugcgcccaccugcccaaguacuggaccuggggcuagcuugccgcuugcuccuugccacccgccaggccccccgcccaucgcuucgcccaaauccuuucaaacaagguucccuccugccaccugccggcccacuagggucugcgccacaggcucggcgccaccacgcagcucgcggggagguggcccccaccuccuuacugcacaugcccggcagaaguccgggcgcgcaacuucgcagaaccucacugcccgucccuccucgccucagucuccucuguccucucccaggcaagaggaccggcggaggcaccucucucgagucuuaggcugcggaaucuaagacucagcgagaggagcccgggaggagacagaacuuuccccuuuuuucccaucccuucuucuugcucagagaggcaagcaaggcgcggagcuuuagaaaguucuuaaguggucaggaagguaggugcuucccuuuuucuccucacaaggaggugaggcugggaccuccgggccagcuucucaccucauaggguguaccuuucccggcuccagcagccaaugugcuucggagccacucucugcagagccagagggcaggccggcuucucggugugugccuaagaggauggaucggaggucccgggcucagcaguggcgccgagcucgccauaauuacaacgaccugugcccgcccauaggccgccgggcagccaccgcgcuccucuggcucuccugcuccaucgcgcuccuccgcgcccuugccaccuccaacgcccgugcccagcagcgcgcggcugcccaacagcgccggagcuuccuuaacgcccaccaccgcuccggcgcccagguauucccugagucccccgaaucggaaucugaccacgagcacgaggaggcagaccuugagcugucccuccccgagugccuagaguacgaggaagaguucgacuacgagaccgagagcgagaccgaguccgaaaucgaguccgagaccgacuucgagaccgagccugagaccgcccccaccacugagcccgagaccgagccugaagacgaucgcggcccgguggugcccaagcacuccaccuucggccagucccucacccagcgucugcacgcucucaaguugcgaagccccgacgccuccccaagucgcgcgccgcccagcacucaggagccccagagccccagggaaggggaggagcucaagcccgaggacaaagauccaagggaccccgaagagucgaaggagcccaaggaggagaagcagcggcgucgcugcaagccaaagaagcccacccgccgugacgcguccccggaguccccuuccaaaaagggacccauccccauccggcgucacuaauggaggacgccguccagauucuccuuguuuucauggauucagguuaguugcccaccgcuaaacuggggagccugagggcggugugggagcagcgcagguggaaaggaggugagaaggaaaggcaggucaggggcgagugggaagagaggaggcucagcuggucagccugggaucgggggucagggugaggcggcgagggcucccccaaacuucccaggaugccaggggcgcccugguggccaaaggcuuguuggacggcggggcgcacgccgugcgucccgcuggagacaaccugaggucuccgagcuggugccccggcuacgcgacugaaucccgaacgcaccccagauuuggagcugcacacccaaacggcauugguaagucacuuguuuugcgcgcuuuucuuccuccuagaaagacuagucucaaauaaguuggccuucucagguguccaaaaugugguucggaggugcgcgcgccaacuuucacgaugugagagcagccgcgcuguagagacaccguugaaaugugcggaaaguaaucugaaugggaaugggcgagaacucuagagacugaccacccgggagggaagucacgcgcgcgcggcgccuaagcagcucagagccggagcccaggucccagagcugacaauuaagccgcgggaccuccgcgccagugccuccagcugccgugcgccagccuuggccgccacagcccgccucccgucgcucgcgggacagagaccgccucaaagagcgugcgcaccugcccgcgcgcgccggagcugaccucucccggcggcgggcgguuaggggaaaguaccugggggaaagguagaggagguaaggggacccuuggggaugccccuacgggcuaccaggguugaacgcacaggcauggucacgucgggguauugccaagcuuuuggcgcagcuggucggguggccaggcugcaugcggcuuagcaggagacguccugggcuguuugcgcaggaccucuggaggcccucgagaucgucgcaaguggaaagguaaagcggaacaagggacaggcuggagacgggggucgcgucuaacaucaggauaacuuacaauucguuuccaaagagcgcgguacgcgcagagcuggggaaagguguuggauccggcgccaguccuuggacgaucagucgucgaaaaggaggcaggggccggcggcuccggcagccuuggggaggggaggcgaggcggcgugcuccggccauuuucagcacggguagaguuaaguuuaaucuguaaccuggaggggaaucugcucugaugacccagcacaaaaacggcagcaaucugguaacgcaccuucggaagggaaggcgugcucuccucgccaguccuggggggaaagacugauaagugaaaugucuuuaaaaaaucucauccgacuuggaaauugauuuuuuuuuuccuggugugcgugucucauuuugcgccggcuuaauuauacggaugacaacgauuuggaggaauaguaaagcguuuugagggcuugagaugaaugacggucagguucuuaacuccuaagaaaaggaugaugauagaaggaaaauaccuuaaauggucuuccuuccaggaccuauuccguaggaaaggcgucgcggcgcccaagacuuaguucugccgggcugcagcgcagacugugguuggaugcuuuuguggucuucccuaguaaauacggagaaacuaguuuauuugcaagugguuuucugcgacagcaauguuagucucagaaguuuggaggcugcggaagggcuaggcgugccccgcuuuuggcuugccccuaagucgaaauuccugcuuaauguaaacaaugaugguguguuggcuuucugugacauuaaguguucaguuuuuccucugguaaugucucagccugaguucaccaagcaaaaugucucuagggacaagcaagaaaaacuagggauuguguugaauuucuuuggugugccuuucaagugugggagcuaucuucagacuggguauuccgggagacccguuuucccacagagaauuauucauuagagaaaugagcauguugccuuguugcaggaugaauaaacaaguuuuuuaaaagcccuccgugucgagcccacaccucacacccaucuugcuguuuuuuaaacagaagcccaacauagggauguuuccugaacuguaagcaauguaccauguucacauguagcgaggaggggcaaucuaggaacacacacugucuuucagacagucuuccacaaacugccucgccaucugcauuacagcccaauuguaaaaaccuguuaccuaccggcacacacucucccccgcucaauuccccucccccgcucaauucuccucccccgcucaauuccccucccccagcuucccucuuuacacccugauucaaggguggaaaagccagugcagaccauaugaagcaacugagagcuauaccaacccccgaggaaagcaccuauggcccucccugagaagacaggauuuugcuauauagacuucgcaaaccuucucucugccugagagacugguacucagcuccuuccuuuuccagagccauuuuuagcaacuuccccaagcauucccaacucacuagucucccagcuggcccuuugccccacccugcucaacugggguuagcaucugaauaggcccacuugccccuuuuacauaggugaggucugcggggugaggauaggcucccaagaaaaagcagaucuuauggugaaccacauaggugaauuaccagccacuuuuaauauuucaaauggagggugagggaggaggaggagcaggagaauaaagcuagcuaaacaugaugauaugcccccaauauugaaguuguuuccuuuaguacauuaaucauuugcuuaauggaaauuugcuuuugugggggaggggagggcgacccaaaggugcucuuguaacugaacuuaucugagcugggaauuuauguugcaauguuccaauauuguguggggucaaccugauguagguuuaaaguuuugcaaacaaaacucuuuuauguucaucagaauucaagaauuagaaauguuacaguuugggauuguuuugagauguuucuuuaaugcacugcaagccuuucucacccuggaguugcuuacagccuuuaacucuucagccuucauuuucugcagcuguguggaagguuaaggaggaagaaagcugaaacuucaguguugguaagaaugagguuuuuugguuuuuuaauaaucuacauggauuuaccucaauuaucaguuauuauuauacugcucuucaagaagagggaagcuuuugagaggaaacugagcagaaaccauggugugaguaaagcaugucuccuaacugcuuaccuggaaggugaccuaucacaaaaaccaaaucacuaaaauaaaauuaagcuuccaggccagugaugucaugugcuggcucaacugcugcucuucucuaaaaaaucacccagcagagggaugagaugcucaaaugacaucuuuaauccccauguucaagaaugagagauggaauuucuuguucuguugugggguuuugacacuaaugacucuauuuccuauaacuugaugucccaaacuggagcagugggaucuaagacgaaaggcccagggcuagcagcccagguugcuucuagccauggucaaguggccuuaggucagacccaacaccccucugccucaguuucuucuaaaaugagaucgcugaaugagaugauccuauuuaucccuuucagcuccaaaugucuagauugauuagcuuaagaagccugggguuguccaauuugacucuacacuagugauuuaacccuaauggaacucccaaaaaacaucgaaaguugcucaaauaaaaagcaccagcuagguaucgcgccauugcacuccagcccggccuacagugugagacuccaucucaaaaaaaaaacaaaacaaaacaacaacaacaacaaaaaaccccgaaaaacaaaaaaagcaccagcuaggaagaaaucuguuuuguguuggcuucauguaaauuuugucaaaucugcuuuacaguugguugcaaaauggucucaaaaggcaguuuagagaaugcagaauuccacuguguccuuucccuaaacuggaaacacuuagccauccugagagucguauuuaguguguguuuuacguguguguguguguuccccaccuucugucccugaccuuggugucuaagaacaagcuuuucagagcaggagcaggcagcaagguugcaaguacugaccuaguacugcagcuuggagaggcuaaccacugugggggacggcagacugaugggaacauugguugagugaccacaagugcuguugaaaguuuuuugguaacaguuuuaaguguuuugguuaagcuagaccugaaaaaaaugguauagaagcuacagcuauuugagauaaaccaguuuucucaaccuuuguuuuuuucaugaucacuccccucuucgcuucuucagacauaugcuucuuacuugccccuccccaugacauuuuaauaccauggacauacagcuagaccccacugucuguuuaugcacugcaggaccuugucacagcuaagacuuguuugcgcaccgcaucccccaaaaccaguuuugccuccaucauacaugcaugggauaaacaaagcaagcauuucaaaaacaaaaaaaucugguucugucaaauuaagugauguagcacccauuuuuguuuuauaauuucuuucuuacauaucaaaaggccauaugugggggguggggggcauaaauuuuuuacugguauuuguuuucuuucccuuguuuaaaaaucucaugaguuuuuucaaacgccuccaauagcuaugcugguccaagcacuaguggccauuaauucacagggcagagaagccagaauaaacagccuagugacuuaguucucccaaggccaagagccugcaaugcggggccaccauuaccuguugacagugcucagccagcagaggcaggacucugccugcaacuauucccggguagaaauggggaggcugccuucccagcucccacugggcauagccuguguguuuauuuuuuguguuuauuuuaggguaaguauguuacaaauuagcagggcacauggcuaugagaaaggccaacauaaacccaggcagcagggacagaggguaaguggugacaguaaaguggggagagauuuaaggaagacaaaaggaaaagaagaauuugagggaucacagaaaaaaaggaagauguggguagauaagagaaccccugggaaggagcagaaaagaagauuuagaaauggggaagggggucacaaagccaggaaauuuggcgguuauaaagaaagucguuugaaggaauaaagagagucuugaagagagaaagguugagggcagcuucaaguaucugguggcuaaggggguuagaaccaggugcaucaagggacagacuucagcucaacauuaggaagggcauuuuuaaaagccaaauauggcauuggagggcuaccaaugaggcucacagauucgacaccauuaacaucacugucccccugagaguuucguacagaccugguccaaaaauuccaauuucauagguguggaguuuucauacaaguacuucaauugcuacacucaaagagaaagauuuaacaccuagaaaucuagcugucuagcuccaaggcuaaagcuuuggguuuugguucacagcaagguuggucuucaagguccccacucucaaacuugagggguccaaggggcacaggccaaagaccggcagccagcagaagaccacguuucuucuccccucaaccccaugugagagcugguuucugaguguccuggcuuaugucgcugucuuaauuagauuucauuaggaaaauuugcccuggguaauugagguuguucuagaaggugaaauauaccauuccccuuaaacaaugaugcccagaagcccccaggguggcuggaauucccacuaugaauugcagaaauuuuaagcagagcuuccacuaaagccaaauuuaccuuccgagauucccucuuuccccuccaacccccacuuuugccucucucuuaguugcuuucccauggugcuguucaucuuuucuggaauggccucuccuccccugaaauucuuugcugcaucaucagcuagucuggagaaggaauccacaaaugucuggacccacuguucaagcacagguggucagaggacaguggcaugccuuggcugaaacagaauuuggggcaccuuuugagaagguugcugagcuacagcuaauuagcugagugaaggggucugaacucacgaugggggcuuuuuaaucugagcauaucaaguauuuucauaaagacuuuuuccacuaccucuaauaucagccuugcaucugccucuaaccugguaucuugccucauccauuugaggcuuuuuuccuuuagcuggcauuugcuucaaacagccuggccacgcagaccccucugcagauagcaguaugcugcugccuccaccggccaaggcgggcagaggagagucugaagggaaaaggauggcagcagcaagucuugauugaaaaguaauuaauuguacagcuucaaagucuauuacuacucacucagcacucagaaaacauuugucacugggaggcugagaagcuucauaguugccuaaauucuuuucuaccuucucuuucugcuuuuacuuuuuccucaauugaaagaaacccacugacaaccaaugacaugaaugggcugcagagaaggcacuucugcaaacuucaccacccaccuccucccugcaaagccgcagaccaaaaggaaaaugacuaccaaaaaaauacuguuuuucgugguuucuguucccuucccuuucacccaccucccuucccucucucuacuuugccuucucuuuguuggcuacagggauaaacccagaaagcugacagguagcuaccuaaacuugagauaugccuuaugcuuuugguaaugaguaagaaucccagaauguaaguagaaacacaauuacucguugaauacauaugccaugaaagcaucaauagagaggugagacuguuugggaggcccagggcaucacgugcggcuuccaaggaacggggcuguaauggugcuguucagagagucaaugguaaagaaauacacacauucuuucuauuggggguuccauauuuucaaaacgccacuguuugccaccuguggcaccugggccauuuggcuuuccucagacaugcagaguuuaauggaagcaugagaaauucuucccaugccuuucuuaguacaucaagugcagacgcuauuauuuuuaaguagccaaguauacacaauuuucaaguaaaccaucccuggguuucgacagccaauccuguccuccccuacuugacacaucaucucacugcagcccuacacuccagcacacagccccucaugacaggggucaagacccuggcacacagcgucuauccaucccaacucggccuuuuuuuucaggcaccagccucuccugacuuccucuuccuuagcugcauaaacacauuaauagacuuuccuuccucaguccuaucacauauuuaucuuuucccaugauggcaauccauccagcacuggaaagcuauguuuaagguacuuugcuauuauacaauuauaauggcagauccuaaaaaagccccggcaagguuaggccccagacgaugcugcccacuaacauccagcacuggccaucucccuccagaucaaggccauguuucugucuugagcuagcaaaauuaucagccuucaggaggaucaccagacaagccaaccaaucaggccaaucaagguggaccccaguaaacccacuagccgaucacccccagcucuuacuauaccggauuccucaggucccuguggccuugcaggugccacaggugggucaacuccucgaacauuuggccacacuucuggggucccugaccccauuacugauguuucagcucuuagcuccacucaccuaaaggacuuagguuuuucagagucugguagccagucacuacagagaaauaacaggaguggaaaaaagggggaauaucaggguuaaauacugggauuuauucuuccuagucuuaauuuaucuuuaaauuaaggcaauuccuauuuaaaucuaaggguccuuucucagcuuauaguggugauuuucaacugggggagauuuugccccccagaggacauuuagcaaagucuggagacauuuuugguuguuaaaacuaaggggaugcuacuggcaucuaguggguagaggcuagggaugcugcucaacauccuacaaugcacagggcagucaccacaacaaagaauugccuggccccaaauaccaccagugcagaggcuaaaacaccaagucuagaugagaugugcugagugguucugaaaccccuuccucuggugugcucccaucucucccuucugaguccucccuacucacuccuggacugucucccuuuuuccuguccagugcgccaauuguucaagauucuauuaccaaauguauuucuccccuaaagaguuuucucugacuccauaaauucaucuuuguaaguacgauugccaauuugaaugugugaucuuuaucuuuuucugaacuucagaccuuuccucccagaaaaugggcugcaaaaaucuccaucccaacugcccaaaguuccuuaaucugccaugucuaaaaccaaaucagcacugccaccuugccagccccucccacugacuucccugucccacucccaguguuccauccaucugggugccacacuuuggcuccuccaucuuuugugucuuucuagcauaagagcugcuccaggaggauccuuugggaccccucuugagugccguccuucagccuuccugcuuccuucaccgugcuaggucucuccuuuaaacaucuccuuugugcauaaccccuuuccuuuguucucgaucaggaucauccuccaugcugcuucugcuuuuccuaaaaguaggcucaaauccucacuugcagaacaaaaaacuuucaacauccuuuccguuuccugccaaaauagccucaaaagugcuugcccucauacuccauggcauccucagagagauucuaucuaauuucuccuaacuuuucucccccugcuccccaagagccagccaagguggccaguuguguuuacccagccacgccccauguuuccuaccauuaaauccuuuguucguggugggcaaaccgucucccaucccccacuaccaccuucuauucauagccaaggcgucuauccuuccuuggaggcccauauaaaaagucauuuucuccagcaagacuuucaagguccccccagguggaguucuuuucuuccauuuguaugcugcucuacucuccaggaugaggaacugguauuugucuaacuuguuaaauuuguuuuagucaccuccaugcaugugcuccccuggcaaagcucaugauaucagaaagaaugaacaaaggggucccacagacccaugagggugucgaacagagacccugaacccguuccucgacaaaugguacuuugggggugagcgcgaggccugacgaaagcaaacaaccccuuuggagcacccauggcagccucccuggggcuccaaccccaaugucuacugaccuuccacuugugcaggcucagcaucccuggggccucaacuccuuauccauccugggcugcuccucgcaguaagcccucuccuugggguccuggcccucuaccucccagcccuggaaaucuucuugcuccucaccuugcccggcaguggcaccccguuggcuggguuagccugccgccaucaacacacccaaggguuggccccugggaccccaccucucccccgaggcucggcaaccuguggcaugaggaagagugaccccacggcgcuagcgguccucguggucuuccaggccuagccgccauacacccgccccccaccggcuuccaaccaccccagcagcaccucuucg

SEQ ID NO: 13553 - RNA, 71541 nt, Homo sapiens
cggggagguggcccccaccuccuuacugcacaugcccggcagaaguccgggcgcgcaacuucgcagaaccucacugcccgucccuccucgccucagucuccucuguccucucccaggcaagaggaccggcggaggcaccucucucgagucuuaggcugcggaaucuaagacucagcgagaggagcccgggaggagacagaacuuuccccuuuuuucccaucccuucuucuugcucagagaggcaagcaaggcgcggagcuuuagaaaguucuuaaguggucaggaagguaggugcuucccuuuuucuccucacaaggaggugaggcugggaccuccgggccagcuucucaccucauaggguguaccuuucccggcuccagcagccaaugugcuucggagccacucucugcagagccagagggcaggccggcuucucggugugugccuaagaggauggaucggaggucccgggcucagcaguggcgccgagcucgccauaauuacaacgaccugugcccgcccauaggccgccgggcagccaccgcgcuccucuggcucuccugcuccaucgcgcuccuccgcgcccuugccaccuccaacgcccgugcccagcagcgcgcggcugcccaacagcgccggagcuuccuuaacgcccaccaccgcuccggcgcccagguauucccugagucccccgaaucggaaucugaccacgagcacgaggaggcagaccuugagcugucccuccccgagugccuagaguacgaggaagaguucgacuacgagaccgagagcgagaccgaguccgaaaucgaguccgagaccgacuucgagaccgagccugagaccgcccccaccacugagcccgagaccgagccugaagacgaucgcggcccgguggugcccaagcacuccaccuucggccagucccucacccagcgucugcacgcucucaaguugcgaagccccgacgccuccccaagucgcgcgccgcccagcacucaggagccccagagccccagggaaggggaggagcucaagcccgaggacaaagauccaagggaccccgaagagucgaaggagcccaaggaggagaagcagcggcgucgcugcaagccaaagaagcccacccgccgugacgcguccccggaguccccuuccaaaaagggacccauccccauccggcgucacuaauggaggacgccguccagauucuccuuguuuucauggauucagguuaguugcccaccgcuaaacuggggagccugagggcggugugggagcagcgcagguggaaaggaggugagaaggaaaggcaggucaggggcgagugggaagagaggaggcucagcuggucagccugggaucgggggucagggugaggcggcgagggcucccccaaacuucccaggaugccaggggcgcccugguggccaaaggcuuguuggacggcggggcgcacgccgugcgucccgcuggagacaaccugaggucuccgagcuggugccccggcuacgcgacugaaucccgaacgcaccccagauuuggagcugcacacccaaacggcauugguaagucacuuguuuugcgcgcuuuucuuccuccuagaaagacuagucucaaauaaguuggccuucucagguguccaaaaugugguucggaggugcgcgcgccaacuuucacgaugugagagcagccgcgcuguagagacaccguugaaaugugcggaaaguaaucugaaugggaaugggcgagaacucuagagacugaccacccgggagggaagucacgcgcgcgcggcgccuaagcagcucagagccggagcccaggucccagagcugacaauuaagccgcgggaccuccgcgccagugccuccagcugccgugcgccagccuuggccgccacagcccgccucccgucgcucgcgggacagagaccgccucaaagagcgugcgcaccugcccgcgcgcgccggagcugaccucucccggcggcgggcgguuaggggaaaguaccugggggaaagguagaggagguaaggggacccuuggggaugccccuacgggcuaccaggguugaacgcacaggcauggucacgucgggguauugccaagcuuuuggcgcagcuggucggguggccaggcugcaugcggcuuagcaggagacguccugggcuguuugcgcaggaccucuggaggcccucgagaucgucgcaaguggaaagguaaagcggaacaagggacaggcuggagacgggggucgcgucuaacaucaggauaacuuacaauucguuuccaaagagcgcgguacgcgcagagcuggggaaagguguuggauccggcgccaguccuuggacgaucagucgucgaaaaggaggcaggggccggcggcuccggcagccuuggggaggggaggcgaggcggcgugcuccggccauuuucagcacggguagaguuaaguuuaaucuguaaccuggaggggaaucugcucugaugacccagcacaaaaacggcagcaaucugguaacgcaccuucggaagggaaggcgugcucuccucgccaguccuggggggaaagacugauaagugaaaugucuuuaaaaaaucucauccgacuuggaaauugauuuuuuuuuuccuggugugcgugucucauuuugcgccggcuuaauuauacggaugacaacgauuuggaggaauaguaaagcguuuugagggcuugagaugaaugacggucagguucuuaacuccuaagaaaaggaugaugauagaaggaaaauaccuuaaauggucuuccuuccaggaccuauuccguaggaaaggcgucgcggcgcccaagacuuaguucugccgggcugcagcgcagacugugguuggaugcuuuuguggucuucccuaguaaauacggagaaacuaguuuauuugcaagugguuuucugcgacagcaauguuagucucagaaguuuggaggcugcggaagggcuaggcgugccccgcuuuuggcuugccccuaagucgaaauuccugcuuaauguaaacaaugaugguguguuggcuuucugugacauuaaguguucaguuuuuccucugguaaugucucagccugaguucaccaagcaaaaugucucuagggacaagcaagaaaaacuagggauuguguugaauuucuuuggugugccuuucaagugugggagcuaucuucagacuggguauuccgggagacccguuuucccacagagaauuauucauuagagaaaugagcauguugccuuguugcaggaugaauaaacaaguuuuuuaaaagcccuccgugucgagcccacaccucacacccaucuugcuguuuuuuaaacagaagcccaacauagggauguuuccugaacuguaagcaauguaccauguucacauguagcgaggaggggcaaucuaggaacacacacugucuuucagacagucuuccacaaacugccucgccaucugcauuacagcccaauuguaaaaaccuguuaccuaccggcacacacucucccccgcucaauuccccucccccgcucaauucuccucccccgcucaauuccccucccccagcuucccucuuuacacccugauucaaggguggaaaagccagugcagaccauaugaagcaacugagagcuauaccaacccccgaggaaagcaccuauggcccucccugagaagacaggauuuugcuauauagacuucgcaaaccuucucucugccugagagacugguacucagcuccuuccuuuuccagagccauuuuuagcaacuuccccaagcauucccaacucacuagucucccagcuggcccuuugccccacccugcucaacugggguuagcaucugaauaggcccacuugccccuuuuacauaggugaggucugcggggugaggauaggcucccaagaaaaagcagaucuuauggugaaccacauaggugaauuaccagccacuuuuaauauuucaaauggagggugagggaggaggaggagcaggagaauaaagcuagcuaaacaugaugauaugcccccaauauugaaguuguuuccuuuaguacauuaaucauuugcuuaauggaaauuugcuuuugugggggaggggagggcgacccaaaggugcucuuguaacugaacuuaucugagcugggaauuuauguugcaauguuccaauauuguguggggucaaccugauguagguuuaaaguuuugcaaacaaaacucuuuuauguucaucagaauucaagaauuagaaauguuacaguuugggauuguuuugagauguuucuuuaaugcacugcaagccuuucucacccuggaguugcuuacagccuuuaacucuucagccuucauuuucugcagcuguguggaagguuaaggaggaagaaagcugaaacuucaguguugguaagaaugagguuuuuugguuuuuuaauaaucuacauggauuuaccucaauuaucaguuauuauuauacugcucuucaagaagagggaagcuuuugagaggaaacugagcagaaaccauggugugaguaaagcaugucuccuaacugcuuaccuggaaggugaccuaucacaaaaaccaaaucacuaaaauaaaauuaagcuuccaggccagugaugucaugugcuggcucaacugcugcucuucucuaaaaaaucacccagcagagggaugagaugcucaaaugacaucuuuaauccccauguucaagaaugagagauggaauuucuuguucuguugugggguuuugacacuaaugacucuauuuccuauaacuugaugucccaaacuggagcagugggaucuaagacgaaaggcccagggcuagcagcccagguugcuucuagccauggucaaguggccuuaggucagacccaacaccccucugccucaguuucuucuaaaaugagaucgcugaaugagaugauccuauuuaucccuuucagcuccaaaugucuagauugauuagcuuaagaagccugggguuguccaauuugacucuacacuagugauuuaacccuaauggaacucccaaaaaacaucgaaaguugcucaaauaaaaagcaccagcuagguaucgcgccauugcacuccagcccggccuacagugugagacuccaucucaaaaaaaaaacaaaacaaaacaacaacaacaacaaaaaaccccgaaaaacaaaaaaagcaccagcuaggaagaaaucuguuuuguguuggcuucauguaaauuuugucaaaucugcuuuacaguugguugcaaaauggucucaaaaggcaguuuagagaaugcagaauuccacuguguccuuucccuaaacuggaaacacuuagccauccugagagucguauuuaguguguguuuuacguguguguguguguuccccaccuucugucccugaccuuggugucuaagaacaagcuuuucagagcaggagcaggcagcaagguugcaaguacugaccuaguacugcagcuuggagaggcuaaccacugugggggacggcagacugaugggaacauugguugagugaccacaagugcuguugaaaguuuuuugguaacaguuuuaaguguuuugguuaagcuagaccugaaaaaaaugguauagaagcuacagcuauuugagauaaaccaguuuucucaaccuuuguuuuuuucaugaucacuccccucuucgcuucuucagacauaugcuucuuacuugccccuccccaugacauuuuaauaccauggacauacagcuagaccccacugucuguuuaugcacugcaggaccuugucacagcuaagacuuguuugcgcaccgcaucccccaaaaccaguuuugccuccaucauacaugcaugggauaaacaaagcaagcauuucaaaaacaaaaaaaucugguucugucaaauuaagugauguagcacccauuuuuguuuuauaauuucuuucuuacauaucaaaaggccauaugugggggguggggggcauaaauuuuuuacugguauuuguuuucuuucccuuguuuaaaaaucucaugaguuuuuucaaacgccuccaauagcuaugcugguccaagcacuaguggccauuaauucacagggcagagaagccagaauaaacagccuagugacuuaguucucccaaggccaagagccugcaaugcggggccaccauuaccuguugacagugcucagccagcagaggcaggacucugccugcaacuauucccggguagaaauggggaggcugccuucccagcucccacugggcauagccuguguguuuauuuuuuguguuuauuuuaggguaaguauguuacaaauuagcagggcacauggcuaugagaaaggccaacauaaacccaggcagcagggacagaggguaaguggugacaguaaaguggggagagauuuaaggaagacaaaaggaaaagaagaauuugagggaucacagaaaaaaaggaagauguggguagauaagagaaccccugggaaggagcagaaaagaagauuuagaaauggggaagggggucacaaagccaggaaauuuggcgguuauaaagaaagucguuugaaggaauaaagagagucuugaagagagaaagguugagggcagcuucaaguaucugguggcuaaggggguuagaaccaggugcaucaagggacagacuucagcucaacauuaggaagggcauuuuuaaaagccaaauauggcauuggagggcuaccaaugaggcucacagauucgacaccauuaacaucacugucccccugagaguuucguacagaccugguccaaaaauuccaauuucauagguguggaguuuucauacaaguacuucaauugcuacacucaaagagaaagauuuaacaccuagaaaucuagcugucuagcuccaaggcuaaagcuuuggguuuugguucacagcaagguuggucuucaagguccccacucucaaacuugagggguccaaggggcacaggccaaagaccggcagccagcagaagaccacguuucuucuccccucaaccccaugugagagcugguuucugaguguccuggcuuaugucgcugucuuaauuagauuucauuaggaaaauuugcccuggguaauugagguuguucuagaaggugaaauauaccauuccccuuaaacaaugaugcccagaagcccccaggguggcuggaauucccacuaugaauugcagaaauuuuaagcagagcuuccacuaaagccaaauuuaccuuccgagauucccucuuuccccuccaacccccacuuuugccucucucuuaguugcuuucccauggugcuguucaucuuuucuggaauggccucuccuccccugaaauucuuugcugcaucaucagcuagucuggagaaggaauccacaaaugucuggacccacuguucaagcacagguggucagaggacaguggcaugccuuggcugaaacagaauuuggggcaccuuuugagaagguugcugagcuacagcuaauuagcugagugaaggggucugaacucacgaugggggcuuuuuaaucugagcauaucaaguauuuucauaaagacuuuuuccacuaccucuaauaucagccuugcaucugccucuaaccugguaucuugccucauccauuugaggcuuuuuuccuuuagcuggcauuugcuucaaacagccuggccacgcagaccccucugcagauagcaguaugcugcugccuccaccggccaaggcgggcagaggagagucugaagggaaaaggauggcagcagcaagucuugauugaaaaguaauuaauuguacagcuucaaagucuauuacuacucacucagcacucagaaaacauuugucacugggaggcugagaagcuucauaguugccuaaauucuuuucuaccuucucuuucugcuuuuacuuuuuccucaauugaaagaaacccacugacaaccaaugacaugaaugggcugcagagaaggcacuucugcaaacuucaccacccaccuccucccugcaaagccgcagaccaaaaggaaaaugacuaccaaaaaaauacuguuuuucgugguuucuguucccuucccuuucacccaccucccuucccucucucuacuuugccuucucuuuguuggcuacagggauaaacccagaaagcugacagguagcuaccuaaacuugagauaugccuuaugcuuuugguaaugaguaagaaucccagaauguaaguagaaacacaauuacucguugaauacauaugccaugaaagcaucaauagagaggugagacuguuugggaggcccagggcaucacgugcggcuuccaaggaacggggcuguaauggugcuguucagagagucaaugguaaagaaauacacacauucuuucuauuggggguuccauauuuucaaaacgccacuguuugccaccuguggcaccugggccauuuggcuuuccucagacaugcagaguuuaauggaagcaugagaaauucuucccaugccuuucuuaguacaucaagugcagacgcuauuauuuuuaaguagccaaguauacacaauuuucaaguaaaccaucccuggguuucgacagccaauccuguccuccccuacuugacacaucaucucacugcagcccuacacuccagcacacagccccucaugacaggggucaagacccuggcacacagcgucuauccaucccaacucggccuuuuuuuucaggcaccagccucuccugacuuccucuuccuuagcugcauaaacacauuaauagacuuuccuuccucaguccuaucacauauuuaucuuuucccaugauggcaauccauccagcacuggaaagcuauguuuaagguacuuugcuauuauacaauuauaauggcagauccuaaaaaagccccggcaagguuaggccccagacgaugcugcccacuaacauccagcacuggccaucucccuccagaucaaggccauguuucugucuugagcuagcaaaauuaucagccuucaggaggaucaccagacaagccaaccaaucaggccaaucaagguggaccccaguaaacccacuagccgaucacccccagcucuuacuauaccggauuccucaggucccuguggccuugcaggugccacaggugggucaacuccucgaacauuuggccacacuucuggggucccugaccccauuacugauguuucagcucuuagcuccacucaccuaaaggacuuagguuuuucagagucugguagccagucacuacagagaaauaacaggaguggaaaaaagggggaauaucaggguuaaauacugggauuuauucuuccuagucuuaauuuaucuuuaaauuaaggcaauuccuauuuaaaucuaaggguccuuucucagcuuauaguggugauuuucaacugggggagauuuugccccccagaggacauuuagcaaagucuggagacauuuuugguuguuaaaacuaaggggaugcuacuggcaucuaguggguagaggcuagggaugcugcucaacauccuacaaugcacagggcagucaccacaacaaagaauugccuggccccaaauaccaccagugcagaggcuaaaacaccaagucuagaugagaugugcugagugguucugaaaccccuuccucuggugugcucccaucucucccuucugaguccucccuacucacuccuggacugucucccuuuuuccuguccagugcgccaauuguucaagauucuauuaccaaauguauuucuccccuaaagaguuuucucugacuccauaaauucaucuuuguaaguacgauugccaauuugaaugugugaucuuuaucuuuuucugaacuucagaccuuuccucccagaaaaugggcugcaaaaaucuccaucccaacugcccaaaguuccuuaaucugccaugucuaaaaccaaaucagcacugccaccuugccagccccucccacugacuucccugucccacucccaguguuccauccaucugggugccacacuuuggcuccuccaucuuuugugucuuucuagcauaagagcugcuccaggaggauccuuugggaccccucuugagugccguccuucagccuuccugcuuccuucaccgugcuaggucucuccuuuaaacaucuccuuugugcauaaccccuuuccuuuguucucgaucaggaucauccuccaugcugcuucugcuuuuccuaaaaguaggcucaaauccucacuugcagaacaaaaaacuuucaacauccuuuccguuuccugccaaaauagccucaaaagugcuugcccucauacuccauggcauccucagagagauucuaucuaauuucuccuaacuuuucucccccugcuccccaagagccagccaagguggccaguuguguuuacccagccacgccccauguuuccuaccauuaaauccuuuguucguggugggcaaaccgucucccaucccccacuaccaccuucuauucauagccaaggcgucuauccuuccuuggaggcccauauaaaaagucauuuucuccagcaagacuuucaagguccccccagguggaguucuuuucuuccauuuguaugcugcucuacucuccaggaugaggaacugguauuugucuaacuuguuaaauuuguuuuagucaccuccaugcaugugcuccccuggcaaagcucaugauaucagaaagaaugaacaaaggggucccacagacccaugagggugucgaacagagacccugaacccguuccucgacaaaugguacuuugggggugagcgcgaggccugacgaaagcaaacaaccccuuuggagcacccauggcagccucccuggggcuccaaccccaaugucuacugaccuuccacuugugcaggcucagcaucccuggggccucaacuccuuauccauccugggcugcuccucgcaguaagcccucuccuugggguccuggcccucuaccucccagcccuggaaaucuucuugcuccucaccuugcccggcaguggcaccccguuggcuggguuagccugccgccaucaacacacccaaggguuggccccugggaccccaccucucccccgaggcucggcaaccuguggcaugaggaagagugaccccacggcgcuagcgguccucguggucuuccaggccuagccgccauacacccgccccccaccggcuuccaaccaccccagcagcaccucuucgggcguuccaacgcggcgcccccuauuggaccucccacccauauccgguuuccggucugacgcccccugcucauucgccaggcagccuugauuggcaugaccccugcccaauggcugacccggcgcuggggucggaggggagugaguugguguugggacccaguugggccauucaguggaugcucaagugguuaagccgucuugcguggguguaguuggccaaaguuugaaucaaaguucaguguugacaucuggaaguguguagacccauagagcuaaagcgauauaucuuugggggaucccaaacguuucccaggguccaacuguguucgccuccuuccgugcugcguggccacauggaugguggaugcaggggugcaaggaugcacggugccugugguacccuggcucuaagagggaugcauuagacuaaacgggaucgcaacuugcggugguucgcccgccugcagcucuuauacagcagcccgugccgugcgcccugcuugcugcagcccgcccuguguaacucauccagccuccccucccccaggguucugcaggucagaugacccccugccuccugcccaguugcucugugccuagacguggcucgccaaucugucucacuggugagaccgaccugaugcgcaccugccgaguuuuaugugacccccuuacagcagcuuuucucccggguuccaaucccucugcagaccccagaccagagcauagcaugugcacacaucaaggccaccagguggugugggcauuuaccuuuggcuagcucugagcucaccgcagcaugguagcgggagcgcagcugcgcgggcaaccgccggguuuguggccgguuggcgggcucagugccgccucagugggcucuagcaguagaaaaguaaagcgacuacccuaagauacccagagcgagaggagaggggcuagaagggugcuggaggcaggcuguaguggggcuaaaggagcugacugaccagcgcugcggccggugcccgaagcagcgagcagcgcaccucagcuccgguugccgcgcggcaugguauuuaucuguggguucagugcgcacagcguuguccagucucgaaaccacccuaaaccggcauuaaaccccaaccaaaauccccuuuaacccuucccuagaacagcaggaccugcgaaacucugaggccgcuuugugagguccuccucugcgcagcacgccccccaccccucucuuggugccgccgcagcuacucccuagggggcuuugcucuuggugguacgcacccgagaccuucuuauuccccugcgucaccauccacauaaacaagagagcacccugcuugcgccgcugugggccacugcggagaccccuagagugugaugggggugggggcuguuaaagugcuuuaccggagccaaccucagcaagugacaaacaaaagcagcaaaaaguacacccaaggcauuuaaaaaacaaauugcgugcuugcauacucggcauccccucucccucgccucucucugcuucuuuggugggcucacgaccaccugucgcaucccuacgcgugccugcgccccuucccaggcaccaaaagccuugcgcuccggacuaggggcuugagauccggggcugccuggaggcugggggcuaugacucagaguuucagggguauccuggggugaugaaauccuucuucaguccccccucccccgaggagucgguuggguuggggagggaggguuucagcuccuguacuccagcguuccgaggcccacgucuugcgucacgugucccgcaacgcaggagcgcuuucucuggccagcggagaagcgaggagaaagacuccaaaucagucagggagaggaguggaaggagccaaaacgucccugcgaggccugcgcucaccagcccccuuacccaaagucccgggccccuggcgccaggagcaggcuccuggagccggagccagcucggcacuggaaccggcguccucugguggcagagagagagcgcuacuggcgauuuucggaccgaaucggcacgcucgucagauccaagcaggcgggacuggccuggagcaaaaagaaagagagaggagggcguaaggauagaccaaggaagaggggcuggggggcagccugggggcaugaaaaguggccaggaaggagccaagacuccaccagcaacaauugaguugcuucagccucagucuaggguuccuuccaggccuugaaccccccaaccucacaaggguuggaaagugaggccggugaacuuuccagcugguacuuugauuuuaaaauaauaauaauaauuuuuucacccuaguucgguugggugcuccaucuuacggagccccaaacuuauuuugagaggccgccaccguguuaugggcgugcgcaacugccucuacggcaauaauaugucaggacaacgcgauauccccccugaaaucggggaacagcccgagcaaccaccuuuggaggccccaggggcagcugcccccggugcugggccuagcccagccgaagagauggagaccgaaccgccucacaacgagcccauccccgucgagaaugauggcgaggccuguggacccccagaggucuccagacccaacuuucagguccucaacccggcauucagggaagcuggagcccauggaagcuacagcccaccuccugaggaagcaaugcccuucgaggcugaacagcccagcuugggaggcuucuggccuacacuggagcagccuggauuccccagugggguccaugcaggccuugaggccuucggcccagcacucauggagcccggagccuucaguggugccagaccaggccugggaggauacagcccuccaccagaagaagcuaugcccuuugaguuugaccagccugcccagagaggcugcagucaacuucucuuacaggucccagaccuugcuccaggaggcccaggugcugcagggguccccggagcuccucccgaggagccccaagcccucaggccugcaaaggcuggcuccagaggaggcuacagcccucccccugaggagacuaugccauuugagcuugauggagaaggauuuggggacgacagcccacccccggggcuuucccgaguuaucgcacaagucgacggcagcagccaguucgcggcagucgcggccucgagugcgguccgccucacucccgccgcgaacgcgccuccccucugggucccaggcgccaucggcagcccaucccaagaggcugucagaccuccuucuaacuucacgggcagcagccccuggauggagaucuccggacccccguucgagauuggcagcgcccccgcuggggucgacgacacucccgucaacauggacagccccccaaucgcgcuugacggcccgcccaucaaggucuccggagccccagauaagagagagcgagcagagagacccccaguugaggaggaagcagcagagauggaaggagccgcugaugccgcggagggaggaaaaguacccucuccgggguacggauccccugccgccggggcagccucagcggauaccgcugccagggcagccccugcagccccagccgauccugacuccggggcaaccccagaagaucccgacuccgggacagcaccagccgauccugacuccggggcauucgcagccgaucccgacuccggggcagccccugccgccccagccgaucccgacuccggggcggccccugacgccccagccgaucccgacuccggggcggccccugacgccccagccgauccagaugccggggcggccccugaggcucccgccgccccugcggcugcugagacccgggcagcccaugucgccccagcugcgccagacgcaggggcucccacugccccagccgcuucugccacccgggcagcccaaguccgccgggcggccucugcagccccugccuccggggccagacgcaagauccaucucagaccccccagccccgagauccaggcugccgauccgccuacuccgcggccuacucgcgcgucugccuggcggggcaaguccgagagcagccgcggccgccgcguguacuacgaugaagggguggccagcagcgacgaugacuccagcggagacgaguccgacgaugggaccuccggaugccuccgcugguuucagcaucggcgaaaucgccgccgccgaaagccccagcgcaacuuacuccgcaacuuucucgugcaagccuucgggggcugcuucggucgaucugagaguccccagcccaaagccucgcgcucucucaaggucaagaagguaccccuggcggagaagcgcagacagaugcgcaaagaagcccuggagaagcgggcccagaagcgcgcagagaagaaacgcaguaagcucaucgacaaacaacuccaggacgaaaagaugggcuacauguguacgcaccgccugcugcuucuagguaaugcggcggacucugccugcgggcagcagggccgccggggaaccggggaggggguggcagggcugccugguggggcuaggggcuccgcagugggaggaggggguccagccaaaggcgggaagaacuugcuagaaaguuccagggagggacccuaacugcccugggagcgggaggggaucuuugguggauucggguggccgaaguauaugcccuccagggagaaaaguggugccgagcgacacugagggucguuuccggcuggacaggccagcgccagcaaccguaagcuggacaggcaggggcuucaggugagccaggaacugccggggaggggccccggggccccgggacuccccuggcuaggcuggugggguccacggugggcuggggucauuggggaaggcgcgccccgccucgccuggcacggcugcuuggacucagacagcuugucguugguguguguugguguccauauucuguguucgccugugcaugauacgcugaaguguccccuguuccuaucccggcacccccaaauuacccgccgacuguguacuuguacuugggaacgggcuguguugugguuugcgccauggcccgggcaaaaaacuuucgcuguucgcacacucuggugguaccugcgcccgggcgcucugcggcaagcggugcggaggacacgcggggaagguggcggggccucccgggaaauaagcggggcccuuggccugggggagcggggaaucgcuuuucgccggccuccgcguaaccuuguuucuguaugucuuucucucuuuuuccuuuugcgcuaagcguuuccucacuucucauucguucgccaaacccucccgccuuuacaguugaaaaaccagacacacagguaucuggggcgcccggggcugcacaccucaguucgguauucugcacacacacagcucgccuggucgggggaugggggaaaggggaaacacaaccugcuguaggcaaguccggaucccaaaccacuugggggcugguuccaagggggugggcguggcuguguuuaaaaaauaugaaauaauuuuucuuccuagcgaagagcccgagguaagccaaucauuuuuacaaagaguacaguaggaggggcuugguuuaaaaagauggggguuauguguugugaguggaaugucaccuuuguguuugaaaugcaacuaaaauaaaaguuuucaaaaaaugcucugaguguauuugaaguguguggacaaaguauggcaaaaccgugaauaugacuugugaaaacaaguaaauguuugcaugugaauuuuuucaggcagcuuuagcugggggcaaagaggcuugucaaagguaaggucuucugcaaauuggcucuggauacaaaaaauauauaaagguauuuugauuacagaaguuaaaaaucaugauauucuugucaggaggguauuuugguggccuucuaccuucccccuccuccucugcucacauuuccccaccucucggugcccuccccucuccaggaucccccuccucaccccacagcaagacccucuccuguaucucccagucuuucccuggccauucccaguuccccacccuccccccagccccccaagacuucuuaacuucaaaucuggggcauuaaauauuuuugccacauuuaaacaaagcaucaauuagcaauggucugaauaugugguuuaaaugaaaacuuccaaacaaacuucacaagcuuaauuuuuacauuuuauucucuaagacuuucucuaagaccuuccaagggauuucaagaucacaguuuuuaaggcugcgcuacauuuguuaaauauguuagaaugugugaugguuuuuuauuaauggcauuauuggcauauaacugugcuauugugauguggcucucacaaaucacaauuuuaaaugugaggaucauuuuguguaugcccauccagguagaucaugacauugucauuuaccuaaagacauauaauauggucguuguuuuaaauuucaaaugucucaacuacacuaaagcuaccaaacauuaaaugacaaugcacugguuucccugcagacaacugauuuugccauaacagacccauuucaauauuccaagcacagcucugggaagcaaaccuguagauugggggugggaggacauaaaugcauacagacaggagacccaagugacagugugcaccugaccccuaauugucaaauuggugaugugccuuacaugcggggccucaguugccuccuuugugaaaugaagcuuuccuagcagaucuccacuaaggaaugcuuuugcaccaugauuugagucuucuauucuuccuggaggugggggguggaggagacacagucuacuuacaucaggacuggagacuuauaccauagauugugcagccaucaauccugcagcaaacuguccauguuugggaccagucuuaagaauauuagaaguuuccuuugucuccccuuauuuugucaccaggaguaaaaauuaacuuuaagaaaaggaaauuugcuggggucaccuuguaccuuguccuggcuuuguucucgggugcugguagccaaacaccuuuggaugcagcauaguccagaaggugggcuggcaaaccaugggccaugucuaacauaagccugaaauaugauagccaguguuagcugcuagcugaaacuguaccacugcaguuugucaaagcaggcuacaguuuuugaccaggcuuccuuuugcagaggugacguaccucuucuggaccugaauuauugaugggggacagggagaggaggaaggaugaggacuuacucacauguaggacaagacuuuuuacuaacuuuuuagucccaacauauaaaacaagacauccauacaucccuaccacugaaaaugcagaucaaauggcuguccuuugauaugguugcuaauuugugacaugcagauucaucuguugcuugaaaaaauguauguucaugugcuuauccuuucuguuuuuauugccgggacaauuuaaucucauuacagggaauccuaagaaaucaaagagagagagagagagagaaagauagauagaaaucaguaauaugauuaaaauucuaaaauaucuaaagaguucuuuuuaaagaagccuuuuucuuacucaacacuauccaccaauagacuguuuccauguuucuguuacguuuuuaaauaauuuugguggcuuaaacauuuuuuaaaacuucauuuaggugugauuuccuccuuaagaacugaauggggcuaauagaucagaguuucuuaguaucugccacauuuauuaaaauuguguaggcaaaugcuauauauaauaauggcuauucugcuaugaugcuuuauuuauacagugaaucacaauuaauuguaugauuauuuaugccaccaagugcaacaguaugcauuguauuccaucuugcagaagcaccuuuuuauuuuucuuuucucucucucucucucucuuuuuuaacauacagccauuuuuuuauauucuaaaugccuccacugagcuuuuggugugguaggaaggacauggcuuaucaggccacaaaauuuuggaguccagauagauuuauuauuuucucuuuucagucuccuaguaagauucaugcuucucaaagucugaaauucuaccuugguuuuaauucuuacagauuucucucaaaaaaaauuuucccauauagguagauuaauguuuaaaauuuacccccauuauuuacaauggaaaacugguuuuaagcaaaaagaauugggggucauccccuuacuguauguauccuccuaacuugaaaaggaaaaucucacugcucucaguaugauuaguaaccaguaauaauaauaacacauucugauuacauuuuuuguuuguuugauuugaaacaaagucucccucugucacccaggcuggagugcaauggcaggauuucugcucacugcaaccucugccucccagauucaagcaauucaccugccucagucuccagaguagcugggauuacaagcgugugccaccaugccuggcuaauuguuuguauuuuuaguagagaugggguuucaccauguuguucaagcuggucucgaacuccugaccucaagugaucuacccagccucccaaaguacugggauuacaggcaugagccacugugccuggccacauuuuacauuuuuuaaagccuuucaucuagucauauuugucucuugaaacaguccugggcaauaaaaacgugauagggccccauuucauaggcaaauaaaccaaaagcucagagauuaaauaucagacacuuuuuuuuuuuuuuuugagaaggagucucgcucuaucgcccaggcuggagugcgauggugugauuuuggcucacuacaaccucugccuccuggguucaagcgauucuccugccucagccuccugaguagcuaggauuacaggugcaugcaccaugcccggcuaauuuuuguauuguuaguagagaugggguuucaccauguuggucaggcuggucucaaacuccugaccucgugauccgcccgccucagccucccaaaguucugggauuacaggcaugagccaucgcgcccggccauaaggcacuuuuacucaaagacugcaagguagguaaaggaucacaaauuucaaauucagauaaugcuuaccagaaaugugaugauaagcuauaaagcauuauuuaaauguaaagcaugauuauucuaaguauacuaugugcucuuaaaaucccuugccaaaugacacgugucgaguagucugcuacuuucugaauuauagcaaaacgcacagaucccugguuauaaauguccauugaguauacaugaaacaugagcucccccauuucugagauggcugucauugcuuugguaauauuucauuuacacauuugcuuuaacucaucugccagcacugcaacguugcagucuuaguuuguugggcuacuguuuuccuuuuuuuuuuuuuaaaugcagguuuuuuuaaaaguuuuuugguuuuuuuguuuuguuuuguuuuguuuuuuugcagggucuaaagcuuuucuucuuguuuagguuuccacuaaauaauaauuaaucauuauaauaauaaaaugcaguuacuuuucugcauagcucuauuauaaguauagcguuagaauguuuagaauccuggucuggaucucaugaucuuaucaaaauaacucugcuccauagucuuuguagugauuuuuuuuuaaaaguaugccuuacuucuaguccaggcuaauuuccauuuagcaagagucagugcguggucuuagaaaucaccuuugacuuuuaugcaggaagguuaguuguuguuguuguuguuuuuaagauggagucucgcucugucaccuaggcuggagugcagugguacuaucucggcucacugcaacuucugccucccaguucaagggauucuccugccucagccucucgaauagcugggauuacagacaugcaccaccacaccuggauaauuuuuuguauuuuuaguagagaugggguuucaccauguuggccaggauggucuggaaauccugaccucaggugaucugcccaccuuggccucccaaagugcugggauuacaggcaugagccaccgugcccagccaggaagguuaguauuaagcaaaacauaaauuuauuuuuagagaagguaaccuagauuugaaauucccaaaggcagccaugcuccuucuucuuuuuagaguuaguuuuuccuccaaauaaaacuuacccccaaccccagcaaaauuguggcucuucaaaugccucuaaauaacucucaggagacacaucaguagugaacaacaauucguuucuacacuucuugguuucuuuuagcuguaguagcaaaugugagguuccucucaaacccacucacgccauuugcccauuuaaaaaucaaauuucucaggaggaguagcaauuuucaagagagaagggacagggccaauugaugucacaagguccucaccaucaauuaagacaagucaacggagggaacuaaaagcacugggcagccuaauugaccaucucugaccccuuggaauagggacuaggagacucuggcccuaacacgcaccuucacagauuucauuaaauuagacugaauggagcuuuuguucccaucagauuccuguucuggccuguggucacccuaagcauaagaucauguucucuuuaggaaggaagaggagaauggaccugagccucucuuugggaguucugcugaaaagucugcaaguccuaaguggccuuuaugcaauuuagagacuggaaggaaggcacgaauauaaauugggggaaagaagccccugaacaaaggagaggagagguauuucaaaaagaggauauauucuuuuuuuuauugagacggaguuuugcucuuguugcgcaggcuggagugcaguggugcaaucuugucucacugcaaccuccgccucccggguucaagcgauucuccugccucagccucccgaguagcugggauuacaggcaugcacuaccacgccccacuaauuuuguauuuuuuguagagacgggguuucaccauguuggucaggcgggucucgaacuccugaccucagaugaucugcccgccucagccacccaaagugcugggauuacaggugugagccauggcaccuggccuuuuuuucuuaauucccccaaaaagagggccagcuacuagaagcaguuacaauuugagaaaucuggagucuuuuuuaaaggguaacauguucaacccagugcuuggcacauauaaguaccccaaaacauguuuuggguuuuuuggguucuuuuuguuguuuuuuguuuuuugagacagggucucacucugucgcccaagcuggaguacaguggcaugaucucggcucacugcaaccucugccucccggguucaagugauucuccugucucagccuccccaguagcugggauuacaggugccugccagcaugcccagcuaacuuuuauauuuuuuaguagagaugggauuucaccauguuggccaggcuggucuugaacuccugaccucaggugaucugcccaccuuggccucccaaagugcugagauuacaggugugagccaccauaccaagccucgacuuuuaauuuuagaaauuuauuuuccuccuagauuuuuuuuuuucucccugcuccaagugagguuuuggguuugguuaguuuucuguuguugcuggguuuuuuuuuuguuugugucuuuguuuuucuguuuuuugcauuucucauuagacuauuaacauguaaguucuaaaagugccagccaucucauucugucuuucugucuccaccuuucagaguacauucuuuguuuacauuuuguaaauaaaggucaacucaagcaguagacgaaugccaccuugccacauuuauaauugugugaagucacucucaggugaaugaugugccagagagagaugaggagauaacuuacuuuuugacuuguccuguaaaagugucaccugucaccccugccuauccagcucccccuucuguuuugauuagcuccuaacuauaaaucaacucaauaccgaggcugagcucaaggaccugagcuuggauuguucuaugguuauuacacaugaaaaaaaaaaaaaaaagaaagaaagaaaauguguuuaguuuccuuuccaacagccagauggugaaccaggccagcucaugggaauugaagaugaagagaccuccaagaaagagguagggaacaacacaacaaaacaauguuugacuuuucauuauguugaucgucacaugcucuuugagcacacacgagucacacaccuuucaaguuagaaucaguggagcgcuuuucuacaugcaacaacugggagcuaugcuaugggaagaauguuaggcaacugaucugugacagggcaauggaaauuaagggagugugccucuguuguacuuccuuagaguaaaaucccaaauugcauugcagaguaauuuguuaaaccucaggaguauuuaaauucaggaguauuuugacuuguggaguucugcccacagaacugcacauuggaucuuacuaaauguuuuuuaaugauucaauuuggggcgaggagagagguauaaagguaguauaaauuguuauccaaucucaaauuuauuaugagucagucaauguuuccgacauugucacacacacacugugugugggacagaguaaguacuuuuaacuuccuuuaaugaguugauaaugggaaggaaaaaaaucucuguacuacuuucuaaagagugucacaguugagcuuucacaagcucagugucaccacugagugagcaucgauucuuacaaggaaauuaagacuugggcugcaagagccucgccucucucuucugauuuaucuggcucuugccucucccccuccaucaaaagaccacacuaucucucuccucuuuuccauuugaacgauuuugccauucaucaaacugauugcuaaugugcaaauuacaugaugguauuuuuacagggaaccugcauucagguaaguuugaagcugugggauauuugagggggaaaaaaugaauaaugcuuaucaugauccacagaaacuaaagucaggcauuguaggacaguccagaacccaagaagggccauggacaggacccuuccaaaggaaagagaaucucgugucccguguguuagcgaguauccauuccagcucccccagggcucugggacccacauaucugugccuccauuuuucuaggguuguaguagcuggugguccaguugaaaaaaaugaaaacaggaaaccugucaagaauagauaguguuauuuaggaaguauauagguacuuacauuacugagaccacuugaacacauccuuuuaaauagauaccuuuuuuaaaaucuaugguuauguaacaucuguguccgagggauuuaagcagaaagcccuguggguuucucuuuucaaaagacagaccuuauuuauaaucagccccucgauuuuuuugggggggccuucaugggcuuuugaaaucuuaggaaguguccauccuaauuccuuauagcugcucuuucuguggcucuacuagggccuucaagaugcugaauucacuuauuaauuaaaucauugacgucauucaggggguuccuuuugcccacugccccccaacaugggaauuuuuaaaugacuggcucuagaagggcccaaagauggugaaggugaauugauauuucaggugaccacuagauggugagacaguauaaggcagaaaacagguggcacgugucugugaaaaugagagggauggccagggcuggcaaaggcaaagaagggucccccuugacuuuuaaugccagcccccaccccaggacagaccuuggauucaaauaggccccaaagcuuuagccagaccagcuuuuuacuuuuacgcugugacuucuccuaguuagcuauaugccaggauuuuagaagcauuuuggggggcucagucuaacagagggguccuccaaguggcuuuauugacauuuuuucauggggugguuguccuaugcacugugggauguguagcagcaucucugaccccuaccuaccagacacacacacacacacacacacacacacaaacacacacgcacgcacacucucucucucucucucugacaaccaaaacuguuucuagucauugccaaaugucaccccucauugauaacuacugcccuaacaucaucaguaucaaauucuggggacaguucaagaucauacauacuguaacuugcguaucuuaaaaauauauauauuggggcugggcgcgguggcucacgccuguaauccuagcacuuugggaggccaaggugggcagaucaccugaggucaagaguuccagaccagccuggccacguggugaaaccccaucuuuacugagaauacaaaaaauuagccgggcgugguggcgggcaccuauaaucccagcuacucaggaggcugaggcaggagaaucgcuugaacccgggaggcagagguugcagugagccaagauggcaccauugcacuccagccugggcaacaagagcaaaacuccaucucaaaaaauauauauauacacauauauuuuauauuauauauauaucauauauaauacaaaauauauauaauaugauauaucauauaauauauacauauauaauauauaucaucuauaauauaaaauacuuuuuuuuuuccagagaaaaguuuguccacugcaguuacuuuuuuuuuugagauggaguuucacucuugucgcccaggcuggagugcaauggcaugaucucagaugacugcaaccucugccuccugaguucaagugacucuccugucucagccuccuaguagcugggauuacaggcaugagccaccguguccaacccugcagaaguaauuucuagaaaucucagagaagaaagugacccagaugacccuaacuagaauagaaaaggaaauuauuucagggaaguaaauagugagcugacuuugauuaaccaagucagucccauagcuaggcuaaaucaaugcuuaaauagccuuuacccuuaaaugaucacaucuuccacuuaggguuucuuaaggaugccuuuuccuguagcaggcuaggaauucucucucugacuggugcacacucaauuaauucacucugcauuguagagaaggaugccaagacacgaaggacccaucugucagauggcugcugacaacguaucagcucuaggguggcaggagccccacuuuauauguguuccccaaaacaacagcagagccuuuaacugauaauguguacacaccagcaagcagugugugggccccaguugcugggucucccuagucucaggcccauagagaaccagccuacugcauggaggugaccuauaaacuuucagcaacugaucuuucaagacagacaguuagauugcaggagagaggggcaguggaaggaacggcucugaaugacuggacugagaaagagcauaagaucucucaggaauaauacauagcuaagccaauagaaguaacaauccaaggacauuuccuggucaagagucuugcgcuuggucucugauaaaguggacacccccuucuccauccuagggcagacucuguaaccauuauuucuuggaauaaucauaauaggacuaaauugugaucuuaauuuuaaacaguggucuaagccccuaauuugcaucugaccagccucucucaaguaaccauuauggaaggggacuuuauaacuucuuuguuauauuuugacauaacacauuuacauuuuugcccccauuuggucuuucuauagaguuuucagauuguaacaucugaauucaucucaucaaguuuucaaauugaaacaucugauuguaacaacugaaacagauucauuagggaucuaauuuuuucaaacaaaggagauuuuuuucuuuuuuuuuuuucccuagggaguuucaaauuuaugaccucugacuucauugcaaaggccagaaaaauaaauaaauagauagacaaugaccacucuccacuccagacaugcagguguauuucaacacuuuagcuuuuacuaucaggauuucuuuaggggaagguguagaaauauauugguaguuugauaaauuauauaucagacauguaaaauuuaaaguaucauuugaaaucaaaacuugucugaagacuagcuuuuuaugucacaaguucagcuaagcaaaguguccccuaacuauaaaaccuccuuacugcagaauccuagaaauuaccaaaggcaagcuucuugaauguugauuuugaaauuuugccugcgaaagugcaacaucuuuccaagcaaaugcuuagaagacucagggcagaacccaaaaacaaaugccagacguuaggggaaaauuuuuaaaaguuggauugccagaaaacuucuagcuauuuauaauuaagcauuuuuagcugcuaaaaggaagcacauuagaucauuuuguuuugcaaaacaaauggccaguguggguuuuaggauggacacucccaggagggcuccccuuucugagugggagucuuuggaaauguuccugaugggauccagucauucuggagcgcucuuacgaaaucguucauccuagggcaguuugguguuugugagcuuacagcguuuacuccuugcugucuucuaccauaggucugaucugaugggggaggcagugggcagaggagcuccagcucuuugggaggguccuagaauaguacaaacagcacuggguuagaaguuggggguucucauuccugggaccuugguugauuauagaacuuuauucuaggauuccaugaauuugccaagcugacaucgggaaaaggcuaaaguuugauucuugaaaguauugacaaggccccauuuaggaaugauucugccaaguauuccugggguccugccauggucaggagagcaccuuaaauuugaugaguugucagggaagaagcagaggguaucucuguguucagcuuuauguaugagaaagucaagacacaagaugggggcaggacagggacagcuugagaaaggaggcuugagauugagacuuggaacucaggugccagggaugaauccaaaaggcuugcaggcaucucagccucagacuuaagcuaacauauagcagauaguggacaccucuccuguuucuuucuuucuuuuuuuuuuuuuuuugagauggagucuugcucugucacccaggcuggagugaaguggcaugaucuuggcucacugcaaccuccaccucccagguucaagcaauucuccugccucagcuuccugaguagcugguacuacaggcgcacgccaccacacauagcuaauuauguauuuuuaguagugaugggguucuccauguuggucaggcuggucucaaacucccgaucucaggugaucccccugccucagccucccaaagugcugggauuacaggcgugagccaccgugcccugccaauauuugucuuuuuaguagagaugggguuucaccauguuagccaggcuggucuccaacuccugacuucagaugauccgcccaccuuggccucccaaagugcugggauuacaggcgugaaccaccgcagccagcuuuuuuuuuuuuucuggcccugcaaucuugauuccccagaguuagggucugauuucagauguuaaggcaggcucaaaguggggcaucugcucgccacaagaaggugagaggucagaaagaagaagcaagaccauuagggcugccuuaguugaagaaagggggcucaucucucauuuucucagaaguuucacaauccagaaaggggagaacggaaagcagccuccuaaggaguucucgaauuucuuucucacuuuuccuuuguuuucucgcucucucacucucuucuaagauuuauuuuuaaaugggguucuuauuuuggggggacuuucugagcaggaacuaccuuuuuuuuggagggaaauaaaugagaacacaaauuauucagggcugggaaguggaaacaaugaaagaaagcaaggcuacucagaaccggcuggcagauggcgcucggcuuuuacgauugacagccuggcuuucaaaaauucacccuugcgccggcgccuaaggcagaacccgcaucccccucccuaaauccuccuucccaaggacacggccccugccccuaaggcugaggaauguuuuuaaaagguuucaguugagcaauugacaucuaaggacaaaucccggcaacuuuuaacgaguggaucugaagaucuuagccaaggcaggaaagcacacgaucagguaaccuccagauucaccgcccuggugccccgguucuccugggaacugguccugagaucuuggacaaaucccugguucuaguuuuucucaauugaaaaaacaggagggaugucuuucucacuuuaaaacuuauuuaauuaucuuauaaaguuucaauagaugagguaugccaacccccuauccaacacaaauuuuuuuaaaugucuguuccaaaauggcagauuguauaggaaaucaaaugguagggcccucuguuguccuuugguaaauaauuaauaguuucugggucccaaucaccgggagaaucuuugugggagcagaguuuggugguaaacucuuucacaccucaaucaagggcuagaaaagagguucauaggugagcagagcuccaguuuccaccagggaaaucuaaggggccuaccuggagaaguuagcauuuaagacaauauggagagaugaaguagaauuugaggugcauggucaaugauuguuuacagagaagggacuugcuagggauacaucauugcuuuuccauucaugcaaguaucauuguguuuuucaggaucucugagaccucagggcuaguuuuaaguucuuccccuccucaaccccucuccacuucucagugcuucacggcacacuggggcauucucacuagcgaagguguccucucuaaggaugggaccccuacuguccaucucaggcucagcacugccuuggggcaggccacuucuggcuucuuuaggccucguuuccacgggaggggaagcuggguccgauggugucugggucaaauuccuugguuccaagaacagguaccguugccauucccuuccauuucugcccccugcaccaccccacccagcagcuggaaaaugaugaggucaucuauuugagaagggccacacaggccucccacacaaggaccuacaaaguccuccaaugggaauuuauuucuuucugaucaaauuuacccuccauaccccauucauauacacauucuuucuccccucucucuuaagauuguaaaguuaaagaaacugaauacacaggguugauuuaagguaaacgucccucccacccaucuauuuaaaaaauuuucuuuuacuugauaacuuuccuacaacaugauucucuuaugcccauauuccucugaggauucuuuaaagcuuuucuugcacuuucuccuccucacagucccugacuucuagcccugagugguggcugagggcaggugacccuguagaccguggggaacagaggaggccagggcagguggcugccucuuuccaaccuuuccugggccaugggagcuccuccccaccagaggucagcagagagcucagaauggcugggucugcucucagaaauugggaucuuggaauucucuagaugaaauguaggaugcccaaauggaaaaaaagccccauguuuccaggguguuuugguuggggcucucauccugucuugggucccggggaccuuacuuuuaacaccaauacagccauucugugcuuuucucaggggaggggugguuggggguuuggucuguuuauuugguggcuuucuuggucagucuucucccugcgccagacgcacaaaucccucccuuagagggaaccacacccucuuagaacucucccuucuggggcccaacugcccacuuucgcuucccacaugacauggaacccacaucccacacuuggccgggcgccuuuucuucuaguuguauuuauuguuaaaaugacaucauaauauuacaggaaauccccccagccuacccucacccugcugugauuuuacugaucauuaucucccccuguucuuuacucagguguaugcauaguuuugagagggcaugaaucauggugugcaguuucauauuaaucccccugcuccacaaacacacacuacaggacaguuuccuuagagcucuuccauguucgccaucguccuuccacaguucuuucacuuguucaguccuuucgcuagcggggaagagcagggaaagaauugagguucccucccuuuguuuuuccuucucugaucuuuugaaaucccgggguccuugugaacgacucagaaauuaaaaccaauucccuuuggccaguuguuuauuguugaaagagagagacaaagagaaauuaaggugcaaacggaaggaaagaaguaaauagagauuaaauuuaaaaauuugaaagggagcagugguucacgccuguaaucccagcacuuugggaggccgaggugggcagaucaccugaggucaggaguucaagaccagccugacuaacauggagaaacaucaucucuacuaaaaauacaaaauuagcugggcaugguggcgcaugccuguaauucuagcuacucgggaggcugagacaggagaaucgcuugaacccgggaggcaggguuugcagugagccgagauugugccauugcacuccauccugggcaacaagaaugauacuccgucgaaaaaaaaaaaaaaaacaaacaacaaaaaaaaaaccaaaaaaauuaaaagggagagagaggaggaaaaaagagggaaaggaaagagagaaggaaggaagaaggaagggagggaggagggagggggagaaaagaaaagaaaggaaaagaaaaaagagaagaaaagaaaaaagaaaagagugccuuugccaaguuuagcucuaagcaccaaaugggguccuugcccucuaggaacuucuaguccagaacagaggagaggaucagguugcaagugauuauccuucuaccaggcaggggguggagcgcugccaaggaggguguggcuggcacagcugaggggccaggcuggcuagaccggacaggaguacggggaggagaggcagguucacaauccaggcuggggcauccucuccuccccaucucacugccccaugaggucccuuguucguucaagugccaaccagaagagcugggacagaggccucucuugugugccaagacgggggccaccaccacccucugagcucugaccacugcccucucaccucuuauugcuuucccaaguguuuaccuccugauucuaaaacgaugguccaauuuuuguuuuauuuuaaaguuaggaacacacugcauguagcacacuucauggagcacaaguguuuucacaugccuuaucccacuaagugguuuuguuuuguuuuagaaagucuggcacacagagaaccuucuaguucuuuaaaaaaaaaaaucauaaauuuuuaaauuugauaauuauccagaacaaaacaaagcaaacccuaagguuaaaagugagcauccuauaaguuaaguauagaucuuugauguuggggaaaccuuugaauuuuacaaaucgauguccuugagaauuggguuccagccagacccacuguaggcauuguuuucuuuuuuucuuuuuccuuccuuccucccuuccuuccuuucuuccucccauucccccuccccacuuugaaaaacaaguuuuauucucuuggguuauguucauuagagagggaagacaauucuguucagcaaggaaaggugaggggaagagaaaaggggggaauucagccagaggagaacagggacaagguugauugcucugugcuggggugaggguggggggcagagagagaacaucacagccagaugcaaaucacaagagcagaccuucagcuuccuggcauugguggggaaaauauuccgucagcugccuuucuauguccugggcuucauucaucagcucaagagaaaaaaaauaaaaucaaaauuucauccuaauuuguugugguuggaccccauucucccacauuuuggccuucuuguaaagcacaaccacaaaggcagaaguggcuuccugggcugaccugccucucaguucauucucaaggcguuagccucaucccaucaggaggaguucagacucuccccaagcaccaagaguuagaaauguguugcuaauugauuugagcuaaauuuguguugcuuugagacuuagcaaaauggcugauuaggggccaguguuggggaaaauaauugcugaucuaauagcuaugaaaaggaacucauucacaaauauguuuauaaaaugggccuucugugacauuuuggaauugucagggaguuaggggucacggugguucuucaggaagaaagaaauguuguugggaaauguuuaguggaaauuuagcauaaaaugacaugccuaauuuaagaaaacaguuaaauccaucaugguuccaagugaaaacaguugucacaaauuaauuuuucaaauguuugacuauuggcaggucugagguuuacucaucuguagguuauguccaacuuggcaaaagcauggaauccugcccaguccuugguacacagggacuagcacauguacccauuuuuucucacugauaaguuauuuccuaauuuuuugguuaacuugaaggucgaaauagccuuacuccuuuuugucugucuaguagcaucucuaagcuugcaguagcugcucacgugucugccacgccccuuagaaggacgaauccuugccuggucggugaguuugccucaauucgggcauuuucauuuguucauucauucgauauacauguauugagugccaaauaugugcccuuccccguggggaagacaaaaguaugagacacugcuacucccuugauggaaucaaaacaaacccaggaaguuaacaagagugggcagucucugcuaagcgauuacacagggaauaaauaaggaaagauggaaagauugucaaccaaaagacuucaacaaccugcuaagagucuuccagcccaguugagcacaccaaaucagagguuaccuaaaagugucaugagugcugauaauuaaacugcagaaaaccuagaaggaucugcuggggucaaaacaagcaacauuugacaggcacagccauucagauuuucaugccacucugaggcugaaaauuucugcacaaacagcagugacugaaccuuugcuagucacaggauagaccucccuguugauaggguagaccucccuguugauaacuugucagucaugggacugaaugaggccuuucuccaggaggcacagcccagaggguuacuggccaugcugaggaggcagucuugcuuccaggaggggcugcagaggccuggcccaagaguggugcugagaacugccuuuugccaacuucuuucuuucauugugcacucucuggagccaaacuaugccuuccaggaucuuucaagacuaaaauucucuuaggaagaugggcccaauauuucccaccuaaccuuagaaaucuucuaugucuaggauuaguguuuugagaguuagaugggaaaguguaguuugcagccagauccuuauguacuacagagugcuuucaccuuagugcuuucauccuccaucuuagcuccaacccuccaucuuagcucuugggcuggcccccgucuuagcucuagccuuacaucuuagcuccuggccugcccuccaucuuagcuucuggccugccuucuaucuuagcuccuggccugcccuccaucuuagcuccuggccugccuucuaucuuugcuccuggccugcccucuaucuuugcugcuggccugccuuccaucuuaguuccuggccugcccucuaucuuaguuccaguccuccaucuuagauccugagcuuugggucucuuuuguuuuguucccuaaugcagauagagauagucuauauucaaauacuauaauuaauuuccagccauuguggaaugaaaaacacauuuuaauuuccagaauuuaauuuccaacuuuccuuucacaaauacuuuuaaauuaucuauuuauuacccuugaaauaauaugucuuauggauaggucucuguaacuaucacagcauaugauagugaccuuuauguuuuuuugaaaauaucuguguaauacagauugcuagcuauuuuuuauguuaaaaauaagacaagggaagguugucuggaugacugaacugaaagaacucucaggugaacuuugcuccauagugaauaugauugagauuuauagaauuauuaaguuguggcuucuuaaaaauugccaccgaaacaagaaugccugaauuuuguguucugggugaucguggaugagcacauggcacaucugaaaagugauuuggccccaggccuccuuaccucccugcagguggcuguguucucuucaguuaaucccauuagcuggcaaaggcugaugaggcuacucguaagggacaugugcauuuucauaaagagcuuuagaggcccaaaagcccagagagucacauuuuuaauagugggguuccuaagaguagcauucuaacaagaggcauuggggggaacaggggagagcauuugggcagucacccccuccccacuucuaguuccagccccauacccuguuuucccaacccaagucuauggcugccuagcagcccucuaagcaaugaguugacuuucuuccacugugaccccaggacacguggaccccucacaccagaucuccaaguagcagcauagugcuuaguguuauucugccuggcagcggggugccccccccaccccauucaguggcagucagguucagaucguagccuucagggugccugacucauuccggcuccggucgauaaugacaagccccauguuuuucuccagcguccacggcuaugacacauacaacagucaggaaauaaaagaggcuugaguacuauacgguugcuuuacuuucuuuaaaaaagaaauauaaugugaagggcaugggggaaggagcaaggaggcaggaguccaggccagcaaauaagccagcagcaaaacaaccuuguuguuuguauguuacauaaacagcccccccaacuguccugcgguuauauccuuaggaaaaacuggggcuuaguggcgcuuggguugauuucacaccuuagcuuagaguuacucagagguguauuaacagcuaaugauuccauugagggcggcccagauugccaucuugacuugccagauauuagcaauacucuuauagaaacccaaaagccugccaauuaaguuccccaguguaaguuaaaaggggccuuucugagaugcgugaucuuuaggaaaaggaaauuaaacuaauuuugaaagcuccuaacacucgaguuuccuuauaauguaaguaggugacagcugggaugaauauuaugagucccucccauaauguguauuugaauagaugucauggauucuaauggcagaguucaaagucacucagaggggcggguuuuuauuuuuuuaaugucacccaccugaaauuauuuucagaaaguucuguaauggcuaacaggauuagaaugacauugucacaaaaugauaugagguguuaaaaagaccccuacaugaugcgguguccacaacgcacaagaaguacccccccacccaagcaugacucaguaacacucagugaggagaagagcaucgaauuauauaaguuacaguuuuauuucagacacacaagcacguaggccagcagugauaguaaacaugcaggcaugcuuucccucugagcaugagaggcguuuggauuuuacccucccagaugcagaaccucuguacuucuaaacagcuuccuccugacccuuagcuaagucaacggggaaaaucagccuccaaguuuugcuaaauuguguaccaugacagugacuuguauuuaggagaccuugcguggaucuaaagcccagaaguagccaccaccaccguuccuccugaugaaaauggccucaccagcaccucgcugcaaacagacaccagcucaaaacauugauuuucuccccacccucgcaggguuaggauucugcuuagaacucugcuuuaagcuaaaauuuccaucaccaaagggccugauuucaggcagagaaaggaccacuuuagcaaaugagagaagcgaagaggaguggaggaggagggucauuucaacagcagcaaaacucagccaugccauuuucccugacagcacuuuaauuaugaugaaagaacaagauuuuuuuuuuccgguuuuuacagaggaggcucgugguggggggaaaggagggggcucugaaagagaugugagcugccaagguacagagugcaaagcggcugucacugccaaaugacagaugcaguuggagagggggagagaagcccuucccugagccugugcaccaguggccuauucugugggggcccaggacuagucagccaggggcaaauggugaauaggauggcccaaaggagccaccugcuacaugcuagcuucccccuuuccuuccgugagauuuuaaccccagggcugguucuccuaguugugcucugcuccaccagcuuugaaagccuuggagggguuucaaguggucacauaccuuauuguugaaaaggauguuuuucuuuaaagucaggugcuaagucaggugugagguugaaauggacacuuaagggcuucagagcaggauaaagggacagagcccaggaagcccaggacugaugcucugaugggcagaagccagccguguuuuaggaauggggaaagaguuggagcaccagauguuaagaggcuacagucagcucaagcaagaacgagagaacggcgcugucacugacuucccaccucccggccuugccgguaaucccugcucugauuggaggcaugggguccacaggaggcaccuauuguguugccacaaugcccaaaaguggccugagaauucugggcugcuaguguuuagaaagagauauaagugaacccuagacucucacagcuggaaaaagccuuucuuccugggaaugggaaguaacaaaaugaguccagguuagcuguggaguccuuagagaugaagggagcagagagggcggaaaaaaaacaaaaacaaagaaggugcauuauuuuguguuuccuuucaccucccuccuugguuuuagggcccuuuccuggcaugcaacaggaagugcaggcuguguugagagccucuggugcagacuuacgcagagcacaagagaugaugugagccugcuugucugggcugcuuuuguguaacugaauuacacaguaucuauguuagaagugaugucacccaagagagccccauggccuugaacuaaacaccaaggggcaucgggccccggccccaggaggccugcuaugcagcaacuuuucugaacaauuugugauuuucuguucuuauuccccucacuaaauugucaugcugcuagagacacuucuaauuugaugguuauuaaugggcagcugguaaugaaacagcaaggacuuagggcuuugcaguaggugaauuacggacauuuacaaguaaaacaacuuuacuucuuacauuuagcaagagguuuaacaagcaaagugcaacaucugcagaaucuuaugggaggaggcaguggucuugaaauugugaggcaguacugcagggauagagaucgccuuucccuagaacaacugcaaucuccccaucagagccaacuggaaauacaaauuugcuccuaucuccaugcguggugauucugccugcuacagagauggaggaacagugaucuggcugauuuuaaugggcccauuuagggaaaaacacuuaaaaaauaugugaaaaugcauuuucccccuauuccuucuggaaagcaacauuaggguccggcaguucugucuggaaggagggagaugcaggagcagcauccuggcuuaugaccgcguggcugcuuagugguuuuauuuuagaaagaguuuuaaugcagaggcagcggugguggugggggugcgggugggggggggagggagacaaaucagauguagagguuugcagagccuggaggccaaaggaagcccacuucaggagaccacauuuucagcaucagaauaaguaaaguauuugaggauuuuugucuccucuuaaaaauaggcacuuuggaaaaggaaaauaugcaggcuuuugagaaacacagugaggugaucaguuaaugugaggugguggugauuguaacgucggaagaauuggucucauuuuucaugucacaauuaauauuguuugagauuagauagcuucuuaauuuagaccauuuacauuuuacagagcacuaaaaagcaagccuccaagccacuuucuggcagcacaaagccaaauaaaugggaacaauauaaccuuaaaaagauccauucuuucacuuguagcuuugcucuggucaauaucgagucauuuagcacaaucuaaaaaacucacauuuuucacugcuagaaauauguaauucuuccuacuauucauugccugcagauguccuguucuggggaccuuuuugacuuggguuuuugucuucuugacaccaaagcauacaaucaauuuggucaaaaguucaaucgugaaaaagcaucuggauguuuugucuauaaacaaccaguuugccugaauauuugagaggaucagcucagccaaccaccuguccugauguuaccccaacacagcccaaaugcacucagaggggugcggaaggaaggguacacacaaacaaggugugggggucucgcuuucucugcugcagccaucugaaaucggcugcagaggaggggggaaaugaagcagcaggcuaguccuucuaggcagacguggagagagaaccguguggaaagauaucuuuauggcuagacucucagcaacaucacugucagaaucuggugccugcagccaucuuagaauuuagaggaagcugaaggcaccugcccacauuuugucuuagguuacaaccagcucaauccagccagcaaaaaauaagguugagaagcauuucgcuuuuacagaaaaagaaaaaauuuccaugauucuguuccuugaaaaaaaagcugacccuccccaacccaaaccuuuuauuucaaagucaccaaaacugagacuagauaaucucucucucucucuuuuuccucgugugcauagccaguuuagacucucuuggcuggaauuuuuccugaucucucagugcaguaaaaagccaggcagaugggggaagaagggaacauggagaggcagaagaaggggcaauggcuccuuggcacaucucccuuuguaguucagucuuacacaguccauuuuuauuugcaaauagcucagcccaaaagaggguauugauaugacccccagaugcuguuccgaauccaucuuacuuauuuucccucgggggugcaggcagggcagagcccagauaugaucagaccuucaaagcgcagccuugauccuuuauuuuucauguuacagucacagaccuugaaaauguguuuucagcaguuuaccacauaccgagaauuucaggaaacaaaaggucaagaauugaugacuuagauuuauuaguggccccauuaagcagaccucagaauucuaaugaugggucuuugcuagacaaaucaaugucauguuucuaaaaggacaagcgugacagcugggugauuucacagaauuaucagguauugggaggaagguuaagcagggguucaauuacuaucaauuacaaugauguucuuguuuguuucccugggguuuucaugcugcuaguuguguauuuuuucccuugcauuugcauauuugcuguuuugcuuuacauguuuuagaaauuauccaucuauuuuuuuuuuuccucucaaaaucucuucuaccuuuggcaucaauuguagaaacuaaaugucugcuguagaguucuauccuuuagucauaguuuuuuguucuguuuuguuuuguuuuuaaacaaaguucucuucucugccuccccacccaauaaacugaguggauguauaguuaugccaaguuguggaaaacacauuuaacacauuuaagaacgugccagguaugaaauauaaaguauguuauaccuaagauuaaaauauuaauucgauuuggggauuaugccagucaacauuuugguuuuacaugcauucauucaacuaacuuaugguaucuuguugaaaugaugcauuuaaaauaauuacugauuuaauuaaaagaaaacuaaggaacuuuucaggcugagaaugacauuaaauuauccuguucuugagcgccucccagaggcguggguuaaauaacaccagaauaugaauugagggucauuucggcuuuucuagacuuugggaugccuccaaugguuaugaguaaaaggaguggugcuuuaacuuagagauuagaugucucugggucccaauuaaguuuuauauccauuuccuuuguaugguugagcuauuuggcaccaucuuggcagaagacagggauccagggccuuugcuaccaguggaagggauugaggaaagcuuccucugugauaagucuuggcuuggcaaaacauagccuagccuucuuccuucccucuccagaccagggcaccacguggagauagcgccguuugcuugggcuggccuuggacauuucagaguuccccucuuacuacaugcugacaucaucccgcaacuccccaugugccuucccucacuguugccaagugcucuugaaagucaaccaccuuccugggugacugcugcuuucucaccucagguuaaacccauggacccagugaaaguucucccaggggcucccauacccggggguaaucauaccuuccauaugugaagggcuaguuuuccagaguuuuuauuucuugguguuaggucacugcaacccugggauaaaaauagauguaauuagcauguugcagaucagacucugcacuuguagcuuugugccacuuucucuaauaauaccaauuuuggugacacauuuccuagaauccuggacuugcuucaaucccuaaaauccuccaagagcugaauuguaggacaaaccuguuugcuuuagaaccuagaagggcuuugucccaguuagauugucucuuuucccuaccuuucuagacauugcagguccaucuccauuuucuuuuuuguuuguuuguguuuguuuuguuuuguuuugagacggagucuggguuugucgcccaggcuggagugcaguggcgcgaucucggcucacugcaagcuccgccucccggguucacgccauucucccgccucagccucccgaguagcugggacuacaggcgcccgccacugcgcccggcuaauuuuuuuguauuuuuaguagagacgggguuucaccauggucucgaucuccugaccucgugauccgccugccucggccucccaaagugcuggcgugagccaccgcgcccggccucauuuuuuuguuuuuauuaucagggagcaacggcuccauucuccccuaaggcugacauuuuuguugaaggcugagcacgcaugucuuccgugcuuguggcaaaaggcccuuuccuggcuggcuccagaauccucaccaguuaauugggaaaaaauuugaguuaggcaucacaauuucagccgagcugggcaaacaacgaguacaccugucacucgagccaguguccaaaacucagccccauggaucacagcuguagcguuauuucagcaugagcaauucaguauuuaauguuccuuagaaaaaaaguaaaucauuccaagcugcuacuguucaccuauuaacucuuucaggauuucaugguggugggguggagguggggaguaaucuauaauuugcuuggcuagcagagauaauacccccuucccaagucugucuuucuuacauaauggccauuucuuacauaauggagaagaggggcugcaaaacaauauccucuugaucuguggcagccacugccuuccagaaugagaaguuagauuuucuucuuucguuucauuuauauuuuuaccugcgcaguacagguacugcuuccuacgaucagcagcuuccauuucuucccucuuuccacgguagcuuaaauuagcccaucaucaucagcaaaucuuaauuuacaauuaagugcugggaaaaaaaaaaguucgucauuaaucagaccuucucauuuuauguaaauggcccccaaaagcaacacacauuuuuaaucuguccugccgauagcugagcccuucugucauuuggguccuaauaaaugaauuggccaucugcaauuaaucugcauaguacaaaucauuggaaggccgagucugucugccuucugaaagaaacuggcuauauuuaguuuuuuaagcaagucugcuuuguguucuuuguaaagucagcgacauucuuucaauuuuuucgguguaauuagcacaaaaggagccguaaucugagaagguaguagagacuaaggcaaccgaaaaacaggaauguucaagaaagcaggcagaggcagccuucccaguauugggcggcgugacagagacccugggacguggcuguggguagagcugaggucuguagcucauaaaaaaucuccuuuucaucugauccccagacugguugcaaacgcuugccgcuugggcugaauaauuuuccccuucucauaacuuccaguggucagcaaggaccuuagaaagacacagugccaucugggcucugcuguugagugggcuccugacaggccagugagaguucugugcacacugccaagcccucaauaaacugcugagugggagagcagagggcauagcccugagcuccccagcaaaugcugaauuucaaccaacuggaggcuacauggaaaucaagcagaggaaggcugcaguggccuugggaaggagaguuagagccuguacgaaaagagggggcagcccuccucauugggagcugugcagacugugccccgaugguuaguuccccccucaaaauaaaagccagggaaauagguggagcuaagcgguaauuacacauuuuucaauuucaacuaaaacgugugggcaaacacaaaacgaugaaaagguaucuacauuucuagaugaauuaaaugugugacuaauuaugucacguuaauugcuuaauuccugguuuaccaacagcagauggaagugggacuggagaggggguuuuagcucugaaggcgaaugacaccugaggcccagucuaaaucucaguuuucccaaacugaggcuagaccauaacggcagggcuguuugaaaaugaucaccuacauuugguuggcagguagauaaaaucugaagauguaaaacuucuauuuagcagucguuucauuuguauauguccacaaagcagcauuuaacuaaacaaaaugaauugccugauuaauccaguguuuuuaacugucuaaacuccaauucuauggagcuaaauuugaagaagugaauaccaugaaaaaaacccuaaaaucuuuaaaauaagaacaauuauaaagggcuucuuuuaucuaaggaaauuuuauuagaaccucaggccuccugacugggcucaauaucacaucuccaggugcaccaacugccucuuauuuuuuccuguugucacuuguuuaguaagauguuggaucaaagugucauuuaaauaaggcaucuuguaaauaagcaggaaaguaaacugguccaugucuauuuuuaacuagucucccuacauuauucuccauccuggaugaguuuccaucuucaaggccaaguuaaaaguucuaagcaacagguuuucccauuaccuuaguccucaugaaaauuuuuccccaagggaagugaaggauauuucaguuuaggaaaauuagcuuuccugccguagagcggcaaaacucuuaaauauuuuuuucuacucaauuaagagcuccauuaaguggguccauugaucuguuauugauguugauguaccucaaagaaaauggagcuuccucagucuucuccuggauuugacuuucaguuuuggaguuacuuguggaagcugccgccuguguucugcugaugggucugccuuuugguccugcuaguggguuuguuuucugcucccuguugauauccaaguuguguguccaccuagaaucuucaaugaaggguaacaugugcaucauaucauuuaggcuucuaaaaggaacaaaguaauacaugucaucucuuuuuguuagcuucccccuucuugagguagauggugguuuuguuaaaaguccauuccugcccacgcuggggcucauggggauguggugagaaaggcacugauggccuggggaauugggcgucuguccacagagaccaggaagccucucucacagauggugccuccccaucagagagucaggaaagaucaagaagggcugcaaaacguccucuuugcccucauauuaugugccaugcuuuuaaguagauguuugaacagcaucucaaagccacuggcucaagaaauuggguccaaauacacuggccaauguacguccacauucuguuugaauuagaguauguucugaauuaaaaacagaucauuuuaaaaugaguugauggauaauaaauaggaaaaugucauauggccauguaguuaauucuucaguaauugacuucaagucuucugaaaugaaguuuuauaucauguuuaguuuugaauacaaguuuaggguuacuuuaugguuggaguuacuaacuagugaauaugacaagaaaaaaaaauguccuagauaaucacuacauucgauuucuaagaacuuuuauggucuaaaguaauagagccuucuuacaaggauuaacugagacuaggaaaugcuuuuuacaauuccugcuuucaucaucugcaugacauaggcuuugauauucauuugcaauagcaguuucagucauucuagcuaauuaaagugcagaacgugcuuugaagacaggaaacacuguggaagugcuaaauacuauuauuaaaaccuuacagcuaaaguuucuguuucaguggaaaccuauuuauuguuuccuaggcuauuaaaauaauauuauaauuacauuugcucugggcucuuggaagacaacuuaaaaugaccccaacuaaugaaaggccaaggauaacauucuuguccaaaaacugagugacagcauuaagcagaacaguauuuucaagauucuaagcuguagcaaguccacugcuucaaaagguagacaaggcauucuuacucagaaaggaggauacccaggggccaaggaacacaaacugccuuuaucaccacgaagcugacaagaccacagaauucaaacccugaugugggacguuguucauuguugucaaauauggaauguuggaaagaaauguuucgaggccauaucuccauguagugugugacaccaucuguuuaaacaaguuuuuucguuaggugaccuaguguuuuagguuagggauguguuaugaucucaacuggcuggcuugggcaugaagcaagucuccugagccagagaucugugcuuuccuugggcauuuuauacccaagauauucugcccuuugucccucccugaaaucuccauaacucccuucucuuccugagccagacgaggggccccuuccauuggaaagcucucucaucuggacuguuccaagaguuaugccaauagauugccccacuuucaaagcauaaacuagguacuuaaaacaguaaugaucaauuaaauuacuaacucauaugaaaaggucacacaugguagccuccaaaacuaaaagacuugaaaaaaaaaaaucacaacuuuuagggccucaagaggucaaauuugaggccaaaagcucaguaaaaucucuucuuucacuuuguguggagugaaaacagacagccuagcugaccacaaaccagcuuguguuucagcacucugggugucauuugcuuaccuguaaacccaugauuccaccugcugucauuuauuuacaaagugaaugcuuuauuuauccaucaguaguuagucauaauaaaauauaggugaaaccuacacuuaaaaaauuuuuguuuugaagaguggccucauagauugagagcugaaaggaguaaagccugaucuugcguuacccauuucuaggacaauagucccaauugugccuugccuaggacgcauguuaguauaugacauggggcaguuucacuccuuuuaaaguucaggugugauguuuaucuaaaaggggaaggugguaauggagcucagagauuuccaaauaaggaggcucuucauuauauucauuguauaacuuuguagcuccuggcauaaguaucuagguuguauuuguuacuauuuaccuuguaccucuuaaagacaauguaucugugcuuugccacaguagaagcaggaaggaagaugcuuuugaacaaauggagcauaacaaaaaugucuggccuauucuucccucuuacaagucuuuaacaauuuuuaaaaaugacaaucaaucaaauucagccaggaauuuuuaauuuaccaucuaaagauauagaaccugugcugugucaucaagcgguucuaauuuaggugguggaugguagugagccucacuaucacuaguacaggcagccuaggaaucaucgauucugaggccuuacugcugaguucuccuaugagcacauucagguguaucugcacaauauuuuuaugcaucuuugguuaggugaaaagcaucaaccuaggauaguuccuuugagcauuuucaaaauaagguguauuuuuguguggaagagaggccauccaugaucaggagugugacaaaaaccuggccccaacuuuucagccaaguucaagaaagucaggggucugcagcagcccagggcaggacggugucuaggcugcgcuuccuguucuuaauuccaaguguuguuuggugacuuugaaucgcccucuguugucuuuucagauucauaaaaaagaggccuuguacaaugggggcagcaguguaccugaaggggccaagaaaaauaauauguggcaucuucaucugucacaccuuuucuuacucgaaguggagcaaacuggggaaaaggggggaauuucagucauccgguugaauggcuaacagugucuuuuuauuuucaaagcuaacuuaaaaugauacaaguuugcucaaggccucuggugguaucagccgccccauaccccuggggacuguuaaauguguuuccauuuauagguagacuuuucuuuuuucuccuucuccaucaaacaucuuaaguuucaugggcucuguuaagaagucaaagaaaaaguuggaagacaguuuguggacuuugcauaucugggcuuuccgggacguaggccugugucccauccaagacacugcucacgucuuagccugauuaccuggccgccucggcucaccugggcacauggugagccgcggaacuggcaggcaccaaacauuuauugaaugaauaaaccguaucccagcagacaccaugguggcagcagaugaccuaaccaaggucccaggaaaggcgggcuggggucaacugcuugaaaauuuaguaacccugcuccuaaucccgugcacugcuauauccuagugugcggcgggacacuugagaguuuugaaagaacccucaaacaaguucacguuccguaaacuacuuuucccucuguuccagagcccccagggcgcccaggcaaggccgccaccucucccaccugggaggacgccucgagcaccgacuccacagccacggccaccgcuccucggcucccgugacaccggcgcgccugcugcuucgagcaggggaggcuuugcacucccaucgcacuuuucucguccgaagauacgaaacuccguccgggcgucgcaaauaauucgaauucggcucucugacaccuaccucggcgggcgcgcgccgcugggagggcgggguggguggcuggagguaaggaggcgcacagcagggguaagcgccgccgucgcacacuuugcacgccgcccagggcuacaccacucaccgaaaauugggaggcaggucugggaggcgggguugagcgcccaccgccuugggcgcgcccgcgccccccgccaucgcggcccccgcgcccccggcccacgcccgcgcggucccggcaccggccugcacccccagggugcgcggcggcccauuugggugcguccccggugggccgauuuuucgcgcuuccccuucgguuuauaggggccgcugcuaugggucgguccucugaagaggcuggggcgucaucggggccgguuagaagcucugcuccccggcggggacacucagucgcgucggcaccgcggagcgggcugcgucagguggcuggccggcgcggcgcuccccugcucucuggcuccgggcugcggcgcggcggcuggagcgagccccugucccggcgcggggcggcggcgggcggccggcaggcgcugccuugcgugugagugcaccucacucacauguaagucggggagcgccggggccucccgcggaagugcgagucgcccggcgcaggcaagagccgccggguccgggacaaggcaggggcgcccgggcgccgcugccuugccccggggcgccuccgggcaccccccaauucucucucuuuucucuucuccauuggcgugcccaagagccaaaccaaggagcgccugaggguaaacagacuccugccauccgcgccuuugcacuuuucuuuuugaguugacauuucuuggugcuuuuugguuucucgcuguuguugggugcuuuuugguuuguucuugucccuuuuucguuugcucauccuuuuuggcgcuaacucuuaggcagccagcccagcagcccgaagcccgggcagccgcgcuccgcggccccggggcagcgcggcgggaaccgcagccaagccccccgacacggggcgcacgggggccgggcagcccgaggccgggggcaagcagggagcccgggccaggcgcgagccgagcuccccgagguggccgggccaccaugcugaagauggccaugaagcucaaagcccgggcggcggagagcgagaagaagacggccgcggcggcugccgagguggcugccgaagcugcggcggcggcugcggcguuggccgagccgagagagccgcucgcgccgcggaagagcggggaccccgagaagcucgcgaagaaccccaagaacccggcgcgggaggcgcuccccgaaaaguuccuaacagacaaggagcgcaagaagcucgagaagaagcugcuggagcagaggcgaaaggaggagaagaagaaggagaaggagaggaagaagauggagaagaugcugaagaagaagaagaagaaggugccagaagcccaggaggaggcccgaugccccgaggccgccgccgccgcggccgccgccgacgacgacgagggcgccgaggagggcgccgucgggggcgccgaggagggcgccgccgccgggggcacgaguagggccugggcugacugggacacggacucgagcgacgaggacgacgccuacuacgcggcgccgcgcguugggggcaucguguggcggcccgggccgcucaaggcuggcgcgcugagcgcccaccugccccucgugguguuccuggucuucucggugcgcagccccucgugggugcucaacuuccugcugcagaagcgcacggagcagggccgcggcugcggcuucguguucggggcgaccugcugcuuccgaguguuccugggcugcgccuucuucuccuacuugggcggccgcgccaagcgcagaggccgcgggcgcuccggggccagaggcgccuucggcucgggccauggcgcccggcgccgggggcgcgaggagcggcucaucuagucagaccccccaccccgccaccgccaccagacaccaccaucgcuguguaguguggguuuuuauucguguucguguguguguguggacacauuuuccuuuucgguugcucuguccuuugguucgugcucgccucgcuuuuuccacacuccugcucucuggcucucugugucucucgcucuuucgaaaauuuuccuaaguccgggcgcgcgcucccuccccuuccgcccaccccagccccucggcggcgcccgcgggagggggaggaggccucgggggcgccgggcgacgcgguccgggggguggagcguuggcgucgugcgaggggucgucacuggcgcggagacgcccccucuccccccucggcucagccgggcugcugcccgagcccgggggguggggggcgucuccccggcccgucccguccccggccgggcgcgggcggagggacccccuccccgggcucccggggggccgccucccuccgccggcucccgcccucccagccgccgccgccgccgcggccgcuccucggcccuccuccuccuccuccuccuuccaccccccucgccgccgccgccuccuccuccccccgccuccccccgcccgccgcggcgcuuuuggcucggggcggcggcgggggcccggccgaggcaauaagagcggcggcggcggcagcggcggcagcagcucccgcagcuccugcucugguccgccucggcccggcggcggccaucagcccccucggccucggcucgaggggcggggagcugcgcgcgccccucgguccgaccgacacccuccccuucccgcccguccgcgcgccccgcggcccgcggcccgcaguccgccccgcgcgcuccuugccgaggagccgagcccgcgcccggcccgcccgcccggcgcugccccggcccucccggcccgcgugaggccgcccgcgcccgccgccgccgcagcccggccgcgccccgccgccgccgccgccgccaugggcugccucgggaacaguaagaccgaggaccagcgcaacgaggagaaggcgcagcgugaggccaacaaaaagaucgagaagcagcugcagaaggacaagcaggucuaccgggccacgcaccgccugcugcugcuggguaagggcgggcggggggcgccggccccggcccgggggcccucgaagggcgccccgcaggccgcgcgcgccgagcccgccccccgccccgggcgcgcgcucccgagccccccgcccguucgcgggcucugucuguggggggcgaggccggaagggggacccaggggcgcggauucggccgggcgggggcucaaaaacggggcggggggccguggcgacgcgggcgcgggucccccucccccggccugcccgcucagugucucucucuugcucucgcucucgcucucccccucuuucucucuuucucucuuuuuccgcgaggccuacacgacgccagggguuugggugcguguuggggagggggagggggagcccauggggcuccggagacugcgacaaaaagaggguuucggggacaggaaaccggguggcggguagagggagggggacccgccuccguggggugugagauuuguugggagagggaaagaggggaagaaaggggcgaggagaggagggggugacgcuggggggcgccgugguggcggagggggccucgccaaagggaggcuuuggcggggagaaguggccgaggagagugggggggcuggugacaucagccccucggaaaggaucggagcgguaaagguggugcagugggggggagggggcgcaagggagucguggcgccggagucgggaggggggcggcgaggggaggagggagggcgguugccgcugggcgcgacuuggugcguuucgggcaggaccgacugacugugugugcgcggagcagacgugucccgggccaggccgggccguggaaggaggagaaggagagucaaauaaaauaagaccaccccccaacaccaaaaaauggauagaguuaguacgagaagugcccagugaagccaaaugacacgucauuuuacagugugaccuuuuuuuccccuuccagacuugcaggcuuuuucaaaagcagagcggagaauuaauuguagcagcugccccccccacccaccacgagcagcgcccccccaacacuauuuuaauaaaccauuaaaaaaaacacauuuuccugcuggcuggccacauugagagugcuuugugaaaagaaaaaacaaagacauucacaaaucagauaaaacuggagaaugacauuugucuguaaauggcuucuuggucuggaaauggcgugguuucuuuuuuuuuuuuuuuuuuuuuuuguccuccucaaggugggaggggggauugagagugcucuaaggagacuuuuccuccaggugggaagagauaaaaagacauuaauuaguuguuuaucaagugacauuuaguuguuugguuuuggguuuucuuuuuuugauugcgauuuuuccucugauuaaaaaaauaauaauaaaauaaaaaaagguuaacuauaaggagauggccuuuccuccuuuuuuuucuuaaggugcuguuuugggggaaaaaaauguaaugaaaugaccaaaagaauuacacagcauuaauuaaaaauggaaguuuuccacuuccuugauaauuuggcuaucugaauaaauuugugaauuugcuagguuaagaccuaguucguggucacauuucaacaaaacagcuugaguauaaagaaaauaauaaaaggcuguucuuauuuauuuuccuuugguggcuuuugguuugcucuuuuugcauaggucaugacuuuguucuccuggguccagauuuauaaaagcagaaaauuacuaauuaagucaaaauaagugucuuugguguuuaugcauuugcaauuucaguaauuaaaugguacauguguugcugucuugucuaaaacuuuuaaaggcagaauuaugcuguugggauauuaguaugcguauaacuugauuucaaaguauaaaucuggaaaagucuagaaucuuuucugugaaugcuaucucaguacuacuuuaagucaagugugaugcuaaugauaucuuaaaauuuccaacaccuuuugugcagugaucacaaagucuccacuuaauuugagacuguuacucagaacacgccuugcgucacgggggcuaaucuaaguguccuagucuauaugacuacauuacaucaugauguauugauugccucuggccuaggaaucugcagcuuaagccagugacacaauauuuugcauuuuuaaauggugauucucaccaaauaaugccuccccacaaaagaggaaaccuaauaaugccccaaauccucuuuuuacuccaucuuaaugacauaaaaauuaagugaauuagagaacuacaaugaucuuaaaauaauuuuucagccacauuucauaaauguggaaacugaggcacggaucuguuuuugccuaugaaagauagguccuguaacuguuacacaguuuaacacuucugaaauuagaauauuagagauccugcuaaauauuacguauuguuuccuuggccucucuuaauagugccauuuauauuuuuaauuuaccagaguuaggcucauuaagauaguguuugcuuugaaaucaauguuucuguggaaacuaauuuuaacuuuuacagauauugauuacgggcuugugaaaaggcaaguaaaggaggaaugcugugcuaucugggcauuaaaacaaaacaauacaauuaaaaguuaaaaagaaagaaaaagguaauaacagauuuguguggaaggagggcaaaaaaacuucacacguggauuaucuguuggagaaugugcauugcaaaaaagaugcaaaauagcaauccucccucuagcuugauggaaauguguuuuuuccaugaaacauauauguauuuuuacaaaugaaagaugauuuaaaauggaggcauguguuucuacucuuugaguugggaagggcuuggaaucuuucaaauucaguacuucccagggauaguuuuccuuuugauuaaaguuuuguucuuauguuacuuuuuacuguuguuuuugcaguuuaccuaaugcuaauagggucucaggaacuguauuugauguuaaagugugguuuuuccagaagaugacagauaauugauggucuccccuuuuccucagcaacauaguuguacccagagggaauuuaucuuuagaaagauauaguuugugaggaaagaggaggauggauaaguggauaaaauguaaugcaguuuuagggguggauuuuuaaguagcccaagggguaggaaaccugcacagaaagaagcugcguugugaaaauguugaggaggaaagugcugcaucgcuacgugauguggaagagacugcagugucugggcauuguugggaaucccggguauuuuaaccaugaaacaucugacaacaaauuaugugucuagauauguuuaugugugaauguucauguaucagggauucaguuucacaguuuuaacuucaauuuucuuguuuaccccacaaaugacaaaauugcgucauuccuucucuuugccccuuuccaacaccaccccacaauuuuuuaaacaaucaaaagaaaaauuaaaaccagcaaaccuuaaauucuuguuuguuauuuggauggugaaauacugcagguagacacugaauuggacauugauuuccuuuucucugcgucgaaaugucaaggaaaguugcaagucugugauuuuguguuugguuuuuugcauguugcuucuauggaaaaacaaaacaacaacagcagaccucccugcccaaaguguuaaaaugccuccuucauaaccugagacuuacuuucauuuucuaggugcuggagaaucugguaaaagcaccauugugaagcagaugaggauccugcauguuaauggguuuaauggagaguaagugucaaaucugugcaggggggcaccaaguaagaggaacagacuuuauacuaaccuuuaggaaguauaggugggcuuugggggcugggcagccaguuuucacuuaauuuuuccugauuuacauauuagaaaauccugggaagggcucuuuagggucccucaccccccacccccuuggaucuuuggugcaacaaauacuacugaugaaagcaccaguguuugugacaaacaucucccuaucccaagaaaaucgugccugguugcaggggacgcuugacagcacuuggccccgugacagccccucuccgggccaggucccugccacagucuucggacaucacugcagugucuucaacguggcuuuggccgcccccucguccggcccacgcugaucacugcaaauucaccccaccccaccucacgcagauuucaauguaaugaaccaacacaggauguuuuaaacuauuagggaaacauuguuuccauaauauucucaccagaaacagauguggaaguggcagcccguguuuacaguuucucauuuuuuuugucccccuuuaaauuaccauuauggguaaaucauuguuucccuuuaaaacaaaaaacaaaucaguaccccugccuacagaaaagaagagggaacauuuauuuaaaggauggaaagacugggaguuaggcacucccagccucacugaggggcauuuuugccuuugagaaguccucccagguauccugguauagcacaauguggcaauccguagugggaaugaagauuaaacaggagagacuuuguauuagaccugugagacgaguuaggaagcccugccuggcauggggaaugcaaacagggaacauucaauaaaucggggaacuugcuuuucuccccaagaccccagauggggccuacccaucguucucguguaacaaaacguguaaaaaaaaaaaaagaaaaagaaaaaacaaaacaaaaaaacuaaguugaccagucuguuuucacugguaugagagcauuaaccgcacuagauuucaagcaccugaaggcacuaguuuguaauuacuagcugguuggcacaguccuguucccuuucuuaaacuuggauucgauugaaaauuuaaccuugaguugcuucagcuuccauuucaaaaggggaguuggagucaaggugguagcguuuaauuauaccaaccaccccccaaaaaaacaaacaaaacaaacaaaaaaaccuuuacuagucacuaagcauccaggaaacaaaggugaacuuuuucaccuuucagagcaaggcaggcagcuccuuauagagaauucuagaauuuguuagaucaaauaauuguuuagagaaggaugacaucacccauacgaauaguccuguuaguugaggaugcuuuuucuacuuuaacccugaauucagaaggauugguugggaugcacagggggcuucuucacucaucugauuaugacucucaauggguuaucaacaugcacauacgugcuauugaguaagucagcaucacuugucaccaaccaauuccgaaauuaauucuugacacaccccucgauaaagcccugccagcggagacugccauccugacaauaaauaaauaacccugagacagacuuccaaccaugaaucugucauuugaagaaaaaucuugcauaaauuuucccccugcaacuugcaggaguacuuacuuauucaugagaguaguuaagcaaaaauaauuugaccauguauccucuagauaaauauuuugaugaaaacuggacauggcuagcauuuuucaaagaugcagcagccacuguuuaccuuagcuugagucggauggaagcuaagucaccuuugaaauaaauuacugacagcuucauuacagauugcccuaaaauuuaaaaauuuuuauagaaaggauucuccucccuaagcgagccagccuguaacaccaggcaaggguuuuaaaccagaacuucucuuuucuguuuucuuuuuggaaagaggaagcaacauucccaguuugccuucuuugcagacaagggcacagauacguuaaauuuagccugugagaggguuuacagggguauuccucaugggagccuagauaccuuauuuuuaucucauccaacugccuccuuuuuucuuuuuccucacugcgguauugcaacaaaagcuauuuccuucuuaacuaggaauucccuaugagacagugacaucugucccuaaaggguggucugggugguacaggguucuuccucccugaucuugcguuuuguuagggcucggcugagcuauuaaauuugccuuaacucucugcgggcugccaugcugauuacauuuuuaagaguaagauaauacugauuugaccuucagaaauacagagguuggaugcggauuuucuaacucaaaacuaacucuguuucuuacauuuagugccaggaacaaaacaaaaacaaaacauaaacaccauuaacauugguugaacuaagcuaaucaauuaccaaacuguagaaugcugcccuucggccuucaaggaggaauuccuacuguuuaugaagaucggguuuggguuuuugguuuuuuuuuucuuuuucuuuuuuccguggugguggugggugggcuuuuguucuuuuuguuuuuucuguggugguggugggugggcuuuuguucuuugaaauuuuuuuugcuacaucacaguccagacauaguuuaaugacaauuuauggggaacaauuauuuauaaauaaaaccauuuuauagguaguuuccuuccacugcaagaagugaggucauuaguuuugcaggaaauccugggcagaaaucucccccguuuaugccuuuaugccuuaaguuacaaccuugggaagauucugaccugggagaauuaggagccuuaugcgcugccauauucuccaaagaauugugagauaaaucacugcuuuagcucccuaaugcguguacguuuagugaaagcacaagaaaacaauuauccaucccuccugucuccgaccagagucuccagagagcucuguuaauacugcagcaaaggugugggauucuucccccauggccugcagucucaguggauguuccaauuuagccagaaaggcgaccuaagaauugccgggaggauggauggcuggcgcgcgaauuguugcuuuugcucuuggcugaugguugaggaauguagagagacugugugggguuugugugacacugcggugccuugcagauuaggugagcuuucaaucucucuuuaaaaggggcggcgaagaggacccgcaggcugcaaggagcaacagcgauggguaggcacauucaaaaccagaaaaaauuguuaacaaaccaaacaaacaugaagaucauacugggaaacugaggccagagacccgggaagaaaauaaaaaucauuuaaaggaccaucagccauauuggcauacauuugugaauaacacacaauuuccugacauuuuggagcaaguaaagugcguaacauaaauuuuuuuggccaugcuuaaaguagaaugagauccagcugggggaaaguuauagauuucagccuuggaugaucaguuuaggauuuugagaauugauguuuuuccauaugguuucuguuuucccccagcucuccauuugaaccagcugcuuguuuuaaaacuaucuacuaaauuccaucuacccacugguuggucugauuuuaaaauuucagaccucuuugaaacaaaauuuguuuccuuuauuaaaauaugcaaugcugcaccgucuuuaauuuugaaaaacgccuugguaccuugcagcaggucguuaagaaucaucucgaaaagccucuggccuuuuaaaaaugaucaaauuuauuugaaucaaaggcacuuuacguuagcuugguggauaaggaaauucaugauggcaucuuuuauuuuuccauucauuaucaaauuauuuuuucuuugcuuccugcauccccacacccaucacacacacacacacgcacacacaugcacaugcauacacagacacgcacacacaucacacgcacacacagccacacgcgccgcgcacacacacacgcaugccagguaaccacucuagcucugcuguguauuuagcaugcagugguggaguggcuauuucucaugagaccauccagaaccauugacuuaguuuagggcaucucaaagaaacagcuucuguggccggggaggggaggggcaaagauauuggggucuggggacaaaguaacugacacauguuuguucaucuguuucuuuuagaauauaauaucccuagaugauggcuacaguuucucaucuucccggcuauguccuaucacaauuugcaugcuggaauugcucggucuuaggaacuucuaauaagaauacuauucuguuaucugaggggggaggggggauggggccccugcuaccugaccuuaaacgaugauugaaaaaacgaaaaaugaacugaaauccuuaauuggcagaaauguaguaugacaacuauccaaaaaggcaucucuauaagaaaugacuaauugacaaucugcuguaccaaaaguuggcauuugagcaagauaugacaaguccuuagugagcaaccuacuguguacuagauguccugcuaaacccuugaacccuacuaauaccuuggccugcacgucucucucacucuguucugcaagucaauauaaguauuaacauucgugauaaauaaaaauucucugcauguuucagcaaucccuguaucucgcgucugucuucugucuuccuuccuuugucugucuuuucccaccaaagcacaaggauuaagguggagaccugaauagcuucccccaccacuuaguuagcugaagcggggggaggggaggagcucuuaaaaacugaacgcaucccaucugcuguauacauagaagggggaggaggaggaaccaagacccuaaaaguacuuccagccuuagucccaauuuuguagcgaaucagaauucuagcuaauggcauauguuuugccuuuguugaguaguuuaaagacaucuaaggaauuuucucugaauuucacaaucaacguuaaauucauuaagcaauaguaaaagugaugauaaacccgccaacccccaguauaauaucuccaucuacauaguaauugcuucaauggaagaauuuuauguuuuaguauuacacacccgaauuagauuuuagauuucuauuuuagcuguuuuauacuugauauacucccacaccuauucacauacguagaugaauacugaacacguucucaaaauauccguauuuuaagacgggaaguuuuccaauuaucauacuacugcuuagaccaaaauaucaaacugaaugaaagaaacuuguuucuggaaauacuuucucuugcuguaugcagauuuggauauuuaguacccgaauguauuuaauuuuacuauuguggaaccucaaaaccaaagguuaauagcuuucauuaccugugaaguggagccugcuuuuaaugaaugggaauagauuugcccuaggggguuuuggguaaauucugaauucaaaagugaacauuggggaccaucaaacacauguccuuuuaauuuauaacaucuaaauaaucgauguuagacuguaauaccaaggccggggauucuuaauuucagaaaugagcuuugauucugcacauacaaagcagacagucgcacagagcggucaggacucacucccuuucacucuaaggugguugcuuuaagagucugggggccagaaucagauuucagauuuguacacaaggccugaagcucgcucaccucccugucaucuguguuucugagauucuccggaccugcagcacuuuuacuuaaauggcccugaggggauuccuggcaacaucuguccccccuccccaccccagacaccccccaccacuaaugagcguggccccucugaacuuccccagcucuucacccaauguagaagagcaguggugcagugaccugugaaaggggcuucacguaggaagggggcgagaugggauccuucagcaggugaaggcccagaaguacacagacauuuauucagaaagaauaaauuuguaaguauaauucuuugagaaaggaaagaccaaaugauuuguggaaggccugucgacaggcccgcacuugaccccaccguccguccccgccccccaccccugcugcuccacugacugcccugcccugcucgucugcucgucugcucuugcuaauuaaccucccuucgccuuuccucugccuuaacugucguguucuagucuggagagauuauauguuuuaauuucuacuccagucuaugaauuggugaaucagccaagugaaugcuucaaaaacugggacucucaaaagauuaaaaaauauauauauacaaaccgugaaaaagauaaacucuguccccuccaucucccauugguuucugccucggugacucccccccucuuggccucaguuucccugucagagaggcaggaccguagcaccuuuuuuccgcaugacaacgcccucaccucccagggccuaacagguacagcaggugugcugugugugcugguuccauuuuugggcuauagaccugaugagauacauacuccacacaagaggccuuuucuugcccucuaaaaacauaaacucgagaaccuucccuggcugugcuucuaaugaaggcuaguuucugaaaaacauacagcauuuggaucaguguaaugugguacaaaaauuaacauucuguuaugguccccagaagccaaaggguguguccuuuaccugugggaccagugacccugaauauagaucauuccauaaagaccacgcaggccaucccauguggcugaguuaaacucaaggaaaagcuacaaaaccuucaaccucuacuuaccagagggaucugaccuccccucccccuuagauuauaaggccuucuaggggguggaaucuuauuugauuccuauugcacauggaccaacaugcacuaacaucaugaacuagaaguuucauugcugcuagcugcagugccuggagcaucgcacauacgacuuuuuuuuuuuuuuuuuuuuuuuuuuuugacagagucucacucucgcccuggcuggagugcaguggugccaucucagcuuacugcaaccuccgccucccggguucaagcaauucuccugccucagccucccuaguagcugggauuacaggugcaugccaccaugcccagcuaguuuuuuuguguguuuuuaguagagacgggguuucaccauguuggccagacuggucuccaacuccugaccucaggcagucugcccgccucagccucccaaagugcugggauuacaggugugagccaccgcacccgggcuccuguaaugaacuauuauaaacaccaccaccugugcucacugguucucucaguaugcuagcaacugaguuaauuccaagucaaaccaugggacuguuuuguuccaccccaaccucauagugaccuaucacuccagccucaccccuacccagauguugauaggaccaggagaagccuuuaggaaguguuaguauguagugugggggcuucaaacccaugaaagauuaaaugagcugcaugcaacuucugguacagucaugauugcuaaggcaauuugcuaaucugccccgauugggcguguccucagggcacauuugggagguuauaauuugcaacuauguuuauucagcuaccuccaaucuuugcacagauccgaacccacaacucccugaagaacagaauacuaugcuuuuuagucgggaugucuuuaugaaagcaguacuccuaacugacauggugcaauaugauuuucuuuucuuuucaaucccacugcagugagaaggcaaccaaagugcaggacaucaaaaacaaccugaaagaggcgauugaaguacgugcuggcuccuugugcugucugucuuguagcgcccucccagccagugcuguucccugaccgcuuugcuaaaucauuuucagaccauuguggccgccaugagcaaccuggugccccccguggagcuggccaaccccgagaaccaguucagaguggacuacauccugagugugaugaacgugccugacuuugacuucccucccguaagcuacaccccgacuuguguggccuuagccccgcccaccugagcacaguguccauauaggaacaugagugacagcccugcacaugggcaggagcauccaaaccacacuucaggcaaaacuacauuucagugauguccauccuuaggaaaaaguuaauuucauguguaaccuuaauuuaauaauaauaaucauuagggcuuuguucaagauggaugagcaaaauucugucaccccuucuacaucuuagcucaccuguccucacaaauaaacaucacucuugaauacuacaaucucacuuuauuagauuguaaauuuuuaugaggaaaaagguccugagcuauggcaggcuuaauuauucccucauucacaucuuaggacaaaacuguauguuaaauauggcacacaaauacuaauuguccauuuacuccacuggaagugcccuaagguaccuugggaugccucagugaagugccaaauggaagacauucucauuuuaaacaggugaccuuuuuauuaagaguuuucuaaaguccuuggggcaaaugaaaucuuuucucauuauuaaaaaaaaugaaauauaucuaaaucauaacucaaaaaucauaaaauagaacauauggaaaagacuuuccucuggaugcacgacacuguuggcucccuaaagaacuacuuuuagggaacaaaaaacuguucaagcccaagcauauaaguuuaggccccuucguggggagaauggcuuauaagcggggaacgggaaacgagauggaaagauguaugcguuuguaagacccacagggaagagacuugucuacagcuaaaacaaugaguuauuguugccuuuugucaggcuuucgugggaauuuguguuuguauauuuuagauggacuuggcugcaaacuuaaauuggagaaauuuagugguauauaguuaguauggauagcuaaacuuuuuaaauagcauuauuuugaaaaaaaagcaauaaacacaauauguauaauauaacccacugacuuucuugaaauaugauucuauauuuaauaggaaaaggaaacagcagccuauuaaaaauguaucagaacaauaacuuuuuauuaguccuacuaacaucugaacuuuuauguuccuaccuacaagucccccaucaucauuuuuuuugguaagauucacauuuucccaggaggaaaauuuagucccagcacaucuuacaaaugaaguuucuuauuuucacaacauugaaccauuuauuggcauauucuaacacauuuaguguauauucuuccuaaacaauucugugaagaaacuaaauuacucaguagcuuaccccauucccccuacacacgagaaaagaaacuacccaaaaccaguaauucacaauaagacccagcagcuaauugcgugaacuuuugaauauguuuaacguguugaauuaaaguucuuugugagcauuaauucauuaauugggcucaaaauucaaaaucacaccaagugucggucacauagggaacucuggucucaggguuugaaugacaguguuguugauuaguucaagcucuugccuuucucuaaacuuucuuguguucacuuucaggaauucuaugagcaugccaaggcucugugggaggaugaaggagugcgugccugcuacgaacgcuccaacgaguaccagcugauugacugugcccaguaguaaguaaccgccacccaacccaucagcacauaaaacagacaaaaacaagaaaacaugaaaaccugugauccugcuuugaaaguuacuuguugaugauuccuuucuuagaagccaaccaguuaccccacuggcagaaaguucuaaucugauucaauuguuuauuuauaaaguccuuaauugcauuuuuuuucuuuuagugcagcgacauuauuuuacauaaacauuuaaagccuguuagagcaaaaugaugaugaguuucauaguauuccuaauuaguaggaaguaauuaauugaauugacccuaagcauuuagggaaauagggcugugcucacauuuugaauaauguaaaaauacuauauuuuauugcuguaauuuuaaaacauaacaaagaggaauggugaagacauagcuacgccuccucucuccuugguaguuguugauugaucuauuucugcucucagguaagcgacucuaguagcugccuaguguuacuagauccuagugacucuagguagaguuuguuuuuguguugucuugacuuuugaacucuauuucauauccuuauuuauuccuucucaccgggucuugauucaaggaugguaaguggucaauggauuuuaaauccuaaacuguacaccuaagcaguacaauaccguggugggguuauuuucaaauaaaacaaauuacuaccugcgaggaggacagguuaaggccugcaguagcaaugggaaaagcaucuuucuccaaagucacucauaaaggugggcucaccugguugguguguuggcaaaugaagaagggggaacuuaaaacacagacuuuauugcacaacucuaccugaugcccaggcugcuucccuugcugccuaacaccugacuuaccauugccucagggaucgcccucugucccugucacccaccauggucucucccagaggacaucguacccgauagcuagaaaguugccuuugaaauaguuuauggcuucccucaucuugcacaugauauagcaagcaugugguggucaggguuauuuaaaaaauauguaaacauuauuauuauuuuuuugaaacggagucucacucugucacccaggcuggagugcaguggugcgaccuuggcucacugcaaccucugccuccuggguucaagugauucuccugccucagccucccgaguagcugggacuacaggugccugccgccacaaccagcuaauuuuuguauuuuuaguagagaugggguuucaccauauuggccaggcuggucucgaacuccugaccuugugauccaccugccucggccucccaaagugcugggauuacaggcaugagccaccgugcccagccaaaaauguaaagauaucuucuguuuguugaugcugcagaaaugcacaaagcagucucaguuaaugauauucugaaguaggaguguccugugacuuggggcaggggagucuaguagagguuugauguuuuagccauccuuauuacaaguagcugaaacucggaacugauuuugcuauaggaaguauuagcuaaucagaaccaaggugccaggcugacucaccaagggcuaagauugcuuuacuuaguagccucaagcccaaggaacugauugugaaaaccaccugaauaaacaggagggaggaagagguaauacuguucaucuauaaaucauauaagccucuguuagggucugcgcaaucuaucaaccccagcccugccuucccauaggaaauuccuuuauuuucaauugccacauacauagauauuccacgguuuaauauacaagcaaauguguauauuuuuucaaggaacagaaaaaaacaguccaucuuggcuggucccuauggcccccagcccccacuccuucuucaacaaagucccugauuuucucaaaaguucgaaccaaaagcuggaagcgcuaauuauaguaacgcaaaacaaauggaaauccuggaauuguuugcauuuuguauuuuggauccaagucagaaguuaaguacagguacaagauuaagagaguuuaaccaccccaguuuugaaugcugggggggcagggagacccaguuucguuaauuaacaguagcuuagccagauuguugaauuuugucggguuucguuuucucucucaaaucauuuagaaguuuuugggguuuuuuuaagcaacacuuaauuacuccugaaacuuugucugaaaacgcaccauuuguauagaucaugaaaaguuuuaaggaaacucagagaaaaagagaacaacgcagcuuaaaacuuuuaaaauguccucccucacccguggcucaaacagcccugcaucugccguggccggcacguuucugguugaacugccuuuauguuaaaguucagauacugguagugugcccauuucuuaagcugucuauuuuuauuuguugagcugggguuuggcuggcuccacuccagaugucucucucacaagauuuggugcugaugaucuauuuauagaacugugguucuguugccaugguaacaugcuggaggccagggcggcuggggagcuauuucuggacuggugcuguaauguaagauugauugggcaaguuaguauauccucuaagccagacuaacucugaacuaguaaaaaggaagaggggaacagaaaacuuaggcaguuucuuuaaauaaacuuuucucucuuuaugauuuucuuuucucguuagcccgcuuuaaaacaauuccaaucucuacaugccccucccuccaaaaaauaacugguuuuaacauuaauuuuccauauuaauuaccccaaucuuucaaaaguaaauuuuccugugugucuagucaagcaacacaaacaagaugcuuuuuuuaaugaaaagcguaauaucuggaguguucuauuucauggaccaaacagaacggaagagaacuuuguguuuguuuccuguucaggauggcuagggcgagaagggccccuuugugccaaccucuuuuguucucuuuaaucaaugagauucuuaaaaaguaaaaaggaagggauacagauucucaguaacuaaaacaaucucgugugcccuugaggggaaaguccuugauguuuuuaagaaugucacuuuauuguuuuuuaacugaaugauauagagguauacaauuuucaaacuguuugccauuuuaaucaagcaauuugaaaauuaaaauguuuuugucaggcauuaccaaauggcacagaaugugauaggccagccugguuuugggguccuuucucuacugguugauaugcauaaaaccuucuaaaaaucaagaauauugccagagagcaacaggaauaaagaagcuaaguaaagaauaaaaaagaaaaauagaaaaaauaaaaauaaacacgaagaacaaagccccaccaccgugcugugcuguuuguguggccccacugcgucgaggccacaggcuagcugcuagacgcaucuagaguucccugauuccuaaaauuauuuaucuuaaauccuguuugcccuaaccuucuuaaggcaucagcuuugaguuacaaauguaaccaacacacaagcaaaugugccauugacuuagugcugcauaacugugggacggucacuuccguugagccugaccuuguagagagacacaaauaguuggcaaauugaugugagcgcugugaacaccccacgugucuuucuuuuucucccagcuuccuggacaagaucgacgugaucaagcaggcugacuaugugccgagcgaucaggugugcaaaaccccuccccaccagaggacucugagcccucuuuccaaacuacuccagaccuuugcuuuagauuggcaauuauuacuguuucgguuggcuuuggugagauccauugaccucaauuuuguuucaggaccugcuucgcugccguguccugacuucuggaaucuuugagaccaaguuccagguggacaaagucaacuuccaguaagccaacuguuaccuuuuuauauaacagagaucaugguuucuugacauucaccccagucccucuggaauaaccagcuguccuccuccccaccagcauguuugacguggguggccagcgcgaugaacgccgcaaguggauccagugcuucaacgguaggaugcugugggcuuggcuguucguaaagaacgcuuugcuucuguguuguuagggaucagggucgcugcucacgcucuuggcuuugcucucuuugguuaagaugugacugccaucaucuucgugguggccagcagcagcuacaacauggucauccgggaggacaaccagaccaaccgccugcaggaggcucugaaccucuucaagagcaucuggaacaacagguuuguggagugaccgcccacccccugcgcuugcccaggaggcccuggucugcacuguuuauagagaagaaccccgugcaagcauuccagaccccuggccgaaagcgcgcuucucccaagcauucacacggccucccuucuuguagauggcugcgcaccaucucugugauccuguuccucaacaagcaagaucugcucgcugagaaaguccuugcugggaaaucgaagauugaggacuacuuuccagaauuugcucgcuacacuacuccugaggaugguguguauggcuuccacucuugcuggcuguucauugcggugguucuuuuucaaacggucaggcugaaaacccccaucccccucccaccaccaaaccauaaaggaucuauaagagaagcaagaaaaacgcacucccacuaauucucauauggaaaaaucaggguuuugaagacuucaggagcuacagagaugcuagcaccccagcucugcuugaauuuuaaauuacauuaauauguauucccuuuuuauauagcuacucccgagcccggagaggacccacgcgugacccgggccaaguacuucauucgagaugaguuucuggugagucgagccugucuuuaguuuccucucuuguuccuccucuuuuucucauggauguaaauuuacuuaauuccaaauucagggguucagcuacccaguuccaugguuuuaguucacgcacauccaguguggauuugagcucuuugcgccccucuuuuugcuuuuguuuucauaugacaucagaggcuggcugacagccgucccugguagguguccccaucagggauagggugguuccuggcgagggugucacugacaaguccccuuguuugugcccgcagaggaucagcacugccaguggagaugggcgucacuacugcuacccucauuucaccugcgcuguggacacugagaacauccgccguguguucaacgacugccgugacaucauucagcgcaugcaccuucgucaguacgagcugcucuaagaagggaacccccaaauuuaauuaaagccuuaagcacaauuaauuaaaagugaaacguaauuguacaagcaguuaaucacccaccauagggcaugauuaacaaagcaaccuuucccuucccccgagugauuuugcgaaacccccuuuucccuucagcuugcuuagauguuccaaauuuagaaagcuuaaggcggccuacagaaaaaggaaaaaaggccacaaaaguucccucucacuuucaguaaaaauaaauaaaacagcagcagcaaacaaauaaaaugaaauaaaagaaacaaaugaaauaaauauuguguugugcagcauuaaaaaaaaucaaaauaaaaauuaaaugugagcaaagaaug

SEQ ID NO: 13554 - RNA, 6959 nt, Homo sapiens
uccagccacccaccccgcccucccagcggcgcgcgcccgccgagguaggugucagagagccgaauucgaauuauuugcgacgcccggacggaguuucguaucuucggacgagaaaagugcgaugggagugcaaagccuccccugcucgaagcagcaggcgcgccggugucacgggagccgaggagcgguggccguggcuguggagucggugcucgaggcguccucccaggugggagagguggcggccuugccugggcgcccugggggcucuggaacagagggaaaaguaguuuacggaacgugaacuuguuugaggguucuuucaaaacucucaagugucccgccgcacacuaggauauagcagugcacgggauuaggagcaggguuacuaaauuuucaagcaguugaccccagcccgccuuuccugggaccuugguuaggucaucugcugccaccauggugucugcugggauacgguuuauucauucaauaaauguuuggugccugccaguuccgcggcucaccaugugcccaggugagccgaggcggccagguaaucaggcuaagacgugagcagugucuuggaugggacacaggccuacgucccggaaagcccagauaugcaaaguccacaaacugucuuccaacuuuuucuuugacuucuuaacagagcccaugaaacuuaagauguuugauggagaaggagaaaaaagaaaagucuaccuauaaauggaaacacauuuaacaguccccagggguauggggcggcugauaccaccagaggccuugagcaaacuuguaucauuuuaaguuagcuuugaaaauaaaaagacacuguuagccauucaaccggaugacugaaauuccccccuuuuccccaguuugcuccacuucgaguaagaaaaggugugacagaugaagaugccacauauuauuuuucuuggccccuucagguacacugcugcccccauuguacaaggccucuuuuuuaugaaucugaaaagacaacagagggcgauucaaagucaccaaacaacacuuggaauuaagaacaggaagcgcagccuagacaccguccugcccugggcugcugcagaccccugacuuucuugaacuuggcugaaaaguuggggccagguuuuugucacacuccugaucauggauggccucucuuccacacaaaaauacaccuuauuuugaaaaugcucaaaggaacuauccuagguugaugcuuuucaccuaaccaaagaugcauaaaaauauugugcagauacaccugaaugugcucauaggagaacucagcaguaaggccucagaaucgaugauuccuaggcugccuguacuagugauagugaggcucacuaccauccaccaccuaaauuagaaccgcuugaugacacagcacagguucuauaucuuuagaugguaaauuaaaaauuccuggcugaauuugauugauugucauuuuuaaaaauuguuaaagacuuguaagagggaagaauaggccagacauuuuuguuaugcuccauuuguucaaaagcaucuuccuuccugcuucuacuguggcaaagcacagauacauugucuuuaagagguacaagguaaauaguaacaaauacaaccuagauacuuaugccaggagcuacaaaguuauacaaugaauauaaugaagagccuccuuauuuggaaaucucugagcuccauuaccaccuuccccuuuuagauaaacaucacaccugaacuuuaaaaggagugaaacugccccaugucauauacuaacaugcguccuaggcaaggcacaauugggacuauuguccuagaaauggguaacgcaagaucaggcuuuacuccuuucagcucucaaucuaugaggccacucuucaaaacaaaaauuuuuuaaguguagguuucaccuauauuuuauuaugacuaacuacugauggauaaauaaagcauucacuuuguaaauaaaugacagcagguggaaucauggguuuacagguaagcaaaugacacccagagugcugaaacacaagcugguuuguggucagcuaggcugucuguuuucacuccacacaaagugaaagaagagauuuuacugagcuuuuggccucaaauuugaccucuugaggcccuaaaaguugugauuuuuuuuuuucaagucuuuuaguuuuggaggcuaccaugugugaccuuuucauaugaguuaguaauuuaauugaucauuacuguuuuaaguaccuaguuuaugcuuugaaaguggggcaaucuauuggcauaacucuuggaacaguccagaugagagagcuuuccaauggaaggggccccucgucuggcucaggaagagaagggaguuauggagauuucagggagggacaaagggcagaauaucuuggguauaaaaugcccaaggaaagcacagaucucuggcucaggagacuugcuucaugcccaagccagccaguugagaucauaacacaucccuaaccuaaaacacuaggucaccuaacgaaaaaacuuguuuaaacagauggugucacacacuacauggagauauggccucgaaacauuucuuuccaacauuccauauuugacaacaaugaacaacgucccacaucaggguuugaauucuguggucuugucagcuucguggugauaaaggcaguuuguguuccuuggccccuggguauccuccuuucugaguaagaaugccuugucuaccuuuugaagcaguggacuugcuacagcuuagaaucuugaaaauacuguucugcuuaaugcugucacucaguuuuuggacaagaauguuauccuuggccuuucauuaguuggggucauuuuaaguugucuuccaagagcccagagcaaauguaauuauaauauuauuuuaauagccuaggaaacaauaaauagguuuccacugaaacagaaacuuuagcuguaagguuuuaauaauaguauuuagcacuuccacaguguuuccugucuucaaagcacguucugcacuuuaauuagcuagaaugacugaaacugcuauugcaaaugaauaucaaagccuaugucaugcagaugaugaaagcaggaauuguaaaaagcauuuccuagucucaguuaauccuuguaagaaggcucuauuacuuuagaccauaaaaguucuuagaaaucgaauguagugauuaucuaggacauuuuuuuuucuugucauauucacuaguuaguaacuccaaccauaaaguaacccuaaacuuguauucaaaacuaaacaugauauaaaacuucauuucagaagacuugaagucaauuacugaagaauuaacuacauggccauaugacauuuuccuauuuauuauccaucaacucauuuuaaaaugaucuguuuuuaauucagaacauacucuaauucaaacagaauguggacguacauuggccaguguauuuggacccaauuucuugagccaguggcuuugagaugcuguucaaacaucuacuuaaaagcauggcacauaauaugagggcaaagaggacguuuugcagcccuucuugaucuuuccugacucucugauggggaggcaccaucugugagagaggcuuccuggucucuguggacagacgcccaauuccccaggccaucagugccuuucucaccacauccccaugagccccagcgugggcaggaauggacuuuuaacaaaaccaccaucuaccucaagaagggggaagcuaacaaaaagagaugacauguauuacuuuguuccuuuuagaagccuaaaugauaugaugcacauguuacccuucauugaagauucuagguggacacacaacuuggauaucaacagggagcagaaaacaaacccacuagcaggaccaaaaggcagacccaucagcagaacacaggcggcagcuuccacaaguaacuccaaaacugaaagucaaauccaggagaagacugaggaagcuccauuuucuuugagguacaucaacaucaauaacagaucaauggacccacuuaauggagcucuuaauugaguagaaaaaaauauuuaagaguuuugccgcucuacggcaggaaagcuaauuuuccuaaacugaaauauccuucacuucccuuggggaaaaauuuucaugaggacuaagguaaugggaaaaccuguugcuuagaacuuuuaacuuggccuugaagauggaaacucauccaggauggagaauaauguagggagacuaguuaaaaauagacauggaccaguuuacuuuccugcuuauuuacaagaugccuuauuuaaaugacacuuugauccaacaucuuacuaaacaagugacaacaggaaaaaauaagaggcaguuggugcaccuggagaugugauauugagcccagucaggaggccugagguucuaauaaaauuuccuuagauaaaagaagcccuuuauaauuguucuuauuuuaaagauuuuaggguuuuuuucaugguauucacuucuucaaauuuagcuccauagaauuggaguuuagacaguuaaaaacacuggauuaaucaggcaauucauuuuguuuaguuaaaugcugcuuuguggacauauacaaaugaaacgacugcuaaauagaaguuuuacaucuucagauuuuaucuaccugccaaccaaauguaggugaucauuuucaaacagcccugccguuauggucuagccucaguuugggaaaacugagauuuagacugggccucaggugucauucgccuucagagcuaaaacccccucuccagucccacuuccaucugcuguugguaaaccaggaauuaagcaauuaacgugacauaauuagucacacauuuaauucaucuagaaauguagauaccuuuucaucguuuuguguuugcccacacguuuuaguugaaauugaaaaauguguaauuaccgcuuagcuccaccuauuucccuggcuuuuauuuugaggggggaacuaaccaucggggcacagucugcacagcucccaaugaggagggcugcccccucuuuucguacaggcucuaacucuccuucccaaggccacugcagccuuccucugcuugauuuccauguagccuccaguugguugaaauucagcauuugcuggggagcucagggcuaugcccucugcucucccacucagcaguuuauugagggcuuggcagugugcacagaacucucacuggccugucaggagcccacucaacagcagagcccagauggcacugugucuuucuaagguccuugcugaccacuggaaguuaugagaaggggaaaauuauucagcccaagcggcaagcguuugcaaccagucuggggaucagaugaaaaggagauuuuuuaugagcuacagaccucagcucuacccacagccacgucccagggucucugucacgccgcccaauacugggaaggcugccucugccugcuuucuugaacauuccuguuuuucgguugccuuagucucuacuaccuucucagauuacggcuccuuuugugcuaauuacaccgaaaaaauugaaagaaugucgcugacuuuacaaagaacacaaagcagacuugcuuaaaaaacuaaauauagccaguuucuuucagaaggcagacagacucggccuuccaaugauuuguacuaugcagauuaauugcagauggccaauucauuuauuaggacccaaaugacagaagggcucagcuaucggcaggacagauuaaaaauguguguugcuuuugggggccauuuacauaaaaugagaaggucugauuaaugacgaacuuuuuuuuuucccagcacuuaauuguaaauuaagauuugcugaugaugaugggcuaauuuaagcuaccguggaaagagggaagaaauggaagcugcugaucguaggaagcaguaccuguacugcgcagguaaaaauauaaaugaaacgaaagaagaaaaucuaacuucucauucuggaaggcaguggcugccacagaucaagaggauauuguuuugcagccccucuucuccauuauguaagaaauggccauuauguaagaaagacagacuugggaaggggguauuaucucugcuagccaagcaaauuauagauuacuccccaccuccaccccaccaccaugaaauccugaaagaguuaauaggugaacaguagcagcuuggaaugauuuacuuuuuuucuaaggaacauuaaauacugaauugcucaugcugaaauaacgcuacagcugugauccauggggcugaguuuuggacacuggcucgagugacagguguacucguuguuugcccagcucggcugaaauugugaugccuaacucaaauuuuuucccaauuaacuggugaggauucuggagccagccaggaaagggccuuuugccacaagcacggaagacaugcgugcucagccuucaacaaaaaugucagccuuaggggagaauggagccguugcucccugauaauaaaaacaaaaaaaugaggccgggcgcgguggcucacgccagcacuuugggaggccgaggcaggcggaucacgaggucaggagaucgagaccauggugaaaccccgucucuacuaaaaauacaaaaaaauuagccgggcgcaguggcgggcgccuguagucccagcuacucgggaggcugaggcgggagaauggcgugaacccgggaggcggagcuugcagugagccgagaucgcgccacugcacuccagccugggcgacaaacccagacuccgucucaaaacaaaacaaaacaaacacaaacaaacaaaaaagaaaauggagauggaccugcaaugucuagaaagguagggaaaagagacaaucuaacugggacaaagcccuucuagguucuaaagcaaacagguuuguccuacaauucagcucuuggaggauuuuagggauugaagcaaguccaggauucuaggaaaugugucaccaaaauugguauuauuagagaaaguggca

SEQ ID NO: 13555 - RNA, 1354 nt, Homo sapiens
ucucaaaauguuggaaagaauagauggcuguuaaacuccuccuaccucuccucuuagauuuuuuaaaaaauagugccagaauugaaagcggaccaauuaauguauguauaacuaauugugccuacggaauuggggauuauucagcucacuucuccuucaaccaacagguugguuaauccauuuauuguuaaauggauuaacaacccguaaugaaaccauuacauucagccuauaagucacaaugauuuaaaaguaauugggucagccgggcgcaguggcucaggcccguaaucccagcacuuugggaggccgaggcggguggaucacgaggucaggagaucgagaccauccuggcuaacacggugaaaccccgucucuacuaaaaauacaaaaaaauuagccgggcaugguggcaggcgccuguagucccagcuacucaggaggcugaggcaggagaauagugugaaccugggagguggagcuugcagugagccgagaucaugccacugcacuccagccugggugacagagcgaaacucugucucaaaaaaaaaaaaaaaaaaaaaaguaguugggucuauaggucuugccuccugagauauuguggaucuguuguuuuuuccaaagccuugucuagauuguccagauuagcuugcauugcuuaaauacuccuaaagucauuuaaguucuaaagucauuuuccuguuuaagaagaauucugggccgggugcgguggcucauaccuauaaucccagcacuuugggaggccaacacaggcagaucacuugaggucaggaguuugagaccagccuggccaacauggugaaaccccgucucuucuaaaaauacaaaaauuagccaggugugguggcgggugccuguagucccagcuacuugggaggcugaggcaggagaaucgcuugaacuugggaggcagagguugcagugaagugagaucacaccacuguacuccagccugggugacagagcaagacucuguccccugacccccaccaaaaaaaaagaagaaaaagaagaauucugguggagaauuuuuaugaaaauuagaaguugguuucacuuaauccauugaggaaauacuuacugagugccuacuaggugucaggugcugggauauagcugaaucagagacacaauucaucuggugcuaauggcaaaaaaggagaaaagagaagcuaucucuaacaauuuuuuuuaaaaaaugcagcgaccucagaaagaggucaagaaguccuuuccagggaaauuauguuuaagcugagacuugugacuucaaucuggaggacaaagagaauaggguacaguggagaaaauaagaaaugacaguaaagaa

SEQ ID NO: 13556 - RNA, 14549 nt, Homo sapiens
cagggcgagagaggcuggcugaggaucgugaccagcaccuauaaggaugggaagggcgccagauacaaccuugccaucgaggagcacuguacauuuggggaccccaucguuuaaggccaugucacuagaagcgcaguuuaagaaaaggcauggugacccaugaccagaggggauccuaugguuaugugugccaggcuggcuggcaggaacugggguggcuaucaauauuggauggcgaggacagcguggcacuggcugcgaguguuccugagaguugaaagugggaugacuuaugacacuugcacagcauggcucugccucacaaugaugcagucagccaccuggugaagaagugaccugcgacacaggaaacgaugggaccucagucuucuucagcagaggacuugauauuuuguauuuggcaacugugggcaauaauauggcauuuaagaggugaaagaguucagacuuaucaccauucuuaugucacuuuagaaucaagggugggggagggagggagggaguuggcaguuucaaaucgcccaagugaugaauaaaguaucuggcucugcacgagacugaggcugcccgugccuuauucgcacacaaaaacaaugucacaucaggacuuaauccaacccagcagaaaggcuuuuuaaaaauuuacuuauuacuuguucuuagcaaauuaagacaauuacaauaaaacaucagcuaacuggguucuugugagaaaacugaggucagcuuggaaaggaguuccccgaguggaguucccagcggcccgcggcugacggccagaucuguccugaggggucgugggagcccagcgccugccuugagggaaaugaacacugaaaacaggauuugggagcaguauuggauugacagcagagaagggacuguuuguaagggcaguuucucacugaagcugcuaccauuuuccuuuguaaagaagucauccaccuccucccagcggugcccauuuucaagacgcugcccgagccucuuaaaacagcuucuugaaaggguuuuuccacaacggguucuggaauguucugcuucagcucuggaggaugcucuaaauuaguucaccaugaugaaguuagauuugcagugagcuuuaacgaggaaaacagugacuguguuagaaacaggaaguagaacaugacauuuucuuucuuuuuuuuuuuuuuuuuugagaugcaguuuugcucuuguugcccaggauagagugcaauggcgcgaucuuggcucacugcaaccucugccucccagguuaagcgauucuccugccucagccucccgaguagcuaggauuacaggcacgugccaccaugcccagcuaaugcuguauuuuuaguagagaugggguuucuccauguuggucgggcuggucuugaacucccaaccucaggugauccacccaccuuggccucccaaagugcugggauuacaggcaugagccaccgcgcccagcugacauuuucuauuguaguaaagggcuaggcagucggccucaccuauaaacuccgucacagggucaugcucgccuuccguuuugaugguaccugcgaugcugucauucuccaggauggggaggaaaaguugcacgaagucagagguauaaggaggagcaaugacguccagcaccugcgugggggagcacagggugacuucuuccgcacacuagugcggggcauccaccgacauccgggugaaauggccaucaguuuggaaaaaaucccuccccacccccaccggccggugacaccacccaucuccaacauucagaugcccagggugguaauggagguaaagugugucauacagcugcugcaggcagaaggugcuuuuugguaaacgaguaucugucauugucaucacuacaucagaaagcacaguucucaguuagguacaaaaugaacuaaauuaagccaaaaagggcagugcuaguguaaacaguaugaaacaugaaaccaacggugcauugcugaccucagugacaaaauagcgaaugagugaaaugucaguguccagcuucuccagacacuuucggauguaacugacaacaggaaguacauaaccucgacucagcaggugaaccauccuguccagcagugucuucuucaacucaagcuacagaagaagggggacagggagcugguuagagaggguccuccucagcccucuggcaagccccacgggcacugcucaccugcuccaucacguccagcugggagugcucagucucaaaaagcuuaacaagcagcugcaggaccugggggugcaggagcugguggcaggugcugaucuacaaacaggccagagggagcuucgcugagcaguguggucacgcucagcacacagagaaacugggcacugucacagccaccaaagagcuuaucacuguggaagaagguccugacaccuaagccagggccaucagcuuccaguaacacuugacugagguuaagaaauuucugcagucaaugaagcuagguccuuaagaggaaaauccucaggacagaaauaacuauuuuugagaagaguauccucuaaacucacugaauagaugcaauguuaaugccaacguaaacagcaugagacagacacuguguaggcugugaacagcucuccgcccucuuaccucauccagcaacgccagguggacagggguauggucagucugcagcugaaaguaccuugguucugauacaguccaauccacccacuucagcacacccauugcuaccacuggaaaccuacaguuaaggcagaaugcuuccuuuaaaaaacaauuuaaaacacaaaauaugcuagaaaagcauuaaaggaaaguuaaaaacaaacucaaaugacuccaucauucacccuucaauacgccccccaacccuuuuuuuuuuuuuuuuuugagacagggucucacucugucuuccaggcuggaguacaaugacacaaucauggcucacugcagccucccgaguaccugggacuacaggugagugccaccaugucuagcuaauuuuuuguagagagaggguccaccauguugcucagacuggucucaaacuccugggcucaaacuauuuucuugccuuggccucccagauugcugggauuccaggccagagccacugugccuggcguaagcucugcuuauuaguaaauagugugaauggaucagcagccacucaacaugcggugcaagaagcagaguucaauucucugcucacuuuaaaccacuuaucgaaaggaaaagaucauuaaugagugauacucagugaguuugguggacuggguugaaguuuaccuuuauuuagcaaacucuuucuucaucccuaguauaaauuauuaggggaaagacaugccuaagaggacacacuauuucuaggacacgucuauuuauaugauuggcauaaucacaaaucauuucuauguaagcaauacuuugugggcauaacuuuaccuauaaauagacccuucaaaucaauuuuuguuaacucuggcuaucuuuuacuuagccuaauuuguacucaacagacuucuggcaaauaaacaucugaaaauuacucaugcugcuaaagcuguuuaaaguucccuacauacuguuuaaaaaugaaaaaauaaauaaaaugaacaaguaucgcugaagcuuuuguuauuugagcuuucaauaugaaaacucaaacgaccuccuccccaaaggacugauuuaagaacugaguuucguuuugcuuaccuaauacacugauaaagugugcucaauucugccacuaguucagaggccccuuuguucucguugcaacacaaauugugaacgguuucgacagcuuuugacguugacuucagcucaucuuuauugaugcucacucgcuuguucugaaaacacacacacaagcuggugagccugacagggcagauaucccugcugucgggguguucuggugucggccacuucuugcaaagcacuuucccuauuucuacuuaaguugggagucaauucagcugucaaacuucacagucacacaguguacagaaacugaaaagcaaugagacuaguguuuguccaugucuuacggaaaucaguuucauuucuuuagucacauuucaauuuacgguuugcagagcauuggagacauuacgcacauuuucuggagacguuuagugcuuucucuacgcagaaacacaagaaaacacaugccugauacuagggagggucaagauuucuugcagccaaaauuccaaaauaauaucaaagcagaggaggauauuugucuccuaaaaaauccacaaauucccagaaccgaugguaccuucuuccaggucucaaccacgcuugcugcguacgccaagauguggauguauuugugcuugugguccugguugauccgagccccugguuuaaagagugacugcaugaacagguccaggaaggcuggaacgcggaucugaggagaagcauaugcccaguucgggauggcaggcgugagggcacugcucacccaccuccccucaggguucccuacacagcaggggcccaacaggcuccaggcagagagugugacugaggaaggaccaggacaaugauggauuugcauucacagccuucagacaaucagacaagcacagacuuuccaaagucaccuuaccagcugacauuggggauucuugagaagcaacuuacaaguucaaccggaggaggguccaugcuugugaacaucuugaacaggacggugaugucagcaggguucagggcuccuuuggacagcauggccccgagagccuggcaggcccugggguaggaggcagcugugcccaaggcuagugugaucugacuggcgucaugaccucuugaugagaaaaaccauagaccccguuacuaacaaggcagcuucuuuuuucuguucuuuuuuacacauauaauacuuugcauuguugggaucuguuuuucugucauucacgaguauacugacugacccacaaaaauaacauuuacaacacuggaaaagugauuccaauacagcuugcuggcucuauaagaaaggagucacacacuuuaaauacuuaggaacacucuauugguagcagaaaauaaagcuaauaugagcucauuuugcgacacuguaacaaugagauugcugagcaacuauuucuggacugacuuuguuuguuacuucagaaccccaguguaaaagcccaggcccauaacuccagcaaagggaagacgaaucaagugcuuuacacaacaguccucaaagcagcacuuuagaaagccagcucuccaaguauaccaaaaacaacuccaacuuuuccagcucugcuggauaaaaggaaguuuuuaauuuuuuuuuuuuuuuuugagacagaguuuugcucuuguugcccaggcuggagugcaauggugcaaucuuggcugaccacaaccuccaccucccagguucaagcgauucuccugccucagccucccaaguagcugggauuacaggcaugugccgccacacccggcuaauuuuguauuuuuguuuaccagagaugggguuucuccauguuggucaagcuggucucaaacuccugaccuuaggugauccauccgccucggccucccaaagugcugggauuacaggcgugagccaccacgcccagccaaaagcaaguuuaccucuacguugaacagaaggagcuagcagcuuuggcuguggaacacgggccaugggaaggguuuuguggggagcacuaggaaggaagggcugagcagaaacagggccucucacuucuccugggcaaagcgcugcacuuccugggcgauccugcgcacagcggagccccccugcuccuccugggccagcacggacaucauggccugggcaaacagguacgugugcuccccguggcacaccaucuucugcaagauugcagggagagagggggcaggguuuacuacuguagcacagacgggcggacgagagccaagccuccaccgugcucgggcccgggagugagcauccuggaaggugcccucagaaauggagauucucuccagggaaggagcaucucaugcuugaaaaccaagacccaaagcagccuccuucuaaucugagguucauaaagaaagaacuuacggcaaacucagggagauuuuuuucaagguuuucuucuccuccaucuaaaauuguagcuagagagguccggagcacucucgagaacacuucuagcugcuggcaugcuguggacacacuggugaucucccccugguacccugcgucagaaauaagcuaggacacaaaacaagaagucagaggggaggcaugcagugaccgcaccuccacgggaagcuggcuugucaguguucauggugagguggaguaagugugcgcuggucgugggucucaggccuucacuccgcccucacccugcuaucaccuaggugugugcccugggcugaccaccucuccaucguuucuucauaugcaagaggaagaucaagcaggcacgccuaaagcuccucuccaaccacaagagaauucuuguaucccugcuaaauccuaaaacacagucaacacugacccaaaaacagauacaaauuuuacacuuuucuuucucaguguaaggcuuaugaaaauaaaacaauaaagaccuuuauggaaaaaaagcaaauaugaacugucaaaggaaacagaccaacaaccaaaaauaaacauucauaaacacuuuucuccuuaacucuagaacucuuccuaccuuaacggugaaguucagcaucaaacagucuggaugggcuucagccaguuuauaaaaaaggucccgccacgugguaugugcaaucaucuguuccagccacgcuggggucugccaacacacacacaaacagcaagauaggaggaggccccacuuuuacuugaguggagauucuguuguauaaacgaucacaggagauuggugcugauggacuccccaugggcaucuaguucugggggaggcagacccagagcuggccacagccacacagucggcugagugacagaaaggucccuagaugcccgcucagcuuuuagaaaaucggacucaacacaggaggguacugaaaguugcuuccuaggagacaccgagaaccgcauagagcugccuugcacacacagggagcucaugcugccccagcuuguaugcccuuagcaaaagagaaagaggccauuuaaauggcacagguguucuggcccaucaccacauggaguagccagaaaaacauuucucucagcucuccuaugugacggauguccucaaggacugugcucugaaccugccauccuguuugugccaaggccagcuccccgaggcugcucccagccacagauggaaugcagcagggccucaaaagcaggccuguccaggagacgugggcucccagaaugggcaccuguggcuuaaagauuccccacugauauggcuggaacguucuggaaacugcacugcagccuaacauucuuccuacuaacccucauuccuuuucucuugcccucaagggucagacugcaucacagcuaccccagccuccuccagcccuaccccaucuucccucauagucgcuuccccaucaucuccugcaggccuagcccugucuuggcagcugcuucuuggaggaaccaaacgaauccaccacaacacuccaagggcugugcccuggagucagccugagaggggaaauggugggaacuugcuguucauucucuugaucucagcaccugugugccucuugcgugcaagcaugucacgacccuggguacagaguuuaaagggcaauucugacuagaugcaacuucugucucacacucugauuuuaguccucaacucugccauuacuuacaugauaugccacgcuccacuguacacagggaauuugcaaaagacccuagggccugguacuaggcaaagaaaaauaauuucucaccucuccuucuucaguaaaaauagaaucugcuuugcgggggucaaaauguuugaucagcaaacucuucaagugauuuuccacaguuuccugaaccugcacuggcucaacaccugaaagagaauaaaagcaacuagacaauggcaagcuguccauucacuguguggcuuuagaaagcaaauggucaaaagucucuaugugaaucaaauaccaaagaauugcuucugaccacuuauacauguaagguuuuggaacucuucaaaguaguuaucaaugauaagaccaaaaagcagcacagaacagaacacacaagucugguccaccccuaacuucauggaaaggacagcaccaucugcagagccucacugaggauaaagacaaauggccccagcaacagguagggggauggaaaaacaucccugcccagugaggagggagcagauggcagccaaaagagacacacuuguaucuaaucaccgggacagcaguguguccacaagcuuccggacagcacgcacuucagugaugucaucugcacccggcuccguggauuuacaguaagacucuacuuugaucauauuaacuaaaagccauaaucacagccaguccuaaauuauccgucauuuacugcuugcuguaauagacgucuugaaaaugacacacugaacacacacuguauaauccuauaauucuacaacaugguagggaaaacagcucaaugagaaucacguuugcaggcuaccaguaaaccucaauuacugaaucaaagauaagaggcaagcagauacaaaugaguaagauaaagauaaaaaugaguaagaaguucagcucuuucuuacacaagucucagaaaccaggaaaucaaagaaggcauuguaucaguguuauaaggacccaaaagucuauuuuuaaaaaaguggggguaacuagccaggacaggggacacccacaaagcaccugucugaaugagccacucggccagcagguucacagucugggccacagcgguguaguuuucagauaagagcuggauaacauucucuggagacccuccugccugaaaauaccuagggaaaguaacaacagcaauuacacccgaaugaauggaaugauggacaacaggaagguaaggaaggaggaagagaaucagguuucaaaauuuuuaaagcagcggagggggcugggugcaguggugcacaccuguaaucccagcacuuugggaggcagaggugggagaaucacuugagccuaggaguucaagagcagccagggcaacguaaggagcccugucucucccaaaaaacaaaaacaaaaauagccaggcaugauggcagacgccugugguggccaccuugcaaggcugaggugggagaacugcuugauuccaggaggcugaagcugcagugagcggugauugugccacugcaacagagcaagacucugucuuaaaaaaauuuaaaaaaaaaaaaaaaguggcagaggggacccccccuugaagccuuuaguucaguucgcguuacucuugcuuuacauagcaccuucuggguguauuacaaaacuuucucuaaauuacccccagccuccucccaauacagacaccuuucucacauaccucuucagaguguugaagauggaggguuccaugauauaaucccggguggaaaauuuaugcaggcauucuugcugaaccuccgcaucauccucuccuucuccagaaucauccuccugcuguugguaaaugcgaagagccaggauauuuuuuucauuaauacaaauacccuaaucucaccuuaaaucguauaaugcugcccauuuugaaaguauucuacacacauuauuucauuugacuuucaugacaauuucaugaaaugggcuggacagauagugaguggcuaggaaaaugggauccaggaucacacugaguggguguguacaacuccucccuggcaaaccgcguuccaugcucacacaaguuacccaaccucucugaguguccauuuccuccucuguuaagugaagauaauaauaacgccuauucccauuuggcuguugugaggauuccaugagcuaauuuuuggaagaacccagcauaaucccugacauuucguaacagugcaauaaauaguaaacuauuauuauuauuguuuucacuauucuuauuucauacaugccacugaagaguaacaaccugauucuugaaagcgugagccaucacuuaccauuagaaaguaaagaccacuaacucgccuugcauccacacuucuggcuggacuccagucccaauucuauguggaagcaacuucaggccugucacuccaucuaagggcaaagcaggcuucuucaccugcuaaugaccaugugaggauggacugugaucccaaacccuguccaacuuuaacacugccacccuaacuaacaagcagaugcuuuuugaacauucagucugcacuaugcucaucaaccaaggaaccuaagaaaauguaagacaagacaaggcuuuuuccaucaaagaaguucacaaacuaauaggagagacagaccuccaugcaaccuacucuaacauaauggggcaagagcugggccaggggucagcaaacuaugacccagagccgaauccagcccucuccuauuuuugcaaauaaacuuuuacggaacacagcacacccauucuuuuaaggacugucuaugauugcuuucccccuguaagggcagagguaaguaguuaagacagagacaggcacaaccuaaaauauuugcuaucuagccuuuuucagaaaaguuugcucacuccugaucuggacuaagauccuaaaagcagugcuuugggagcagacagaacccgaugacuucccaguaaaagcuguggagucuucucucagaccagauuugcauggggaacgcugagccccuaagggcaugacagaggccggacuucaccccgagcuucauucccacguugucuguucucuugggcuuccacccugggcacucaccuaccugccucuuccaccaccucuugggucaugcuaucuaccugcucaccaaucuagaauuagccuggaucucucucuccgucuuuccucucuuaagcuccagacucagguauccaacauuccauucucauuuccagucagaugucucacaaguauccaaacucuuuagguccaaaacugacaucucuucccuagaaacagaucuucuuccuacaacccauauuuccguaaagguauccuucauauaucuacuuguuaccccccaaaccugaaaaucauccucagcuucucucccucaccccacccccacauccugucacaaagacucaucaguuccaucucccaucugucuauccaaggugguccuucuuuccacauuugccucugcucuuccuuauuuuuuguaugcuugcaguagcaacauuccccugaagucucagucuuauuccuuccuuucaaucaucuuucacaccguggccacagugaucuuuguaagccacaaaacugacgucucucuccugcuuaaagauucccaucuccuucaggaaaaaacgccccagcucuagcaagagcgugcccuucccacuuccccuguccguucugaccucucaccacuccccauuugcaaucuguagcaggacucaucuauuugcaugucugcagcucuuaguuuccaccauccagacugaacaucacgguggccuccuuacacaucuuccuaccucccacuauguaacauggcaucaggcgaacagaauuugggucaccaacuaucuuuuaaaauccaguucuugccacccuccuaacaccuuuccuaacuuucuguaccucuuccaagcagagucacagaauaaacaugaaaugaacgucugguccaccccccucauccaugagagcccacuggugucagugggccaaauuaggaucaugauuaaaauuccccaaacaugagacuccccaaucucccaucaguggggucuaggucugacugcacaaacuugggcaaauaacucacgugcuuggucuauaaagugaagguacugauuagauggcccuuauaugccccaguucuaacacuuuaugacucaaagccucaaggugaggccgggcacgguagcucacaccuguaaucucagcacuuugagaggcggaggcgggcagauuacuugaggccaggaguucgagaccagccuggccaacauggugaaaccacaucucuacuaaaaauacaaaaauuagccgggugugguggcaccggccuguaauuccagcuacuuggagaaucacuugaacccaggagguggagguugcagugagccaagauggcaccacugcacuccagccugggugacagagugagacuccgucucaaagaaaaaaaaaaaaaaaaaaggccgggugcgguggcucacgccuguaauccuagcauuuugggaggccggggcaggcggaucaccugaggucaggaguucaagacuagccuggccaacguggugaaacacugucucuacuaaaauacaaaaauuagccggacaugauggcggaugccuguaaucccagcuacucaggaggcugagacgggagaauugcuugaacccaggagauggcaguugcagcgagcugagaucaagccacugcacuccagccugagcagcuaagcgagacucugucucaaaaaaaaaaaaaaagaaaaaaaggcucaaggugauauacuagaugccccaaacaccaaccuaccacuaagcuaauucacaccuucucaucuggaccacuuugguagucagcaauuugacgaaguggcaacggaggcaaaggauguggguuuggguccccucuccuuccuuuauuaguuucaugaccuugggcaggucaguaagucuuuucgucucauuuucuacacuuaccagauaaguaggguaacacccaacucaaaauccuguguguggaaggggauaacgcaugacacacauggcccaagcucucaguuagcuaagucugacucuauccacuccacccuaagccuccaacacugugaaaugauccaacaugcaaaucuacucgugucacucccugccccaaacuccugaacaagccauaccauucagcagcucuccaaggaucuucagaaccugcucccuacugaccuccugccacugcuuccaccaggcagcuaacaucacagggcuucuuucaguuccagaaacacaucgcccgccuuggcauuuuagaccauggcuccgaagccgccaucacaccaccacccauguuuaucaacguaagccccacuucauccuuuauucccuuauaauaccacuucaaaaugcaccagacauccccaaucuugauuguuguuaaaaaugcaaguuccugggccacgagcaguggcucacgccuguaaucccaguacuuugggaggcagagguggguggaucaccugaggucaagaguuugagaccagccuggccaacaaggugaaacccccucucuacucaaaauuuuaaaaauuagcugggcaugguggugggugccuguaaucccagcuauucgggaggcugaggcaggagaaucgcuugaauccgagaggcagacguugcagugagccgcgauggcgccauuacacuccagccugggcaacaagagcgaaacuccaccacaaaaaaaaaaaaaaaaaaaaaaaaaaaaaaaaaugcaaguucccaggcucccguccagaccaacuguugggccgucuccaggggagggacgugagaagcuacauuucaaucaugcgccucaguugggucuuuagaguaagguggggacacacuguccagacuagagcuaccugcccuggcucugcagucccuguccucaggguggaacagugaucccuccugggcuuccaccccaaacccuggaaggucaaggcccgaaaauccuuuccaucaguuugcccaaaaacagaugaaaucagcccaaggugcugaagaguacaguuuauaaaacaguaaagcacauguaggaaugcccuaaguucuacuuuuuccucaugaugcugcugugaaguuuuuccacuuuauuuuuguuuaaaagucugugagcuccggacccaacccuccaccuuagcguuggugucccgcccgccgcgggggucgcagggccggcgccgggccuggccggagcgaggggguacugggggccucgggccgccccgcgccagagccuccggcgccucacccccaccccaagguccugcaggcgaggaggcggggaccccggcggccgcgccgcgggaccccgggcgggcgggggcggggcgggcugugcuugaaccacacggugaccgcgcgggccgugcgcgcgcacaccccccgcacgcccgcagccucgcgccgcgcggccucuccgggaguggggccggcccgccggcggcggagacgaacgauucucucuagggugcgcccagugccccgccucaccuggccgccgucagccucgucgccccacucggccgcgcucccguaguaguccucguccaugauggcgcccggcacggcccccgccaugcccucccgcgagcgagcgcggcgcaugcgcgaggcggggacgggcgggcgggcgcacgcgcggccgcg

SEQ ID NO: 13557 - RNA, 12684 nt, Homo sapiens
gccccgccccgggggagugucccggccuggccgccgcagccuuaagggccgggcggggcaggggcccaaagugcggggucggccgggugcugggccgaggccgaggccggggcgggauccagagcgggagccggcgcgggaucugggacucggagcgggauccggagcgggacccaggagccggcgcggggccauggcgaggcgcgggccaggguggcggccgcuucugcugcucgugcugcuggcgggcgcggcgcagggcggccucuacuuccgccggggacagaccugcuaccggccucugcggggggacgggcuggcuccgcuggggcgcaggugggcaccggcggggaggcagcccuggggggacgggaggcccaucgcccgggccaggcgcgcgcucugccuccugggggcccugcgucgccaacaggccuuggaaggucagauccagccgcuucguuuugggggucgcuccuucucuuccacauccagggugagcccugauguuugugggguuggacaagccccaccuggccagaaagccaggccagccccaccuccucggccucuggggguggcccuuacggcgcggcauggcugggggagcaacccgguucccuccuuucgggggugcccugccuccuucacauucugagagcgcuggagccuccuagugugaggugggcccacaccuggcucaccucuggugauuguggccccacucccaugcccucagguguugggaaaggcgggagggcccuaccgagggcuuccugggcccacggcccccgggagccccagcaccgaucuggguggggaugaucucuucucagcacauacccccggccucaugaguaccuguccccagcggaucugcccaagagcugggacuggcgcaauguggauggugucaacuaugccagcaucacccggaaccagcacaucccccaauacugcggcuccugcugggcccacgccagcaccagcgcuauggcgggugaguggccgcccuuugacugugggccaggaaagcccaucccggcugccuguuuauaggcccaggcagcucagcccgcgguuccaggggccugugauucaaggccaggucagccugggcuggggugcuaaggccgaggagcgcgggccuuugcccucugcugaggugacccaagcugggucauucuggggcuuuugggugacaggcaggacuaggacugaaucccagugacaaguggcugccaggugcccucucucccccaaagcuugugaccucagccauugggauagaaacagaaaugcaaaaucacugaguccccaggcuguauuugaggauacagaaguaaacugcuucucagcacagaugaaagccuguccugggcuuggaauauugggugaggcuaguuggcuacagcccauggccuaaccuggucacuaccuccagccugguggguuucuaucuuaggcuuuuggcaggaguaggguagggaggcucuuagcaaagaggaaggggaaacuaaggcccucccuaucaacgaggcugcugcacccugcuuugggagagaaggcgggagaagggacagcugcaaaccagccccaggcccaccccacagcauuuggaagggacucugcuauccccucuccagucacagcacaggguccaggagccuggauuuccccuggagaugggacuugcguggccugggaguuuggcccaugagcacuguggugcuguugccucuucccuggccuugguccucaugggucaggccugcuguacacccaugugaaaaggauagacuacaguguggcugccgcugugggccaaggcugggggacaugcguuugcgugugcuccaucucacugacgccuccucaaugccaugauugcuuccaguuugcagaugaggaagcaggcuuuuugcagagagauggggaggcuugagcauagugugagugacagcugagauuugagcccggaagccugggcuuugugccaggaugucugaugggcucagucuugugaaugagggguucuugcucuggggguagggucuggaccccagagccagccagcugaagcuguggcauccguggcgucucccccgggggcuggaacacacuucugaucguucaaaggucccuuugauguggauggagcuggaaggucugggagaccuugggcgggcugcaggguguggguggggcuagaggcagaggacugggcagagucuaggggaaguguccaggccuggcacccgcugaggaagugaaagagccuuugaggguggggugagggugaggggagaauagaaaggucaacaggugccugugggaagccuugaacucuuugagagggagucaggugacaagaugugcgucugugaaggacugcggguagaaaggagauggcuuucagauggaugugggacccuggccaggggucagcccugccgcauuuccccaggggacucucucugggcggaugacugcuucaccccacuuucuccugaaaccuccuucucagcgcacccaggcccaggcacucgcuuccucuuucacugaggaauagaagccaccagaaggggacuuccacggggcccuggccauuugccagccaaggcagcagguccuccauuugucuucccuccucucccccaggaucaacugucuuguccccucacugagcccgucccuucccacucagggaagcucucccaccuggaaaaaaggaacacaaagcccccggccccaccccgccccaauucugggcucccuagggaaguaucuggagucccuccacuuccucuucucuacccuugaacccacuccagccucagucccaccucugccacuccaccggcacuguucuuuccacugccaccuggggcccaccgugaagcauucuccugaucacgucuccccaggaugcuuccuucuccugcaccauacugcccgccuccaccucccuggccacuccuuccccucuccccagcugucugcuccucagaguucugagugucagcuuccccaggaccaacccuucaccugaacucagcuugacauccaccugcccacucgcccgcugucccggucaccugacaccuccagccucagaccuucaggucuggauggcuccuuccacuacugucaccugacagcccauuucuuccccaguccucccuggcuguccuuccggcuaugcaggcaaaagccuggacugguacccgacuccucuguuuucugucccucauauaauccacccacaagucuugucgguucuaccuucgaagcagaugcagaaaucacgcaccgcccaccgccuccuccaggucuaagccacaccgccccacugccgacugcccucacuggucuccuggccucugccccugaggccacagugagccugugacaacccaucagaacauguucuuuggcuugaaacccucucaggauuccacucagauaaaagacagaacccucuggccuucaagagccuucaccaucgggcucccucccaguccgcccuugcuccccugcuccugcggagaguggagcagggagguagcuucucccaccaggcaccuccucucucccugaggucccauggcucccucccucccuccuauggaugucaccucagcggggucuuccucagccacccuaugcauaugacaccccacuuccugaauuaucucccggauuuauuuuucuucauggugcuguagacuuugcacaguuacagaugcuccuugacuuaacuguggggucaugucccgacaacccccucguaaguugaaaacaccaugaguggaaaauguguuugacacacccagccuccugcacacccuggccuggcuuugucugcauuaaacguauucaggacacuuguguuagcccacagugugaguaauaagcccguucccagauggggcuggugggaugaaggauugaguuuggccgugggagaagcuugugcauaccucagugagcugguuaggccggguccagaugcuucaggcaggaguagacggagaggccagaaccgaaacugcucauccauccgagcucugccucugggccaggacugcugucgccggguuggguugggcauagaaggauagggcucgggggcaggccaugggacgcccugcacugccaaguggaacuccagaagcccaggcaggaggugcuuccagaaggauggagcgaccgcugugcugacugcugccggagaguggucagcucggaugacaguggagaagugaccuuuagcaagagagaaagggcugaagaggagcggggcaguaggggucggggcacugucucaaaccauugagugaagcagaaaaccgugauagugagugggaggggccgggggcuuccucuguuguugugagaaaggcaaguuuggggugugcagaucugcuuagagggggcauagcugacaagggagcggggagaaggaaagcuggagggagccaaguccuugggaggaaacaggauggaaccuagggugggucggucaggugggaggggacaaaccagccaccggcugcuccaggaagaggguuuggggugcagagcaugggcaggcuggguggcggcaggauggaggucugcuuugggacuuuucagugaugcgugaagucaccagagcagggacaguuccagaaggccccuggcugggcgaccgggaggaggccagguggaggagcggacuguggggcagugugggagagucuggaaggugacaagagauggaggggaugugcagguccagagggggcugccaaugggcagagggacucccugcucauugugcccugggggagggacaggugaggcugcaggaagaguuccgacuugaacguggggucaggagaugaggccugaggcaggugcagggguguguggcugugaaaucauuguccugggagggcagagugagaugacccugaacaugggcccggauuuccuucuaggaucuguuuuauugcauuugugcaugggaagggaagcaggucccucggugaccacccugagcugucccuggcugcaccuugggauuuagagcccagccaccugggcagugagggcauggucagccagccgcugggagcccucugcaucccccagugccuucggggcugggucccugcuggccuuccccagcccucaggaccgcaucuggccccucacuggggcucaugcggcucccugggcuauacucguucacagagcugacaccuuggcccccuguccacgagggcagggacggucucuccuggcuggcuuugggguguggcccacuugccauggguggcugagucucuguccauucagcccuucauucagcaggcacuucucaggugucugcagggccagaugcuggugaccgccuggcccuggcccugcucucauggcauuuguagcgggagguguggcagacaggacagugcccaaagaaggccaggagaggccucucugcagagcgacgucugagcggagaccuccaugaagaggucagcagggagaaggagacacaggcagcugggcagagcugaaggcaggccaggcugggcagcgccugcaucccgccugaggcguccagguccguucggggaaguggguggagagugggugagugcugacuggcaggugcugacuguugcagaucggaucaacaucaagaggaagggagcguggcccuccacccuccuguccgugcagaacgucaucgacugcgguaacgcuggcuccugugaaggggguaaugaccuguccgugugggacuacgcccaccagcacggcaucccugacgagaccugcaacaacuaccaggccaaggaccaggguaggcugcugcccgugcccccacuccacccuccugcccuccacucccucuuccacaggccuucguggcugaggacccagccugaccccgugcuccucacauuggcugguggcuggggagcugcgggagggcagagguugcagcccccaggggcgcuggugcucuugaccaugagggguaguguucccagugccagcuccagccucucgcugcagaagcccccucugcuaucuugcacccgcuugggcuggggaucagaaaacuggaccccguagucccuguugagaagcccaacgaaaaagccugcugcaggagcggucugaagagcauccuuggccaugcgcgcgguggcucaugccuguaaucucagcacuuugggaggccgagacaggcagaucacuggaggucaggaguucaagaccagccuggccaacacggugaaaucccgucccuaccaaaagcacaaaaauuagcugggugugguggugcacaccuguaaucccagguacucgggcagcugaggcaggagcauugcuugacccgggaggcagagguugcagugagccaagaucgcgccacugcacucuagccugggugacagagcaagacuacggcucaaaaaaaaaaaaaaaaaaauaccggcccuguccccaugucuccagccucguggaagagugucuugcuccugugccccuuuggcugggccugaaugugguguuugaguucugacaugcuggcauuuugguggcuuuuugggccuuuguaggggagagguguagggggccuuguggagggagaguucauuuuccaggagcuuugguggagagcagguggggaggugcugccccaaacuggaaggagccauuggcuugguuccuguucuggugacccagggcccaggucccccacauucaggugcggcuacggccaagggggugcuguguggaugagcagacccaagcuagccuggaaucccuagagcuggcacauuccuuucaggcugcucccauuagaaacagaaggaaagaaaaguccagacccuaaucccauaauugguagguuuuguuuguuuguuuguuuguuuuugagagggaguuuugcucuuguugcccaggcuggagugcaauggcacgaucucugcucacugcaaccuccgccucccggguuugagugauucuccugccucagccuccugaguagcugggauuacaggcaugcgccaccacgcccagcuacuuuuguauuuuuuaguagagacgggguuucuccauguuguucaggcuggucuuaaacucccaaccucaagugauccaccugccuuggccucccaaaauggugggauuacaggcaugagcugcugcgcccggccauaacugguaguuuguuuuuuuuuuuugagacggagucucgcucuuucgcccaggcaggacugcaguggcgcgaucucggcucacugcaagcuccgccucccggguucacgccacucuccugccucagccuccggaguagcugggacuacaggcgcccgccaccgcgcccggcuaauuuuuuguauuuuuaguagaggcgggauuucacuguguuaaccaggauggucuugaucuccugaccucgugauaugccugccucggccucccaaagugcugggauuacaggugugagccaccgugcccggccauaacugguaguuuuaagccaccugacucagaucucccucacagccagagcagagagcugggaaagcccagcagcugcuugcuuugcugccuccaccccugccccaggcuauauaggcuggccccagcgcccugugcacucugaaguggcagaagguccucugggcaccacccucugccaacggggcucccuugccuugccucucaggccuuauuguucagccagaaauucuccuggacuggcugagugaguccuucgagaagggggacagauggaaggugcagagggaagggcuaucagauggcucuggaagcaggaagcagguaucagguggucuccagggccacgcccacuccacgccaaagugcucucgcccagcugaggccaggccccuccaacccacccagccugacaggagcagauggagcucaucagaaaccugauugugugacuggugaccgcgguggcucacaccuguaaucccagcacuuugggaggcugaggcgggcggaucacuugagaccaggaguucgagaccagacuggccaacaugguaaaacccugucccuacuaaaaauacaaaaaauagccgagcgcgguggcaugcgccuguaaucccagcuacucaggaggcuaaggcaggagaaucacuugaacccaggaggcagaaguugcagugagccaggaucauaccacugaacuccagccugggugacagagugagacucugucuccaaaaaaaaaagaaaagaaaagaauaaaaaaaccugauugcgauaaauagucaucuuuguaguguuagcaaaaguguggccacacauccaccauuuucccguaguacugggcacugggcacuuggugugcaaggaacaaauugaaccagugucugagccucaaggugcucauguuccugggggaggaaucccgacagauguguaacuaugacagacaggucgcgccaaagcagcgaauggcaggccgagggccgccguguggauggagugaaaagugggaacacagugacucugagccuugcaaaaccgagagcuguacuuuuucuuuuuuuuaaauuaauuuauaaaauuuuuuuucuguagagaugaggucucgcucuguuguccaggcuggucucagacuccugguaucaagccaucuuccugccucggccucccgaagugcugggauuacaggugugagccaccacgccuguccuuucuuucuuucuuucuuucuuuuuuuuugagacggagucucgcucuugucgcucaggcuggagugcaauggcgcgauccuggcucacugcaaccucugccucccggguucaagcgauucuccugccucagccuccacugaguagcugggauuacaggcauccaccaccacacccagcuaauuuuuguacuuuauuaguagagacagggguuucaccauguuggccaggcuggucucaaacuccugaccucaggugauccacccaccucggccucccaaagagcugggauuacaggcgccuggcccucuuuauuuuauuuuuuaagccuaauucuugauaaccucuuaagucgaaauaaccagaauuuuuuuuuuugguccccucagcgugggcacagaagaaaaugcuuuuuugugguuguuguuacccaaaguauuggccuauuuauucaccagccagcaauagagacauuuuauuaagugcuaaucauuugauuaugcuccauuuucagcuagaaaguauuguggaaagguccuucuccagccauuagaggaaaaaggcgaacuccugggugccuacuaugugcuaauuaaugucugucucuuuucuucucugccaaggccuggggaagggcuuuucauaacucccuggcagcugaaagaagagcgucauuaagcagcaccuaauagcaagaugauuuccguucuuagcugcugagugguaggcugcaugaugagaguggagagugggcuuggcgggcuucuuugucaguggguugaugaggagacggccucaugcugacuuuucuugcucucccccagagugugacaaguuuaaccaaugugggacaugcaaugaauucaaagagugccacgccauccggaacuacacccucuggagggugggagacuacggcucccucucugggagggagaagaugauggcagaaaucuaugcaaauggucccaucaggugaggagaggucccgcgggcaaagagagguuugcgggugaggaaaggucccgcgggugaggaaaggucccgcgggugaggagagauccgcggugacagcgccagugugggcucaugucggugcucauguaggcaucuccguccuucgccacuuuccuucuggccgguuguacucaguaggcucgagacagccacaucauuuccccucuaagaacuucaguuuucucagaguuaacacucagcugauagcaagucugccccuauggaugguugugcggaaugcggaugagacgcuccaagcuguaccgagggggcaguuucagcagggaagacacuaugugaauaacaacagaaguuuauccagaaccgucagauauacacuaccugagucggguuuacacuuuguugucauaccagauuuuuuuuuuuuuuuuuuuuuuugaaacacagucucacucugucacccaggcuggagugcagugguaugaucuucgcucacugcagccuugaccgcccgggcucaagcuauccucccgccucagcccccuccaccgaguagcugggacuacuggcgcacaccaccacacccagcuaauuuuuguauuuucuguagaggugggguuucgccaucuugcccaggcuggucuugaauuccuggacucaagcgauccaccugccucggccucccaaagugcuggaauuacaggcgugagccacggcgcccagccauaucagauuauuucuaaugacgguaaauucucucaauuuaaaagugguaauucuuuaacugcuugcucucagcuguggaauaauggcaacagaaagacuggcuaacuacaccggaggcaucuaugccgaauaccaggacaccacauauauaaaccaugucguuucuguggcuggguggggcaucagugaugggacugaguacuggauuguccggaauucauggggugaaccauggguaagauguuuucauuuucuuaaggucauuccuagaaaaaaacguccugguacuccucucgcuugaaugguucuguuuacguuuagcuaaaaacuggggccuugacagaggguuccuugcuccagcugucucagccaccgcgcgaguggcuuuuggggccagacccuucucugacaugcgcggcugccgccauccugugcacuuuggguguucagcagcaucccuggccccuccacccacuaggugacuccccgcaaucccagugugaccaaaaccgucuccagauggugccuggugcccuggggaagucccugugagcacugcuggagaggggcucugccacccucuuccuuuacaaccagcucauucuuuuucccaucaugguuuuugggcuccccuaaaauacugugucgguuuuucaaaaauacucgaguugggccaaaaauccaggagagagaaauuaacugccagaccuagucuuagccauuaauaauuuaagacacagaaauucaugauuaagaaauggggggaaagcgguucaugugcaggugaugaaaugucgucauuuuuuacuaggugacuaauggggguaguaguagcuggaggaggcaccagucuagagucaacauguuuugugagaugaauucacuucuggcauagagggcccucauguuaaacauuaaccaagugaaauguuucacaaaagguauuucagaacaggggucaugggaaagcugaggggcagcugagugggcugucuggaucccccaaggcuggccugagagauggaggcagaaagcagggggcagggggcugacggcagcaaggggagcgggagacggcugcagaugggcugacgcgcgaucccacuucucacagggcgagagaggcuggcugaggaucgugaccagcaccuauaaggaugggaagggcgccagauacaaccuugccaucgaggagcacuguacauuuggggaccccaucguuuaaggccaugucacuagaagcgcaguuuaagaaaaggcauggugacccaugaccagaggggauccuaugguuaugugugccaggcuggcuggcaggaacugggguggcuaucaauauuggauggcgaggacagcguggcacuggcugcgaguguuccugagaguugaaagugggaugacuuaugacacuugcacagcauggcucugccucacaaugaugcagucagccaccuggugaagaagugaccugcgacacaggaaacgaugggaccucagucuucuucagcagaggacuugauauuuuguauuuggcaacugugggcaauaauauggcauuuaagaggugaaagaguucagacuuaucaccauucuuaugucacuuuagaaucaagggugggggagggagggagggaguuggcaguuucaaaucgcccaagugaugaauaaaguaucuggcucugcacgagacugaggcugcccgugccuuauucgcacacaaaaacaaugucacaucaggacuuaauccaacccagcagaaaggcuuuuuaaaaauuuacuuauuacuuguucuuagcaaauuaagacaauuacaauaaaacaucagcuaacuggguucuugugagaaaacugaggucagcuuggaaaggaguuccccgaguggaguucccagcggcccgcggcugacggccagaucuguccugaggggucgugggagcccagcgccugccuugagggaaaugaacacugaaaacaggauuugggagcaguauuggauugacagcagagaagggacuguuuguaagggcaguuucucacugaagcugcuaccauuuuccuuuguaaagaagucauccaccuccucccagcggugcccauuuucaagacgcugcccgagccucuuaaaacagcuucuugaaaggguuuuuccacaacggguucuggaauguucugcuucagcucuggaggaugcucuaaauuaguucaccaugaugaaguuagauuugcagugagcuuu

SEQ ID NO: 13558 - RNA, 610 nt, Homo sapiens
cucugacaucaucuuguuaauuuauuugugaaaauucacaaucgaacugaguucuugaaggcaagaaucuugccggucuugcucaaaaaucauccucagugucucccauauagucaaggcucaaugacuacuuauugaaaaaugaaaaaaaucaauagcuauuugugggaugaaugaauuaauggagucaucuaguuuauuuguuguaacuuccgcuagacuguaagccccugagggcgaggcucuugccagacuuguucagugauuucccccuuccuaaaugacaauuauuuguugcaucaauggaugaaagaaugacuaagaauugcuggggcaggaggagguggcaugugguuucauucagagaugagccuuguccagggaacagacugccuggcuuagcuuucagaauauggcuucccacccugcucuccugcacucuccacagccgucuaccuccuaacagaacaauuugccauuuucaaugaagguuauggaggaaaaucuuuacaucuaguuacuuagaagcuuguuagaaggaccaccucauucuuguucuuagcuuguuugauuguuaaagacaaaaagccagguuaauuuaggagggagg

SEQ ID NO: 13559 - RNA, 808 nt, Homo sapiens
uguggccacauuuauaguaaggacucaaaugaugaagagguugauaaggagccaugcucccacccccauccuucuaacacagaagucaucacuuuggacuuuaaauugcaguguggacacacacacaacacuuccacagugaugugucauaaugagggcugugucaaaugcaaacaggagcacagaagccgaaacaaggcacugugcucagcuaguggggagaggcguaucagugagacacuuggagaguagaguauuugcacagaaucucaagauaugaguaagacuuuccagggcaaaucagaggaaagugcauucuggguggagagaacaccaugugcaaaguucaaggguguggaaaugcauggccuguaaggauagcgagagauuuauguggcuguggguucagcugaguuggagaaugggaggagaaaacaucaaagccagacagguagacggggacagagauaagagccuguuagaugaaccccaggguuucaacacugacguugucaacauuuggggccagaucccucuuuguuggggcagggagucaguugccaacuugugcauuguaggauguuuagcagcaucgcuggccucuacccacagaugccaguggcacccucaccaccaguugggacaaccgagcaugucuccagacagugccaauguccccuggggaauaucgucccuagggaaauugucaccugcugcuguagugugauagggaugacccagaauagaugaucaguuguuauuugugcaaugacuaaaugaagggagcacagacaaaaagacuggaaag

SEQ ID NO: 13560 - RNA, 2364 nt, Homo sapiens
auuauaguugauuuuaucccuuuaaacaauuacuguauuuguuuuugacguagagguuucaauuuuuucaccuugggggcaaaugaaaaacuuggcauuuuucauuugggaacauauaauagcuuguaaacuuuucagacagcaguaaaugucugaaaaaauaucaaaaacagcauaaagacaagauuauguagcucuaauuauacguauauaauuauaaaaaacaaugugcaaggguuauauuuuaaggucuuuuaaaaucugauuuugaucauaccaaaugacauaauauuuuuuaugguagccuuuuacuuucaagacuuaauuuucagacuuguacaaguuccuucuuacauucuuucccucucacaccauccuacuggagaaagcauacuuuuaugcuaagaucuuacuuuaagcuuuuuaugugaacaaaagauguacauauaguaaguauuacuuccguaguccucaaauuuacuauaacuuuuguacuuaguauauguuuuauauuuggaaaacagcacuacgcuuaguuuuccuguaguuccugagugaugucuguguguuccuugccugcccuuuuuugugagcacagauuagucuguuauccauggcuggcacuucacuuaugauccuuucucugcuagauuuuuaugcagcucucuaugaaguuucauggcccauagauauucaaaagcaagauauucuauacauauguguauauguauauauacuccuuauguuaauacuaaaguguuuaugcugaguugcugccuuuccccgucauguauccaugugcaugcucuuagagaccuugaaugguugaggguaaagugauuuauuaguaauucuacuugccuuguguaugucugagcugaaaacaaucgugauuaagaaauuuagagguggcugggcgugguggcucacgccuguaaucccagcacuuugggaggccgaggcaggcggaucaccugaggucgggaguucaagaccagccugaccaacauggagaaacccugucuccacuaaaaauacaaaauuagccgggugugguggugcaugccuguaaucccagcuacucggaaguuugagacgagaaucucuugaacccgggaggcggagguuguggugagccaagaucgugccauugcacuccagccugggcaacaagagggaaacuccguuucaaaaaaaaaagaaaaagaaagaaauugagaaguaacgccucauaauauuuguucccagcuuuuuaaauugaagcugguugcauaaucuggggaauagucauaauuucauguguuauacaguuuaaaaagccugcaaaagugacuuugcuuguuuacuuucugccucagauugacuauuuuaaccaauauugucacgacuagaucauagcuccuagugaauaacaugagguguuuuaaaguuaggucuauuacagaauuaacauaagcacaauuuuaauuuuaugauaucugauaugccuaucuaauacaucuuaaugcauuaaaugcugcagauaagaaucuugcuauuuuucaaguagacaacauuagaaaguugaaucaugaacucauucaauucaucaagucaaaagcacugaguguuuugcuagucuagugacauggguuauuguauuuccgagaagugccucucauuucuggggaguuguuuacauauacccugcauuuaaaccaauuaaaacaauccaaguuucuuuaaaaaaaaaaagaaaaagaaaaagaaaaagaaaaauauuuuaggcuuagaauuaucuaauggaaaaaauguaaaaaaguacaaaaaugaacuaaaaguauaucaguauuugcaguauuugcugugauuacuuagguuuagacuuucucaacuucuuagaugacuaaaugggcugaagacuuguaacuaacuugaauaggauagacuucauacccugugacaaaaaggauggggaagagaauaucauuggucuugccauauaccuccuagcuaaaaggaaaaugguuuguaguuguucuugggccuacuguguugcuuuucagaaggacauaagacuuucuacuuuaucugauauggauaucgucuacuuccucauuccuuuaugcucacuuauggaguaguuacauagaaauauaacucuuggugguacuguauuuuaagguaauucagaagcaguauguauuauuuauguacauguacaggacaccauucaaaauggcuugaaaauauucagcauguuuguuauuugcuguuauauuguauguuuaguuuuguaugugauaaacagaauugauguaaguuuuuguggacuugaauuucuccuuccuugagaucaauuaaacagcagaaaaauauugucug

SEQ ID NO: 13561 - RNA, 4021 nt, Homo sapiens
uaucacagacuugguggcuuaaaccaaaagagauggauuuucucauaguucuggaggcuguaaguccaaaaucaggugccagcauggucggguucuggugaggccucacuuccuggguugcaaauggccaccuugucacaauguccucuguaaaccaaaaauaaaauucaaaguccccugacugaaggcacccuccucuuggccaaggggauuucaaaauaaacugguucagaccaugaugggaaguggguguccgacaugccuccuuauacccuccuccccuggaauucaggcacaacugaccagcuuuaacauuaaaauguagaucuuaagacugacagaagaaaauccauguagcaauaagauaucaaauuccaaccugacucuaguagaacgucacaugacagauagcaggcccugaaagaaaucaaaguauuuucccccagaacauauuucauugacauauuuugaaaugguccugcaaagcugucucucauggggaaaaucuacauuccauagagaauccccuucccuuuccagguaguuuccuacccaggagagauuuaacuaagagucuggcacauuuuagcaccugauaaaagacauuuacuauuaauaucuauuuucugaggcccgcuaccuagaggcuucaucuacauaacaagaaauuuggcuuccacaacccuccuuaucuuagcauuucuuucugcugacuucaacucuucaggcagagcuuaacccugucaacaaacugccaucaggaaaucuuuaaauccaccuaugaccugggagccccugccucuccaggccaaaccaauguacaccuugcacguauucauuucuguuuuuaucuauaauuucuauccccugaaaauguaugagaucaagcuauaacccaaucaccuggagcacauguucucuggaccucuugagaccaugccucaggccuuggucacucauuuguggcucagaauaaaucccuucaaauauuuuacagaguuugacucuuuuuugucaaaaccccacagagccuucccucugugcgugucccuggaggaagagagagugcaugagcuccaccauuaagucugcaaauucauagaccccucucuuaugaccucauuuaaccuuaauuucacucguguccguguaaagggaccaccaaacaggcuuugugcgagcaacaaggcuguuuauuucaccugggugcaggcggacugaguucaaaaagagagucagcaaaggguaggacuguuuuauaggauuuggguaggcaaaagaaaauuacagucaaaggggauguucucuggcaggcaggggcggggaucacaaggugcucagucggggagcuuuugagccaggaugagccaggagaaggaauuuuacaagguaaugucaucaguuaaggcaggaacaggccauuuucacuucuuuugugauucuucaguuacuucaggccaucuggauguauacgugcaggucacaggggauaugauggcuuagcuugggcucagaggccugacacuuaaugaccuccuaaaagccccaucuccagaugcuguaacauagggggauuagagcuucagcacaugaauugcaggggugguggagggauggggaguagagacacaauucauuccguaacaaguggucaagaaaagacucucuaggauggugacacuuauggugagacccgaagaaugagagggaaccugccaucugaaacucuggggaaagcccacugcagaaagaggaacaguaggugaacagggggagaaauaaguuguagagauuagcauuaagcauucuauuucacauuuguuaaauuugaggcuugugugacauccaaauggaucagugaagcaauggaauaaaagaauggaaaauccaauaguaauacaaauaauuuauuccuugccaaaguacaaccaucaaagguuucaaagauacauguguauggcuuucuaugccugcccuaucuggaucauugucuuaaucgcuuggccaucaugaaacaagucauuuggguguggaggaggauggagaaucaguuggcaagcguggagccaggcuagcuucaagugcagcccagagagccagguggagaaaaucagcaccaagacuuuucccaggugaagcacuucaucaggcuuaucagaggaaguguguuuagggguucauuagagaacacaauuagucaaaacaaauucuuccugucugggaagccaccaaguccuuaaaaaaaaaaugcuguaugagcauccccaguggccaauugugcauccaagaaaaugcugcugucaccaucugaguaaguuucauuaaguccaaaugccucaaauugccuucuuuuucuuccugaaacccucagcuuuuuaauucccugaaauccauggucuuugacuucccacugcacacaguuguuuagauaaauccauugaagaucucugcccacaaagcauacgauucuggagaaaggaagagacacuucccaaaccccaugaggccucacccacuuccugcgagaaguucagaaaagaucccucuguguucuugguaucagagagcaccucgagacaucgagaggcacuggugauguuaguuaaauugcacauauaaacagaaugcauccgauuuuaauugcuuuauuccucucuaccaaacaaaacauguauaagccuuagcaggcugauaaaggccuccaggcacuguuuuaacaacuugcauauaauuugcaguuugcaagcacuggugaggaaaggccugcugggggcagaggcucuguuacaaauccuggaggugagguugccaggaggggaaggaggagugggaaaaauucuuauuacuuugauuguguauuuuaauuccaauauauugaaaaaaaaugcacucauuuuguaauauaauugugucaauguguuuuaauacagcauguuguuaaaguuacuuauacauuccugggaagauaaaaucuaggggcuagaagucagucauuuaaauaauaugaaaauauccggggcucauuugaugacaguguuucaaauauuggaccaaacaagaaguaauucucccaacuuccuaugaucuuuaccccuuaauguuacuccaacaagugcuauuuugaauuaauuccaucucucauuuauuaucuuguuacuggaaaaaggagucccaauccagaccccaagggaggguucuuggaucuugugcaggaaggaauucaaggugagucacagaauacaauaaaaugagaucauuuauugaaagcuacuccaauuacagaguggggauccucagaaagugagagaaggaacacaucauccuuguuuuaaguuuuucuuccauagcggucuuaucuaugcaaaagcuaagcuaagcuaugacuaugugcagacgggcugacagcgugacaaaauuuauuauucugcugauuuaaagaaaacuguauuuggcauuuuagugcauauguacaucaaagcauaauaagaaguaucuugaaggcauauauuuuuauguacauuggggcaucuggacauuuuguugucauaggaguuuguccuugcagucauuguaaacugcuuccuuagccauaaacaucuuaugaccauggguugugauuggcaaggaaugcgccuugcugguuuuaagauggcauuaauucuaaaauggugucaccugggcucuccugggcuccuguuucccgacaaaaaucuccuacaagggaauggagaguggacacaacauuuccugggaaaaaaccauaagucucuuguucaauuagaaaaugcuaaaaauugggcuuaucugaguguguaaauuaugucaaagaguugacagaugacauacguugauauauucaugaaagggggcauuuuuccuuuacauauaaggaagagaguuuagguuucaaguuuauauguaaagagcuugagagucaucacuccaguccuuccaacaaauaaaaguuggacaaacugaaaaucaaugaccuuucuugaaccuauuggagaacugaguucac

SEQ ID NO: 13562 - RNA, 1682 nt, Homo sapiens
uuucaaggcacauuuaauuuaauaucaagagugcaauacaaaaggcccaaauacaaugaaggaacacauucccccauuaacaccaacgacaaugcucuuucaaacaugugccuguugaauggaauggggauuucauaaaauucacuaaaaaaaaaugcagugagucucaucacagcuaauauccuuauacaaucuaguugugaaaugaauguuuauaaugcuucaaacaguuucaaccugaaguuugauaccacaccuucaugucuguacaguccucaguaaguuuaucuacaguuuuugcagccauucaaagaacaaaccauugaauaaaaccacauugauuaaggcucaagcaaguaauacagagccccaaacuaaaugguuaaauauaugugcuacuuguacggacaucuauuauuugauucucucaugacuaucaaaaguuguuucucagcaaauaaaaccuuuaaaggcaaaauucaccucauuugaguuuugacccagaaguacaacaaucaugaaguccacagucuuauuggcaaaacugauacacagugucucuaagucacuaugcucaagguuaagagcgaugcauauuccauuuuuacauuuuacuggaauuuuacauuuucacuucaugauuuaaaaucucuagguuuucauuccuucaaacugucugaagacacagugugccacagacuuaagacuucuguuucucccucuauuuucuucaaacagaaacauuucucaagugucuacauguucuagaaggggaauuuuucggagguggccacuucuucggaauaguccgaugccaucaggcgucugaagcaaggggaaggggaaaagaaaaaagcugaaacacaagguucaucugguaaguuuuacauuaaacauuacaagcuggacaguguaagaauguggcuuuuuuuuuuuuuuuuuuuggcucaaaaagucugagucuugguguggaaacgaguacuugguugucccaccacagcuuucucguagugggacugucagggaagucuuaacuggggaggaugauuuguuuaccuaucaggcguaaacuuccaggcacucaguucauuuugggcuuguuccaguuugucuuuagucuguuccaguucaccuuucauuuuuaggaaaaacaaguugaucgcugggucuaccauuguugaucucaguugggcaacgcucggcugcuggacuugcuugagguacuggauuugaguaguacacucuugcaucucuuguuccuugguugcuagucgcauuacaaggauguuuucccugcgugcagacucuugcuguuguugcuuuaguuuuucuucagacucucuuaggccaguuacaucauuagaguuuaagaucuguauacuugcccuccaaagcuuguacguaugcuucauauuguuuccaucuuagaauuaacucaucuguugccauaacuuugaagucuguuucacucagucgaacuuucuugggaagagguucuucucuggucaucuugaaucgaagagucgccuuucaggcauggcgggcagucacuugcccgccgccgggcccgccaggagaggaaaggugaagggagggagcgaggccgccggccuagcccgaucggagccucgaggcgcaauagagcagcugcuccccgguaacacgccccguccuuuccgggg

SEQ ID NO: 13563 - RNA, 29919 nt, Homo sapiens
cauuggccguggggggugaggcgggccccgcgcaggaaaccccgccccucccucugcggcgggggcggccccagcggaugaaugaagcggcgcguggcugccggggaggccagagcguggagcgcugcgcggcgcggcggccgggcccucgagacggggacggugagugcgcggggagcggggagcuggcgcgggugcacagggcccgaccugcuggcguaggagcgcggcaggugccgccaucgugggcaggggcuggagcgccggggggaugcgcgcgggggcgggaggccugggcaccggccgagcgccccgagccucuccgcgggggagggcaggaccgagcggaaucggaggccaaauucgccgcuucccgccgccggcugcgcagguaggagcucccgagucgcccgcaggaggaccgaggcgaaggggccccacgcugcagcgggugccggggggaagcgggugagcaggggcugcggcccuggcagggacugucggaguggccggggcaggugaccugggcagguggcccggagcgcgcgcaggcgcaggccccacagauccagcuggggacgaacgcgccuccgcggagcuccagaguugcggagucacccaccugcggcggccgcugcugccgagucaaggaggaaaccuucaugcacggaaguuucucgggggcggccgggcuuuguucgcgccagaggcgcucgagacaucuccgggaggggagcgcgggcggagcgcacagggcuaguuuccagcagcggcggcgccccuuucccugccccaccacgcgacguccuggccguggcuuggggggacccgggcgcccuccaggugcaggcagagggucgggugcccucgcguugcuguugggcuccccugaccagggaggauggaaaggaaggagcaggcaggcuuagcugcccuagaccggcccuagaccgggaaccuggaagcagaucugacuuccacuuccaagggagaaaccgccucccgcacuggcgccccgaggggagagagaagcccagcuagguuuccgcgugguccgcgugguuggugaacccucaggcuggggggugccccgcuuggcgugcaaggcccucuuuggagcugccgugggaccuggcuaugcguccuguuucugucuggaggcggcuggaacgcgguaguuuuccacauccaugcaaccagcuugucagcugcugcuccucagcugugguuuuuggaacuuggguuaccuccaucuaaucagaaacuggcucugcagagcccggugucagcgacguuuucauucccagcagcgggagcaaauggaucucagaggacagcuccuuggccuuagccggcuccgcuugugaaucugguaauaaugacaaggacagugacagcagggguuagguguugagugcuggaaugugccgggcaugguaccccugcuuugagcaucgucucauucagucccuagcaaccccacgagguggccauuaucacucccacuuuauagaugaguaaacugaggcaccaagagguuaagugauugacucuaggccacacagcuuguaagugcugaagaggucugacuccagguuugucugauccaggcuugggcuccuguuuuacgacucuguucuuaaagaggcaaaaggcgacugcagggucaggccggagacccagaacagcgucccaagagcugggccugcgguuacugggccagagugucuguucuggguugucagugaucgcaggacaccaguaggauguugcucgggccgagaccacacagcccgacuucccucugugcugcuggagggagccagggcagaggccggccacucggugagaccuggacgcugaccacagccaggcugcccugaccgcccucagcaggcuguguccugccuuccugcugggcaaggucagcagguggugccuggaaaauucuucaugagggagcuucccucccgaguggccgugaccuaaucuguagcucacuggguguggccccuaaagcaggugcugggcaagucccucccaugguggagagcuggcugggcacguggcaggcagggcaggcugggccaggugaaggguggccagguggauggacaugcucuccuugcuagacuaagcccagagaggccggcucuccucggggcucugaugggccccuuggcuugaccaagccccauugcaguuuuggcuccaggucggucugacuuccaaauggcaaaauuuuucucagcccauuguagaaugaaaaguuaacucaucgagcuuaguauugugccuacaaggucuucgauccggaugucuccaugaguguuaauccauuucugggguggguacugcugagccaauauacauuccuggcuuccuggacucguccacuggaacguguuggguccuggugcucuccccagcagaugguuguagguggucagagaugagccacagaaaagccaacgugcagccuggugcugggggcaggagggagcagggcccuuggagcucugggagagagccacgccaggccagcccuccugcuuccucaagcgggcuguggacagaggccacaaaacguucccucacgagccacaugacugccucauuugcaaguggcaaggugcacacuguuggcuuuuggacaaggacaugggacaguccucagaccuugcuguugccuucguucugggacauggaccacugucuggccccccagugagcuugcugagugucagcugacuucaggcaggaucugggucuugcccacuuguuggaaugggcacguggggauugcaccccuugaacagggagggaggugccaguaacucacaugcuagguuaacagguucugggugacucugagccuuggcccugccaggggugugaggaggaaacuggcccugcugcugggacaacagacucugggcguguccuccugugggccucugcagaggaagcagacugggacuacaaagaacaaccugguccuggggacccugcugccuucucuggccccugcuggcccuucaggcuacggugagggugagggugcgggugaggaugagggugcgggugaggacccacccacacccgcacccucacccucauccucacccgcagccucacccucaguccucagacacuggggucuccggcugucuccaacccuucaguucuuuucaguagccuccuucccaccagcaucacacagaauuagacccugggacuacauuucuggcggaaggugacugcuuuuucaaaccacgugccuucugcagaagccgcuccccacguagcccaagcguagggugagacuuggcaccaguggcuggggucgcuuuugggugccagagagcccagauuccucucccucccacgcgcagccaggcccuuccugcccacggaccuugccuuuucuuggugguuuuucuaaucuggcaagccuuggggggcaccugaggcauugccccucuggcccaagccgcagggagagcuugcgaugcuuuggguggcgugugucguccagucugccccaggcucacuuggggcccuugcauuugccacuggacucugccuuucgggaggcgcuguggaccugagauuuggacccaugggccuaggaggccaccugggaggagaguggcccagcugugccaggcagguuccucaucuggacagaaccugcucccugcagccucucaagcuccccgagggcccuucugggucuugucucucccacacauugggggucagguuugagccccuuugcuggcggaccucugagcugcccgcccuucccucccaccacccgcccugccuccuguggugcacagggcucuccuggaggagggagguccugggcauccccugccuccucaccuucacccucaggagucccagagcccuggcugcucugcacagcaggcugggaagcaggcccugugcccaaggacuagccugagaacuggggagguccuuuccucuuccccagaggacaaagagagcugugaacaccacgggucuguaaagggguccccccacaugcaggaaaacaugaguuguggcaucacuuacgccuucacucaccaguagccgaggcacagcggggguccugagcaugggcagggcaagccacuuccaccccagccauggaaggaggcugaggaggccagggcagcaguggggaccugcggcaggcagggccugcagggcuccggggccggacaggguggauuuccauucugagucuguuucccaugaacuccagugcugacugggcccacuuugaguaggacgcucaguggcucauucucauucucaugaugucucuguuauggguggaaacugaggcagagagaggcccgugaccugcguggcuuggagccagccuccgucuucuucucaaacaugcccuugaauggcaggagaguuuucaguuccauggaugggaugaugagucggaaggaagaguaaaccugcacacacccguggcuucacccguccuccccacgcucccagguucaguggguggagacugggugcaagcagguugagggacagguccuucugggcuggcccugcugccgcacccuggcucccucuugcucagacaauccuucauugucggccccauacaaagcaauggcuuccugccugcucgccugugcgaggucaccagguaugcaaauugggguguaccaggcacagcugaggcccccauaugcugaucccagagucugugccucaagcuaaagaagugaaagcuccuuucauucauucauccagcuugaggaagagacccuggagugaauuuggagauagaggagagagucccaggugucuuggggggcugguguggcaggggaggcagcugaagaugguguggggagcaggcaggugcucagggcggggcugggugcagggcaggcauguggcuguggcuggcagccucagagccgucaggugccaggaggagggacucggcuuugccaggcagugccugggcuggaaucugaagagaaaggagaacugagacccuaugguccugccuggccuccaaauucugaguggggccuggaagccgggacugggacauccccuaauguggaggggugcuacccacccagcccagcuccaggccucccuggggacauuugcugggccacaguaggucagccaggccaggcccaggggcuggcaagcuuaaaauaguuuucucagagauccugcguccuuuccacgcacugcgcugagagcgcuuugcagggagccaggcugggaaguaagugcauggggccuagggaaguaggugggcuucuagaaguggcacaggccgggcugugucagcugcccacacacggggauacaggcuggcaccccaguucccacagucugggcugugccagccacccgcacguggccacuagcuccucccaggucacuguccuggcuugagaggagggggaggaagaggucagccggauucgccucuaaaagacccuagcagaggagucagggccuccuaucccggagaugcagcugacugaccaggccagcaugaggaaaucggaagagaacucuggcccccauggccuccuccuaaaauagcgggcacugacccauacacaggcgcacacgcacgcauacacccuccccaggccugcccccagccggaggcuccagggacacauuaucccccggcugaucgccuuggccuaauucacacccuggcugccaaggccucuggcagcaacauccccccuuccuccccugcgggguuguuguggguuagagcagggacagggccugagggggcuaagcucccagggaaagggcagcuggcucucuagaugcaccggaggggcggggugguuugcguuucucucgggcugagagccaccuaaggcuccgccucagauguucucccauggacagaggcaucagggcaguggggaaaggaugggccgagaggugagugggugcccuggggcggggcagccacagggggccugaaguggcucacgggcggggccaccagucagggcuccgggccugggcacaugggcaggcucugcuuccaggggcuccuucccaccugccggcugcaugggagccguguggccggagccccaggggagaccuugucccucauucuggagcagccgucaggaguacaaggccaugggagaggacccuacuccauggaggugauggacccuccucccgugauggggcagauuucaguaacugugugugcacaggagagcucagcugguucaggccuccagaagguuccugggcagcgauggugguggugugcugucagagccuccucccuaagccuggcucccagggccuuggcugaugacuggaauucacuccaggcuccgggccucuuguccccaccggccaggcgguucugauucgcagccaugggcagcuuuugcacccagcucucgagugaccgccccugggcuccucgugggugcgacaguguccugggagucccugaagcccagguuucccacauagcaggcguuaggaagucgguaccaaaguauggaaggacuggcuuguauuagucugaguuauccagagaaacacaaccaacaggauagguggaaagagauuuauccugaagaccuggcucaagcacuuauggaaggggcaagucccgagaccugucguuggcaagcuggaggcccaggagagcugaugguuucgguccagucugagucugaaggcccaagaaccagagaaaugcugcugcagguuccagccugaaggcugaagacccaagaagagcuggcauuucaguccaagcccaaaggcaggaaaagaccgaggucccagcugcagcugucacaggaggaggcccucucacucagccuuuggaucuauguaggcccccaacugauuggacgaggcccaccacccuggggagggccacccuucacaugcuaaucucaccuggaaacacccacagcacacccagaacgaugcuuggcuaaaugucuaggcacccaaggcccacucagguugacacaugaaauucgcuaucacagugcucuuggcccugacccugagaccaucgcacauagcgucagaggcuguagagugggcccugcagaggccaggaagcagaugcccugguguuagaugcagucaggguguucagaugaggaugacaguggacucgaccugggaugcugacaggagccaggguggccugggggcuggccgcuggccuguccuucacagggggugcagucuccugcaccccauggcugucccaucccugccccgggucucccacccccuccucugccacguggcugccacugcccggccuuccacaacugccuuucagccucaccccaucugcagacuccucauuugcagcaccgggguucaccugcaucuggccucaucagcaggugcagucuuaucugcguauaaaccagcccaccccaugcagccagcuugggaugagaggacggucaugggguccccguggcccuuggagggaggccuuuggaagaggcagguccuuugaauuuggucuggggucaaggcugccugcagcucccuccccagcuccguagugggggcuguauccaugcaucagaagaagcugcugccuuuuccgggggaagcugaggguguggaucggaagaagccgcugccuuuuccaggggaagcugaggguguggcucugggaugaggaugaggcuccauccuucacuguuacagggaccagcuugggaagcugacgcaccuuuuugucaaaaccaauuccaaguggaaagaaacuauaggcaggugugcauguguacacacaccuacacagacgugcacacacaggaugccagaaagaagaaucaaaaggacaggccucccuucuuccccaagcccagcugcaauguccuguuccccuugguggggccaguccaggggcuaggcagccucuacguggggcugccaugaggcccuuccagccccugaaacuccccugccccaccccacaccagcuuauccauaaugggccugagaccagaaaaccaaaggugugggcugccgagcugcccgccuuaacgcggaccagacaucauuacuccagucuccauuagcagugaacgcagaggugacguucaccuucucacugagccaugagugcaucugccuuggccaucucggaagcuagcagaucgcagaaggaaagcaacaugugaguggcgcgggugguccucaugggccccagcagcauuugucauugauggaacugaugaccgagaccaggaugggggcgcuggcugccuccaccaagcaugcgucuggcuguccacauugcuggacucggcugcugcggcuaagaugcuuucaugucccacguugggcugguuuucguggcaaacguuagcccugaaauguaaguccugcaccgcacguucagcaaggacucccucagguccgggccaagccuugacauacaugcugggcacccacuucuccaggcagaguucucaucccucuggcucaccagcucagaacggcacgcucaguaaaugccagugcuuaggacguauccaugugaggucuugguacaauccuggaaacuuccuuugggaaaugcaugaaugugggacccuccucaucgcccugagaguccagaguguugccugcccagcgucacuccacaacccaucuguccccuggauggcaggagccaggccagacgccccaucauagccagcuuuuauguuugcuccuguuguccuuuagcccugagucauggaaggcccacccuccccuuuccaaucuagacaccgcuguuuuaauggggaaacggccucccagagaagauuuccagcuucagaagagaacccggagcugaaacucuugggcaugaugaagauggaauggguacugucacacacaugcugcuugcgugagauucagauaagggaggcuggcccgaagccaggucgcugcuggaucucagaaagacgucagaacgaggccccaacggaagccccuggaggugcacagcuggugagcugaguggugccauguaauucucaucgucugcggccgucugaugggcaucugucggaagccacauggcugauauuuaaaagaggauuuuaaauuugcugauuuaaaugugcauaauagguaacuuucggcugagcuuuacauauuuaugucagagcuuuuaauucagguaaaacagccuucagcuuggagcuguuuggacaccuacaacuaccuguucuuucucaguuguggcuuucauuuucaagaaggaaguccuucuguuucucuguggccauugcuggucacgaaacuuagcaaucuggcuuccucucaaagcuaugcagacgggauccucccccuucccccuuaccugcuuuggccccagcgucugguccugaggccagggcugaacaaacugccuguaugaggcaagcccagugcccgggcguugagcggguguuucacggcagccagcgucuugguucgcaaugguuuacgugggcuugcccaccauugagcaucccagggaccccaucagauccuuugcagaagugcugccgaauccgacccacucccccugcccccgccucccccacccugccccgccccacaccccccacccccgcucggccccccuccccgugccagcacgugcagcuaggcggaaccucugagcacucucccgccugcgucaggcuguuccuuggcccuguugaggcuccuucccuucauguucuggcccagcccggaaaugaggucaaguuucugcuauuuaugugugugcgugugcacguguuuguguguguggguggaccuugaccuccaggcaguccucaggguaguucuuggcucuguguuccugcacuaagaaaaacaaugcgagggaaacacacccacaggcugccuggggagucugcguggcucugagccuggccuguccuccuccgggccucugagguugcuuucuguuucggcggccggcggccgguggagcccuugcgccuccucgucagucccgccccggggcucuugcuccuccggcuuuuccgcugacuccuggcauucgaguucuuguguuacacaugcuccugggacgucauccuugugacagcucgcuucaguagaaagccuguggcucguggguggccguggguggcucucugccccuuggggaggcguggagcauugcucuuacaauaugaaugucucuccuuccacgcacacucccuuucugacgcagcaggucccaaaccagccuggccugccagcucguggauagguguuggcauuguaaauaaacccccggguguggccgcgggcacccagggagcaggccccaggcaugaaugcuguggaaucucugcuguccgaggccuccaaauacggccucaaacagccucccggcaguguccaaggucaacagcggcugcacgugagugccacacgagcgugcacggcucuuucaguaggugucagaaggcagcugugacgcagacgcuuggcucuggggccagacugcgggggcugcauccucauugccaccggcgggcuguguggccucgagcaaaugacugaccccccugggccuucuuccccuacugugaggccugggacggugccugguacacagcuggugcucagugugcacagcggguguuagcacccugccacccagcgggauucuucacagcagcugcccgccuucgucccaaggagccuggggcugaggcauccauucgcugagagggcgagaccuccgauuccacagaggagcccuguggggaccgcgccucggcagaggacguggcgggaggacccagagcccagcuuugggggcucaauccugagaucccuguggccuuggggaaggggugcugguaccgccagaucucuccagacguaaaacaagccuugccuggaccugggggagaucccauggccugcucccggccugaccaugcugggcccgguuuaucugccuucacagaugaaguugccccuuuauuaaaaaacaaaacaaaacaaaaaaagccagcaauuugucauccccaaaugcuguagugucugucagcauaggccugucccggggcugguucucacugaggccccuguguccccucgcagccccauggcggaucaccggcugcgccuccgcucccacccgccacgcugaccuuagaguuagugugucuguuaagcucuaacucugccucaaccccaaggucaucucucugggcccuccucaggccucugucaucucccaaauucgggggcauaugugacaccuguuugccuccgugggggcugcuguaagaaaugaccacacaccaaagggcuuaaaaaauaguuuauucccagccaaacacugcauguucucacucauagguggaaauugaacaaugagaacgcuuggacacagggcagggaacaucacaccccggggccugccaugggguggggggaggggggagggauagcauuaggagauaaaccuaauguaaaugaugaguuaaugggugcagcacaccaacauggcacauguauacauauguaacaaaccugcauguugugcacauguacccuagaacuuaaaguauaauaauaaaaaaaaauaguuuauucccaccagcuccggaggccaggaacccaaaguccacacaggcugugcucccccuggggcucugaggaggguccuuccugcccccaguggcucccggggcuccaggugguccugagagcgccacgcccgucucugucucugucugcagguggccuucucugugucaucuucuccucuaaaaaugcaccugucaccggguuuagggcccacccuaauccaggaugaucucuucucagaucacuugucacaucugcaaagacgcuuuuuccaaauaaggucaugcgcucaggucccaggugaacgugacugcccggggaacacggggggcaccgguccgcccaccccagccccagcgcaggcccagugagcagacucugugaggagcugccaggaggauccugggguaucacccagcccagguccccacgggacugccugcugucccugcaucuccgugcaucucugcgcgucgccggcuguggcuggaaggagaccccaaggccggauacuuagggcuucggacucugcagagcccugagcauggcugauguggccccggccucagccugaugucagugggcagcauuucucacgcuuuguguuuuggagccucccagguugugauguuucgugggcugaauaagcuuccagaagcgccggggucccuguugaaugugauacaauguggcccaauauggacacgccaccgcccaccccaccuuagcuccacagugaagacaaaagaccccagacuguggacuuagacaacagaaacgggcccucucuuacugcugaggaccagaaaucagggaucauggugucugcaaggccggccccccucggaggcugugagggaaggagcuacuuccggccucccucccgggcaggggaauggucugcacauccacauucccuuuuuauaauauggacaccggucagauuggaucagggcccacccaaugucccuguuuaaccuuagucaccucuuuaaaggccugaguuucaaaaacugucauauucggagguauuggggucaaggcuccaagacagcuucuuuuaggggucacaauucagccauaacaggaggugccccagauggcaagcaccuugaggucugcgagaaagacccucccagggugggggcggcacagguguucuguaucacagcagccccgggaaggacccucccagggugggggcggcacagguguucuguaucacagcagccccgggaaggacccucccagggugggggcggcacagguguucuguaucacagcagccccgggaaggacccucccagggcgggggcggcacagguguuccgcaucauagcagcccuguuuauucgccgguuuauuucugacggggaaagcccuuaagaugcagagaggcuacagccaccuggguuccccagaaggccuugggcaguaggggggagcuguugcuccaggaauugguguggggagugaggcggugcccuguggagccucgggaugguggggaacagggcuggugagggcaguggggcaggggcagcgcaggguucagaaggaagguggcacgugggcacguucuccugguaacuggucuacauggcugccgacugcaacuccuguuagccacaggcugacccagcagcggccggagcuuggcggccggggguguuuccggugcugggggcucacguggcccaggaggcugcuuccagcucauuccugcaccucccaaacucugcacggagaggagcuccuuccucacgccaaagggugcagagagcugccgggugugaacuuaaggaagaacaaggucaggcuccaggaccaagguggaguccaucagggccacuuggcugcaaauggcaggggacguggcugacacagcgagcggggccagggcggggugaccugggaccccagugucugacucggccucugcgucucagcuccacucuccaccgcguggccccaucucaguaggccuugcccccgucacagcccugacgccacaccgcugaagcggcagcuucuccuuccaacaguucuaaaaagggcaggaauugagucccugugagcaagcugggcacagccccccaccuuuccgcagcggagcuguggcugggagacacagugccugggugugggccuggccagacgccacccuggauuugggaggcucuugagacaaggcaggcagagcuuugagccacccccgugaugggugugcuggaauguucccuccuggaugugcuguacccguggagagacgugagcuugcuaaccagacauucuucucacaggacacaccagccccucggauaccacuuggccacucccgcugaggccacucccacugcguggcugaagccucgaggucaccaggcggaggcgcggagaugccccugcaucagcugggggacaagccgcucaccuuccccagccccaacucagccauggaaaacgggcuugaccacaccccacccagcaggagggcauccccgggcacaccccugagccccggcucccuccgcuccgcugcccauagcccccuggacaccagcaagcagccccucugccagcucugggccgagaagcauggcgcccgggggacccaugaggugcgguacgucucggccgggcagagcguggcgugcggcuggugggccuucgcaccgccgugccugcagguccucaacacgcccaagggcauccuguucuuccugugugcggccgcauuccugcaggggaugacugugaauggcuucaucaacacagucaucaccucccuggagcgccgcuaugaccugcacagcuaccagagcgggcucaucgccagcuccuacgacauugccgccugccucugccucaccuucgucagcuacuucgggggcucagggcacaagccgcgcuggcugggcuggggcgugcugcuuaugggcacggggucgcugguguucgcgcugccccacuucacggcuggccgcuaugagguggaguuggacgcgggugucaggacgugcccugccaaccccggcgcggugugugcggacagcaccucgggccugucccgcuaccagcuggucuucaugcugggccaguuccugcauggcgugggugccacaccccucuacacgcugggcgucaccuaccuggaugagaacgucaaguccagcugcucgcccgucuacauuggugaguggggcuggcgggguaagugcuggcagggguggcugagggcaguguugcaggagugaggguaacuggccggagccagccccgcccccugccuucguguaccccuugucugcauggcccuggggcugcugcaagaguuggcaggggaggaggguccgcccugaggcccaaagcugauguaagggacuccggcuuucucauguggacccugcucagggcuccaggccgcugugcccgggagccucagugcaaccccugcgugguguccagcccaccuugccaggaccaaggggcacagucacuaggcgcuggguggcaccagguccaauggcggcagaccucaugcuccggcugggaaccuggcacuugccugggaaggaguuugaugugggauaagugacgagggacagagccccaaggccacacccauguuucccugaaagcaccauguuggcuccaucagccacauagagguggagggacagagcccugagaccacacccacgucugcccguaagcaccgugucugcuccggcagccacauagggguguggaaaagaccgagcaaaucuggagagucagaacuuuaaggggaaaaauaacaugaagcagcucauggcugcuucacagcuaucuaagaguaaagaucuauguuauaacucuaugcuaggcagcugagcucacugcccuggggcagcccugggccccucacuggcuuccugcuccuguuuguugagauguagggaagccccauggcccguccgacauggccgaguugacccagugcacggcccgccugaccccacuucucggcgucccccugccuggcuuggcucucccgggaagggcaucguaggauggucacggggagcagcuggccccagccggacucugcagugaccucagccuccucauguccuccuugagcucugcucaucccagucaccuggcagugcucgucccaagaacccaggcggguguugagaucaccucacuccagcgaggggacgucccaccacaccgagccuuccaaaucccggccugugggagagugagcguggcugggcggaggggcucaggccucucuggucccuuuccccacccugggccccuaauuccugccaguguccaucugugcggcuacuuagacgcccugcaaacggggcuucgagggccuuugcccuuucguaagggaaagacagugcacuuggcuuugagggggauuuuuaaagauugaugcugacccauaucaggcccaguggcaacugcacagacucaucuaacuuaaagaggcccaugaggggagugggccggagaugcagaauggcgggugcggggcuucucccaggcacggggccccacacggcccuccgcagccccuggguggugcacagcggcccugacgccucugccucucucgcagccaucuucuacacagcggccauccugggcccagcugccggcuaccugauuggaggugcccugcugaauaucuacacggaaaugggccgacggugaguggccgcgcacccagcugccugcgcuggagaggcccacgugucucuggaaggggguucagagucagcagggcccacucugagucaggccgggcgcggcgcaggugcugggcaccccccgggcuggagggagucaaggcuggccuuggcucuggaggacucggaggaucuguaggggccuugggagucggccccagggcaggaggcagggcaggcaggcagugcccgaggccuaagcgcuugcaaagcccagcgagcccuggccacuaguucccuaaugaaacugagauuuuucuguuucuuuuccuuucuuuguaucuugugugugugacccuaguuucuguaaauguaagcaggagaaagcaaggagggguggagggagaggcagagagagacagagggaaagacacguagagacagaccaauucacagagacagauggagauagagauacagagggacagaaagaagacagcgacaggcagagagagacagagacagauggagauggggaggcagaggagacauguccuugcugaccgccagugcucuguggguuugggccccccauucaucccuugcccauccugcacuugugaaguuuccaagguccucuguuacucggccugggcaccgcugcaccuugggacucuuucugcagauggcgccucuccuggaggucucuagcacucugaccucuuacaaaagccccucuggccucggauugauaauguggggucaagugugugcguucugggcagagccuggagguaggcuggagcucgugucccgggucuggaugcuucucucagucucugugccccuucuggcuccgggaucugggcccacuuugcacaaaguggggaggcagagcggggucuggcccccggaggcggccgcagcauuucugcgcuggagcaagcaggugccgccuggcugcagccuugcaggguguuggcgcucccuguguccucugucugucucugcggcucugcucccggccuuugcuggccuuuugcccucccgccgcugccucacugugaagacacauccccgaaagcccagagcuuguccucacugugaagacgcgucccuggaugcccagagcuuggaugggcuucuaccacuccacggccgccucagcccaugguuauuuuccacucgccuuuucguuugaaagcacuuaugugcaaauugccacgugcacaacagucccuucguggggagcucucagugagcuccagcugagcccucuggcgucccugggaaccccaucugucauccucugcacuguggggagggaugccuccucccgcuguugccuggagaggcugcuccucuuagugcccaaccccaccguggucucaggaccaggccacagguggcaucuccagcccuggagcgugggccaaggcauggagccaucugucuugggggacagcuaagccaaggugguguuugcuuuagucugcaaggaagggacaggaccuguggccagcagcaccaggggccuguguugaccagcgugcagacagacccuggaggucugcccggaggaggggccagcagcccccagugugugugccauggagggcacaggugggcugcacgcugacccaggugccacugccucuuccacaggacggagcugaccaccgagagcccacugugggucggcgccuggugggucggcuuccugggcucuggggccgcugcuuucuucaccgccguucccauccuugguuacccucggcagcugccagguggguuucccuuccccagcccagccuucacauugggagacugucccuuagucuucgcgaagggggcaccccguuuccucugcugucuuuuuccccgccaugaucaagucugcggcacacccucauucucaguguucuucccaucuggguggagagacgccuccuggcuguggcacaaggcagguuguguguccauccuguccuguggccuccccucugccccagcggcuucucccccucaggccacggaacaggcuugucccaaucagggcagggccuccauccccuccuucccccagccccacuuugggccccagcucucccacaccuccaaacccggcuugugcugcauucucacgugguuucuguuccagugccgccuccccggggcugcgagggcugcagggaugucagacagugacguucccagaccggggaggggcagaggagugggggcagagccucucucggagaaguccaccuccgggagcccccagcccccagccccagcucacucugugcccuuccaggcucccagcgcuacgcggucaugagagcggcggaaaugcaccaguugaaggacagcagccguggggaggcgagcaacccggacuuugggaaaaccaucagagaccugccucuguaaggaccggagucgggaggguuccuaguguccucagacccuuuaaugguccccaucuugggggagucguugagaccccuccgggaucaugauggggacgcagccccuaaccucugucgugacccugggccaagagauuaaggagcaacagauagagccucugggccaggggccgcagaccccgccucagggcugcagagccgugggagagucccagaguggggccggggccucggcccgcacccagggagccaucacuucacucauacaguguggagacuccugugggcugcgccuggcucccaguggccacggagcaaaucccuuccacaccagcaagucuccccguggccugugugucccgggguccccagggaagcugcauuugacuugagacccuucccucaccaugaccccccacacucuaauucccuuucaucaggugucaccugugccguaccccccgggcccugggaugcugcccccccaucucccucccucccucagagucucugaggaccuccccccucuacccggcgugucccgcucacccucuggggagguugcuugcuuugccgucugccuuggcugccuucccuuucugcugagugugguccggccuugcuuugcugucuugcugcacugcuagggugaacccggggcccugagccggugggguccuagagggacaacagaggggcccgggcccucccggccucuccuggggaucaugccuucccuggggggcucuccccagggcugggcacagguggcccucaggguggccaccacccaaguccucagcgucugaggccccagcacggggagacucuugugcccuuguagcagcaggucccugagcucacaaauggcugugucucacuggccauaguggguggagggugugggcaaugggugagucccugcugccugcccucaaccaggauaggagggaaggcaucagggccaaagguggccccucagaaagccccaagcuguccacggcagagaggagcagggcuggaugaagaugggaaagagaggccucauuaggacccugauagaccccccaaaggagcugggagcugccugcuaaggagggugaccccaugggccaagcugacccggggccacguucccaggacuugggaacaucguguaggcacuggcucacccucucuccuccacccagcagcagagcggcuuagagcugagggucaggcgcccuguucccagcguggcugugagcccccaguguggaccuaggaacccuggggcucuuucaguucaucaggugauaaggagguuuauguccaggguuaguucccuaaaccaguugcugggaagaaauaaaucaugggacauguucccuuuauuaaagucaugacuaauucucugggcaaauucaacacgagaauuucagccgagcaaucagugauuaagaaaugaaguuugcauagcauuucagagagucagggccuccuaacgcagccacacaccccggagccugggcaggucugggaaaagccccagggagggacucccccagggugcccaccccagccccauccccccauaugccaggacccccccagggugcccacuccagccccgucacaccacacgccagaacccccccagggugcccaccccagccccauccccccacacgccgggaccccccccagggugcccaccccaggucugucaccccacaugccagaacuggcuggggaagggagggcaugggcuggggucuccuuuguccuccaucgucuugccuuuuucaagacgugggacccaaguaguuaaccagaaagaagaggcuuuucaauccucaagucaggaaauaaauuuugaaagaacugggcucucccauuuuaaucagggaaggggacagaaagaacccauguucauggcugcugaggucagucugagcgagccagcgaacaccuccaagcaggcagagugccugugaggcuggagcggaguuucugacgccaacaucagcucugcaaggcaccugugggccuguuggggcucagaggcuaacuagggcugcaccgucuguuccugauucuucagaauccauuuacauuuggccaccuccucaaacaagagcauuugaauguuccaggcauucagaguugcguucaucggaaccaggcucuagguguggccgagaggaaagagccgcccuccugcaggugggggugaugugaggccgacagucugcucuggugagaggcuggaaaguguagguuuacaggaugucacuaagcugcagacgcagggguucaagucagcgacacugcggugugagcagaggcgacauggacaugucauuuauugugaaaauuugcauuacugugggcugaugugagaggcuauugugccaugaccuggggcuucaggaacagucucugccccuggucuauguuaugaguuccagggacaggacaauagcugugucugcaaacacccccaccugaggccgagagccccccacucagugggggagaagggucacgcacaggagcgugcugugaacaggaugcaggcagcugugagcugggaugaaugugagcuuugcccagucugggugaucuguguaccccagagagagccgagccucucuuugcagaggcgguuucccuucugucugccucgaucacugcacuggcugggagggcuuugcgugguuuacaccaugcaacacguuuuccaucucagcaucuuaugcgcuuaagcagcgguugggcguuagcccugcucaggccuccaaugcuaacaaaaacagggagagccuccauucaccccccagggccucgugugcagggacaggcagccccgacgcacugcugucggccaccuccuggguuagaaacugcaaggccugauguggggccuucccagcuuccagggggcuauguccuuauccugagaccccacagccaggaccgcaacaggcagauguggaggcugaggcugagcccucagggccagacggcucagaguucccacaguuccccccagggcuccaggcccaugcaccaaggacucgccccaguugaggccucaccacccccagggccacuggcccccaagugcaaaccaagcuagccagguccgucuacccaggggcuucuugcauggaggguucgaaucccaguggcuuccugccccacuucucccaggggcuggcgguuggggacuggccacaguccccauucccgugauuccauuccccuaucccagggccuguccgguccuggacuugguggccucugccugccccagccaguucccuuuuucaggcccugcugcuggccagugacggaacaggguccugggucacuuggggucucuccccaccugagcugaagcucuggccaaggcacugauaagguuuuucccuaaucagggacugcagcuuucaggacaagugggccacaggcauaggcucagccuggcgcccccuggguuucucuggaauaagugugggugucccccaccugccugcaccccacucuacucccugucggaacaggggcccuuuguaaucagaccggggagcugacagccucaggaacagcagguuccucccacccugggucuggcccacucugacccucagucucuucuccacaccccgaccucugcccaccacucugacccucagucucuucuccacaccccgaccucugcccaccacucugacccucagucucuucuccacacccccaccucugcccagcuccaucuggcuccugcugaagaaccccacguucauccugcucugccuggccggggccaccgaggccacucucaucaccggcauguccacguucagccccaaguucuuggagucccaguucagccugagugccucagaagcugccaccuuguuuggugagaaaacugaaucuuggggguccucugcuuuuaugucaguucucagaaacagagucuucaagggcaucuucuagaaagacccagacagggcacauggcagugagugcccucccacccccgcugccagagcagguguggagagcgccacgggggcugagcgacucuguccacaggccgggagaguggugguccugcccucuuugugggacaugcuccguagguggaaggguccacggugggcuccacccccuagccaccuagucuuggcuucugugacuuggugcaggaaggguuuggaccuggcuguuccaugagccaggcacuggugccucaggaccuccuggaacagugcagcuggggguuucucggugccagaggcaggcuggccuucccaggcugggcaggucugcagaaaguggggaccccuccucagagcugcuccuccugccagcguucacagaguacccugggccauggcagaggugccaggcaugugggccaccaccgccaaucuaccgcgcucuacccuuccaggguccacuaucuggacaggaagagggcaucagaugagggcuccccucccucccccacaggcccauccuggccuggccccucugggcugaccucacaagcccacauucccacacucaacagccccccagaggucagcucuacugccccuuggagagccuccccaccuguccccccaaaucuguccccuccccaccuguccccccaaaccuguccccucuccaccuguccccucaccugugcccuccucacuugucagcccagaagcuagaugccagcuaaucgcaauuuuuuacuguugguggccacucaggcuucgacaaauguccuugucacagccugcagggacucggcagaggccccugggggaggaggggguguggcugcccuggaggggggucaguggaggagucauuggcuucccacuggggcaggggccgcugaccuuggagcacucugggcucuccuccuccccccgccccgccccgcccccccgcucccccuuccccuuccccuuccccuuccccuuccccucugaggcauccccgcugugggcucuggacagaggucccuccuagggcucuaucagcgcaacagcuaagcacucaggugugguguugagugcugccaugcaggcaggaauugaucccucuaugccucaguuuccccaccuguaaaguggacccggcugauccaccacccucucccaccacggcccccugccugagucccuggcugaaucccucccucuccccaggguaccugguggugccagcgggugguggcggcaccuuccugggcggcuucuuugugaacaagcucaggcuccggggcuccgcggucaucaaguucugccuguucugcaccguugucagccugcugggcauccucgucuucucacugcacugccccagugugcccauggcgggcgucacagccagcuacggcgggaggugagggccagauggcaccuggguacgcgucggggccccaagcacccgcggucccugggcauggaggaggaguggugcagcacuugggagaggugguuuugaaaagggcuacgucacaggacagcggcaagggcaacacccgcucagcagggcacccggcagcauccacgugaaaaggcaccaugccagcccccagcagugccugcgcuugggucccggcugugcccccgggcagucauaugccucucugggccucagcacucugcucuguagcugugucaaauggaacaacagcccuaguguucgggguccuugaggcuggucucucggugacauaaaaagugucccaggaugugcuccuggaguugccaugugcugggagugggagggacaccugcuggucagguggcaauuagggaauauccaaaauacacguagguagccugcaccucggcccugcccugcgggccccgggagugcaccugcaggugccgugcaaggccgagaagcacaaagcagccguuguggcauuaucggaaccuaagagucaucaggguggacggggucacuacgcuguccucacaacagaggcccugcccacaaaggaguggaggaagcucauccugggccacugccaagacauacugugaagugggaaaaaggaaggaguuggacaaugggcgcagugugcucugauucaagugagaagugcagauguuugugacugccgaggggcguguacgugcagacgaccccugcaaaugcacagccggccuguggcuggagaaccgaggacugggguggggcuggggccacgaggcugccuuuguguacuuggcgcuuuuucuuuccuaauguuuguauuugauccauaugaauguguugccuguccaaaaacaaaugaacuagggaaaggggcugugcaucaggcggacggugcuggggggcaugggugugccuuccuugcgugaggaggaaaaaccauucuaucaccagaaggcagugcccagugugagugcccagcgugcugggggcggugcaagcuuggcaaguuuguagacccgaaaugcaggcugcauggggacgagccccauggcugacccugugccugcugggcgccagcauggcucuggccuggacccuaccacucgcuuguccccccucugcagccuccugcccgaaggccaccugaaccuaacggcucccugcaacgcugccugcagcugccagccagaacacuacagcccugugugcggcucggacggccucauguacuucucacugugccacgcagggugcccugcagccacggagacgaauguggacggccagaaggugaguggagccgcugccuaccgccccuguccuccccuggacccugggaaggggcccccgugccuuccccuuguaaucggagcuauuguugggcuucccagguguaccgagacuguagcuguaucccucagaaucuuuccucugguuuuggccaugccacugcagggaaaugcacuucaacuugucagagaaagccccuccuucugguuuucauauucguuguaauuuucuuuacauuccucagcagcauuccugcacuaacggcaacucuacgguaagcuggggucgggugugcgcuuguccagagcuuuccuugcagcacccugaggcggagcucugcagauccugagacaggagcacuccaggaaacacccaggucuaagcgggccugucugucacugguggcaggagagaccucacugucucugaucucugacgaggggcuucccacuugggggggggugaugauguggcuggggacugguccaggaggccacuggccuagggggugacuuggcaugcaaccccacuucugugggugcugacgcugugguuuucuauugcagauguguccgugacccucagagauccuuugcccugggaauccaguggauuguaguuagaauacuagguacugugcagugugaggaagccauggucaguugcacagugugcucacugcacaagggcaugggcaagugucuaaccaccaaggggaugugcuucccagcaggaggcuguucccgccugggaagggguccauucccuaacuguccacuagaggggcccaucgucauuuauuugcccaaaggcuuucccugggagaucaugggaaacucgcagccccaaugccgaaugcccaaagaaaggaacguuuaagcccucuuugcacccccugagaacuccaacggccaguaucaccuucccagagcccaucauuccaggccucuuggcugccugcccccugccuagccccuacccaccaggagugugggugcugagugggcuucucuccgcagggggcaucccggggcccaucgccuucggcugggugaucgacaaggccugucugcuguggcaggaccaguguggccagcagggcuccugcuugguguaccagaauucggccaugagccgcuacauacucaucauggggcuccuguacaagguaagcaggcccagggaggggacagagggucugcucugaggguggcugggggcuccgaacaugccgcgaucuuccagcagcuuggaccacagccuaguacaucacagauguuccugcagccaguuuguagaaggcccuucccacauuccucaugaguugguuguggggagaggcaggugggcugcagggccuccuccugggguucacuguccaggcccccagcagcuccagcaaagcccaggcccaggcccugcucccucucccaccuccugggacugccccuccacaguguggucuugcacguacccgggaugcccguuaacuaaaagcuuugcagaaauaagaaguggcugcuccuguuagagcggcuugacuagcugguccacuccgggccucagucuggggggcuggcgggcagguugcagccucuccgugaucagugcgccuuggauuccauuggaucucuuagucuggcccucauuuuucaagcuaacagaaacuuucuguugugacuuuuggcguaugcuaccugggaggaaacgcaguauuuguguuuggaauuugcccccauuagacgauaaagcacaaagccuucuaaauaaaaugcggucccacggccagcuguucagaggaucuugacgcucuuccuugggugacggacccaggagaguucauccugcaggaacccguggccucaggcuuuccaggagggagguuagagaaagggaaggagcccagcugguucaccuccccucggauuagcagaaaagaggcgagucugagcagggccuuguguggcucuggagagaagcaguggguuaaggagacauacaccucgguuucccccucaucugagguuucacuuuccacaguuucaguuaccagagguccaccacagucugaauguauuaaauaggaaauuccagaagcaaacaguucauaaccuuuaaagcacgcgccguucugcacagucuggugagaucuugaucuguccugcccaggacucggauucucccuuuguccaacuuuggaagaaggcaaggucagaacuuauucugcagggagcuuuggggauauuggauacuaaggcccaagcccucugugauacgccuuucgcuuuggcauaaaauaacgguugacucucuguuaggcgcgucucugcucagggaguggugguguuuggggaagcccaaaggcacaugagcaucaggaaauugaccauuugacuucauaagacauaaccuuuguccagcguguccaggcuauucaugccaccaccuguugaucacuuagcagccggugugguucccacaucccccaucaccauaucacagugccauguucaagccacucuuauuuaccuaaucauggccccaaagcaccggagcacucacgccgccguucagcucugccaaugggaagccggaggcgccuccuucagcgagaagguguaguuccuuggcugggcuuaguacuacccuuagacucacgcguccacaggggucucagugucugcggaugagggggcugcuguacuuucccagggagccguccccagacucucucuuugcuguguuggaugcaucccuuagcugggagcagcaggcugagagcccuccacacgcagccauccccugggcucagcacagccagcgggagccguauccagagggucagaguuggccucagcagcgcaugcguccauguuaauuguagcgggggagcacacggugucuccuuauaaacacccucgcauuccacuuuguccugcaccgagucaaaacagccucacucccugaaugcaggcucagggccaucagccaggcugacacuccaggaggcacaguggguguuucugguccacgcccagcguggaaaucauaguggugcacauguacucugcgugggcauugcggcagcauccgugcuuggaccucaccgccuuuggggcccacgugggauuccugccacaucguccucuugcccugcaaagucggugcagccccucauuguugacaaagaaaccaagacccugaagguucagaacugcccaugaugguggcaccggggcuugaaccccggcugugguggugaccggcgacuggcucugugugagguuccuguggccgccacgacaaaggaccgcaagcgggguggccugauguagcagaaccagauucgcuugcaggugggggcagggcgggcuccuuccgccgcucuggcucucugcagcugcauguggccuuucccucugucccugccucaagucuuccucuccuuucucucaugaggacaccagucauuggauuuggggcccaccuuagauccaggauggucucaucucaaauccuuaauuacaucugcaaagacccuauuuccaaaaaaggucccauucacuggugucuggcacuguucaacccaugacaagccccucaguccugugccucuguuuuuagucaaaggguguguuucauucccucuuuaacaauauuggcgucugcucuacaaaccgguuauaugggaaagauacccucucagagcaggauggguuuccguggaccuggugagggugcugcaggcuggggcagggacaggacugggacaggcccaccaguauccaaaggcucuggccgagcuccccacgagguccagcgggcuccucucuccccaggugcugggcguccucuucuuugccauagccugcuucuuauacaagccccugucggagucuucagauggccuggaaacuugucugcccagccaguccucagccccugacagugccacagauagccagcuccagagcagcgucugaccaccgcccgcgcccacccggccacggcgggcacucagcauuuccugaugacagaacagugccguugggugaugcaaucacacgggaacuucuauuugaccugcaaccuucuacuuaaccugugguuuaaagucggcugugaccuccuguccccagagcuguacggcccugcagugggugggaggaacuugcauaaauauauauuuauggacacacaguuugcaucagaacguguuuauagaauguguuuuauacccgaucguguguggugugcgugaggacaaacuccgcaggggcugugaaucccacugggagggcggugggccugcagccugaggaaggcuuguguguccucaguuaaaacugugcauaucgaaauauauuuuguuauuuaagccugcguccccguaccgcgug

SEQ ID NO: 13564 - RNA, 6725 nt, Homo sapiens
agcugaggcccaggucccagucagccaagccagcucuuggaccacucagcggucccagcaggugaggcugaccagagccugccugggcuaagaggcugcguucaccagugccagcugugguuggucaccaggaugccugagcgcgcuggcacaggcccagggcacccugcagagcaaccaacccucaccgagauccccagggaaggggcuguuguuggcccauuguacggaggagggcacugaacccucaagaggcucagggccucgcccggucacacagcuggaaggcgccagagccaggaaagggacccggaagcccgacccggagccuacacccgcagaggcgaaaacaucugcguagcggcucccuggccagugggccguggugggcguggccgagagggaauggggcggagagaagcccgugagggcagggcggaggcggaggcggaggcagaggcggagcgggcggagccggaggccgcggcggccuugauuggaggccgccuuaagcucgucauggaugcguuuugaccuggcggccccgccccugacccgcccccgagccgcccucccgagcgcuuccccgcccggccccagccuaggccccgcccugaucucgcccccucuucaccguccggccccggccccgccccgcgguggggccuccgcagcgacccgcgguuaacgcuuccccagagcuugggcugcgcggcggccgggagucggaggcaggcggucaaggccggcagggccggacccccuacuugcccuuucucccagcaggcgcuggacucugggggcgggcgugagccccuccgucccgcacccagacccgggcagcgagcccuaugccugcaguaauugugggguuucugguuuuguuuuuuccuuaacaucuuuauugagaccguuaaguucacccgcuuaaagcgcacgauucggugggguuuuguugcgagcaaccguggccacuaucuaauuccagagcauuucaccuccuuaaaaugaagcugggcccggccgggcgcgguggcucaagccuguaaucccagcacuuugagaggccgaggaggaaggaucaccugaggucaagaguucgagaccagccuggccaacauagugaaaccgcgucucuacuaaaaauacaaaaauuagccggccguggugagcgccuguagucccagcuacccgggagucugaggcaguagaaucgcuugaacccaagaggcagagguugcagugaggcgagaucgugccauugcaccccagcccgggcaacagagcgagacucugccucaaaaacaaacaaaaaagaagccgguccccauccgcagugacucgcguuucccucccccucccccguccccggcaaccgugcaucuacuuucuauuccuauggaguugccaguucuggcucuuccugugaauggauucccaugcuguguauuuucgugucugaauucucugacuuucgucucagcccgcacccacgcugccgcaguccgcgcucgcugcuuuuaggcugaacgcggcugcgccgugcgggugcccgcgcuccgggcgccccucgcagguucagccccggguugggggcggcgcuugccucgcggcugcgggucccagccugaaccugugucuuguuccacugccgcgggcgcccgccacggagcugcugcuuccuagggagacgguuccaucguugaaggaacggccagacugucuuucgcagcagcggcccaucugaccgcacagcacgaccgcacgagggucccgagcccugacccucgcagcacucgucaccccggccgcgugguuguggcggucucggcggggcaggggguccccacgcgggcugauucuaguuucgcgugaccgauggugcucauuagccauaucuguacaucuuuuuuuuuuuuucgagucggaguuucgcucuuguugcccaggcuggauugcaauggcgcgaucucggcucacugccucccggguucaagcgauucuccugccucagccucccgaguaacugggauuacaggcgcccgccacuacgcccggcuacuuuuuuuguauuuuuaguagagacgggguuauacgauguuggccaggcuugucucgaacuccugaccucaggugauccgcccgccucggccccccaaagugcugggauuacaggcgugagccaccgcgcccggcccaucuguacaucuucuuuggaaaaauguguauccaaauccuuagccguuuuauaguuagauugucuuuuuauuaucgaguuauaagaauuauuuauaccuucuacaaggaaguucauuaucagauauaggauuugcaaauauuuucucucaucugugggucgucuuuucacuuuucugaugguuuccuuugaagcacagacuuuuuuguuugggugcaguguauuucuuacugugcuuuaaagaggaacacguuuuaagaacccccgcgcggggcggagcagggcggaguccccggcgggaagggacccgagaccucggcugcgccugcgccgacgccggcgcgugagcccgagcgcguacccggcggagcgcgcgcccgcccccgagugcgccugcgcggagcucguggccgcgccugcucccgccgggggcuccuugcucggccgggccgcggccaugggagaggccgaggugggcggcgggggcgccgcaggcgacaagggcccgggggaggcggccaccagcccggcggaggagacagugguguggagccccgagguggaggugugccucuuccacgccaugcugggccacaagcccgucggugagcgcccaggcugcggacgcgcgugggggcggggcgggcaaccggcggggcggggcggggccugcgcucgcgacacccucgcccccacgcuccccgccgagcccgggccgugacaccgccgccacacccgucccgggacccccgcccccucccacgcgcccuucggaccccgccccggaccccgcccacgaccccuacccccgugagaccgcgaggucccagcccgcagugccccacccccacccccgccccgggacagcccacccccucccacacacaccacccagcccugcccccccacagccccuccacacccuggcccuccccaucucuccgcagccacccuugccccuccaguccccagggcagcccguccccuccauccccuuucuccucaccgcucaccgguuaucccgccgccccuccuccccucaggugugaaccgacacuuccacaugauuuguauucgggacaaguucagccagaacaucgggcggcaggucccauccaaggucaucugggaccaucugagcaccauguacgacaugcaggcgcuggugagcccaaccgcccucccugugccgcccgaugggggcacgaacccgcacaccgcucucugagagucagccugagcugggcagaggccccuccaugucugcuggggucugcugggcagaguagaggccccuccaugccugcuggggucugcagugagcucucagggucagccugagcugggcagaggccccuccgugccugcugggguccccugggcagagaccccugcagugaggcucguccuuaaggaggacaucccggggcuccagagccugucauggaaagcacaaacacagugcuagcagcuggcuagcuuuucaggggcucugcuuuagacugggugcugggccagagucuccagcugagacccuggggagggagggaaggaugcagagucccgggcccuuaggccauugucagccuccugggaggcccccgaagugcuuuaggcagagggugacccuaucugagucacaccaaggugaauuuggugacuucugugggagucagacaaguagaguuccaguccucgcagagcuuggagcuggcacugugugacgggcgagcggguuaacuagguaagcaggguggccagaagagacagguggguguuccaggcccuguggcagcaggaggugguggguccaggagcucaaagaaggugguguacuuggagaguggggugggggucaggggucaggugaccaggaggaguggggaccugugcugguggagagucugugccagccacguuggacucagggccacaccggccaucaguaugacauaggucucucccucuggucugugcgaccucaggagggcagugccuggcaagcacucucuucuucuuugccugguucugugccuguggcgcucccaaccgacacccucgguguccaugggcuccugccacguggaugagaacucgaggugccugcggccuuuccccagggcugucacugugcccucugcaugccgccuuggggaacgcagucucauggugagacugcaggccgugcugggcaggcggagcccacaggugugugucaccagggcugcccgguccucagggcccgccuuagugaugcuggccccggugggucuuccugacuccugcaucugcugccgcugguucugcccucccugggucugucuggaaagcccagcuguggcaggcgcuguucacaaaaagaagaaaugcccuuugcccuugccccgcccgccgcagccuccaacacagugaugugugcucauuggccucuccccaaguggcucuuacacggcucuagugacuucuugaaacugcaucuucacccuuguuucuuaaacaaaacucucuauuugauaucagcaugagucugagauucuuccauucccgaauccagagaggaacuucguccuuccagaagagaucauucaggagguccgagaaggugaggcucgggaaagguugggcuugggauucagaaaaggccagacccuggccaagggcagggaggugagggugaggaccccgggccuccagggaggugugaggguccagcgcagaccccgcccuaccugugcuuggguggucuuggaaccuccgggauuggagaggacuuuguuugagagcaguggcuggacggaagcugaggccugugugggcagcaagcgucggagcagucccuggccugaccaucccccagcgucggccaccaccguggguuuucggugagcgucagcugucuccuccacaggaaaagugaugauagaagaggagaugaaagaggagaugaaggaagacguggacccccacaauggggcugacgauggugaguguggagcucacccugcccugaugcccuuuggggcucagcaccccaagacugccuucaggcagggcacagucaggugggcguagagccugcggugcagaggccccaggcaggucaucuaggcacaggauggauccugcagugcccccuccccaggagcugagugccugcuccauguuguaggccagggucugagcggcggucccugcagugcccgccgcaggcagguccucaggaggaccaggccccucugugggcccaaaugcaaggggcucccagcucaggaggaagcuuuggguucagagggucacgugucaguaugcagauuuuuuuaacugaacaggaagacaaaaauaagauucuggauauucuguuuucagccaagugauuuuucguuucucaguuuuuucaucuucagggaguuuggggaaagcaucagaaaaauccagcaaagacaaagagaagaacuccucagacuuggggugcaaagaaggcgcagacaagcggaagcgcagccgggucaccgacaaaguccugaccgcaaacagcaacccuuccagucccagugcugccaagcggcgccgcacguagacccucagcccugguggcggcagagaagcgggcgaggcacuguggucgcugaggggguuggcugggucugagugccaccccccaggccacagugauaccaucccagugccaugagcccacacugcccgcccucaggcucucaggugaacguggccgucagcggggaaacgugugugucaguuggaccaugugggacccugauggaccugaaagaccaggaucgguccagcucagauauugagggcucugaagccuaguucugucuucucuggagcagcuguggcuuccccguggcugcuuggugacauggauuagcgcuacgugggcugcagcauuugggauccaggcuaccuagaggggcaucgggccagggaaaaccucggauuagcaagcaauaaaaacaugaccucacucuuccucaaaggagccccuggucuucccugugugacucaguucuuuccaucuguuugucccgcugcaagccucuuucugcgcugacugugacauuggaacguggccuuccugucacccccuccgugccacgcacugaaggccacccccacccaccugggaaacuaagaacuggauauuuugccucauucacuuguacuguaacaauguauauaauuugguugguauuucacuauuuaauuuuuaagaagccuauuuuacuaguguuuuauaugaacaaaguacugcagaaguuaaaccuguguuguauuuuuucugagauguuuugcuuuaagagauacuuuuugcucaguuuuuauaugccagauacagagaauuuguagcgguuauuuuuguaugaucuaguaacuugcaaacagaccaaauggaugagaggcggggaccgugcagcugucggcugaugaggaggcggccgccccagugcugauggagaugccacuuucgugugacugcgaacauuaaagcacaaaaaaauccaac

SEQ ID NO: 13565 - RNA, 9378 nt, Homo sapiens
ucguggggugggggugggcguuccgcgaggggcauccucccgggcggacguugggggauucucgggggagggaggggcgcggggcgggcgucccggggagggaggggcguugcgcgcggacgcgggcggggccugggccgcuccguccccuccccccgcccgccccccgcgcuuccucugcuuucgguuucgcuuccgccuccagcgcgagccccgccgccgccgagcauggacgaccccgacugcgacuccaccugggaggaggacgaggaggaugcggaggacgcggaggacgaggacugcgaggacggcgaggccgccggcgcgagggacgcggacgcaggggacgaggacgaggagucggaggagccgcgggcggcgcggcccagcucguuccaggugcggccccgcggcgcggaagaggccugggguccccggcgccccccgcccggcugcguggacgggagacccccccaucccgggcggagacaccuggagccuccuggagcucccgcagccccggggacccccccccagaccggccgacccccagccccagggcccggcggggaagugcgggggccgcgcgugggugacagcggagcugagccucccgggccccaucgugugugggcgccguuccccccgggggugccucgggcgcgucccgcccccagccgccguggccgccccugauggaaccccucccgccucgggcccgcgccucggccuccuggcggccccugcgcaggccccgcggccuggggcuggggcuggggcuggggcuggggcuggggcccgggccgggucuggccugggaggcuucgcgucugcaccugcgggagcccggggcgggccgacggggccuccgcuuguuacuuuuguuaccgccgggcgccugucaucgccgggguuacuuuuguugccgcgcugggaacgccacacugucgcaguccggccccccugucggggagcugggauugaucugggagcggccuuccagcugagcugcccggguugcggagggccgggaagugcauggaacucgacggcuccgcauggauucuccccuuggcacccagcacuguuugcguuugcgccuggccaugguggagcgggcagugagagagcacggaggggcuccgcccugucgccgggagggcagcggccaggcaggcugggcagggggguggggucuggcucugucccacaggacggugugaccccugggugggcucuugacgggcuuuccucacuggaguuccucaggccgcucuccugaagcggugcucagaggcccugaccauccugccaggcgcccgugaccccugaccucuucccucugccuccugcuguggcuucuguccacaagccccuccccuuccccuuuggaccccucaggccuccccagcugccugcgcuggacccuggcggggcuguuucacuuuuuccugggcagugucauguaugcaccugugggcugacuguguggccacauccagucaggacccagccuccagaacugacccagggaggcucccgcuggccccaggaaggagaaguagaaacugaugaucaggcggggcgagagaaccacaccagcggcccuguugagaaaucaggccgagaggucgguggcgguggcucaggccuguaaucccagcacuuucggaggccugggcagucggaucaccagaggucaggaguccaagauuagccuggccaacauggugaaacuguugucucuacuaaaaauacaacauuagccaggcgugaugggcaccuguaaucccaguuccuccagagauugaagcaggagaaucgcuuaaaccugggagguggagguugcagugaguggagauugccugggagguggagguugcagugaguggagauugccugggagguggagauugcaugaagcuccaucucgaggggaaaaaaauaagaaagaaaaaucaggcagagaggcaacgccaggucccagcuggagcucagcggggagccaggggauacaguggcugaccgggccuccuaaccccccuucuagcacucccccaggauccugggucccaauuguugcccuggacaaauacgcccauuccugcccuacccaccgagugaggcucagccccaggccccccacccucaucacaaggucagggcugugucccaccauccucaucacuagguacuuccggcccuuugcucagccccaugaugcuuggccugcagagaugggggcugaagggcuuggggcaucaaggggaccugacaucuugcugagaagccaucacuagacagggcuggaggcuggagacucagggccugcccucaccguggccagugaggcgugggguugggcagggaaggggcauucauucauuagacccugccagaagcaccuggguccccuucuggggcuacagguggugaggccacugcccccaagaacacagccuggugacuuuaguguacaaagcagggggagucuccaggggcacagaacagaggcuaaagccaggguggagguggccagcaggccuaggaggaggagagggucagggccacaccccaggggaggugcaugucagccaggggccacccuaagguggaagccaggagucccaaaggggccuagagaaggagcagccccccaccuggcuaccgcagcccucucugguucugugcaggguauugggaugcguuacugaggcccaaaucugccccacugggaacccccaaaaaagagccagggcaggagaaugagagggaggagccaugaaacccccgcccuuuaaagacagcucuguggcagcuggcccaggcccugcagcccucaccacguugggacucacuugggggucucccauggggguccuaaucccaucucuuuucuucccaguccagaaugacaggguccagaaacuggcgagccacgagggacauguguagguaucggcacaacuauccgguacguaccugccccugccccgggacacagaacccucccgccagcugcucuucucaggcagaaugucccagguucuacuggaaggcuggccuggcuugcugugccagggccacaguucugggcaggacccugccuggggcacagccugguauagauucagagcccugcccuuccccucucgcgggagaccgggggcaucccccuacuuuucugagcuucagcacaccgucgccuugcaaacauggccauagugccagccucgugaugcacacgugugggguccgugauaccgcccacacagcaccccacccccaugccagcccugucuccugcagguuguccucagccauuacccuccacaccccugaaucacggaaaccccugugcugccuucagggugcugaggaggggaccugccaggccuggccuggcuggcgaaauggggaaggggggucccuggggcuuggaggcagcugcuguccucugaauggcccccaccugcagagugaggagccaggcgggcucuugggguauugggccagccuggagguuugcagaugcgccuccccgaaagacacggagggccccagggcagcuugugucugauggaucccugcuguccccuuucucuggcucuucaggaucugguggaacgagacugcaauggggacacgccaaaccugaguuucuacagaaaugagauccgcuuccugcccaacgguaggugccucacaaccacuggcagccggcgcuuccauccuugccuggcaggggugguccacugggcccugguuugggauguacccggcgauuaccagggccacggcuuucaaauagccccacagugcccccuggaggcggccagagggacuccaggauccccggcuugggaucuccgcagugguguuugggucggggugggcuaucucuguaaagagccagagacugaauaucugcagcuuuucaggccacacagucucuaucaaaacuacugaacuccugcacgaccucaugaaagccacauguaaaccaacgagcuaaggauagcuuuuauauuuuuaaaugguugcaaaaaauuaaaguagaggccgggccugguggcucacgcuuguaaucccagcacuuugggaggccaaggcggguggaucacaaagucaugaguucgagaccagccuggccaauauggugaaacccugucucuacuaaaaauacaaaaaaaauuagccaggugugguagcgugcgccuguagucccagcuacucaggaggcugaggcaggagaaucgcuugaacuugggagguggagguugcagugagccgagaucucgccacugcccuccagccugggcaacagaaugagacucugucucaaaaaaaaaaaaaaaaaaaaaaaaaaaaagaacaguguucuauuacuuugauauuauaagaaauuaaaauuucagugucaauaaagcuucacgggcacgugcccacaccuguuuaugcacgugccgggcugcaacgugaaacagagacuggguggcugcacaaaacacugucaggcccccaucucaggagacugugccugccacaucaugggacuggguucagcugggggcuguguuugaggacagauuucuguggcugacgggccacgcuuuugcaggaggcacugaggcccccuccuguacagacagguccuggucgaggaccagugguucccccagagggaccuuccgggcucucagugggguuugccgccagccagcaacaaggguccaggucacagauggcagcagggcaagggcugugcaucggaggagggaugggcagccccacugagccuagcacccugaagagccucaggagaugagggcgaggaauagcuuggggaagcugcuggcagcacucucuccuuaugucccccacccacaccccguccuccugagcacgggcaggguggcugccacagcugacuuguccccauggggcucccaggcuguuucauugaggacauucuucagaacuggacggacaacuaugaccuccuugaggacaaucacuccuacauccaguggugaguuggggaggauggggggaugggggguuggcgaggccacagggggagggcccucccaggcaggagcccucccgacgcugcuuccuggcacggacugagcacucccugcccuuccuggaagcugguguccacauuacacggauggacauuacuggacaugcaagggccgcugagggaaggcucaggucuguccccaaucugugggcucuuggugaccagggagacaggaagggcugcacacaagcucccugaaacaggagagggggcaggcacugccugccagaggggcagccuuagugccaggaggccucagugagccucaaggggcggcccccgucucggacucagcuggggcaggguccuggcguagugcugggaugagacuuguggcaggcgucuuggggacccacaauguggccccggaaacagcaugcccugcuuuggggacagcucgcugggcguccacagggagccucugcuggugugugacgugucaugagugacaacacaagagagggaagagugaggaguagaaaggaaggcccuguccgcccgggcuggauggcugcagggccccucgcugccugagucaccuccccaguccugcugagcaugcaggcugugacuuacgcaccacacaccuccuguccugggcccuugcacgcucaccugagcucucccacccucgcuccuccaccuagccacucccuccuagaguugagccugggaacccagaggggauuggaacugccccgggcuacacagcgagcaccugcccaaggucuggaagcggcucuccuaaucccuugccugagcaucucuucuccugcaggcuguuuccucugcgagaaccaggagugaacuggcaugccaagccccucacgcucagggaggucgaggugagccaggccuuggcugugacuggaggggaagauggggaggccugggcaagccacgccgcugcagagacggggucgccucuggcaguaggcauuuggugcccccucaggggucccuuggaaggcagaagggccgaaagagccuccaguaugaugaccuucccuccccagugguccucaccccaccaggcaucuagagaaacucaauuuccgaggcuguuuguccccaugcgggagucuggggcugagccccugagagacccggaguggcgggaccugccuuucucaccacugguuuaggcuggaguggggucacccaaguguggaagcugccccugagggaugcagggacuuagagagccgaggggccccuccuggcacuuucccauggccagcgacuuccucucaggggagggcggcagccucaggcccuggugagagcucggagcagcucagaggagagauggaggcaugagugugucucuugucacuuuacccuaaaagucugaguccaggcuaggugccguggcucacguuuguaaucccagcacuuugagaggcugaggcggguggaucaccugaggucaggaguuugagaccagccuggccaacgugacaaaaccccguuucuacuaaaaauagaaaaaaauuagccaggugugguggcaggcaacuguaaucccagcuacucgggaggcagagguugcagugacuugaggucacaccauugcacuccagccugggcaacagagcaagacucugucucuaaauaaaugucugucugucugucugucuaguccaggccucugagugagucgggacccacggccacccccacacucaggaaccggggcuucagggauggugccugagcucuccaagggggucuuuuccagguguuuaaaagcucccaggagauccaggagcggcuuguccgggccuacgagcucaugcugggcuucuacgggauccggcuggaggaccgaggcacgggcacggugggccgagcacagaacuaccagaagcgcuuccagaaccugaacuggugaggcccggcugcucccgcccacccccaccccggcgcagaacagggccacgucagguuucgggcaggucacagagcgcugcugcagacggagaacuccagggcuguuugggcaauggaccaaggcccugaguccccuccuugcugccuguagagccgggcggucccuccccgauaggguuggugagaagguaaagaaugcucuuccugcacccaggagguggcaguccacauagagaagcaagcaggggugauggagaaccugcaggcgguacagccaguucucacaggguguucgaggcgccuguacccugcaggggccccuuguggcucucauccagccagcuccuccccaccagggggacucgggguacagccacccucuaggugaugcgucagcaucccccuaacccccgugugucuagggcccacaggccauuuucacagggauggcaugaguccuccccugggcccagagagguaaauggagagagagacugaaucgugggccaggguggggagaccucguggagccgggugggagggcaggccagggcggggugcggcccagcaggaggggccccagccauugaccucuccugacccggaucucucgcaggcgcagccacaacaaccuccgcaucacacgcauccucaagucgcugggugagcugggccucgagcacuuccaggcgccgcugguccgcuucuuccuggaggagacgcuggugcggcgggagcugccgggggugcggcagagugcccuggacuacuucauguucgccgugcgcugccgacaccagcgccgccagcuggugcacuucgccugggagcacuuccggccccgcugcaaguucgucugggggccccaagacaagcugcggagguucaagcccagcucucugccccauccgcucgagggcuccaggaagguggaggaggaaggaagccccggggaccccgaccacgaggccagcacccagggucggaccugugggccagagcauagcaagggugggggcaggguggacgaggggccccagccacggagcguggagccccaggaugcgggaccccuggagaggagccagggggaugaggcagggggccacggggaagauaggccggagcccuuaagccccaaagagagcaagaagaggaagcuggagcugagccggcgggagcagccgcccacagagccaggcccucagagugccucagagguggagaagaucgcucugaauuuggaggggugugcccucagccagggcagccucaggacggggacccaggaagugggcggucaggacccuggggaggcagugcagcccugccgccaaccccugggagccaggguggccgacaaggugaggaagcggaggaagguggaugagggugcuggggacagugcugcgguggccagugguggugcccagaccuuggcccuugccggguccccugccccaucggggcaccccaaggcuggacacagugagaacgggguugaggaggacacagaaggucgaacggggcccaaagaagguaccccugggagcccaucggagaccccaggccccagcccagcaggaccugcaggggacgagccagccgagagcccaucggagaccccaggcccccgcccagcaggaccugcaggggacgagccagccgagagcccaucggagaccccaggcccccgcccggcaggaccugcaggggacgagccagccgagagcccaucggagaccccaggccccagcccggcaggaccuacaagggaugagccagccgagagcccaucggagaccccaggcccccgcccggcaggaccugcaggggacgagccagccgagagcccaucggagaccccaggcccccgcccggcaggaccugcaggggacgagccagccgagagcccaucggagaccccaggccccagcccggcaggaccuacaagggaugagccagccaaggcgggggaggcagcagaguugcaggacgcagagguggagucuucugccaagucugggaagccuuaaggaaaggagugcccgucggcgucuugguccuccugucccugcugcaggggcuggggccuccggagcugcugcgggcuccccucaggcucugcuucgugacccgugacccaugacccacagugcuggccuccuguggggccacuauagcagccaccagaagccgcgaggcccucagggaagcccaaggccugcagaagccuccuggccuggcugugucuuccccacccagcucuccccugcgccccugucuuuguaaauugacccuucuggaguggggggcggcgggcagggcugcuuuucuuagucugauaccaagcaaggccuuuucugaauaaauucauuugacuuugagucuuuggu

SEQ ID NO: 13566 - RNA, 7642 nt, Homo sapiens
uuuggucauucuugaaaucaaagagaaaccuuuauuuucaacaaaacugcccagaagagaugguucauugauccacuaggaacaagucucuuaccacacacagcaccaaaauauauauuuaaaaaauuaaaaaacacauagcccccucacacgcaucccccaaaagccacacaacccagaccaaagggaaaacaaaucaaacucaaugcccucacacaugagccaucuuugaauuaggauuuacaaauuuauauauucuuuccuauggaaaaagaaaaaaaaaaaaacacaaaaaccacagggguaaggaaaaacuuguaggugaaggcccaaugucugccuaagcuaacagaaagcagaaucaugauucgugcuuuuccuguauuuugagugggaugcagccuaacagcacagcccuccgugguagaccgaauccuucagcagccagaggcccccgaacacuggaagagcaaaccgcaaccuuccagauucuucagcgagugccagagugcaggcucugcaucagacugccaaagagacggcagcuuuccuugcaaguuuuccacugccuacaaaggccauuuuucccuauaaaaagaugccaggucaaaaaaaaguacaagggagaaaaagaguucucuacugcaguaagaaucuugcagucgcaggcugaucugaggcaagucccacgacgcagggcugguguuggauccaccacgcaagcgcaggcgcuacuugggcuccucaaucacacccuugcugaggucugucauuuugggauauuuuacuuucuucugguccagcucguucugagcccaaaguaguaguuucaguaauuuugccaguuuggguguugacucgcgauuuucauaaucuagcacagcuugguuaacuucacuccacaccuagaauauaaauacaucugauaaaaaccaccauacacgcagagcaccagcagagucuauuaaaaagaggcaguuuaaacaaacauuaagcucuuaacugcgagacacucucaggacaugaaauacauaguccuugccuggggaagcucacagucugguuguuaaacgucacaugcaaccucgauggcaguuaagugccaugagcaagccuugaacaaagugcugaggggacugggagagagguaagaccagcguagcaggacauaccagcacccuccucacaagccucaagaaaacaucucaaguggacucuaggacaggccauccuuccaagacagcguagggaggacagagcccccgggagaggacccgggggaagagggaccugggucugggaaggcgaggagcugucauguucugccagacaaaaacauagcagcgaggagagaaaaguuucagaagacaggauuuuaaaugagaaauacuugggacauaaacagaaagaagguucagauaaauauaagacaccagcaaagggugugaauacuguguaacgaucaccaaguccguugucccuaguuugacaagauaaaagauuaaaagccagagagaggcugagcaugauggcucacaccuguaaucccaguacuuugggagacuggaucaccugaggucagggguucaagaccagccuggccaauauggugaaaccccaucuccacuaaaaauacaaaacuuagcugggcgugguggcacacuccuguagucccagcuacuugggaggcagaggcaggagaaucgcuugaacacaggaggcggggguugcagugagcagagaucucgucacugcacuccagccugggcgacagaacaagacuucaccuccaaaaaaaaaaaaaaaagccaugaaggaaccacuuagcaucccaggcacagaagccaccugucucucaguccacacagcaaagccacacacuuggcguugucacgaagcccccucagagcacauggggaauggaagaaagcuucccucuggcaggccccaccuucugccucugcaugguguggaggaggucuccgaagggcgacuccucgggacugucaaaggccagcagugccaggguacgcuccaucucugugaggcacucucggcucuccucgcccugcuccgccagcugagucugugcaaacuccagcgccgccucugucucccgcuggcggaucagcucgaucaaaugcuguugcuggaggcagagacagacaagcuugacccccacacacccaggccagggacuuagggcaggugguaccaggucccaaucaaaaguacaucacagagggaagacuuuucuugcaucucugaguuaucaaauuugcauuuuuaaaacaaaaaaccgcuucugaacuacauaaaagagcaaacucaaaccucucccccucacaugcauugaaauaacauuauuaaagcaaauuagccuaguuauuucucaaucauugcaaauaacuuuaacuuaucaaguauucacaaaccagacuacucucuccugaaacauaccugcaaauggaaguaaagauaccgguuuguguccaagagcucuggguggaggcuguugaucaaggcgauggccuccugaaucugaccuuucaguaucaucucccggaucuugauucguucaucaaguguuuccagauccacacuagguucgauuccagauuccauucgaaacuucuccgcugcuuccuuaaagcccucugaauagaaaaaccaucuucacugcuaggaaaguuagcaaggaauuaaggcaaagacuuuguaucuccagaaacuccaauugccucaauuaauaaccucugaugugaaccacacuuucucaggaacucgguauuaauaucuuuauaauuuacaaguuaugcucucaaaauacauauagaaaaugagaagaguauacuucauuccuuguuaucccauccaaaaacucuaacccauuagccaaagaggucagaauggcugcuggcccaguguguuggugugggcuccuuugagaggacagauaauagguccagacgccagcagccgcagcucuggugccagguuaggcaagucacacuggcucagccuccacagcacaggggcccuccauggucagcuauaccugcaguggccuguugacucccaccucuuaagagugucuacaauuuuucaaagccagcaugugugccccuuccccugccccugacauaauuauaggccuaaauuuccucuucaccuuccaaaaauauuuuuuuugagauggggucccacucacucucccaggcuggagugcaguggcacaaucuuggcucacugcaaccuccgccuuccgggcuuaagugauccucccaccucagccucccaaguagcugggacuacaggcacaagccaccacauccagcuaauuaacauuuuuuuuuuguagagacaaggucucacuauguugcccaggcuggucuggaauuccuaggcgcgaacaaucuuccucugucucucaaagugcugggacuauaagcaugagccaccaugcuuggcccaaaaaaguuucacagagauuaauuugggagaaggaacuggggacuaacaggagggagauuuuucaugucaugucuuuuaaaaacaucuauuuucuugccauauacagcacugcccuuccuccaguugacaucaagaacagccugacuguuauuucccucugcacgcuucugcucuuccccauucccauccucugaguugggcauacuuuccagaaacaggccagcauauuuuugcagacuggccagaagagaucaacuauuuaggcuuucaauauacuuacuucacaacagucucaauuauuuugaguaacuguaaaacugucaaaggcugaaaaauggguuuguguuaggucucagagaccuggaaaaaucucaucuucagaaaaggcuuucacaugauaacuuccaaacuuaccagguuagcauuguguuuucauaaugucugaacacaaauaacuacgucaucaaaccucagugcuacagcacuccuuauguguucaaaaagggagaaucacauucaugcaacagcauccucacuguaagccauuaccugugaccagguaguucaugaugaggcgguucaugucugcucucuggacaugcaaguuauugagcuuuuccauccacucaucuuucgugauuucaucggguuuuucugcauaacucauucugauuuauuucuacaggaaaaaaauaacagcugagggagggguuuagaugcuccuccaagggcagagggcagcgcuggaagagcugugagccggagaaucccacacugagcauguacggaaagacaacgcugccgugggacacccaccagacugagaaugccaaugcuuagcaaagaauaaguucacuucaacuuuuucuacucugguaucaggagaacggacugugcuacaaaaacaaucugguacuccuuacaaagcugaacaugugugcuccucacaacccagcaauucuacuuuuaauacauuuauauucuagaaaaacucaccaggaugcaccaaacacagacaacgcuguucacagaagcaccguucaaagcggcaggaauguggaagccacccaccugagcguucauucaacagcagcguggaccaagggacuguggcgcacagaacugcauguuuaaaacccuugggcagauggguuuuggaauucagaauucuucaauguacaacgauuauuuggcacaauuuaccauguaacagccucacugggguuugggggcacuccccaucaucagacguuauuucuucacugaaauguguuagguaucuauacuaagugguagaggcuauuaaacuuuaccuggugagguuuuggccaccaaauagguuaaaaacaaaaccaaaaacugugguuucagagauguuuagauuuuuagcauugcugagaagggacuguggucauguauucacacaagagaauuucauaaagcaguuaaaauaaaugaacaugacacaaagucaccuggaugacucucauaaaacaaugcugaaugaaaaaagagaguugcggccgggcgcgguggcucacgccuguaaucccagcacuuugggaggccgaggcgggcggaucacaaggucaggagauccagaccauccuggcuaacacggugaaaccccgucucuacuaaaaauacaaaaaauuagccgugcucgguggcgggcgccuguagucccagcuacuccagaggcugaggcaggagaauggcgugaacccgggaggcggagauugcagugagccgagaucaugccacugcacuccagccugggcgacagaacaagacuccgucucaaaaaaaaaaaaaaaauuugccgggcaugguggcagaugccuguaaucccagcuacucgggaggcugagguaggagaauggcgugaacccgggagguggagcuucuagugagccgagauggugccacugcacuccagccugggcgacagagcgagacuccgucucaaaaaaaaaaaaaaagaaaaaaaagaaaagaaaaagagaguugcaggagaggccaaaucugccgugaguuuuaucaggaacaacaagacaaaauacaugacaugugcuuuagcaacaaauauguacguggcaaaccuauuuuguuuguuuuuuuuuaaauaagggcaugaaagcugacacucaggaggggguuaccugugggaggggcaaauggcugaagccccagaggcagcuguuccggcuuugggagaauggguggauaccugagacaggcaggggcacgccaccguccacucugucuuucucuuuugccacugauacauacguuacacauacuacuuuauacgaaguacugcuaaaguguuucaauaaauuaaaaaacuuuggucucuuggcugaaaaugggaugaaugcaggguggugagaucugagcagccagucccuuagggagacacccaagcgagagagaacaucggcagaagagauggagagcaaggugagaucaagaugcuuuggccagagucaauggcugcugcuagacagauuaccggacaaaagagagggaagaauagaagauggucacagguuucaagcaugagaggcccugcaagauggggccacaaauaaggaggaaggacuggaagaagaacagguuugagaagcagggcaaguuugacgugacuauuagacaugcgucuggagaaaucaagcaggugucugaauuacagauccugagcucagagcugaaaacaugaauuagugaaauaaggggcggggggggcggugcuggggcacagggauauuuaaagccaagaauucagcaaagaccauaggaagagcguagauagggaaugagaaucgccauuacuuggaggaugccaaccuugaagguaaagcagagaaaguggcaccagcagaagaaaacuugauguggagcggcagguaaaguggaggagaaaccaggagucgcugucacacacgaacacccaucuuucguugucaacugcaaaacucacugagaccaacuuuuuauucacgacaauuaaugguaacuuaaggacucauuuucuuuuucuuuuuuuuuugagacagagccucgcucugucgcccaggcuggagggcaguggcgcgaucauggcucaccgcagccucgaccuccugggcucaagcgauccucccaccucagccuccagaguaacugggacaacaggagcgcaccacucugccuggcuaauuuuuuuauuuuuagcagagaagggagucucgcuguugccacggcuggucucgaacucgcgggcucaagugauccgcccacuucgaccuccgccaccgcgcccggcccuaggaccaacguuaagagcucccuaggaaaaggcaccuuuucucucggcccauucggugaucggcacucacagcgcuuccacuccgggcaguuacgugcgcccaugaaaagcaacaacuuuguagaacuggccaguccuguuagcaggaagaacucgguagucucaaacuccagcauaaaaagauucagcagaagaaaacacccgugugcugaagacuccuacuuuccaugccacacuuuacauccucacccgcucgguuucugcuuuaaagcagcagauuuuauuaaaaagacuucguuacggacgucgcuccuccacagagacagcuaccgccgccccucaggcuggccgggaccgccccagaacaccagcgccugaggccgcgcgccuggaggcugagcccugacugcccccugggcaccggcgcggggcggccguccgggccuggacucacugcgcgccccaauuccgcaccugccagcgccggcgcuuccaaggcccccagagcgggggcggcgcgcaccccggccacaucccgccugcccgcccggcccggccccgggagacgcucggcccggccgcccgggcccgccgccgccaucuuaccgugcggaaccugccucccgcgcugcgcggucugggcggcugcggcuccgcagccucuccugggcuggggagagguggcggccgccggggcgcccgaguagaaggaggcagaggugggggccgcggcggaggcgggggcgggggcgggggcggggagcgggagggcaggcgcaccggaggccgccccucagcaccucucgcgacagcaagagagcgcgagagcgcgagccgaugaccaaugaagcgcccccg

SEQ ID NO: 13567 - RNA, 2766 nt, Homo sapiens
cuggaaaggccacuuggcccugugcugagugagcggccuucauuagagcgaggcagcccuuggccgguggggacgcagagccccagcagguggugcacgacuguuggcggaaggaacgcguguucauccucagugaucugcccuccagcaucucggcagcaucucauccuccaucgucagcuggcucugccgauguccugcuucuguucacucacagaacuguccccugcuccguggugggcaggagggaaguggugcagggcugcgugcauugccugcgagucgggacaguugaugggcacauggccuuguagcucugggcacagauguguuuggauucauugcagcggaccaccgggcacuguugaccccacugagcagugcuaaguguugguuuaguggauguucguggaauugcugacccauccaagggcguccuuuggagccaguggagccugccggcgcaucugaggggcagaaugcugcuagcacuugaaucugggaucucgccuuauucucaaguagcaaggcaucucgacaagcauggucuaggucugguggccagcuugccaguaccugagccggucgggucaucugccucugagggaccguccucaccgagcuccugcaucccuugaguguugaucaggaggcguccacagcauuguucucgccucugaaugaugcuucuuucuguguuggagccuggcgaaguuguguuuucaagcccucuacuucucuuuccaguggguaggagcuuuuggcaguguuuacuuuaccuagauggcuuauauaauccaguaagagaugcaaagauaaaauugcugcgguuguuacagaagcauggcggccuccagacugacccauugguugcccuuuagauuuuguaaggaugcggugcuggggagguggugcuucccuacccccuagaaaugcugccuuccaacuaccacucucccagaugugacccuugcgauuauuuccucugagguuugaggaugaagauaaguuggagggaaagagaguaacuaauaggggaugaaauauagcagaagcuagaagaaagcggugaggugagagagaugcaucugcacguuuucuucaacagcaccaggugauucagcauauuccuaauuaccuuucacuauucguguauauaagaucguuuacuugcauaauauaucaucaauuugacauauucuuaaaacuagagggugugagaagcacagcaauaggaagucucuccacaaacuaggggaacacaaauggggucauucacgugccuggacugucacuauguggcugucacgugaagugcugguguugauuuccauuucagccaguggguagcugauaagccagugccagcauccagcaugagcagaugucggggagacugggaagucuccagcguuacugcucuccuucccuucaugauaagccagugccagcauccagcgugagcagacgucggggagacugggaagucuccgauguuacugccugccuuccuuucgugugaggggcugcacuugcuuuucuugugaucuguuaguggacgaggucuuccaaggaagugcuuugcacacuuucuuugcuccuuuuuacagucuuugucuuugcagcaagcaaaugaaauuaagccacuuugggauaaugaacauucaguauaauucuacuuugucucauuuuggaucucacuguugucuuuauaaaaauggcacauuuuacaaaguaguuuauucuuauuauacuuucugcuggagagugccuugaaauaaaaugugagaguauucugguacucuguguuccagaugcaugaaauugggugaggaauaaccccuagucuggaaucuuugugaagcauaggguuauugcaaggcaaaugggaacuaacacaucuugccauuugaaucagggucuccaguuucuagaaaaggcagacacugguugggaccaaagucuccauggcacaugacugaagacugguggucgugugugugcggaguccacggaagccucggggagguggagcugcuccuuccauuccgucaggacgugaucugaaaacauguagagaagaugaguugaggacagcuuuucuaaggcaaugugaugucuuugcuuucuuauuucucuuucucugcguuguuaguuuugaagaguggaggagcuaggggcuccagaaagaaucuuacacauguguugaagacauugaugucauagggagcggggagcugcauucccuucugggcuguuacugcuaaaucucaguaugaacagaccaggcggaaagcuugguggccaagcagucugugugcuuccccgcugauggagaacguugcguuguucacaauagggccucauggguguagccgcauggcagacccauggcuggcgcagcugccuguugccgucugucuucaguaacugcugcucuguuaacuguucuauucugauacuacgcguguuguuuuuuacaacagguauguuuuuguuucagaaauauguauugcuuuucucauauuuuuugcaaauuguauugucaacaugggucauuuaaaguccuguaugaaccauaaccugcugugguaccuuuguacauguuugauucuguauucuuuauuccaguguggcauaugugccccucuguaucuuuugagaagugcggaauagguugcuucuaccaccuguucuuaauguaacaguaaaaguuuucacauuuuucucagaacuguuaucuggaagcucucuuuuuuccuaagg

SEQ ID NO: 13568 - RNA, 2766 nt, Homo sapiens
ccuuaggaaaaaagagagcuuccagauaacaguucugagaaaaaugugaaaacuuuuacuguuacauuaagaacaggugguagaagcaaccuauuccgcacuucucaaaagauacagaggggcacauaugccacacuggaauaaagaauacagaaucaaacauguacaaagguaccacagcagguuaugguucauacaggacuuuaaaugacccauguugacaauacaauuugcaaaaaauaugagaaaagcaauacauauuucugaaacaaaaacauaccuguuguaaaaaacaacacgcguaguaucagaauagaacaguuaacagagcagcaguuacugaagacagacggcaacaggcagcugcgccagccaugggucugccaugcggcuacacccaugaggcccuauugugaacaacgcaacguucuccaucagcggggaagcacacagacugcuuggccaccaagcuuuccgccuggucuguucauacugagauuuagcaguaacagcccagaagggaaugcagcuccccgcucccuaugacaucaaugucuucaacacauguguaagauucuuucuggagccccuagcuccuccacucuucaaaacuaacaacgcagagaaagagaaauaagaaagcaaagacaucacauugccuuagaaaagcuguccucaacucaucuucucuacauguuuucagaucacguccugacggaauggaaggagcagcuccaccuccccgaggcuuccguggacuccgcacacacacgaccaccagucuucagucaugugccauggagacuuuggucccaaccagugucugccuuuucuagaaacuggagacccugauucaaauggcaagauguguuaguucccauuugccuugcaauaacccuaugcuucacaaagauuccagacuagggguuauuccucacccaauuucaugcaucuggaacacagaguaccagaauacucucacauuuuauuucaaggcacucuccagcagaaaguauaauaagaauaaacuacuuuguaaaaugugccauuuuuauaaagacaacagugagauccaaaaugagacaaaguagaauuauacugaauguucauuaucccaaaguggcuuaauuucauuugcuugcugcaaagacaaagacuguaaaaaggagcaaagaaagugugcaaagcacuuccuuggaagaccucguccacuaacagaucacaagaaaagcaagugcagccccucacacgaaaggaaggcaggcaguaacaucggagacuucccagucuccccgacgucugcucacgcuggaugcuggcacuggcuuaucaugaagggaaggagagcaguaacgcuggagacuucccagucuccccgacaucugcucaugcuggaugcuggcacuggcuuaucagcuacccacuggcugaaauggaaaucaacaccagcacuucacgugacagccacauagugacaguccaggcacgugaaugaccccauuuguguuccccuaguuuguggagagacuuccuauugcugugcuucucacacccucuaguuuuaagaauaugucaaauugaugauauauuaugcaaguaaacgaucuuauauacacgaauagugaaagguaauuaggaauaugcugaaucaccuggugcuguugaagaaaacgugcagaugcaucucucucaccucaccgcuuucuucuagcuucugcuauauuucauccccuauuaguuacucucuuucccuccaacuuaucuucauccucaaaccucagaggaaauaaucgcaagggucacaucugggagagugguaguuggaaggcagcauuucuaggggguagggaagcaccaccuccccagcaccgcauccuuacaaaaucuaaagggcaaccaaugggucagucuggaggccgccaugcuucuguaacaaccgcagcaauuuuaucuuugcaucucuuacuggauuauauaagccaucuagguaaaguaaacacugccaaaagcuccuacccacuggaaagagaaguagagggcuugaaaacacaacuucgccaggcuccaacacagaaagaagcaucauucagaggcgagaacaaugcuguggacgccuccugaucaacacucaagggaugcaggagcucggugaggacggucccucagaggcagaugacccgaccggcucagguacuggcaagcuggccaccagaccuagaccaugcuugucgagaugccuugcuacuugagaauaaggcgagaucccagauucaagugcuagcagcauucugccccucagaugcgccggcaggcuccacuggcuccaaaggacgcccuuggaugggucagcaauuccacgaacauccacuaaaccaacacuuagcacugcucaguggggucaacagugcccggugguccgcugcaaugaauccaaacacaucugugcccagagcuacaaggccaugugcccaucaacugucccgacucgcaggcaaugcacgcagcccugcaccacuucccuccugcccaccacggagcaggggacaguucugugagugaacagaagcaggacaucggcagagccagcugacgauggaggaugagaugcugccgagaugcuggagggcagaucacugaggaugaacacgcguuccuuccgccaacagucgugcaccaccugcuggggcucugcguccccaccggccaagggcugccucgcucuaaugaaggccgcucacucagcacagggccaaguggccuuuccag

SEQ ID NO: 13569 - RNA, 15821 nt, Homo sapiens
cuugcaaagcgcaacguagccggaagcugguggcggcuggugggcgaccgggcgcauccucauugcagugcggcggcccuaccucggcccuggccugaccccggcggcccugcccgccccucccuccagguaagcgcgcggcucggcggcgcgggcucggccugaggccccggcugccgcggcgucguccccggccuucgcgggcggaccucccugccgcagccuccuccacccggaccccgcuccacccugaggcugcugccccagagcuugggggcgcccacccugaccucccccaguucccucggcgcugggcggcggggcccuucucgcgcggacgccccgcugcagccgccccuccgccgugccgccccccgccccucgugcccccuuccguacgaagcugcccuccacccgcaccccggaucuggaaucucccaccgguuacgggaguccagagggucccugcccacgcacgucgccucccggggcgcgagcaggacccugccccguccgcuucaacacccuuuucccgagcuccuucggacccaggacucggccuggacacaucccagucagguggccucugaagcccgguggggcuuccacccccuaagaagugaggguccuaagaaggagauauauuuuuacaucuugguuucaagcguucagaguuuuugcguuauuuuucaagauaaacuauauuuguacuuuugaagguuaggagguauuugcuuucguguuacuaacuuuaacauuucagggaacuagggcucuugaauauucaaaauagucacguagaggaguuccucuuaaauccaagccaaguccuuuccuuuuuacacacucucucccuccgguaguucugugaguauccuguauguuuuacaguuagaaauuccagccgucuccucaugguucugacuuuuguuugccugugucuguugaccaauacauaagccccgagggcagacguggugcuauggaaagaguacaggaccgaguauggcgaccaggauuggucucguccugcuuuggcggcucaccuccucuccgugggccguggcuucugcaugugccgugguucugcacagggcccucaguggcugcugugacaagaaugugucccgaggcccuuguaagcucagucccgcucccugccccgccagggcaccucuccccacagguuuucccuauuccauccucagucggcuguauagguggaugcucaguuugaugacgguauccgccugaaugagucaugcuggggguccaaguccugcggucaggagugagcauucagaugucugccucaugaucugugguuccuggacacucuuacagaaggcacagaauuauggagcagaagggagcccagggugaacuuuugguuuuguuuugaugaacugcagaaaacagguguuuauuuccuaacuuugaauagguuuaaggugggcacuggucaauacuaggagucaugggcuucagaauuuagaaacuuuggccguguggaguugggacccccccccccccccccgcccagugaauaucuuauuucuggauacuuaagauuagaaaugaaauauaagacagagguuuuuguuuuuuguuuuuuaaaagcucugccuacacugugaauaggaaagcuggucuacacaguccucuuaaacacagugaaggagggaagggcuggcacugggaaggucagcaguacacacguguguagcuucccauggcuuacagaguucagcguguucucuguguagugagagguagagggaacagcacacggcuccauucauauugagagguggaugagccucagacaacgcacugaggcaugggcuggcagggauccaggucugcugccuccaggcuggacuaucuucuacaguuugcucgguggcguggugugcagggccacugggucauucccccuugacgcugggguugguaccaccccuuccuccggcuuugaaucuuaacuauaucaauuuuccugguccugaauuagaugggccaccaguugaaguuguacuuugcugaagcuaggagagcugcagagacauccauagguuuucucuucacccuaaaccuuguugcugcugucccaguaggguccccgugagucacuguggugggggcugauggucugaagccacucuccuuguccugcagcagccacacugucgcccccaugccucagaauggccccagaaggaccuacugcaggucccccagcaggcuggacuuuccacacacuccaggcagcggggcacaggcgggagccucccugcacugcguugggaaggugguggggaggguggagcgcagagucccugggcucccugucguuggcagugaucagcccaaguguggugugucgccuuuuagguggaaaaucgaauuuugcagccaaucuguguguauuuuuaaagacuaccccuugcuguggauuucaccauuagaagacaggacuuuuuauaacuggugcagucuuggugaugaauaagcuuaagcaaagcggcagcaguaaugauauggucuuccugaucaucgcccuggccgcagccugggagccuccuggggguauggggaacagauccuucaguaaguggucccugcggaccccugcugcgagugguccugugaccggggcuuccaagcagcucaacagauugccccucagguuuucuguugugugguguuuuuggacagacguuauuuucuuuuuuguagaguagccuguuuguaaguuuaaaguguuuauuuuucuccuuugcagcaucauggccagcccaagaaccaggaagguucuuaaagaagucagggugcaggaugagaacaacguaagccucugccccccaccccccgcccuaaggcuuggucagggucagugaguuccgggaaguuguacucugagccuguaguucugggacccuccugcaguggauggugguuggcguggcucuggacgugcauggcuugugcuggcugguggccuggguggccggcucuuagaguggugccauuucuggcgcucaucagugcuggcugucgggggugggggcgccuccacauuucucaggucacucgcucuaaggacagguccgccucgucuucccaucugaacauuuuauuacacggaggcucuuuccccucacgccuugcccugacccacacccccggccacccugggcagcccucugcauucgcuccuugaggccaccugucgggucuuuggggucccugggcucugcccugagccaccuggugagucacuuguggccccuuugcagguuuguuuugaguguggcgcguucaauccucagugggucagugugaccuacggcaucuggaucugccuggagugcucggggagacaccgcgggcuugggguucaccucaggucaguguccugccgcucuggcucugcggagagccugcggccaccccagcaucuguuccugacaccagaggugcugacgccagggaagcuugggggccaccucccauugcauugccaguguccacucuagugacgccauggcacagaguuccagcugcuggccacucagccucccugcggcugcugcuugcugugucuaauucucaggacgaugcuggguggagggugucccuggguguccccggugcugguugaucugcucgauccucugcuuuccagcuuugugcgcucuguuacuauggacaaguggaaggacauugagcuugagaagaugaaagcuggugggaaugcuaaguuccgagaguuccuggagucucaggaggauuacgauccuugcugguccuugcaggagaaguacaacagcagagccgcggcccucuuuagggauaagguagagaugggcccgauucacucuugcccaugguguggggcugcccugccguuuguggcagcuggacuguggccuuuagugguucuggagucgguucuucugcugguucugacacacccacugggccacacacaacuugccgcccuggagcagaggcuuccugcccagaggggaggcaaauggcuugcggggggagacagaccuuccccgccuccaggggagaaagcagcugugaccguuuauugccucugugacauguugggcacaguguuucuaagaagucuggaggccaaauaggugggucccccuguguuggaaguuggagcugcaccaacuaggagcuccccagcacuguuguucauuguaaagugaguccuggccucgcauccacaccuggucugugcaccugagcaggggccgucgagggggccgggaggaggcugcggguggugggugcuccaggcgggccguggggggugcgcuggagucgacggugcccgagggcaucgccaggcgccuuuaugcucucgaaugcccugugucuccuugucagguggucgcucuggccgaaggcagagaguggucucuggagucaucaccugcccagaacuggaccccaccucagcccaggacgcugccguccauggugcaccgguagcugcuccucguggggccuuaguacaguuuccacuggguccugaacuuaguagauuggguuucccacagaauucuccccuucuuugcuguugugacagcucuuuucccagaagucagugggaaaaacagcuuuuuaaaauugccaaaacaauacaagcuuuuaguaaauuuagacacccauagagcugucucagauagcgccccagguaagcuccgcacgccuuccaggugugcacacagccgugucugccguggcgcugugggaguucacaucuccaucugcucacggggguguugucugcccuuccccagaguugcccaucugccuguggcacuggcccuggcacccuugaacugaccccgucauggaugcgucccacaucccacugcaggaacgucccggguggggugacuggguagcacgaggccuccccaccucaucuggagcccuguaguccugccacauccacgugcuucugacggaaggcuuugcacugcgggcaacuccggcuugauuccaggcccucggcccucuugccucaccucuccccgcugccuccugccaacagggagagugcagagcccacuguggaggccucucguguugcccaugaggcuggcauugcugggguuucagcaccugagcccgagcagccacucagagcugaaggccacccuggccucaggugcucucaggggugacgugaaggcacugcccacguaggccacaugguucugggggugcuucugggguuaccucagacuucacccaguuuuggccuuaccagccuucgauucucgguuucagagucucuggccagccgcagagugugaccgccuccucggacaaggcuuuugaagacuggcugaaugaugaccucggcuccuaucaaggguaaggacuugagagcuggggacgccuggcgugggccaggcccacaggguucagucugguggguagggcugcuucccuuggggccucccaugugcagugggugugggacccaggcaugcgcggugcagggucugauugcagugagucccagccagcccagugugaauugggggucuuggguguauugcagugagccccagccagcccaggugugaauuggggggucuuagauguauugcagugacccccagcugcccaggugugaauugggggucuuggguguauugcagugacccccagcugcccaggugugaauugggggucuuggguguagagaagcgcuaacacuuagaagaaaagcauaacacauuuucugcguggaaucugcuggaccuauaaaugaauuuuuauccccaaagcugucauauuaaguuguuuugauccuucuucuaguacuucuguggcuggcuuuggggacuugcuggggacccuguggugauguggcaggagggucuuuuuaaaugaucagaaagcacaucucucugcugccacaggaggcagcgugcauguccugugcguggggacguuggcacgucccccagagccccagccuugccuguguucagggccccacgcccucgggaggagcaggguucaugccagcaucuucggccucuuguccgcuuuguuuucagggcccaggggaaucgcuacgugggguuugggaacacgccaccgccucagaagaaagaagaugacuuccucaacaacgccauguccucccuguacucggugaggacuuggcccugcagagcaucucccaugggcagaccccgcccugagggcacgacgggccauagugggcaguguggcaguccuggaacaugugcucuuugccuuguucugaucuaaggaccccucccuuaccuucagcgacguuuucuuucaaaaauguggcuuaaauuuuucagaucccaaauguauucaaucacuuccuuuuuuuuuuuuuuuuuaagacggagucuugcuuugucgcccaggcugcagacuggagggcaguggugcgaccucagcucacugcaaccucugccucccagguucaggugauucuccugccucagccuccugaguagcugggauuauaggcaccuacuaucacgucaggcuaauuuuuguauuuuuaguagagauggguuuucaccagguuggccagguugguuucgaacuccugacuucaggugaucuguccgccucggccucccaaagugcugggauuacaggagugagccaccgugcccggccaucacuuacuucuaacacaaaauguguguauuucaaaucuaacaacagccauucuuccaaggaacccaaggacucugauggcagccacuuggccagguucucugcagaggggagugcuacaugcauugggaagcuggcucugugcuugggucucuggcagcgcugggaaguugcucgggugcugccugaggucacucagggccauuucuggucuggggaugccuggaagcuccaggucagauguucagaguaugacacccugggcuuguugccauuuugcuauuaacgggaauacauuuuguuccacuuucuuuuuccaaggaaauuuuuaccaucuuuaaaaaaugauuuuuguaggugugauggcucacgccuguaaucccagcacuuugggaggccaaggcgggcggaucaccugaggucaggaguucgagaccagccuggccaauguggcgaaaccccgucucuacuaaaaaaauauaaaaauuagccaggcgggguggcaugugccuuguagccccagcuacugaggaagcugaggcaggagaauugcuugaacccgggaggcggagguugcagagagccgagacagcaccauugcacuccgaccugggcgacagaguccgacuccaucucagaaaaaaaaaaagauuuuuauucauugcagcauuguuguccgugacaccagcaaccugagccuuuggccacgggggcugcuuaaacgggagcuugcgcugagagccaaggaagggcuuauuuuguuuuuuguuuuuuuguuuuuguuucuuuuggagacgggucuugcucuguugccagggcuggaguacaguggcauaaucauagcucacuguggccuggaacccugggcucaaccauccucccaccugggccucucaaguugcuuagccucccagaguucugguauuacaggcaugagccaccaugccuggccagaaagggcuuuuuaauaacuagcaugacaagaucuucaaagucuguuaacuggaaauaagcagguuuaaagcggaugucuucaucugcaagagcccccaaguguguggagcuuccagucgcucgggguggccugguugcaccucuggccgcugacggccaugguugcuagcucuugcagucauugcuacaucuuuagggaagaaaagcgcauuuuuccagccugugugugggcuucauuuuuguggcccuuccuucugcugccuuuugcugggaagcugcucucuggggaaggcagcucagcuuggugaucucucaagugagggucccuuugcacuuccuuuaggaggaagagggugaguugugauugaaaugagacguuuauuuuuuuaaauagcuuuaauuaucuugagaggcucagaaggaaacccugagcauagaugaaggagagcagguuacgcuggucgugaccccacacgccucaccucugccuguuccucuagggaggcaggagggagcgccggccauggggagggguccugcccugcagggugggcuugcuucuugaggguggugggagccacgggaggcugguuugcgcuguguugggagcacugcaguuggcgagguggggguagagggugcguuucuguugugcccuggguccaguugcacuccuccagcagccuggagaagcaggcgcgguggggucaggaugggacgggggccuggggcagccucugccuugguccucuuccuugcugagauacucugcucagcgccggguuccugggucccaguccugauguggcugcucuuugucgccucccucagggcuggagcagcuucaccacuggagccagccgguuugccucggcagccaaggagggcguaagucacugccccugccaugccaccguccccaccaggcccucgggacacuggcugcugcuggccugggguucugggagcugcagaagggaugugggacacagaggguuucugggugcuguaaccaugggcugugccaacgcaguaccagccagggugguccugagaccuuggagguucugcaggaacacagcagcccaggcugucaggagcugcuccugugucagaccagcugcuggcaaaggggucccgcccugaugaaagugagggagaugugagccccauugauuccuagacuccacccuauccaagcagggcaggucuccggcacccugugcccuggagcuucuucuggggcucaagucguguuuugagagcgauuucucucuuucgccugcuccucagccugaaaugaggggaggauuuggggcuuucgucagggcagacagugaagcaugaggcagagacccaagagcaggccugacaccaggauggagcaugggcccccgggggcugggcugugguguuacaggagaaggggaagcccagagcagggcagcgcggggcagcugggugccugcagcugcccgcagaagcagccaaggcaccuaggguggggcucuugugaguggaagucacggugcgcaccugucagauguccccguggucacccuggccccgugucuucccccgucacagcgcucaccugucacaugccccuguggucacucuggccccgugucuucccccgucacagcgcgcaccugucacaugccccuguggucacucuggccccgugucuucccugggagaggaaggccugggagggcccuggaaggggcagcaggccagguguccacgcuccagcucccacggccccgugacuuugccgagcgucagcuucugguucccgccagggccgccguuuucucgucugcacgggagggcugcggccuggggaggcccagguaccuuccagccagagugucacgaccgggccuuuucuccuccccccgagcuuuaaagugaccaaggugccuggacugugcugggcauggagccguccccacagcaggguagauggggcuggggcgguggcacuguccauugaagauagcgcugguguggcuuccccagcccgucuucugcuccagcaggccccggcccuguccugaagucuggaggaugggguuggcccugcuguucccuggccuugcacgcugcucacgugugcccucaccccaauagcacaccgagcuggccucccucuagggagaggccagcauuugugcuaauccagucucugcugcagcucuucugggcaucucagaguuauagggcccgcccagagccgcuggcagcccgggggccauugagagacaguccuggaccugagucugugggcccugaggaaggaugccuggcagcccauguuaagucugucaagccuugucuuuguuuuucauuuuaggcuacaaaguuuggaucccaagcgagucagaagguaacagaggagaagcuucugcacccuggugcaucugaaacuauccugagucugacgucacgugcagcaccugaagcugccugguucccucuucucaggccacaugcucagagcugaggggucccagcguagaaggggguguuccugccaugcuguuccccuccucaugcccggguggcugccucauggacccacucagggccugcagggccaaacucguuuccuguucacugguagcugguaccgguguguggccacugcagccggccaccuuguugggagcaggacugcccggcuuggcagauggcccacgcuggcgguggccgcucagccagaagggccgcugugguuggugcugugccugcggcacacuggacgcgucugcacuucgaggcaacggagcgucucuuugcucuggccagggcuucccccagucggggcaguguggccucaggccuuugcauguuuuuuauucuuuaggauguggguaggggccccgcgguucccacuugguggucagggcugugaucuggcuguccucggguucagaaucacacccaggaggcaguacccaugugaggcucaccaugaaagcucaggacugcaggcguggagcugugcauggcucuaggacgcgccuuugcccccugggcgaggguguccuuucucacgaggugcccauccgucacccccguggcccauaucaccccuuccucucugagggagucuccccacgugcccacccccagcugcagggacgcccaucuggcuuuuucgugggccucccaggguccugaggugcagucgcucgcgcaguuucugaaggugguggucaguuccagggcagggagcggcugcuccaggguuguguugcugagagccugcccggugcugccuuaguguugcggcaccccaugguggguucgaaggcgcugcugguuacuaaugccgccccucaccuugcucucuccucaccugucuucuugcugucggguaaaguuuuggggucacaagcagcagccggagccgguaaagcccgugucugcucgugcaugccgcccgcaucuccgccgagaaugugcuuggcuuccucugucccuccugcgugcugccacugucuugugucaccucacaugugcgcacgcucagacccucucccuggccucgguccguggcucuccuuuaagauccaggaucugcaucaggcuuggcugugugugccugucaccccugcgcaguaccacugcgcuccccccgggcaaaaaaaugagacccccaucuccaaaacacacagacccccaacgcaggccugcugccggggaggugcuggagggagggcgggggcacugggcgcagagcugcugagcaggguuuccuggccaccugcgcucccuugaacgcagugcaaaggggaggaucuuugcucugugacgaguucuucccuuuccggccuuugauccgugcugcucccugccuuugggggaagaggaggccucacaccacauccccagguggccguguggccucgacuccacugacccaggaucaggagaggcugagcuccuuucucagcagcuucuuccuauggccccagccuccgugcccucuucccuccaggggggacucggugccugccuggggaggaaggagaggcguugcaggucagcaugggguggcugcagccggcguuggccucaggcacaggcuccacagggccuguucccaccagcccggcccggcagggccgcaugguggcgcgugagggaggacccuggagggggaccuuccugcaagaauuggugggggccgcggucuccgccuucuagagguggcggccuacugcccuucggguguugugugcaaagccccguuuccugcucccugcgcuuguauccugcugccuucccuccugcuggugaagcucgugcugcccuuugcuggccugugcugccacugccgacccgugucccgugguggagcugucguggggcucacgugacuucccuuccuacaggcguccgagcugggccacagccugaacgagaacguccucaagccugcgcaggagaagguaacgggcagcuccgggugguugugccuggagcccuucacuccaggggacgugggugugucagggguguuagggggauuguuuguccagcagcugggacucagcgaggccaagccucacaccccaccucuccagcacaggcguccuccucggggccugggcuccucuuggaccccccagcuggucccuuccccuggccuagggccucccuugcagugcccccagcccagcacccccagcccaccuccguuccucugccucaccccuacagcuggccccagagcccagcacccccagcccaccuccguuccucugccucacccccacagcuggccgcggagcugugcccagaggaggcucugguaugggaaugaugccugccauccuagggggucaagagccccgccagcucccugccuccuucggggccugacugggacaaguggggaagacccaccuggggcagcgugggcuguccuuaggucacguugcuauuugucagcaguggccggcaggggccacguuugcagacaccaggccucacagugacaugguuucuugaugcuggaaucccuuuggggccacuguagaacuuucuggggcucagccugauggguauccacaugccccugauauuucggaugcccucacccgggggauuccugcacuccugaagcuuuaagcuuucaucucucccgcccccauuaaugccgcugucuucauccgugcaggugaaggagggaaagauuuuugaugaugucuccaguggggucucucaguuggcguccaagguagggagccugccagauacgcgggcacagucgaagccagucuccauauuccacggcccugggcgugagagcagggugugccccgugcagcccucagcccagcuuggcaguggccgcuguccucugagacgggaggagagcugcccagccugacagcccgagggauauggaaacaacuuggcccacugcggcccggucagccacuaacugucacuucucccucugcucuuaucuugcugcugcuggccuuuuccucgguaaguaagugccagcgccgucuuugcugccaucagucccacugcucugcgggccauuuggggcgugcauuuuguccuguuuccuggcaugaggcgcucugcggacagacggggagggaagagcaggccucgcuccucccccccaagcauguggugggagcucuugaggucugugcacgaggcuguccucgcugccaugucccgcacacaccuggcaccgcugcagaguggccggggcgucugugucuguacgugugugcgaggcaccccuuguuucuggauuuugccugggucuucucagcgggacggcgcgugccggcuugcgugugggggccuccugaagcugccugugccgcgacagggccugccuaaccucucuucccgucuccuuccagguccagggagucgguaguaagggauggcgggacgucaccaccuuuuuuucggggaaagcagagggccccuuggacagguaugcuguguccccuccugggccuugcaucccacuccccugccuuggccacuccuccuacaggcucuccaggagguggcuggcauccuugcuggggagggaaggggcacuguggaggcucuccgggagguggcuggcauccuugcuggggagggggcacuguggagccucuccgggagguggcuggcaucuuugcuggggagggggcacuguggaggcuuuccgagugcucugcagcugcagaggccuguccugccugucucugcccugcugugugcucuuuggaacccugcaggagcugggcuccccaggcuagggugggagggagggucucacccauaugcccccacguaggaggagcuggcgcugcucugcuguuccucugucucccagacucuggguggauggagcaggucgggggccaggggacaggaaggcuagggccccagagaccuguccugggccccauguccagcucugcccuuagugcuuggcaccccagucgcuucugcuggaagcuggcugcuguucucggccucugaccccaacaggggaaccaccggggaucucaucgggccuggccuugugcugucuacugagaggccagcccuggugggcacagaugcacugcccacuaggugggcccaaauuuucccugcagacgccaugucccuucucucccucuguguaugugguuuuucaguggugugauugcagcugaggacagagggcagggccagaucuggggccagcguagcugagggcgucgcucgggagggccugugucccggcuugaggccaagcgccccugccccuccccacuugacuaaaccacuguuuuauugcagcaguuuggagcugguagaaaaggaaguuuucuguaaaacuguccuccaguuggggugguugauaaagagugggcccugguucuccagcuccccagcaguuuccucugcucugaagcgggagaaacagaucccaccugguggggcugcuguggacccugagcgcuggccugggaaggcggucacuguccaggugcagagcucucgggggcacagaauucccagugguggacugaguaacagucauuuagagucccccuucugucucuuuaaaagccccucggagggccacaguuaucagaacagcggucuggaccacuuccaaaacagcaacauagaccagagcuucugggagaccuuuggaagugcugagcccaccaagacccgcaaguccccgagcagcgacagcuggacgugcgcggacaccuccaccgagaggaggagcucggacagcugggagguguggggcucggccuccaccaacaggaacagcaacagcgacggcggggagggcggggagggcaccaagaaggcagugccgccggccgugcccacugaugauggcugggacaaccagaacugguagggcccacugcgcccccguccccagcgcccccgggcgacuucguguuugcacucugcccucgucguuccuccuccuuccauuugacccaagaaucagcaacugcagugugaggacagcgucucgggaggcaggacccuagggagacccgggugugcgccgccugcgcguggggagucuucggugcgugggggcggcuugcuguccagccugugugggggccgucccgucccacacuccccugggcauucuuggacucaaggccggggcucugcguggcuugcugggaggugggcugcagcacagaggccugugacugcguuccagcggccaguucacuacgcaguaucucuggggccugggaccagccacgugccgagcugucagcgacgugaggugucccuucucguugagauauuuaacuuugguuuugcucuaguucuuucuuuuugaagagagugacuggagugguaaagauggaaaugcuggaaaugauacuggcgcucacgcugccauccgaccacccucggcucccgaguccacgccugccugggccugugcugucagacccgcgucggucguaacccucuguggcuccccugcaucagcaccgucccaccaccaaguucaccagguucaccagacacggccuccacaauagccacacccacaccugagcuguucucagugcuggaacuugaccauccuggaacacccuggaagaaaaaggagcgcagggugg

SEQ ID NO: 13570 - RNA, 7636 nt, Homo sapiens
ggcuuacugagugcugugugcgugaguggguuugugcacaggccgccagugugucugugaggggcaggugacggugccaccccgugccuacauaccacacauccaguggggucaacaccacggucugccugggagucagcacuggucauuuccacaaacccaagcugggacuagggagagaacugggccuuuggcucuucacccugggagggaguccaggggacccaggcaggagacacacagggcucaggguuccucacccagagccuccgaggcuucuacccacccuccugugccguugucucucuugagaggccagggacacgugucacacugcacggggaacgucagccccagcccuccgucugcacgagucacacugcacggggaacgucagccccagcccuucgucugcacgagucacacugcaugggggacgucagccccagcccuccgucugcacgagucacacugcacgggggacgucagccccagcccuccgucugcacgucugccuggugcacgaacaugugugcacgccagggccugaggcccacagccagaggcuccucgguccggcagaccggcaucccuucgaguuggcgcucugcagggaggaggggcuggccuggcuggagcccagagcguugggucacgugaggacucagggguggcaucuguggauggcgugcagcuucucccgcagcguggcgaaggagggccguuccucggggcugcuccuccagcacuccagcaugagcacguagaccuccgccgggcaggcagccgggcgcggcagccgguacccucgcaugaucugcugcagcgucucgugguuggucaucccugggaggcgcggggcaagagcugccucgauucugccugggggucccuauggaggaggccuccuguagccccccaugucaucugccugcccuuggccagacccuccaaccccuugccgacagcguccaggcccggggccagugacuccugggcagagccugcauccucccucuggcugccuggggacccaccuucauagggacacuggccauaggugaaaaccucgugcagcaggacgccgaaggaccagacgucugacuucugggagaagacacgauaauuggccgccucaggcgcuguccacuugaccgggaucuuggagcugcugcucggggaguagaugucguccugggggcgagggaaggccccugguagggcagguggaccgggguccccucacccacccccucugggucaggggcccagagccuccgcugaccuugagcagccgggccaggccgaagucagccaccuugcaggccaggccgucguccacgagcacguuccgggcggccaagucccggugcacaacgcgcugcuccuccagguagcucaugcccucagccaccuggcaggcaaagcccaggaguggcggcagacgcagggcccggcccucgggggcugcaggagacagcgcggggucuuuuagggcacggggccaacggccggugaggccagcguccacccacgucaccuucccccaugccucagccuccucaucucuaagacguggcgaggauggcauggccggcuaaggccacgggaagccccaagugagacagggcgaggguccuguacucaccacagugacccggcagccggcccaggcccccgacaaagaccagggcagagaagagccagaggcugggcugggucuaugucacauuagaccaaggcuggugacccagaugggaccgcgccccccaccgcccccgaacaccagcuccagccccggagccacaaggcucuggccuggcccagaccugacgccagcccccuguuggcuggagaccagacagggaugggaucugcagccggggccaccugcucccgguagagaggcccgguucaccucggaaaccccgcagguucagcucugcgccaggagggaaggggcggucgcaggcgcgucagggccacguggcagcagggaggggacucacugcccaggaaggccugcagguuccccuugcgcaugaguuccgugacgauguacacaggcuccccgcccgagcacacugcgugcagccggaugagccgcucgugccgcaggcccuucagugucuggaucuccuuggcgaggucagugagcuucauguuggcugcgagagaggguguggcuccaggaccggcccacgccacgaacaucacugcccuggggcuugaggguuggacagcaggugcggggcccggccguggcgcaggaucucggggccucaccugacuugaugaccuugaucgccacgggcagggagcccagccacaggccuucccacaccuccccaaaguagccuucacccagcuuccucccaagggcgaauucggaguguggccgcucccacacguccugccucggggccuucugcagggagggugggcagggaggcuggucagcgugggccccugugcucugucccaggcacagccccccacaccaggccucuggcgggcaccccuguccccagcacacacucaccccacccuggcugggacaaaggggagugggugccaggcuuggaggcccggcccagccccgugggagcucauugcucugggggccuaaguggcaccuuugccccagccggauauccgucuacacaugcucauuacugccccuggccgcgcugucauuaugagaccagagaaaccagacugcugcccuggcccucggcaggguggcucacaucggggacaguccccgggauccagugucuccagcccaggugcagcaucuugugaucugccucuccucccacaccuuccgcccuuggggccuggggcagccuugagugccuuccccaaacuggccccacccuccuggcugcuccccugcagagcugggcacugcuacaggucuccuuuccccacucccagcccccuaggaccccaggaaucccaacaacccucagaggcacccgcagagagcagaaugugcuggaaccgcugggaugcuccgaugcucccaggccugggcagggcccuggagcugcgccucugacagccccagggguuuugugacgggguggggaggagcaccuagaacagggccaugccucgggcccagcauggggcagcuuggcaggcacaggcccaccuggggcaugcagggcugcagcaggggguucuggaucagcuuccaguuggccuuguaguaggugagcagcuccuccaggccgggaaagagccgucccuucugcagguagaggcugccaucagcugccauggagacccgguaguggcagaccuuggccugggcccggacuaggaaggguucagagauggagaccccugccuuggcugccagcugccccgacccucccaccccagaggaugcuggccacaacccacuaaggggucuggcucagaccuagcuggggacccugagauggucagagcuguguggaggagggagugugggcagccacaggcuggggcggggcagcgagagcggcccagguuggagcuuuucugcugacggugugcacagaguaggcacuuaauaaauacuuguagaaugaaugaguccaugagucagugaaugaaugaaggaauaaggaaggaaagaaggaaaagugaaugaaugaaugaacgaauaagcaaaugagugaaagaauaagcuagugaacaaaucagugaauaaaugagugaauuagugagugacgaaugaacgagugaaugaguggaugaauggaugaaugaaugagugaauuagugagugaggaaugaacgagugaaugagaugaauggaugaaugaaugaaugagugaauuagugaggaaugaaugaacaagugaaugagugacugaaugaaugagugggugaaugacugaaugaaugaauaaaugggugaguuagcaagugcaggaggugaccagcauaucugcuguugggcccucaguggcgccgggugugaaucaggagccagcacugccuagagaccaaccaccccaaggucaagggccacugaccuggugggggacagaggcaggaggggccgccccagguaccugacagugaguagcccccgaggcugcucucgcugggccggaugaggaaggccccugguucguuggguggggagaggagcagcugcugugccuggguccgacugaccccgcuaaaguaccagcugcaaacagcaggugcggcagucaccuugcaggccccucagccaguggccccacaugcucuccuccguguugccggcagggcugagcccggcugucccaccgccucagggagaagguccaccccguggacuuugagucccagcucaaggucugcacugccucagcccccagugccggccucauccuccugcucagcccugagcauccucacguuggccgugggcucuccguuagcccugcugggcgugaccuccaguucccuguucauagugaccgccagccccagccacagguuaacagucagcccuggccaugggccauaggccuccaaacucggcuucgcugagccccugcacagacauggagcugacggccuggugagcugcccggaagcacugcugggcugucguggcuguacagggccaugggcaucaccuggcugggcacggcccaccugccucaggcaguugguuaguggagggggcccaugcaagcuguguccugaggaggcagccuaagccaggcugugcaggaggucaggaggggcagccagugggcggcugcagggggguugcugugcgaacguucaaagcauccugcaucccaugcuggagaguugugcccaguacaggacggcccuaagcccacuggcgucuguucgcacagacacccccucggaaaagccaggugcaggugagaccucucugaacacgguggcaggguggcagggagcucccaggugcccacuccucagaugcccacacacgaggagcccacaccgggugucgggagaggggccggcugggucuccccuguccaggugggccgcccaccaggucacaucuacucauuccugggagccggaggcauccuuggaaggaagacagaaaugcucccagccccaccccgucugcauaacucugcugcugaaguccaaggcggggacuccacaccugacucagcuucccacccuggagccucccacuuccuggagcuuccugggacccggagagggaugccugccacuccccugccccagggcacaccccguaagcaccaggaggaagaagcagagugagccggugucaggguggggcugaaaccaccugggaagcgggacuaggagaggacccgaggugggccucagagucaacacaagauucggggcuggggcacggccaugccauccuggcagacugggacugggcaagacggaggacacagucuggcaccccugccccggugaccuagggggcaaugggggcagcaggaauagaaacugacaugaccagggccguggggcugggcuuaaguugaagggaaugaagauggagacaggaagaggugugggaccagggacagagaggcagcggccugaggcacugacuccauggacgcucuguccauggagcuccuccugcagccagggccccugccuucuggggucugcuggcagggagacgcaacccucucacguguaaagggacucaggucccucccagcaccgugggguguggggaugagacacagguguuuccccaaaacaucgccagccuccucugaagcccacaucagggcuugggggucagaggugagccccugugggauccugagaugcagaggaugugucugaggucucucccuggggcguggggccaggugucuggagcuaaugacaccugagugugguuagucuuuuaaucuccagccuaggcaaauagucauuagcuuugccuauggaccgcccugcuccaccacgagcccugcccuccaggaacugcugaaggggucuguccuccacaccuggggugacugugagccccuucccaucacaaaggcugcuugccccccaaccacugcucaggacaagcggggcagguguggggugagggccuggggccccucagaaggccccuuccugugacuccggcuucacccgcccaugcaacccccaggacgaugugugagugccaaagggcccccaggaggcuggaaguggcccugagcaaggcugaccccgaaggucuccagggcucaggccuugcccagcuggaugccagaccaaggcagccgcucagagcagccgcacugggcaucuggacuaggcgccucugcaaccccugcucaccugcccucacccagagcuccuggagcgugggccccugucucagcccccagucccagccccugcucaccugccuucacccagagcuccuggagcgugggcccgucucagcccccagccccugcucaccugcccucacccagaguuccuggagcaugggccccugucucagcccccagcccccagccccugcucaccugccgucacccagagcuccuggagcuccugucaucuggugccucccagcccccagccccugcccuccaagcagugaccgauccaugaacacuggacucccugugugagggcgggagggccuggccagccaggcaggguccuggaggaaccgccugcuggguguccagcuggugcagcugaugcucccccccacaggaccugaccacgccugccggagccuccucucccucucggcagcccacagcggacacugcuguuuuccuaccacaccugccggcccggggcccaucagcugucccugaaugaaugcguggaugaacgaaugaaugaacagauagccacggacaugcgauuuccaacucaaaauccugccguuguucuggacuccccagcugggggcgaggcaggcucugacuccgaggccgagguacucacgguuggucugagagcgucucaggagaagccuuggccacgugggugaugggcacgagcccggcgcugggcuggcccgaaagccugcgugcgaagauguagccgccccccucuucgagggcacagagccuguccccgcggcggacacucagcuccccgccacaccgcgccgugaagucauagagcgcaaggaagagcugagggaaggggcugcaaggcucggcggggagcgugggcacugggucaguguugggguccagggacccgggggugccaugguccggcucgccgcccgccggccagaucuugucccagaagaaggacaggaaggccagccgccuccugaggaacggcuccaucccccggggucaccacgcugggcccgagggccaugggagcccgcgagcccggaagaggaacuggcagggccggugggacccgguguccagcgcucccugcccuggccguggggugacaggggaccccggcccugcggucacucagagguccccuggauccaggaggcacacgguucccaccggcguccgggcuggcguuggggcuggguggggcgcagggcggacccccugccucaggcacaccgacagcaccuccuguccucgaccuccuuggcgucuggagugcaccguccccuccccaacccgacggcagagggcagcuuggg

SEQ ID NO: 13571 - RNA, 15167 nt, Homo sapiens
uggccucagucucaccugcuccuucugucgcaggcuucgaaccguggccaacaguuccaguggacugcguggacccgugagcucaggagccucagacgccucccuggagagccaagcugguguucgagguggcgccuccaggguccacccugcugcccaacagccccgcggccaccagagggccgucccuggcccggcugugugcccugguggaccugugucugggcugcucccgcugcacccagcggcucaaugaaagcaccuacguccuccguaggguggagcaugacugcucccgcgagauccugcuggcccgcuuuaagcaggccaccaagagcaaggucuggcgcguggugggcugccggcccaccuucccaaggccccugugcuaccaagucugccacuacuacagcccugggcucggcugccggcgccaccgaaaccggugcaccuuugcccgcagucgcgaggaggcccuggucuggaccuucgagcgucagcacaaccuccagcgccuauggcugaaggcggaggugcagggcagcggggcccagggaggggcaggccgggcggccgacgccauccuuacggaguuuggcggccgcuucgagcugcuuugcucccucugcuucaggcgcugucccccaugcaucugucgcguggacccccaggggcagugcccugagcacggagccugccccucccuccuggcccacgugagcgccgagggccgccgcaagcaacaguuugugguggugaggccgcggccccgggccggccagccuccugccuacugcagguuuguggggcgugggcagccgugcuggcguggggagucccgcugccaguuugcacacagcgccguggagauggcugugugggaggccgagcagcuggguggccuccagcggggggaccugcucacacccccugccccugauggcgacgggcgcacggccccccuuggccagcccccuggggcccagcuguacugcccggccugcuuggucaccugccacucucaggaggccuucgagaaccacugcgcauccucggagcacgcacagaugguggccuucgaccaggcccugcccugggagcaccguuccccacccccgggacucuccaaguucgagcucugcccaaaguaaggauacucgaggcaggagcuuggaguagggcaggagcccaccauaggcagaaccagagguucccaggagcuuggaguggggcaggagcccaccacaggcagagccagaggcucccaggagcuuggaguagggcaggagcccaccguaggcagagccagaggcucccaggagcuuggaguagcgcaggagcccaccacaggcagagccagaggcucccaggagcuuggagcagggcaggagcccaccguaggcagagccagagguucccaggagcuuggaguggggcaggagcccaccguaggcagagccagaggcucccaggagcuuggagcggggcaggagcccaccacaggcagagccagaggcucccaggagcuuggagcggggcaggagcccaccguaggcagagccagagguucccaggagcuuggagcggggcaggagcccacuguaggcagagccagagacucccaggagcuuggagcggggcaggagcccaccacaggcagagccagaggcucccaggagcuuggagcagggcaggagcccaccguaggcagagccagagguucccaggagcuuggagcagggcaggagcccaccacaggcagagccagaggcucccaggagcuuggagcagggcaggagcccaccguaggcagagccagagguucccaggagcuuggagcggggcaggagcccaccguaggcagagccagagguucccaggagcuuggagcggggcaggagcccaccacaggcagagccagaggcucccaggagcuuggagcggggcaggagcccaccacaggcagagccagagguucccaggagcuuggagcggggcaggagcccaccacaggcagagccagaggcucccaggagcuuggagcggggcaggagcccaccguaggcagagccagagguucccaggagcuuggagcggggcaggagcccaccguaggcagagccagaggcucccagguucaguggacgggggccucccugccaccugcugagggcuaaagccauguggccucugaggacccggauaagggagguucauguuugggaacugcuugagccaggccuugucccgggagcacaggagugggugggacgaauaaagccccugcucccuacagaggccaguauugggcugaggggucccggccuuugaacucagcacggcggcugugccucuguguagcccugcugaccucccugucccccaggccugaccucugugaguauggggacgccugcaccaaggcacacucagcacaggagcugcaggaguggguccggcgcacgcaggcuguggagcugcgggggcaggcggccuggcaggacgggcuggugcccuaccaggagcggcugcuggccgaguaccagcgcagcagcagugagguccuugugguaagugggcccugggagugggugggguggggugggguccaggccucuugcugaaggcuagacuuccacgcagcuggcagagacccuugauggagugcgugucaccugcaaccagccccugauguaccaggcccaggagaggaagacccaguacagcuggacguuugccguccacucugaggugagcggagaacagcuccgacugggcggagggagcccuggggaaguggugacuucagcccgggcagacgucaacagccugggucauggagcuaauaccgaggcacugccgcucagcaccugcgugaccugcagcaggucccuuagccucucugccucagucuccucaccuagagacagggggccaggacagucccaccuuggcaggguuauucuauggaguauauggguuaaaacaaggauuuggccaggugcggugguucacgccuguaaucccagcacuuugggagaccgaggcagguggaucaccugaggucgggaguucgagaucagccuggccaauagggugaaacuccgucucuacugaaaaaaaaaaaaaaaaaaaaaaauuagccaggcaugguggugggugccugugaucccaucuacucgggaggcugaggcaggaaaaucacuugaacccaggaggcggagguuguagugaguugagaucgcgccauugcacuccagccuggcgacaagagugaaacuccgucucaaaaaccaaaacaaaaacaaggauucaccagggucuggcaccuggagaguggguggugaggccucaagcugcccacacugccccacgggacauccacaggggccccaggaggguucagccacccccauguagcacaggaagaaacugaggauggcagaggccggguggccugcuugcguucuauccaggaaguggcagggccaggaccugaacccugcacuugggcuacgcuggccaggcugccucucgggaggguuggggggagcccugggccccccucaccgucuggccuccucuccaggagccccugcuacacguggcccugcugaagcaggagccaggagccgacuucucucugguggcucccggccucccgccaggccggcucuacgcacggggugagcgcuuccgugugcccagcuccacugccgacuuccaggugggagugcgugugcaggcugccucguucggcaccuuugagcaauggguggucuucgacuuuggccgccggccggugcugcuacaaaagcuggggcugcagcugggccaggggcgucgcccaggacccugcaggaaucuggcgcucggccacccugaggagauggagcgcuggcacacuggcaaccgccacguggugccuggcguggagcggacggccgagcagacggcccugauggccaaguacaagggcccugcccuggcccuggaguucaaccgcagcagcguggccucgggccccaucucaccaaccaacuaucggcagaggaugcaccaguuucucuaugaggaggaggcggcucagcagcagcugguggccaagugagcugggggcaacaggagcagcugggguagcaggagcagcuggggcaaugggagcggcuggggcaacgggagcggaugggggcguggacuuggcagcggggcuggcagcuguggccccaugagcugacccaggccauccugccaggcugacccugcggggccagguguuccugaagacggcauugcagacgccagcgcugaacaugcucuucgcgccuccgggagcacuguacgcagagguccccguccccuccucccugaugccagacacagaccagggcuuccugcugggccgggcggucagcacagcccugguggccccuguaccugcacccgacaauacgguguucgaggugcggcuggagaggcgggccagcucagagcaggcgcuguggcugcugcuuccggcccgcugcugcuuggcccuggggcugcagccugaggcccgccugguccuggaggugcaguuccagauugacccgaugaccuuccgccucuggcaccaggcaguggacacacugccugaggagcagcugguggugcccgacuugcccaccugcgcccugcccagaccuuggucugucccacccuugcggcguggcaaccgcaagcaggagcuggccguggcgcucaucgcgggcuggggcccuggggaugggaggcguguccccccgcuacucaucuauggccccuuuggcaccggcaagaccuacacgcuggccauggccucccuggaggucauccggaggccugaaaccaaggugcucaucugcacacacaccaacagguaagcccgagccuggccugcccccaccucaccugacgcccggcccaagucuacaccgggcaggcggucacccccuggaugugcuccaguccucugauucugcacucccuguagccgaccagcuuugggcuuuggcuuuaucaggcccagcucagggcaccgaggguggccgggucugcugucaggugaggagcugggugccucugccggggcccuggcccaaggagagugucacggggaaggcugcagcauggcccacccaggacuucuggggaugagucuuguuuuucguuuuuauagaaacacagaucuuuguccuaaccacaagguuccccuuugguuuaugugguuuccucugguuccugccaccaccaccuccccaggccggggccuucccaucccugcccaguggggagugggaggaagagccugggacaguggccauacgucccgggcugauuucuggauuggggguucuggggaccagggaggugcaggugucugcagugucagaggagccgcugggcucgcccagguguugccugaagcccuccguggccucuugccccuuggacuccugacaggagggacaccaguguuugcugcucaccucugacagccagacaagggcugugcucaggggcagcucggcugggcacacaguaggugcuuuagcggacagcacugaggcccccagcaagaagcccaugagcuccucccccucccgcagugccgccgacaucuacauccgggaguauuuccacagccacgucagcggcggccaccccgaggccacuccucuccgugugauguacacggaccggccgcugagccagacggacccagucacgcugcaguacuguugccugaccgacgaccgccaggcuuuccgcccgcccacacgggcagagcuggcgcggcaccgcgugguggucaccaccaccucccaggcccgugagcucagggugccggucggcuucuucucccacauucucaucgaugaggcggcccagaugcuggagugcgaggcccucaccccgcuggccuaugccucgcacggcacccgccucgugcuggcgggcgaccacaugcaggucacaccccggcuguucaguguggccagggcccgggcggccgagcacacgcugcugcaccgccucuuccugugcuaccagcaggagacucacgagguggcgcggcagagccgccuggucuuccacgagaacuaccgcugcacggacgccauugucagcuucaucucgcggcacuucuacguggccaagggcaaccccauccacgccaggggcaagguuccgccccacccccggcacuacccgcucauguucugccacguggcgggcagcccagaccgggacauguccauggcguccuggcugaaucuggcugagauugcgcaggucgucgagaaggugcaggaggccuacaacaccuggcccagcugcuggggcggccgcgagcagaggugcaucugugucguuucccacggugcccaggugagcccggccagcccgggacagcccccgaccgcaccccugcugggggagggggagcucuccggcugauggacgagcccccgccucaguuuccccaucuguaagagggggcugcaguauuugccucccagggcugagguggggcucggccccugaggugucuggagcuuggugggggugccgucuccuugucggggguggcccaguccucacugcguccugcgcucauccccgagcuuggugggggugcccucuccuugucggggguggcccaguccucacugcguccugcgcucauccccgagcuuggugggggugcccucuccuugucggggguggccgaguccucacugcguccagcacucauccccggcccugcugcgucuucaggucagugcacugaggcaggagcugaggaggcgggaccuaggccaggugucugucggcaguuuugagauccugccaggugggugaccagcggggccaggugcugccagcugccccaggauaccccggguggcucggcccacuccucagccuggcaucggcagggguggggcuggucccaccgucuugcgcacccagccugaccugacugcgugcccccugcagggcggcaguuccgggucguggugcucagcacugugcacaccugccagagccugcucagcccuggggcacuggccccugaguucuucaccgacgcccgcgugcucaacaccguccugacccgcgcccagucccagcuggugguagugggggacgccguggcccucugcuccuucggggccugcggcaagcucugggagagcuucauccgugagugcguggagcggcacagugucugccccgagggccuguccauggagcaggucgagcaggguguggcgcagagacggcgcuggccuccccgaggcacacaggcuggggcagcggggaacugggaggcugccccagagccaguaggggaccuggccgaggagcaggcggcuguggugacggccauggugaaggcagagccgggagaugaggcucugagcccagcaucccgugacaucacggcaaccacagcgcagacggaggcugcggcagcaccagcaggagacgcagugaaggaagacguggugcccggggccugugcggcaggagcggcugcugcagcgggcguggaguccacggaggcugaggaugcagaggcugacuucuggccgugggacggggagcucaacgcugacgacgccauccuacgggagcuucuggacgagagccagaaggugauggugaccgucggggaggacgggcugcuggacacugucgccaggcccgagucccugcagcaggcccggcuguacgagaaccugcccccggcugcgcuacggaagcugcugcacgcggagcccgagcgguaccgccacugcucuuucgugccagagaccuucgagcgggcgucagccaucccgcuggacgaugccuccucgggccccauccaggucaggggccgccuggacugugggauggccuucgccggggaugaggugcuggugcagcuccuuucgggagacaaggcgcccgaggggcggcuucggggccgcgugcugggcgugcugaagaggaagaggcacgagcuggcguuugugugccgcauggacacgugggacccgcgcaucaugguccccaucaauggcuccgugaccaagaucuucguggccgagcugaaggacccaucgcagguccccaucuacagccuccggaagggccggcugcagcguguggggcuugagaggcucaccgccgaggcccggcacagccggcucuucuggguccaaauuguccuguggcggcaaggcuucuacuacccgcugggcaucguccgggaggugcugccugaggccagcaccugggagcagggccuccgcauccucggccuggaguacagcuugagggugcccccgucggaccaggccaccaucaccaaggugcugcagaaauaccacacggagcuuggccggguugccggccgccgagaggacugccgcgccuucuugaccuucacuguggacccccagggcgccugcaaccucgaugaugcccucaguguccgagaccugggucccaggugcgagguggcugugcacaucacugauguggccagcuucgugcccagggacggggugcuggacguggaggcgcgaaggcagggcgcugcguucuaugcccccggcagggagccagugcccaugcugccggccagccucugccaggacguccucagccuccugccuggccgggaccgccuggccaucucccuguuccucaccauggagaaggccaguggccagcugaagagccugcgcuuugcacccuccgugguccagucugaccgccagcuguccuacgaggaggcggaggaggugaucaggcagcacccgggugccggccgugagcugccggcccgccuggacuccguggacgccugcgucguggccgcgugcuacuucucucggcugcugcgccggcaccgccugcgguccgacugcuucuaugagcagccggacgaggacggcacccugggcuuccgcgcggcccacaucauggugaaggaguacaugauucaguuuaauaggcucguggcugaguuccuggugggcagcgagugcacgcggacggucacgccucugcgguggcagccagcaccccgcagccagcagcucaaggcccugugugagaagcauggggaccgggugccccugucacugcaccucggccaccaccugcacggcggcgggggcaguccccccgacacgcggcugcaccuccuggccucccucuggaagcagguccaguuugcugcccgcacccaggacuacgaacagaugguggacuuggucaccacggacgacaugcacccauuccuggcuccugcaggccgcgaccuccgcaaggcccuggagcgcucggcguucggccgcugcgcccggggccaccagcagcagggcggccacuacucgcugcagguggacugguacacgugggccaccucgcccauccgcagguaccuggacgugguguugcagcggcagauccugcuggcgcugggccaugggggcucugccuacucugccagggacaucgaugggcucugccaggccuucagccuccagcacgcacuugcccagagcuaucagcggcgggcgcgcagccugcaccuggccgugcagcucaaggcccagccucuggacaagcugggcuucgugguggacguggaggcgggcucccgcugcuuccggcugcucuuccccagcaaccgggagacgcugccugaccccugccccguccccuacggcucccugcagcuggccgagcacccccacgcccuggcaggccggccgggccugcggcuccuguggcggcgccgugucuacucagcgcagggauccagcccgccccugccacugccuggcacugugccggacccacacacccuggccguggagacggcccuguggaagcagcugcuggagcugguggagcugcagcgcuggccggaggcggcugcucucauccaggagaagggcgaggcgucccagcggcgggagcuggugcaggugcagcggagccacuguggccauuuccuggagguggcccgggagcugggcaguggggacacccugcaggugcagcucggcaccagccugcagcacggcuuccugguaccgagcccucagcucuggacgguggcaccgggcuucagccucugccuggagcacguggagcggcccggagacugcuucucaggccguguguaccgggccccgagggaccgguaccgcgacguggaugaguacgccugcgugugggaaccauucugcgcccuggagucggccaccggcgcgguugccgagaaugacuccgucacacuucagcaccugagugucuccugggaggcgucacggacgccgcaggggcagcugcagggcgccuuccgccuggaggccgccuuccucgaggagaacugugccgacaucaacuucagcugcugcuaccucugcauccggcucgaggggcugccggcucccacggccagcccacgcccugggcccagcagccucggcccuggccugaauguugaccccggcacguauaccuggguggcccacgggcagacgcaggacugggaccaggagcgccgggcagaccggcaggaggcucccagacgggugcaccucuucguccaccacaugggcauggagaagguuccggaagaggugcugaggccgggcacccuguucaccguugagcugcugcccaagcagcuuccugaucugugaguggcuuccaccagcagaggcugggcugggggaccgccccgggccccucacuugcaggaggggggagcucguggggcagcagccccuuuccugggaguccuguugguuuuccagugucugccuucacccccagccgcaaggaggaagccgugcguggacuagaggaggcguccccgcuggucaccagcaucgcacugggccggccugucccgcagccccucugcagagguaggucugccccaccccuccagcuuccccucuggcccccagccccacccugcaugagugcucagggaggcugcccccucucagugauccccagcagguuccuggagcggcagaccuacaacauccccggaggccgccacaagcugaaccccagccagaacguggcggucagggaggcucuggagaagccuuucacggucauucagggcccaccagguagggcccaugccgggggagccgcaggcugccuugggccacagggacccacagggugggcuacaaucuccuauucucuggcugcagguacagggaagacgaucgugggccuccacaucguauucugguuucauaaaucaaaccaggagcaggugcagcccggaggccccccccguggggagaagcggcuggggggucccugcaucuuguacugcggccccuccaacaagucgguggauguccuggcaggugcgccggggucggcggugggggccuuuggggagcuggcacgcggggcaggacucacgucccccaacuacccucaggacugcuccugagaaggauggagcugaagccccuccguguguacagugagcaggcugaggccagcgaguucccagugccgcgugugggcagcaggaagcugcucaggaagagcccccgggaggggaggccgaaccagagccucaggugugccugcugucuuuggggcuugggcggaguggggccgagcuguccagacaguccuguguaggugggucucacugagcucugcccccgugauggcccugcguggacagggcucacuguguccugucccccaggagcaucacccugcaccaccggauccggcaggcccccaacccuuacucgucggaaaucaaggccuuugacacccggcugcagagaggggagcucuucuccagggaggaccuggucugguaaguggcaggggccaggggguggagcugccugcagcaugggggcccuggggugacaagcaguguccccggcagguacaagaaggucuugugggaggcucggaaguucgagcuggaccggcaugaggucauccucugcaccugcuccugugcagccucugccagccucaaaauccuggacgugaggcagauccuuguugacgaggcaggcauggccacggaaccugaaacccucaucccccuggugcaguucccacaggccgagaagguuggucggcggggggugugggcagcaugagcaggcgucccuggcacagucucccaccuggggugcccugugugugcagacgcgggugucguguggggcuggggucccucugggucuaggggugucagggccaggccugccuauuccuccaggugguucuucucggagaccacaagcagcugcggccuguggucaagaaugagcggcugcaaaaccugggucuggaccggucucuguucgagcgguaccacgaggacgcacauaugcuggacacucaguaccgcauggugagcccgccccacucagcccccagcccaccugcagccccuggggggccacaaccccgcguggcagccucugaccagcgcacauccuugccugcagcaugagggcaucugugccuuccccucuguggcguucuacaagagcaagcugaagacguggcagggccugaggaggccgcccaguguccugggccacgcuggcaaggagagcugcccugucaucuuuggccacgugcagggccacgagcggagccugcugguguccacggacgaagggaaugagaacuccaaggccaaccuggaggagguggcugagguggugagugucuggugccugugagucagggagggcuuucuggaggagguggcugagguggugagugucuggugcuugugagucagggagggcuuccuggaggagggcaggagagacaccaggguccgcuccaccugcccccucggcuccucagguccguaucaccaagcagcugacccuggggaggaccguagagccccaggacaucgccguccucacgcccuacaacgcgcaggccucugagaucagcaaggcccuucggcgagagggcaucgccgggguggccguguccuccaucaccaagagccagggugaggcugggggcucguggguggggccgggagggugggcgcagcggcagcagggccucaccucccaucccgcagggagcgaguggcgcuaugugcuggugagcaccguccgcaccugugccaagagcgaccuggaccagcggcccaccaagagcuggcucaagaaguuucugggcuucguuguggaccccaaccaagugaauguggcugucacgcgggcccaggaggggcucugccugaucggugagggcggggcugggcucuuccagggugggaacacaggugaggccagggcugggcuagggagcugccgacuccugccugacccugacuccgaccugacccugacuccucccaccugacccugacuccucccaccugacucugacugacucccaucugacccugacuccucccaccugacccugacuccucccaccugacccugacugacucccaccugacccugacuccucccaccugacccugacuccgaccugacccugacuccucccaccugacccugacuccucccaccugacucugacugacucccaucugacccugacuccucccaccugacccugacuccucccaccugacccugacuccucccaccugacccugacuccucccaccugacucugacugacucccaucugacccugacuccucccaccugacccugacuccucccaccugacccugacugacucccaccugacccugacuccucccaccugacccugacuccucccaccugacccugacugacucccaucugacucccacccucacaggagaccaccuccuucugcgcugcugcccccucuggcguagccuccuggacuucugcgaggcucagcagacccucgugccugccggccaggugcgcgucugcaggaggccaacuaugccuuccugaagagcccucuccaccugcaaggugccaggacugggagggaaaguccagggcccccccacccuccccaccacccuccgccaucagccugccugggccagccugccuccuggccucaggaucucccuggggcaggaaguggguggacuuggaggaggaacggcaagggccgguccccacacucuugcuccuccugggcaucuggggacaggaacaccucucaggguggccaagaggggcuuccuugggaccagugcaaggaaguucugcugucccugggaagucucagaaccaggaaggaaacccuguggaggcugcccuuugaccuuuggacgccaccuguaaucacucuggauggugucuguggaguucagguuuauuuucuauuuaaaugaacuaaaagccagcauccugccgggcgugguggcucacgcccauaauccagcacuuugggaagccgaggcgggcagaucaccugaggucaggaguucgagaccauccuggccaacauggugaaaccccgucuccacuaaaaauacaaaauuagcugggcgugguggcgggcgccuguaaucccagcuacuugggaggcugaggcaggagaaucgcuugacuccaggaggcgcaggcugcagugagcucugaugguaccacugcacuccagccugggugacagagcgagacccugucuuaaaaaaaaaaacaaaacaaaaccagcaucuguuacuggaacagagaccucagcccaagcucaggacaaggaggccucccugggagagggggccuuucucccaccaucaccgccuguguccuucaggggcugcuggagggcagcccaaagccaggggcccaccccgccccaccccaccccaccccacccucugaaaugugaaaagccugcacucuuccugugggcugcgcagugggcucggggguuggggggugccggggcgaugcuuccacccuggacugaguguucggggcagccugcucggcuguauguuucucgcacgcucacccgcuucagugcggcucugucccugcugccgccuccaguccugagggaggggcuugccccaccuucuacauuccaauuuuuauaucuuugaauuaugugauuagauauuaauuuaaugauaaaaccacucugaaagcucuucu

SEQ ID NO: 13572 - RNA, 9480 nt, Homo sapiens
caggucugaguggccaggaccacagcacaagugggugccccucacggcagagaccuccagucgagacucaccugccuucugcuccaagggcccggcacccugagauccugaugccaggguaagcuggggggcugcucauggucgaggacacgggugggugcuccugaacagcagaguggccccagggguggaugcgugggggcucaggcgcaggcagccgugggggacaucaccaccucagacccacagcaguccccuagggcagcucaggagcuccggccaccugaacuggcccuuccaugggcaggaccacuccugugggcagcacagugggugcagagccggguggcuggggugagacccuuggcuggcagaagcugccugccaaaugucagcagaggcacagcagcuaggaggcccuugaagccuccaccguacugagggaacagcacucacugccguccucagaggccaaggccacaggcauaagaggaucacccagcugggggcuuguguaugccugauauuaauagcgcuggcuuugccugguguggcccugacaauccucgggccagcccucggugugaacugcccccuccugugugugggcuggcacauucggccagccuaggaccgcaggccugcggaggaccacugugcgccgugugccugcaccccuccuggauccccuggaaaaagcuacaguaccccggccugccuggggcuacagagugaaccccccgcagcaggacaaggauaucugaggcgccucuuggccagguguccugaacgucagugcugagcugggcaccccaucccuagccccagagugcuuccgacaggcauaaacaaaucugaaacuccacccucuggcaccaucugaaaauaacugccuugcccuacccccacucacgggggauccugcagggaccugcagccacccagggcucaccacccagggcucagcagagcacaggggacacagccaccuccccgcccagggcucagcagggcacaggggacacagccaccuccccgcccagggcucagcagggcacaggggacacagccaccuccccgcccagggcucagcagggcacaggggacacagccaccuccccgcccacagaaacaggguuucggccccacccuccgcagagucagucaaggaugugcacagagaaguccuggcagcccuaagcucucucccaggggcagacaggucagccaugggugucagcuuccuccuaccauggguuucucuuggagcuucuaguacugaggcaggggcugccagaagcucagggaaaagggaagacuccacauggaggucauacuccucaauaguaggccacuccugggagcugccucagaggcaggaccggcccaucugucuguguccacaggugcuuccucuccucauucugcucccaggaggcggcuacaucccucacuugggaagugggcaggagacagcccagggucggggaggcggaggcuguccugagcaggggcgcagaguccgggcuccugggggccaugccacuggcugggcugucugaacagcagaguggacgcagacuggucuugccuggcaugggcaugcacccuggcugcccuagccggccaagaggcaaggcuacaggccuggggaagccagcacugugcuggccaggcgagggacggaggagcccaggcacgcagcugugaauggaaccaccaggccccacccuggaaucacgucgccucgcugcaggccacgugguccccaacaugccccuccacggggcugcucucggccacagcagcccacggcagggaggggccgcucacgguggggagggguagccugcccugguccuauucacugguguuccucccagguucuaacuuccugagcugggccgguccagagaacucccauucccacgccacccacaggugcugaugccgcgcugggguaagcgcugcccagagcaccuucugccuaaggcuuccuccuugcagguggggcugucugaggcccguggugcuggaggcugccucagucacuucagggcaccccuugcccuucccucaccuucagccauccuacucugggccacagcacagucgaauguggcucaguccccuccacggagccacagcuugccucaguuuccuccucaaggacuaacagcagguucauuacaggugggucagcucauaaaguccaaggcagaugccucaucggugaucaggccccauaacugaugucaucgucaagaaauaggcacagguggccgggcgcgguggcucacgccugucaucccagcacugugggaggccgaggcgggcggaucacccaaggucggaguuugagaccagccucaacguggagaaaccuuaucucuacuagaaauacaaaauuagcugggcacgguggcacaugccuguaaucccagcacuuugggaggccaaggcagguggaucaccugagguugggcguuugagaccagccugaccaacauggagaaacccugucucuacuaaaaacacaaaauuagccgggcguaguggcacaugccuguaaucccagcuacuugggaggcugaggcaggagaauugcuugaacccgggaggcagagguugcugugagcugagauugcgccacugcaauccagccugggcaacaagagcaaaacuccaucucaaaaacaaaacaaaacaaaacaaaagaaauacacacaggcagccgggugcaguggcucacgccuguaaucccagcacuuucagaggcugagcgggcagaucaucugaggucaggaguucaagaccagccuggccaacauggugaaaccccgucucuacuaaaaauacaaaaaauuagcugggcgugguggcgggcgccuguagucccagcuacucgggaggcugaggcaggagaacugcuugaacccgggaggcggagguugcagugagccgagauggugccauugcacuccagcccaggacucuaucuccaaaaaaaaaagaaaggaagaaaaauaagcacaggcauguguggagaccuggaggcagggcugccccucacgaaccauccacaaugccaaggaaaccagaagcaaacguccagcagcagggagcgcagggcaugugaaaccgacacugaggaaacagccacgggagagagcacacagggagaaaggaaggcucgggcacucccuugcugugguucaggccuguucuaccaccccuggggucaccaucgcccacggaccuuccugcugggugccuguagcacggcaccuccugacaggucagguuuaagggaaguuugcuggauaacuaaaaugaggcuggggggaggagggagcagggaggagcuagcccacaggagccaaugcaggccugaccccacuggugccggacugacucagggagagucauuagggcugcuuucucaggcuggaugagcacuggggguugggggcuugcccuggcccaccccaccacucaggaaaccuucccucagcaggaccugcccugcacagaucaugggcagccucccucugcuccccacuuccacagccccagacuccaucucaaccgcagccaggagucacugcuaacaccacaaaggaccuguuccugcaccagcacgggccagcucugggggcaggugcccaggacagagucacgaguggcaagcagacaauaaacaacaggcaagauggacagacugauugccgggaggauguggcaggaggcacuggaacggugguggaggaaccccagcccuggggacagaccuccacccgugcacagaccuccaagcuggagccugcucuggaacacuaagggcagcagcagagguugaagaggggcagacgcaggaacguuggggacacgcucggggaacagugagaaaagcccuaggcuggggcagaggaaguccucgauggcacaagcaucaggacacaaagugcaagaaaugugccuaagacaagaggcaguuccagggcagaccggggccccuggagaagggugcugcaaucuauccucacugccuggagcuucccuccugucccuugguaaccacaccaaagaaagauaacaacagucucugccucgugggacacagcgagggccaccgugcccagcccaccgucugugcacagggcaggcccagauggcugcugccaccaaccugugucauccaggagugccuuucucaagagcucucagugcuuaucuagcguuggccugccccaccucggguuaaaucaaaaccucuuugguggcugggcgcgguggcucacgccuguaaucccacggaggccgaggcgggcagaucaccugaggucaggaguuggagaccagccuggacaaccugacaaaauaccucucuacuaaaaauacaaaaaaaaauuagccgggcgugguggcgcacaccuguaauuccagcuacucgggaggcugaggcaggagaauugcuugaacugagcucgggaaagggagguugcagugagccgagaucgagccacugcacuccagccugggcgacagagugagacuccaucucaaaacaaaaaaacaacgccucuuuggaaccagcagaggaacagacucaggcccuauuagacuccagccaugcaaaguuccuagucacugcccacugggaggguguggaccugaagggacgcagggccaggggaaagcucuuucugcucagcagcuccuggagaggagcgacccugugccgggacacccuucccccugcggcauccagcgcagcccaucucugagggaguccuggcucacagcguuucugacaggagucacagccugaacccaggcaagaggcgccugagugggaacaaccccuuccuggggaccccgcgggcuccccaagggacacuucagacccggaagggaggggcagcgcccagagcgcccucuugcagccccgggcacugcguggccaccgcccccugacggccacggccccaaaggcgccgcgcagggcccggcucccagaggggccacucggggugacgaaccggggugggggcggguuccucccgcugcacccccacaacuuccccacuucaugcucuugcaaagcccccgcagaggcucgaaggugccacgcgcgugcgaggcaauccgaaggcaccgugcgccgcagcaccuccaaauccuaagcccuggccucgcgggucgggcagggccacaccccgagccgacaacauagaccaacucgcacagucgagcaggcacacagcccgccgggcgcucgaggccgagggccccacccaccgggggcagagaccaaggucaacgcugggggugcgcacccggacuccuuccccgagccccgaggagccugccggcuugggccagguccguccucccggccgcuucaagcccgcgggguuccacccggcacgugggagaacggggcgccgccgccuggccuccgggagugggggacuugggcucgcggcggggacggaccacccgcccagcucggccggaucugcagccccuucccgcucgccaguggaguggaggcgaggcccacgccuaccgguccucgcacgcggucucgcuuuucucagccugccggccuggugugucucgggccguagguggcgacgugggcgaaggaucagcguccgcgcgggccgggggcgcagccauggcgcucggaggccucuuugcgggccuggccgggcggcgcgcaugggccgccgggagcuggcgggucccucucuugcccaccgcggacuacaagccccacaaggccgcgcgucgcggacuacaagccccacaaggccgcgcgucgcggacuacaagccccacaaggccgcgcgucgcggacuacaagccccacaaggccgcgcgucgcggacuacaagccccacaaggccgcgcggcgggcaugggggacccguaguucggcagccuccgccacgugccuggagggccccgcccccuguuuuucaccacaaacugagccgcacaaaaacccuggaaaaaaaucaauaaacauuuauuugauacagucauuuuaauacauacagugauggcccguccccacgccacucgggaccagggcgcggggcggggacgaggaccggggacagauggucacaaggcgggcggggcccgaacucaccguugaaacaucucgcaaauaaacacuuuguagauagaauauauauguauauauauaugguuacaagugauagcuggaaccucuuucaaaaugcacuuauguacugagaacuggcauuaaaaaacccaaaccaagaaacccaaagcacgggacgcccggccgcgaggcaggggaaagccuggggccccagacccgggccugggggagccgccuggggccccgccaaacgcggcacacggggacggccccucccggggucaggcucacuggcuccuucccuucagcgccaccaggcaggagggccaacggucacacaggaggcacccucaccugccuuugcaccagcaaauaaagugcaucccauuuucgugugagcgucggcccggugagucagcccuuccgggcccuuuccuguucucagggcagggggcgugcgcugagccagagguagaucugcagaaagggccccgacugggccucgggcagggccggcgcccaccacacucugggggucagcuaugcuggucccucucacugagggcuccuggaggccuaugugggccagcguagggagugggcagacccugcugagcuccacccagggccccaccccuugggaggagggcucugcggaccagcauguggcagagggagggcagaaaggagggggucagacccaacagccacuucuggcaguagcccccacgccuaccuuaaagacaaaggggguuaaagugcuaaacaucaagguauccaggacuccucuucccacaccagggauuaucugugggcuuugggagugucccggaaacucacccccagcaaaaaccagacccucuucucuucuccccaagggccaaguaccugagaggcuggggcaggcaccacacccugcagguguucagguccacccuccucccgccauugguggcaaggacaaagugcaccuaggcccccgcccagugccugcuccccuccccuccccuccccuccccucaugaggcugccccagcagcagcugccagaccccacccuccaccuccggcuccuccagcuccaccagugaagcucugggacacaggaaggaaugccucccccgacccucugacgcugggucacgcccaucucugccccagccuccauccucucaucaggccgaggugugcguggguggggggaguccgggucuccacacccacucccuggcacaucuggcaagggcugcugaggguuggagccuucuggcccaaggaugaagccagagacaggaaguguucugcaaccccaguccccaaagugcuccuggaacuugucucccuacuacugcaggccaagcccaguggggccccuucucccuggggaaugggggagggugggugcugggggcagaggcagugcccagucaguacugccucccugagcagcaagggaccccaaccccagagacccacgcccugguccagcccagcccccaggcccaccgucugcaccaggaaacccuuagcaccaaaugucggauugcgaguguuuguauaaaaaacaauuuaaaaaaaagguuguuacuugucacagcaacaagacuggcauccacuacacccaggagacacacgcacacgggcaaacaucaaaauucucaucguccagggucaguggggccgagcccucagcccacucccacccacccuggaaaauggccucccuccaaaccuacccccucugagccucauccucccugcaaugccgugguuggaaggcaggaccccagggagggagccacaggcuguggccaccucuuccaggcacccuggacucccugccugaccccugcccuaccuauagacccagccguccucagggccacaaaggggcaaagacagcucuggagcugccaucaaccugcugugacuuuggccaagccccuccccuggcuggccuucaguucccauaucaaaugaccacacaaccagaaacaaugggggcagguuaaaaaaaaaaguggggagggggcucccaugagagcuuggccacugggccuacccagauuggcagacagaaggcugccuuucccccaguggccacucagagccaggccagcucugcccagcuuccugccccacaugccuaugggccccagcaagaccccagggcccgaacuaguccgucccuacuccacgaggcugcuccaaccuaggccugcagugccagaaggcugaacacuggaggagagcacacuccaggggccccacacccccagggcuggcagcuguguugaagggcaucaagcuucugcugcccuguagguacaagaagcaaaaccccucccuugccccaagcugggagaauuacagacaggccuggggggcagggccugagcacagcagggaucgcacugacaaaggaggagcagggguggggguagugggcaggccuggagagguagaaaacagaagcaaggggaccaaguggguggccaagggcaggccggagccugucaggucagcauggcaguggucagacaggggucuguccugggagguagcugggggugcuggaguuccaguguuggguggaggugaggccaggaugguggcugcccgugccagguugcucaggugcccucaccagcccagaaccacaggucaccagggaugccugagccuugggguagccagggaagggacccggcagggccugaggaagcggagccggggggccaaaggccaucugccuacucugcgcugcagccccuguggcaccaagaccccagacacauucccaugaggaggggcaacccuccuggcuauugcacuucugcugggcacaccuuggggagccccaacccaggugugcccuguggcagccuuaacaggggaagggccaccuucagggaagggagaguggcuggcugccccacuggacggaugaagaggcgggggugggggauggagaacuggaggacagaggucccggagcuggcccugccuugaacagagggcgguguggcggcugcaugggggccaggccccacgcaccaugcucacuuuucaggcgccuugcugacucccaccuuccggccgguggagccccgggcccccuugucucugcauccuggaggccagucgucccggcgcgggggcagcuuggccacaggcuccucugggguccgcuccuugggcuuucggccccgcuucuuuccaccugccagauuuuucuucuuuuccuucuugggcaccaaugaguccuggcuccuguguuugggaggugggucugcugauguucggaaccaguucuggggagagaaaagcgcugaugaagac

SEQ ID NO: 13573 - RNA, 1923 nt, Homo sapiens
aaacuucuuggaagaaaaguuuaagaguuuaauuaaaaauuaaauauauuguauuagguauauuuuuuaaaagggcaaaguaaaaaauauuaauacaaucugguuguagaaaauacacugcaagaaaaggagcaggugcuucaaaaauguaacccuggcaacucugccaacagguccugggcucgggcuuccuggaaaagccccgggacacgugggaacuccaggcacccucgcaggggccccccgagggcagguggcccagaagcccaggaaggguggccugggagguggaacgggcgcaaggccgagcaucacuggcuccuagggggcugugacauggaaccaaacauacacgcguaugagagagcagagcggcagcgacgcggucggaucggucgcgggggcugcgggaggaagcgcugcagggacccgggcggcgccggcggccuagccggagaugcacgcgcuguaauagaccgcgcugcuggcguccgacagcgcggagaucaggcugcucuccucugggcaggacauggcgcgcgggcccaguuuggccagugccacgugguacgggagcccgggggcgucgggccgaguccggcugcaguugagguacuggucgaacucggugagguccacgucggcccacagaucggcggcgggccccagcggcucggcgcucuccagcggcggggccucgggcggcggcgacagcgggccgggguacgggccgggcgugcccagggugccguaguacaggccagcgagcggcgccgcggggggcgcgguccugagcgccuccgccaggggagccccguagcaaccgccggggucccgcgacaacucggugggcgcguagggcgcgcggaagggccgcagcgcgcaguccucgggcgccgcgggcggugggaagaaggcagccucgccgggcuccaggccguccagaggcgagcgcucgggcgugggcagccccaggccgucgaacucggcgcccagcgggggcagcucgcggaaggcgcgagccgagccagacgccgcggggaaaggcucgggcgguggcugcgggggcgcuaaucccgggagcaggaggccgggcuccagccgccgggccuugcgcgccugcuucuugcggcgcggccgguacuuguaguugggguggucgcgcaagugcugcacgcgcagccguucggcuuccuccacgaagggccgcuucuccgccgcguucagcuccuuccacgcuuugccugcgggccgugggcgccagugaguggaacgccgucgggcgggugggcgccgagcccuccgugcgcccgggacgccccgcgaggguuuggcgcagcccccgcaccccgcggcccgggaccccugccccccccgccccaccccggcccgagccccccccgcccucucccccuucucugccgcccucccgccgcucacccagcaucuugcugagcaccgcguugugcagguccggguucugcugagccagccgcuugcgcucguccuuugcccacaccaugaaggcguucaugggccgccggaugcgcgacucgucugccgccuggcguuccccgcggccggccgggcugaggccauagcgccccggcucggggcugcgcgggggacugcgcugcgggcugggcggcgaggcgggcgcggcgggcgcggcgagggcggcggggccggcggcgaggccgcgcgugucagcggcggccccgugucccggggcccaugcacagucgcggcgggcgggcgggucguccugugcgccguagccgggcggcgaucucugcauuccagcugggcgcggccugggcggaacggagcgcgggagcgcggcgggcgggcggcgggcacuggggagccgggcgcaagggcaggccaggccgggagggcggauggcgguggggacggcggugg

SEQ ID NO: 13574 - RNA, 9225 nt, Homo sapiens
ugccgcgcgcggccgcggggccgaggguuugaaccgggggucugucguccgcggcggggcugcgucggcugcggcgggugugggagguggcgacggccggggccgggguccugcccggcugcggaggcgggcgcgacgggcgcgggggucgcugcuccugaggcgaugaugggcaaggaagaggagauugcgcggaucgcccggaggcuggacaagauggugaccaagaagagcgcggugaggggcgcgggccgccaggaccccgggaaccccgccccgccgagaccccgucgagcccgccgacccccguuagggccggaagacgaccugaggggcaggacgagaccccuccccggcagagacuaaccgggacgcaggggagacccccacccguggccgagaccccugccccgggccagcccugccguucacucccgcaaccccggcagaggccgcgaucaggccuggaccuugucccgggagagccacccgcucuggacucagaccccucccucgcccgcagucacaggcuccgcacccuucccugucccuuaacuccagacccccagccuggcccgucgacuccuuccuuggcccugucccgccucucggagcccccgggguguucgggccuccucugcgggccgcgccagccccuugccuuccuccaucccggccugggcauccucacaggccgagccccgccccccaacucagcccucucccacgcuccgucucuuacagcguuugucacccuccgucucccauagcauuugucgccggcaacaguuuggagucugagguuggauccccuuuucuucuggagcuuccgugccuccccugccucuucccagcccuugucauccuccuucacaggccagccagauaccugucuugccugugggcccauuuucuucccugucuguccccaccccacaagaaccagguuucucuaauaaauucucucccuucuuuagccaggacuuagcccgcagcaacuuggguuguggguaguuauguggacacccuccgaaaagagccggugugcuuauauaagagccaggaggucgggcaagccuccucugggagugucugggcgcuggagccucuggccggcucuguucacugcggccugggccucuguugucuugcggccacagcgagacuuuggaggaggcugugugugaggacuuugaaggggccaggucaguggggguccaguuccagcgucaugaccuuggcaaccucugcacccucccacagaagcaucuuuagaggaugcugccugccuccugggggguggggaggggucuggccgcaggucauuuggagcuccuggcuggcucaauaaacgugaccugugcuuucccacccagacugugaacuccuggggcagggccagcugugugucugccaggccagcccagggcggugaagguggcugagucaugggcuuugggugauuugugcagccaccccagggcugugugacugcaguggggguuugggggaagcuuuuugggcugagcaggguugagucuggguuccugugaccagcguucuggacuggggucugcccugggaaggggugggcucccacucauuccugcugggugcagcacccccaucauugcguucacacacaccccggaaaacuggucagcacaaaguaggggucugcgaaccauucauagcuguuuccagagaugacccgagaauggaguuguuccccuucuuaaaggagacaaaacacaaacgauaaaagcuguaggugggagaagcaaagaugggucauggagccaggggagggcuggguggggcugggcagaacugaugggggguuucugguggaagaacagcuugaguagaagccccaggggagaaugaggaggggaggcgggcgcugugcaguggggagugggagccagcagagccuccugggggucccagugccugagguccccucggggaccugggggccagguguggggguuuuuuugccucuggaccugagcccacugagagccacguaagcaggugcagggcuuucaggggacaguggccuuggcucuggcuaucaccucaaggcuggacucuguacagcccaagaggcagggccugccugggagggcucaggaggggcugcagcgugagcagacuaugccacccggauugcugggguugugcgggcgguaggugggacaagccccucccauggccugugggucgugggacucugaucaggucaccuuagggcagagggaaugauacacacguggaaacacaugcacguguuacagaggagaugggguguugcagggcacaguugcaguuuuaaacaggagaggccuugcugagaagguguuguugaaauaaagcccgggagggagggagggagggagggagacguugugggaggccgccccaggcgguggagcugcaggugcagagggccucgguggcggcucagcgcccuuggggagcacugaguugccgggccugguguggaaaugugaccgguuugugccuggccucgucaguguugaggaccuggaggaaacgcagaucuuggguggggagacaaggcggagagaacgaggugcauuggaacaguccaggcgaggggugcuggccugcuugggggcaacucagaggccuggaggauagaugaggaggggggcugugggccuuguagguguuggcuguggccgugccuggaguggagggacccuugaaaguuuggccucagcucgggacacugauguucccggguuggcccuucaugagaguuuggccucagcucgggacacugauguuccuggguuggcccuucacagcuggugggcggggggugcuuuggggagaggcugcccugcgcaucagggcaucaagacacaggggagugaaugaaccuggggcugcaguuucaccuggguguggcccuggcugcuggggaggggccguggcucugaagccucaugauuggccaggggagcuggcauuucuguucugguuugggucagugaccugaggugguuacaacgaagucagugaggucauugccacggauguggguuacaacuuggaaugcuugaggcugcagaaccccuccccuucuugacugagcaguaaggguucccugcuguggugcaggaacaugugggcagagcccugggugucuccagguagaggaauuuugguuucuuuuugaccccagguugaaucuccaaauugucacugccuuguguucuccuccaguaggcagaaggaggugauauugucuguugagaucuaaaguccuuuaugaagguccuccuucuccuuccaggagggagccauggauuugcugcgggagcugaaggccaugccuaucacgcugcaccugcuccagguaggucccugccugccccagguccaggacagcuccugggugcagcccaggggauggcaguucugagggcaccuggcagggcuuccccacccuccccaccaggccuuaguuggcacaaaugccuguuccugaggagagggucucugccuuucucugggcucagugggacagggaggggagucugaggauaacccaucuuguccuccguggcugaggcuccuggguuccaaaugggacagucgccauugggagaggccucuaccucccugggaggucccgggcuccuguccugugggggccaccaaggcucugccaggagaaucugaccccuagggugggccccugccucccccaacccagaccacuugccucguaguccacccgagucgggaugucugucaacgcccuucggaagcagagcucggaugaggaggucauugcacuggccaagucucucaucaaguccuggaagaagcuccugggugcggcucaggcggugcccacugagugcuggggcaggggucccagaagugcugccucuugcuggucagcacaguguagagugcuggcaguguccacccugagccaggucgcuugggaguggggcaguggcaaacccagaccaugaagcgcccagcuuggggcuggcaguggaucagugggugccugucagcauuggcugggagguguggccuaggaggccagggugugugcugggggcaggguuccagguagaacaaggagagaagagaguugaggccaggacuugaacugacagcacugagagacuggggugaguugggaggucacacagaggggaaggucauggccaggaggcugggaagugccgggagaggggaagcgggagggagaaggcagggccaccucagcuacucagagggaacagaggggcagcccccugccagggaagggaagggcugggcugggcugggcuggacugaaggcugccucuuccuggagacaguggggugacugggguugcaaagaugcugcugucugggauggaggcaacccuccuagcucuguccacacccuugugaaacagucucucuccagcccuguguggcccucaggcugugcauggcacaagcauguccugguccccagcccuugggccuggcucugggcuuucaggaagagccuucuuggggacaugcuuggucucucuggccaggacaggcaggagggugggccccagagaggccccagagguggccuuugugagugggugcuuguacgggaaaggguucuggggaggcagccucaggacugcagagauggacagguugcuggggagggugaggaccuguucacagaggcugggcagccuccuggccccuggcuccccuggcugggugaggggcugggggcgggggcuggggcuggggccguguugguggucgggcugaggcuguaccuuggugguggucugugccccucccuccucugccuccccuugaucagcccauccccgaucuuuccugcagaugcuuccgaugccaaagccagggagcgggggaggggcaugccucugcccacguccucgagggaugccucagaggccccggaucccagguagcacaccuggaaggcaggugcacacacuucugcuucccagccuguuuccuugccagagaaagggugccagucuccaugugccuaggcacugcuuugaggcugcacacagagucggucagccucaugcuggacaccagccuuguggugugucccgccugcacugaccacuugagaugugggucuguguccaccuggcugucagccagccauccuggccucuuccucugccaagagcugcuguauacccugagugggccugugggagcccccuggccucuucccccaaggcccccugcugggucugguucuugcuggcccacucuggcuucccccucagccucacucaacgacggucccuccuuccugcaaaauucugcccagaaccaaaggcgggggccaacuccccuccugcccugcaugugcacguguggucacugcugccagggggugauaagggcucuguggccugcagcugggagcugggggugcuuauuguggcaggcuauagccgagagauggcuuugcccuugaccacacuggguuguggugacugggccaccaggagcucagggacaccuuugcaaguugauuuuccuccaggaagcugccugcuucugccaacuuccacagaggggaugaggggagggcuagguggaugcagccuggucguugggcagccccauguugggguccagcccugaggggcauccuucucccauucuguacgugcccaggggugucgucugugacagcagaaccuggccuugggcggccccgccuugucuccccccagacagcugugggucucucccucucccugaccaggcagcagcugcagcugcccucagcagaguauuuguguugcggcccagugggugggcaccccagagguggcaggaacugccagguucauucugaucgacugguaaugcugcccagaugcugacugcugggucugggauccuguucccaccuggagaguacacccugacccacuggggaccucauggcccucucccuccuggcugcugggcacaccccauggacaucugggcuggacucaagauaggcagggccacaggccacuguuggacucuggcagaguagaacaagcagggguuggugggggauuaugcuguggcaccugcugcuucuaggaccagugucucgcuggggugccugcagccuugagucugaacccagcuggcccuggcucucugcagccgcaagaggccggagcugcccagggcaccgucgacuccgaggaucaccacauuuccuccggugccugucaccugugaugccgugcgcaacaagugccgcgagaugcugaccgcugcccugcagacggaccgugagugcggccggcccuggcuccugacacccgcugugguucacaggguggcccgggccccugccugcccgcagaggccugcuuccagcggggugacuguccucccccagcccauugcuguggcccuggcaggggcuaggggccugugccuggaucgugggccucuugcagggacccggaugugcccucuaagcugccaggguguuuugcaggcagaagggguggcagguggagaaaccagugggggaagcuagucagggcucccucuugcagaugaccacguggccaucggugcggacugcgagcgccugucggcucagaucgaggaauauauccuuuggguaggggcugugggccuggguuucugguggagucaggaggcugccuggccuggugcccucugguggcugcuggaugccacugcccagcuguccaggggucaccugccuggguggucaccugccuggguggucaggcugucucaccucaggagggcccccggaccagcugaagggcugauucugucugcuuguggggccuagguccccuggggcuguagccugaagcugggucucagucaggaaugggccuggggcaggcuuggcccugcagcccuucaccucuccaccaggugugggugggcagaccgaccccuguguggcugggcagaaccuuuccagcccccaccccaacauggcccccagcggggcaggugguagguggagggcagcgacguuguccucagguggguccuuaaaacacuugcacgcaucuuccgggacguuggaaacacagacaugaaguauaagaaccguguacggagucguaucuccaaccugaaggaugccaagaacccugaccugcggcggaaugugcuguguggggccauaacaccccagcagaucgcugugaugaccucagaggugagccccuguuggaggggcuggagggcugcucccucggagcggugggcuaagccacuggccccgugcuccaggagauggccagugaugagcugaaggagauccguaaggccaugaccaaggaggccauccgagagcaccagauggcccgcacuggcggcacgcagacagaccuguucaccugcggcaagugcaggaaaaagaacugcaccuacacacaggugagcggccgcugggcacccucccccgggcccggugucuucagggcaucuggugccccuccuuggagcccaugccuauucccgccucugcugcaugaauuucccgagccucucagucccugaguaggcuaaggcaugauggccaccuucagggaccacuccccucuacccaggaccucugggcuccacggggcggcgucuuggguggugggacccacuuguugcggauacucaagucagagggccuggccuggcccagcccagccugaacggagggcccucgagguguugauguuggugggagggccgugcugccugcugccuggcagugacugcaggacccucagucccugccauggagguggacacugagugugcuggggagacuguggaucccaugagauggcagggacccuguuaagaggggagugcggcugggugcaguggcucacaucuguaaucccagcacuuugggaggccgaggcaggcggauaaugaggucaggaguucgagaccagccugaccaacauggugaaaccccgucucuacuaaaaauacaaaaauuagcugggcgugguggcgcaugccuguaaucccagcuacucaggaggcugaggcaggagaaucacuugaacccgggagacagagguugcagugaguccagaucgugccacugcucuccagccugggcgacagagcgagacuccgucuuuaaaaaaaaaaaaaagaggggagugugucgaggcggccgcugcaccuggcagaugggacucgugaggggcugcaaggacagccuuuccuuccccucgaaggcugcauggggccugggucggugcagagccugccucucuccugcucccagccacuggucagaacaggcucugccuguggccggaggcucacccuugggccuuccggaaggcagccgcgggcacuggggaccccugcuaguuccccccaccauugggacccucuugcccucagccaagucugggcccuccugguccccagccaaugugagcugcuucaggcucacacaagggccucugccccgauaaacucugucucccucccccggaggcucagcuuuggaagguuggagucacgaggcggccucggaucaggucaccugugggagcucaguggcugcgaggcccgcacugcccauguugaggggaugccgucugcagcggagcauggaggugacccuggguucacccagcccuguucacaggugcagacccgcagcucugaugagcccaugaccaccuuuguugucugcaacgaguguggaaaccgcuggaaggugggugagcaggcucaggcugccccucccagcuccauucucuggagguggggugucucagccucuguggggucuguggugugaacuggggauggcccugcccaaccagccuccugggagucuugggcaugguggguggagagcccagccuugggugagccugugcggccuuccacucugggggaucucauguggccacaaggcuggaggccucacccccuuucucgcaguucugcugaccccucguguagaugugcugcagccuugggcccuccccggcccacguccuccguugacacagcuucucuggagacccuagaaggcggcauguccugcccucaaccugccugccuggauugcaccuuucugcccuuucccccucauuauuaaauguuucuuuuugccaucuuguucuccucagccguuacucc

SEQ ID NO: 13575 - RNA, 7255 nt, Homo sapiens
cuuuggggaagugccgccgaggcgccugcgcacugcgcccccgcgcccccuccccgacugucgggccggaccuuggagcgcgcgggccggcggcggcgcgaguggcucgggagcgcggcuggugagugcgcgcgcgcagcgccggggacagcggcccugccccucccggcccgggcccggggaccgugcugggcgggagcuucgggagccggcgcacgggacucgaaccccaagggcucccgccgccagguccacguggacccugggccgcaguggaaguggagcccgccccccgcgcgugggggagggggcgccgcagccggguuccccuuuuucuggagcucaaagccuggggaagugauugcucaaaggugggggccggaagaacccagguuuccgcgucucccucccccucucagcccggugaggaggggccggggcgggacacccuguccgcccccgcccccaccccgcuggaucuggcagccacucagcccuucgagcuguaggggaggcgcugcgcccccggccccagccgaucgggggcuccuggcgcuagccucccuccagagcgccgcaggagucccuccugccgucugacuugagucccugcugcugcagugcacgccccuucggcagccaggguggggcccagacccaaccuggccccuccugcccccaccccgccuuugggucgcuggugaguagggagcuuugagguaggggugggggcgucagaggcugaagaaagaggcaccuggaggagaacacaggcuucuccagacuggacccuaacagcagagagaggagcguggugggugggccaccaccaccauuucagagguggggagagcuggccuucccuggaggggccaggccagggcucgcccaccagccagauguggaggguggcagaugggaaaggcccuggguaggagcuaaggacugagaauggagccccucuucaaccccccucccaaagguuaugacauuuuuuucugggauugucacauuuucuuauucuuuuuuuggacugggcaggcucugggacguucuuuuuccuucuguggagcaaagcggcagccacucccaagggauccucuauccccagagagcagacgugccgccuauccagccuaucccaucccagacuugggggccaaagccugggaggcuggggaaggggguccccaaugccagguugacaagcaggaggacccuaguugagacucuguaucccccaggagagacggggggaggguagccuggggacauggguugccccaguugaccugagaaggguacaggaagccagguccagggacaggugaccagguccagggccugcaacugggaaagaaggggcuggcucccugcucugcagcaaaugcagccccuagcaccccggcccugcaccccuaaacacguccccuccuccaguucagagcugggguggagaugguagcccagggggacagucucaggggugcuagagugugggggaggacccuggguggggacagagaggaggaagaacugcugccuggggaagccacagacagccccgucuggguacagcuaccaaaccucagguugccacgccccuuccuuucccuagaaacuugaccccugaaagaaagcccagcugcagggcuacuuucggucuccucaucuacuugcuaggagcccgugggacccccagucucagaggaaacugggccgguggugaggggccaaggucccaggggaugcugcaccugccccagacuugggccagggcaguggccucugcaugcccaggccucggggguauugggggcccuaagagugcagaacuccagcacugucucuucugagggccauucacacaccgucccaggaggccaagagaagccaaccagccagaaacaagcauucaaaggccacgagcuaggggaggcguggcggggggaugaagauugagaaaauaaaguagaaucaaguugugagcuuccuggccagggaggguggcggcacaugaggaggguggcggaugugcacggaggccccucccugcccugggcagaagugggcgcagguguucacaacugccuccggggcacugauuggccccccuguaccaucgcccaaggagacuugggauucgaaguggcaucuuagguggcaugagggccacucacagcuuuggcgcuccuggugcaccuccccugcagacggugcaaccaaaugcugggagggacaugcaccacaccacaccccccucagggacuccgaggcuucgacuggggagcagggugccccccaccccugccacccccacuucccuggcuggcgcacccugugguagggccuugguuccacagcaguuucacagccuagaggcagugggcaaggagggagggaagucuugggugggagguagcaggaccaaagaaccauguuuggggggcaugucccuccucaccggggcccugccccccuucccacacccucagcaaguccagccugagucccacuuaaauccucacugcugcaggucuagccugcugccccuggcugagaccucugggacccacagacagaccuggacucuuggugggaagccacucugcccacuccccaccccagacacccuagaagccagucuggccaccacccgcacgcaccaguugguagccccagacucucggggccccuuugggaggggcugggagccggaaaccaagaaagaggaacccaggcuuccggcuucccagggagugagcggaugggggugucucggaaccuccagugggggccucaucuggggcccagccugggaggaggggccagaagcugcugcagcucccuccucaaugauccuggacccccucccagcccugcuguaagcuuggggucgggguagaagcccuaggcagagcuggguccagaggcaggagcaggccccgcuagggagacacccucucaggaccccuccuaagggguaggcaggggcugggguuucagguucucagucagaaccuuggccccucuccccagacccccaggcuguggugagggucugagagcugguaccacggagccugggcaaccuccuccgcccacccaugcccaccccgcaugaggcugagaagcagguaugccaccucccccucugccucugcuccccugggggagaugggguggggcaagcugaggggccacaaggagcugggagaucccugaacacccgggaggccagaagggucaugugccugggaacagggcuacccaugggaaggugggggagagguggagagucugguggguucugaccugaaagcugagguagccccacuuuuccccagaucacagggccagaggaggcggaccggcccccuucaauguccagucaugauacagccucuccagcggcccccagccgcaaccccugcugccugugcuggugcugcugcuguagcugcuccuggugaguagggccuggggugcccagcuggcgagggggucgagggcauggggccaagcagacccaggaggggacccagugguggcuuccgaggcauccccgcaggcaggaugccccugccaccucacagcacuguccuguccagggucuguugggcccuggugaugaguggccggugccuuggccccagggagcucauguauggcucucguaccugucuugccaaggguguguccgugugcuguguacaugcaugugcccguucacgcggcaugugcuuuauccaugcugcugugagccagcccaggcuaggcccugggggccugcgguggaguaagacaggcacaggccaggugcaguggcucaugccuguagucccagcacuuugggagggcaaggugggcggaucaccugaggucgggaguucgagaucagccugaccaaugugcagaaacccugucucuacuaaaaauacaaaauuagccaggcgugguggcgcaugccuguaaucccagcuacucgggaggcugaggcaggagaauggcuugaaccugggaggcggagguugcguugagccgagaucgcgucauugcacuccagccugggcaacaagagcaaaacuccgucucaaaaaaaaaaaaagaaagaaagaaagaaagacaggcacagaccccauacagugugugggguggagggacguuugaacagagaccccaauaagggaacugcuggcccuggggcgauggccaagagcuucccggacagcaugcgugggggaagaagagcagggggcgguggcggggacgucucugggcaucccugugagggugggaguggggcucccagaugguaacagauuuccuaggaguguaggggagcugguggauguuuucacaccuugcagaagccuggcccuauucaggcuucaggcccuggcugaugagaggacagcgcuucuggauccaagguggcgucagcugacccacgggcaagcuggggguggccagggggcagucgggaaagggggugggaggagcccaggggccuaguucugucaggacguuugggugcacgaugucugccagccauccaagugcccuggagagaggucagccggguauggauuuggguccagcacugacaggaugcuaggagccaaggcaaagaagcugcuucccuugagacaaccggggaucaggcuccagaaccugaaggaguguggacacggguuuggggcucucaccugcgucagccgacgagagacacugcugacacgccagaccugcagcgugugaccccaucggugggacagggacaggccaagaucaggcccaggagcaggguggcccuguucccaggcacauucccauggguggcccuguucccaggcacauucccauggguggcccuguucccaggcacauucccauggguggcccuguucccaggcacaugacccuucuggccucccagguguucagggaucucccagcuccuuguggccccucaucuugccccaccccaucucccccaggggagcagaggcagaaggggagguggcauaccugcuucucaaccucauguggggugggcauggguggguggaggagguugcccagugggccagggauggggaggagcacaccaggagccgaagggccccuccuggaaggccagagacucgcgggcacugggucacacugcuggaauggaagacggcagagucuguggucugggcacuguggcagggacaguaaccuggacugcagauucuguggggaauuugggagugugggagagugugggaagagccagcuccaggggcugcccuccugcagugggugcccaugugugucaggugccugcaggggcugcccuccugcagugggugcccaugugugucaggugccugcccaugugcugagggccuguguggccguggaggcgugugugcccacggcagcgcugcuuccucucugccacuaggaaccaagagcggcggcgcgcguggcaggccucccgggagagcaagcugcagccccuccccagcugugaaguauggugaguccagccggcuggugugugcgugcugggggggccccagaccgggagacucgggccugacauagccuggcccccgugcccacagugccacgccaaguccugaggaggugcagagcugggcgcagucuuuugacaagcugaugcacagcccagcgggacgcagcguguuccgggcguuccugcggacagaguacagcgaggagaacaugcucuucugguuggccugcgaggagcugaaggccgaggccaaccagcaugugguagacgagaaggcgaggcucaucuacgaggacuacguauccauccugucccccaaggaggugcgccagacaccagaacaggccgggggccgccugcuccaggcacuagguggggaaggcagcucccgcacccccugaccucagugucuuguccugcaggugagccuggacucccgugugcgggagggcaucaacaagaagaugcaggagccguccgcacacacguucgacgacgcgcagcugcagaucuacacgcucaugcaccgggacuccuacccccgcuuccucagcucucccaccuaccgugcccugcugcugcaggggccaucacaguccuccuccgaggccuaggccgcccccagcagcacagaccccgccgccuccuacggccgacucuggguucccuucagguguuguugucggcagggcugucagggcacaugccuggccggcugggguccccacccgcggagacgguccuagacccaguggggagugcugugucuccugggucugcccacccguggccaagcaggaacuccaggugcagggcgggccuccaggugcagggcgggccagaagcccccucaucggcccgcagcuggcuggcccagugcuccuggcugggggcucuugcguggugagaguagggguccccccaggagccaugcuggacccaugagccucgcuggggccuccuccccaggcagccaaugggccccagacaagccuuugguggggaacagaaccuccgcaucguguaguuuugugacauaaggagaccuccuacuugagcugucuguaccccagaaucaaacacagaaccucagaaccagauuuaggaccucagaauccugcacucaagguggcaggacccaauuucuguuuuauauguucaugaacuuuaaaccuggaaacauguccuuacuagguguuuuaucaaaaaaaaguuuucauauuuaucucuaucccuaaccccccaaaaauaggaugucuuauuauugaagauauuuuuaaagcaaagucucuacucauuuuuguccaagucuggggagagacuggagaaugaguggccccagacucagggcuggggagaaguguccuugucccagggcaggggcuccagugccccuuggaggggacacacagccgugugcuugcccucuucccaugcccuggccuccaccagaccccuccucagaacaguggucccaguggguggcugugcuuaacccugcccggggcaugagcuccacgcccucggccucagccuccuuagcugaaagucgggccagaacagugacccacagcaccucagaagucgagaggcaacaggaggugccgcccaggcccagccggacgggguccccagaggcaggcuggcuggggcaggaggggccacuuggugccaggcccaaugucaucuuucucaucucacaggccccaugaguugagugcucaccag

SEQ ID NO: 13576 - RNA, 55217 nt, Homo sapiens
caccauuggccgaucaauauuuaaugcuuggagauucugacucugcgggagucaugucaggggaccuugggagccaaucugcuugagcuucugagugauaauuauucaugggcuccugccucuugcucuuucucuagcacggucccacucugcagacucagugccuuauucagucuucucucucgcucucuccgcugcuguagccggacccuuugccuucgccacugcucagcgucugcacaucccuacaauggcuaaaacagcaauggguaaggcacugcgccucguucuccgucggcucuaccuggagcccaccucucaccuccucucuugagcucuagaagcauucagagauauuuuauaaagaaaaagauguuaaugguaacacaggaccaggaaggacagggcaguucugggggaggugggagggcagagaagaggucuauggaaaucuaaagcgaagaauuucuuuuaaaagguagaagcggguaaguugcccuccuauggguagagaauuuauucuguuuccauauuuaaaauuaggacucaaucgugaggggaggaagcuaccuuaacuguuugccuuaaaugggcuuaagggacauuuuggaaagugcuuuauaacgaccuuuuuuuuuuuuauuucuucucuaguuuaagaagaaaauaggaaagggguaaagggaaggugggagaaaggaaaaagaaaauugcaaagucaaagcggucccaucccgcuguuugaaagauggguggagacggggggaggggauggagagaacugggcacauuuuacgguauugucucgucgaagaaaccgcuaguccuggggugcggugcagggagguaagacggcgggggacaggguggggguaggaccuccgcuccuuuguuuuagggcaagggaggggaaggagagaggaagucgcggagggcguggagggcgcgggugggcagcugcaggggcggggaagcgcgcggcagggagggguggagggacagcggcuucgaaggcgcuggggugggguuucuuugugugcggaccagcggucccggggggaggcaccugcagcgcugggcgcacaaugcggacagccccacccagugcggaaccgcgcagccccgcccccccgcccggugcugcaucuucauucgaaagggggucggguggggagcgcagcgugacacccaggagcccaacccugcggggacagcggcgccacgccccgcgcuccccgcucccgacuccccgccgcggcuuccaagagagaccugaccacugaccccgcccuccccacgcuggccucauuguucugcuuuuaagagagaugggaaaaguggguuaacauuuuucuuuucggaagcaaauuacauagaguguuuagacauagacacagauaaaggguucuuugaagaccuuugaucguuugcgggaaaagcuucuagaaccuagacauguguauguauaauaauagagaugacaugaaaucguauauaaagcaaaagaggucaaagucuuaaguuaagccacgcgaaauuuccguuuugugggucagacagugccaaauaucggcaauuucauaagcucagagagacaagacaguggagacacaggaugaccggaaaagauucuggauucagggccuucauccgcaauuggucuugugccuugagugcccacgguucuggcgcucaguggccccggggugaaaaggcaggguggggccugggguccuguggcagcuggaagcacgugucccccgggacuugguugcaggaugcggagacagggaaagcugccgaaaggacuccaucugcgcggcuccgcccugcccuacccuccccgcggagccggggagaccucaggcuccgagacuggcggggaagaggaauaugggaggggcaguugagcuguaugcaguccuggaaccucuuuuuucagccccgcaguccacaacggcccgagcaccccuugaugugcgcagacccccggcguggcucucagccccagcaccgagccccucccagccaagcggguggcucugcagaaaagcuggcucgagccccgcccggccacacaaaggcgcggccccacccagcccgggcgcgagaccgcagaggugacccccuucccagggauucagggagggcugucucuucucgcccacccacgguccgcggagcucggggcuuuuuuucccccagcccaagccccccgcccacccucuguucucuaugauuuuccagaauggagaccccgcgaggggcuucucuaagggagacccucgcuccuccagcggggcgcggcucggccccaccccucccagcugaggcccagagccgccuaccgcuggccgggugggggcgcacguggcgacuggguguguggagcgcagccagcccugcagagccccgcgccgcgcccugcgcuccccuccccggaguugggcgcucgcccccgcggugcagccggggagaccgguuucugcgcaguguccugagcuacccccgcuuuccacaauucgcaguucacucgcacguccagaaagguucugagaauggguggugggggcgaucucgccucgcuuucugcaccccucagaaagguuuccgcugcaggcuaguggcugcaaacucaucgucaucaucaguauuauuaucauuucaaaucguuguuauuauuuaaugauucaguagccuuguuuguucucauuuguucaaaagggacguggauugcucuugguuaaggauuaacccuuguugcguucgcuuugcuuccuccuaauugcccucaucccuuucccccacaaaaagguaaauuugucuccaguuguucauuuuaaguuauaaagcaaauauauuuuugcuuccugccaggauuauguauguucauguggcuaagauacaugugcaagugcuugcuaagagcaggguuugugugccaacgauugcuggaaaauucucugcaaagaauuguuuguggcugcaaugggugagaauacacauauauaauugagaugaucuucaacauaagguuauaucuauaaauauauaaauauaguuuaugcacaaaauuuuaaguuuuuuccccugaaacuguucuuccaacugcugauucuugauacagccucaauccuacacagauacauggaucgugaaaugguagccgccauccaaauaaaaaucccaccccaaauaugacaaacgcaagcauccuuucuggccauaauuuaacugcauuugcaaaucaugaaaaaaacacuacuucugcaguauuaaaauaauagauuuugaaauuaauuccaauuucaaagauaauuaauuaucagggcgagugcuuuuuuccugauucauuaaacaauuauguauucagcaugauuguaagaggugcauauaauauuccccauuaucuuuucuaaugaagugggcaccuucugaauggauauauaaguaacuagaaaugaaaagcugaggauuuggucagaauuucaggauaaaacugaaagaaauggcaguaguuuaucaauuaaucucauguauuuaguuuauaccaggugaguaagcugagccugcaauaaacacucucugucccaguguaacacgucgcagguagcuagaaugauaggauaaauuaauagaccuugugguguuugucuaugcacguuaaaauucucugagagaaaguauauuuuaaaaugauaauuaagauuggacauuugugcuauuaaaaucuacaacuuuagucaaaauucacaaugguuuuuuuuuacaauaaugugacuuacagauuuguaguaaauuauucuauucuaaaagagaaaugaguguuuuuauuguuacagcuauuaccucauuaauauuuuuagcaaacuuuuauuuguugcauugaaagcaguuuuaauuacuuuggguuuuuauuuuucaaauuacuaauggauagaugguggaauaagcauuuaaucauuuggcacaauaugacuuccaucaaauagcucauucucagugauuaaaaaaugcuacaagaggcuacaauuuacucagauucaggaaauguccuuucagagugccauaaggcugauucauauaauaaaauaguuuucuucccuauaauuuaagaucaaauaguuacuuaguucugugaauaccuagcaguagcuaucaaacagaauuuuaaaguuaaaucuguacaacuaacaaugaaguggaggaugaaucgauacauauugaauggaagacuuugucauugauaaauucaggccaucuuuaggaaaauuccggauuuaucaaucaccauuauuuuuuacuucaacugagugugacugaucacaugcucaggcuaccuugguagcucauugcucacaggaggcugaaaaaagcuggccuccgagcaggaggaagcucagagcacaaaccuaggccugggcguggccacugggagcugcugauagcgaaccccagcucacaccaguuucuuuuuuggucgugggaagaaaaacacauauuauccuguugucacaagaucugugaccuuauaugaaaaaaugcuagaauuuuuucauuaaaaaagaaaauacugaacuagccagugacccagauguuuucagaaccuagacugguucuguccauuggaaaaccucggugucugcauuaacuuuucaccacacuagagggcaaucauguucucuaaaaaagcagaugauugauguaaaccuaguuccaaauauuaacuguuuaauaaaaucuuuucuuuuaccaggaacauucaaguguuuauucaauaagcugaugccaugcuuuacccuaguggaugaacagagcuuguacaauuuucaaggagacaggaugaaaugaguggucauaaucugaaaguagauacacgcccugguuaauuauucccugaugguuuuacuucucaguuuuauuacauuguuauuauaauaccauuuauguuacuucugagauuuuguaguggauaaauaguagaaaaaugucaguaguaauagcaaaguuauuuagcagccgaauauuuuaaugcuuaaaaauaaaggaauaaauuaaagaaaaucauuguuuacuucuucaucgauugaaaugugcccccuguucagagcacaucugaauaucagagucuccaccugcagagaacaugcagcuuagcgaguaaaacaggcagguaugugauacugaggagguguaccaaaaacugacugcuguuauuuuucccaucuucuaagucugucuuucuuuuccauuuaaagauaccuuuuuaaaucuaauccaaugugauuucaaucuaguuuuaucagauuucaacaauuauugagcaucuccuuguagugguuuucuguuuauuagaaaaucgauguuaauuuuaacgaaguaagaagaaauauauaaguauaaacuaauuuuggguaucaucaaaaguggauuuuuuaaauaugcauugauagaauuauuuuuugauuacauuuuauguaauucuaauccagcuauaaaauauuuaauagugucauauuacuguguuccucaaacuuugaugugcauaugaauuaccuuugauuuucauuaaaaugcaaauucugauucaauacaucuggcuugaggcagacauucugucuuccgaacaagcucccagaugaugcugauucugaccacuaaacacaucaguuuuagggauauuaacuuguaauauacagguaucccuccugguaagcucugguauuaugucuuaacauuuuuaaaucuaugguaaucuuuacaaaauauuuuacuuccgaacucauauaccuggggauuuuauuacucugggaauuauguguucugccccaucacucucucuuaauuggauuuuuaaaauuauauucauauugcaggacucggcagaagaccuucgagagaaagguagaaaauaagaauuuggcucucugugugagcaugugugcgugugugcgagagagagagacagacagccugccuaagaagaaaugaaugugaaugcggcuuguggcacaguugacaaggaugauaaaucaauaaugcaagcuuacuaucauuuaugaauagcaauacugaagaaauuaaaacaaaagauugcugucucaauauaucuuauauuuauuauuuaccaaauuauucuaagaguauuucuuccugaauaccaugugagaaaauucuuaagaauuuauugaguaugacuguauauuugaaaagaguguuuucuucugcuuaucuaagccaauaaaggaucuucauuauucaauucuaacuuucuaaggaagucaaccuacagaucagaaagaggaucuucaaggaauagcaucaaagacauagucaggucucccaugcagugacuggcugaccaugcagccauuaccaccuuucuggaaauauuaugcugcaaaaaugauacaauacacgaaauaucucaaauuaaaaaauauaacauuucccaaauagggcacuaaaaacaugaucccaaauaaaacuagcuucaggguuugcagaauauacuguuacucaacacaaaguuggacuaagucucaaaguuagccauucaguuguuguuaacaguucauuucagggucucucagaagcugggaaacuuuccauuuuugcaauuucuuguacauugaaggaaaggaagacacacuuaagacagcauuacaaaaguaauucauguuuuaaauguuuaauucuggcagucgggcagggcucucuguauaaccucauuuggagaugacaaaaaucuaaacuugagggccucgagccaauaagucuuccuauuucuuuacucaaacauuuucccgcaauggugcuuucuuucaacuguuuuucugguguauucauaaauuccagauucucuaugggaaguaacuuuuauugauugauuuaacccuuguauagcacauauaacaugcaaggcauuguucuaagaacuuuccacauauuaacuguguuaaucacuuaauaauccuaaguagguucuauuacagauauggaaacugaggcacagaaaguugaaguaucuuacucaaggucacacaguuagucagauccagaauuugggcccaggccaucuggcuucggaauccaucuuucaccgauugcugcuagucucauaucuguuccauguuagaggugagcucccauugcagaggucacaccugugauaucaccauuuuauuuaaacagaccagagauggucuucuccuuucugaucacagacucaccuugaagagaaaauacuuccaaauugaugccuaguuuuaauagcuuaccuggggcuuauucaaauaauugccaugauuuaggcuuugggagaaagagagcuaugaggccguguggguuguaacguaugagacacauggcguucugcaggcucagcacagcaucgauuucuggugggaacacacucugaugaccaguuccagaaauaacauugacuuaaucuccucagucccaucaugguuagcacauuucaaaaugccuccuuaacuacuuccauaggccagagauauuuaguuuuaacauuuuguugaauaaaauaaauuuacacauucacauuuaauauaacuauuagauguuauuucaagauucucuucauauuaccaucaaagcaggcaggcaggcaggagagaacuguaggaagguuuugaaucccuugugaaacauuuuuaauuaucuuuuaauaaaggaaucaggcccugucauuugucaaggagacauuugcaguaguaaagcuuguguuuauaauauccauuuuuauuagucaugauuaaagauaacauuuguguacauuuguucucacaaaacacuuuuauaugaguguaaagguuaauuaaugcauuucagccaucauuuugcuggucauguggaaauauagcuucuuuaggaauuguacuuagaguaggagccacauauuauacuauaaaaccauaacaaaaauauuuuaaguuuguucucacuuguuguugaccuccagaguaaaauauuuaauacucuggaaaguuauggguuucaaaauuuauuuuauggcaagaaauagauaauuacaguucucauagagcacauuuaaaauaauuuauuuuuauagggcaaaaauauugccuaggacugaaugauuuuuuuuuuuuuacaaagauuguaaagcaacgccugcaagagugcccauuuagcaguuauucuucuggaauaauuguauuuuggauguuggaguucgcacauuaaccauuaguacaaguacccaauauaacaauagaucaucaggauaauaaaucuguccaucuuuuaguuguaugucuuuauaucaggauaaagagaauugagugaaauuuaucuaaaccuagucccacaaauacuuuuacaagagagcauguuaaaguguaaauuaaauuuuuauuagcauucuacucugucuuuggaaguuuuuuuuccuuaugaaaugcagccauaaaguuuaacuuccauuaacaaagcugcucacaguaaaccuauuauaauaauaguuucccaguuugggcuuccuagugaggagcaaccuaacucacacgaaacaaccccaacuuauaauauauugacuguuacaaaacugagaccagaaaaucccaucaagaugguacuguuaucauuuccagacucucgggaagaacauuaaucaucucaggcacuuuuaggauagacuuauugcagccucccugggaacucugcuucagaacauaauuauuuuuauuaaugcagaguuacuuuuuauuuccaacaaaaauaucuauuguuauuauuuaagucuuacagcuuuaucugagaaauuccaauuagcacccuucucauaauaaauauucaaacacaugaaaaauuaccaaaguuguucuagucuuuuaaugacauauuacaugauccugcacucuugucacuuuaaaaauuaucuuuuuauuauauuucugaugauuuuuuucuuauauaguuuuuuaaaaggagcaggcaagcauagaagacuaaaaaauguucaaaagaaaaauuaaaucgcaugaucuaucuauaugggaccuugucauuuuuagaaaacauucaccugcuucauccuuuugaaucuucauauaaucccucugagaugggcauacuauacaaguugucuuauuuaaagauugguaaauuuaagcucaaauaauuuauucaguggcaagccucagaggcagacucggaacacaggucuaauauauauuauauauauauuauaacauauaauauauauauuacauauaauaaaguuguguauauuauuuaccuaucaaaauauuuauauguaauauauaaauauguuauauaucauguaugugccuauuucauacauauauacacauucaugcaaaauaagguuuagcacucccuccacuguccuguaauaaaacaugcacagugagaauagucauacacgaggcauauuugucuucaguuuaaagucauugauagucagugucacuaacuaaaguaaaauagauuggagcaccaacuuuguucugaagccugugccagguauuaugagaacaaaaauaaaaauguuccucacccuugguggauuuagucuuuugcagaaaaaaagauccuguacaugucagaaaguucaauaguaauaaugguaauuuauaacuauaaauggaagucaccaucucacaauuucaccaucuuaacaauuuuguuaaacugcccuacaauauuacaagauaguacauaaugauacacuaguaacaucaacuaggaaguaccaagauccaccaaaaggcugaaaaauuuaaauauuuaaugaguccaucaaccaaucuggccagagaauucuuuaauuaaaaugcuucccaaauuuuacugagaaucagcagcguuugaggagcuagccuccacccccagagguucucacucuauuaggucugaagcaggucccauggauuugcauuucuaacaagcucccagguggugcugaugaggcugauucagaaccacacuuggaguagaccuaaaacagcagugaccuguaggguccccaagcagcaggccaggacagcaugugaguuacguccucuguggagcucugcaacaaggcgucaagaggucagagucuaaguccccaucagcucugcccuucuccaccagugcugcuggugcugcauggaaggaagagcccagaagggauucugaguuucagucuuuacucuugcugacgcaccuuggucaggucaauuuuccuguuuguuccucuaauucagcaucuguaaaauagccaugugaacugccuuguccauaucagagggucuuuuucagacucaaggaaaaaaacgugaaagugauuagugucugucaaguaguauauaaaugcaagaaguugaguuuuuaaauugucauuagauauaaauacccaugugcaugcauuuagaaugaguaaagagggaacaaggagcgcaaucaaaaacugcgucauuugcuuuuugaaaaauacuuucuauguaaugaaaagugaaauaaaauguuaauugagucccucugacaacagcaucagacguuuugcaguucuugugauuagaacccaccuggccagcccuucuuccuccuaaagaagagccuucuucuucuuaaaugaagguuggcucagaagaagcaauuaacucauucaacguuuuguuacagucaauccacauccaacuuuuccccaacucaaucugcuuuaagggaaggaugguaagugguggcccaagauggcaaccaucaagcuuagagaaucucuagaagcagggguguccccagcaaguagacacugaaaauaugagagggcugauaagccagagauaaaacucaguacuuacuuugcuucuaguccaugucuaccccuuucuuggcaccaccuugacacuacccucugaguccaccuuccugagaugguacaaacucugcuuagacaaagcagcccauguccaaagguguuagggcucaguuuaaagcugccuucaaaaguuaaaacagaaguguaaaguucugugcaauuaaaaauaaucagcuugucuuggaacucaaacgaauguaaaauccuaugaaaauuaaaaagcaguaccacaaguuaccccaaaaguccuuaggucaguaacuguuccuguuacagguaagagagagcauggauuagaggugggcguggguauccaguggacaugguuuugaaccaugcuccacuacuacucacuaucugagaauucuuaaauuuauuaaucauuucuauauuauaauuuucucaguuaugaaaugggaaaacaauaccuaaaucacaugguuguuaaguaagcaauugauuguuaagcauuuggucaucaaaaauauuaauccccuucccugauucccuagauaaaugaugaaaauacuaaauaaaaauaauaaaaauuuaaagugaacaucucaauucuuauacuuuguuaauuucuacauguauuacaaaucuacuagaaauuacuuggaauugaggaaaugauuacugcuuaauaauucuuugugguagagggagaguugguaucauauuuaugagacagcagccaauauaguauaucucaaaggaaaaaauccauucuacauaaugccagaauuuaauaguuaagcauuuuaucuaggucacagcacaauaagcaagauggauaauuaaaauaaaaguauauuucucuugcauauauuucucauuucauguuucccuaucauauuuuauaucuuaccuuacuucaaauacauauauaccuucaauaaaacugagccuucuugcuuacccaggaaguuucaucauucaguagaaauaaaagaugacuuuagaaauauuaaaauacaaaaaucuacacugaggucuuuugaaugcaggaaaaagaauuauaucacacacacacguacacgcacgcaugcauacacacacacagaaccucucguucuuucuuaacaucuuaucaauccaucaguuucacucccacuccguaucaccugacugugcacaauaucucauugccaccucccagucuucucccugccuggcacccuccugcucuccugcuuccacuuuaaacacccuuccuucagcuaggucuuuucuuucagggauccucccguugcuuucuuaucuggaucaauuuagccuuccucuucuccacccauuaguggauaagcacgacaaagacacuagagucaaauaauacaaacagaauauaccuuagaugaguauggugaugaaaaggauauggauacuuagaguuuagcacuauucucucagccacucaggaaagcaacgccuuuacaaucaauaguguuucagguaccaaucaauaaucuguuauugcuauuuuuaaaaucuauaagguaucaguaaaauguaauuacuagagcaacaaagauaucuugugaaaucaaauuaguauucauccagcaacugaguacaaagguuuaagggaggauaacuaccaauaccaaaacauuuuaagcauuuuguuuugccuccuaaauaucaaaucauguaaaugugugguacauaaauuaggaauuauauuuaugacauagcugcagacauauuaagagaaauaugugcuuauauuuacaaguauaguacaguucuuuuucauauuagauacuguugaugauaaucugcauauaaaaaugcucaauauuuuuucacauuuauaagccauaaaauacagcuaauaaaauguguuucuacuuucucauaaacauggaauagugacaaacaaggagcuuuauaugaaagcaccauuacaauuuaaacucucacaaggucauaauauauugcacuaagcaggagaguucagcuuauuuaaaaaaaaaaauaaacucuaaugagguucuggaaugcagagccaaagcauaaagauggaaauaaaagaauugcaugucuucugaacugacuugguugaugauuuuuuuaaaaaagguuuugugucuucugacuugguugaugauuuuuuaaaaaaacguuuugugguagaacaaauaagguaaaugaaauucaguauuuaggaugaaaaguuuuucuaauuucaggaacaacauugaagaaauauugaacuaagcagcuuugaaagaaucagauuccauuuguugaaauuuuucugagaaugaauuuuuuuaagacaguguacacaguugcaguguguauugguuauggauuguggcaagcuauauuacaacuuacccaagaaauaaggaggcugggcgugguggcucacaccuguaaucccagcacuuuggguggccgaggcgggcggaucacgaggucaggagaucgagaccauccuggcuaacacggugaaaccccgucucuacuaaaaguacaaaaaauuagccgggugugguggcgggugccuguagucccagcuacucgggaggcugaggcaggagaauggcgugaauccgggagggggaguuugcagugagccgagauuguaccacugcacuccagccugggcgacagagcgagacuccgucucaaaaaaaaaaaaaaaaaaaaaaaaagaaagaaagaaagaaggaaaaaagucacuugaaaagaauacuggacuuuguguccagcuugcauagcugaaaagaauaaaaaccuguccacuuaaacucauugcaaaaagaagaugucacuccuacaaauagcaaagagucaugaaauuauucuauccagaaaaguauacauuucaucccuuuggauaaauuuuagaagugaacuaugaauacauacggugaggauagccagcuaagaagucaagaaggauuucucaaauuugcugcucagaaagaucauacucuccacaaaacaaauaauagcaggcuuuccaagucaaccuugaauccagcuuuccuuuaucuuuccuucuugugaacuuucacuaguuuacuaucuaacaaugaauuugacgauagccacauaccaucuuauagcaauauuuguuaucauaucccuuguuauuuaucauucaccugcucugcuugagccagcuacaagucacaugucccacgcacuuuuuccuguuugauuuuuuacagcacuuugagacaugucucauuauuccuacuugacaggaaagaagccauggaaaguugagugacuugcuccugaucacaaaugcuggccaaggaagagucgaguuucaaaucuaaugaucuuuccacugcacucuagauuccucauuuugaacuauuuuuuuauuuuuugcacuauagacuuuuuuccacauuuugaacuguuuuuuauuuuuugcacuauagacuuuucucuuauacccaacuauauugaugacuucuuuuaggcuagaaacuuguuucacuuacuuucccuuucuucagauugcugcaauauuggccaacauguauuggguacuuacugagucaaguacugugauugugccaaguaucuuauaggaggauuaucauccucauuuuuacaggugagaaaggaaaggagguaaagucacacacagccaacaaaaaugguagcaccaggauuugaaacaaaucagucugacccaaguugacuuuguuaaccacuguaugcacagucuucuuagacauaguaagagcucuaauuguguuuggugauuugauuauuaugacaaaguaaguaagggaagcagggagaauuauaagaaauaaggcuccacaacacuuggcuauagcaaagccccuuaaaacuucaaaaggucacccaaagaauaaagaucaggcugggagcaguggcucacgccuguaaucccagcacuuugggaggccgagguggguggaucaccugaguucaggaguucgagaccagccuggacaacauggugaaacccugucucuacuaaaaauacaaaaauuagcuggauguggugguugccgccuguaaucccagcuacuugggaggcugaggcagggagaaucgcuugaacccaggagguggagguugcagugagccgagaucaugccacugcacuccagccugggcaacaagagcaaaaaacucugacucaaaaaaauaaauaaaucaaucaauaaaauaaagaucaauuuggagaaauuaaugcuuauuaauaagcaaugucuugcacagcacuucaguuucucaauacauuaccuaacucaauccuuacaacaacacccuauccccauuuuguggauaaauaaacucauguucagaagguugaauaaauuaucuaagguuaauaguuccugaccuagagcucaaaucuucaguuucuaucauauucuugcccuuacccugggguagcuaacauucacucacuaguauuggagcuaaaauaagggagagaacauauaaaugaauacaaaggagacauucaccugccuucucuuucuccuuacauagagaagguugauuaucugcuauugugaaguuugccuuuugaaggauagaaaugagaagacuuucuuaaauuuugccucuacgccaagaaauuagagugguaccaccaguaguuccauuuucaaacuaucacuguagcuaaagcuaugugguaagggccaaggaaaagaaguauucuugcacuucaaaaugcacugaaauaccagucaguagcauaauauaaaggaauuuaguggagagaagaguugaccucaaucuggcuccaacaucucggcucuuaaccccuacccuacacuuguucuucauggggaagcuaauugggccacuggaagauucagcagcuaccauuugcagcugagggacagccccucccugcuuagcaaccaauggauaugcauuuauggaacaccugcuaacugcgacacacacuccuauguaugagggaaaauacaaaaaauguuaaaggagaugccuucccuugcccucaggaaacuuaaguauaguugcaaagaaaugauuagcagcaaacgaaaccauggagaaguaagggcuaaggucugugaaacaagccuagaaaauaaccuuguccuugaaaaacacaaaaagaaagaaagaaagaaaagaaacuccaaggcccuugugaaggaaaccauuaaguuugcuucacuucuguguuuaggaagacacaaacccagucuuaaugaaccucaaggccacaacuacuggagacauuuaggaauugucaccacauucuaauguauauauccucuguuuggcccuuccuauuaauauuuuguaaaauuuuugaagauaugagcaauguuuaaaaccaugaaucccccuuuuuuuauaaguaauauuuaggcugaauaaacaagagaaaauaggacauaaaggggagccaacgugugccuucauuuauaauguauucccaaguugugaguuugguuuaucagcaauuuaucaugccaaauuccaagucauauuuaucuaugcagaucaaacacuugauucuauuuuugccuuaauuuuuuuauuggguauguuuaugaccaagucauaugguauuuucugugacagauaaaaugcacagguuauuccaaucuggcucagccagucauagcaacauguaguccuucucaugucuuaagaaugaguaucaagaauucaaagggaguuccagauggcauccaaaaagcuuacaguuuaugcaucacuuauucuaacaguagaaaaagaauauuugaagccaaaaauagaccuugcauguagcauguggaagaguagaaauugcccugauaguuaaacaauuugaaauucaagacauuaauuucuuuaugaagcauuugucacaucauagguaauauuuuaugccuaucauauauauacuuauuaugaaauacaaagaaauuauucauucuaucuaagacuuuguauccuuuaccaauaucucuccauucucccaccuccacccuagccccuggaaaccacccuucuacucucugcuucuaugaguucuuuuuuagugagaucaugcaguauuugucuuucuguuccugucuuauuucacuugacauaauguccuucaggcuuauccauguugucacaaaugacagaauuuccuucuuaaggcugaauaguauuccauuguguguauguagcacauuuucuuuauuaauucauuuguugauggauacucauauugauuccauaucuugggucuugugaauaaugaugcagugaacauaggagugcagauaucuuuuugacauacugauuccacuuugaugggauauauacccaguagugggacugcuggaucaucuaguaguuuuauuuuuuuuuauuuuuuauuuuuuuuauuuugagacagagccuugcuaugucgcccaggcuggaguacaguggugccaucuaggcucacugcaaucucugccuccuggguucaagcaauuuuccugccucagccuccugaguagcugggauuacaggcacgcaccaccaugcccggcuaauuuuuguauguuuaguagagacgggguuucaccaugucucgaacuccugucuucaagugauccguccaccucagacucccaaagugcugcgauuacaggugugagccaccacgccuggccuaguaguucuguuuuuaauuuuuugaggagccuccauacugcuuuccauaauggcucuaggaauuuacauuccaccagcagugcacaaggauugcuuuucuccacauucuggcuaaccagucuccugucuuuuugagaacagacauuucaacacgugugagauaauaucucauugugguuuugauuugcauuucccugaugauuagugaucuugugccuuuuuucauauaacugcuggacauuaauaugccuuccuuugagaacuguguauacaggagaaaauaaucacuucucagaggagcuuucauuucaaaauauccgggaaaaaaauagaaaaaauggaaaauuuauccuagaguaaguugucuuuuauauuuugacccuguuugugacauaaacuggaugauacaaaacuggaaugcaaaggcuuuaggaggauuacuuacuuacuuguauauugcuuuagguuguuugcagaaaauuauacuaauugaaguucaggcuaugaugugauaaaaucuaugucaggagaugagucuacaugcaaaguuugaggaagugacauuugaguuucaaaacaaaaaagcaauuuucaaugucauaucuagguuaacccaaaagauuucuuucacccuauuuagcugccucuaagauggaugcugaggauaauuacacuguagaacaauaggacgaugcuucacacucaccucacaggcucuguuauucccacauacugccagagauacuccaaaauaaaaucacugcaacaucaggcaguuauaaaccucaacgguauuauuuucuauuuauauacaguauauuuuauauuuuacaaguauaaaauagaauauauuuauucuauucucuuugacacaaagugaccauaagacauauuacuuaaguaugacuagcaaagucauggggcuugucauucaggaggaaacucuuaacuaacuguucaguuuuuguucacugcaccauuuacauaagccaaacuaaugcuucacacugugcaaaacaaugcacaguguugugaaugaauggcuaaaauaaaacucuaaugagugggguuugaaaaaugcaacuuuagaaaacuguugagaaaauguugcacacugcgcauuuuacaaaauuucguugaaggacacuggauauucuuuuuaggauuauggagggaagcaaaauuuuggcuccuacaugcaguuuuuguggccuuugccugaaauagucaucucccauuaauuauuuagauaucauucauuuccuaagacaacauuuagggagacugccuuaaguacaauuuguacacuacccagauaagaauucuuuuuggugaaacaucgauaaauauuacuuggcaguaacaccaaguuaaaauauuuguuucacagucgacguuaauaacuauuauagauaaagugaauuuuauaagacauacucagaucuaaaacagcaauauggagcucuucaaauccauugaaacuucauaccagccuacggaaguagagguuuuuaugcaaacucuucaagaaauaugcucugaacuuuuaauuccuuagauugauagaggaauuaaaucaugauauaacuaauagguuugugguacaaauugcugcugcuuaaucugacucugugucuucccaguguucuauaugaauuagauauuccauuaucuaaagacaaucaaccccaucccacggugauagcucuaggacucccuuugaguucauuaaaucuguauucucagucuccaaacuucugguuaauucaaacagaaaagucaacuggcccaugaacuaaaauaaagucaucugaauuuuuuuuuuauuuugcagugugauaaaagucucgcacuuuuuauuucugaaaguuucugcuuucacugagagcauaauaggcuauccacccuuaugcaaucuuacauacaaagucauagucaggcuaaauucaaaaacacaugugagauagaagucaacguuuauuuucuggagaaaagccacacauuacaacaaagugaacaaugaagcuggcauccuuaucacuggugaccaaaacauuugugacucuggacauuggccccacaaaugcgauaaacauucugcauaggaagugaguuuugcuaauuaaaaauggauccaaaauacuuucuacucuucagccaagaauuaaaaaguaauagggaggaauugaaaucacuugggugcuacauugagccauucuggagaagcaauucagagaaugucauggcagccucaaauugcugcucaggagcaucccagcuuagaagauugcaggaaaggaagagcaaagucauucuuacaugagaacuguccuuaaccagaugaauagacucuccauuuuuuacccuggcuuugucucauuuaagucccaaccaaucuagcuaucauuuuagguuuuacuaccugcuaguauuuaggagcuuagggggauaaaaaaaucccucaauacucagaauuagacuuggugauaaaaaucuugacacauaaacagaauaaagcgcuuucauuacuccucuaaaccacagugucauuuggucucuaucaaggacuguaagaauuucuuucaucaggggaaagaaaaaaaggacaagagccugcaagauguagcggaacucucauuaaacacagcaggagcuuuaacuggaauccagaguaaggugagguaccagguuacaacaauuuacugcuuuuauuacaauuuugaucacaaggacugauucaugucaucuaguuucuuuuccuugucacuaucacuggugcuaagaauacaucaaauugaaauuuaagagccucauauguuucuguauaacccagugauggguuguacugcuuugaccuucuuaaaugucccuuuauuucauuugauauccauucccauagaaaaacuauaaugcuuugguuggucaaaauauuaaucuuucaaaaccucccuggcuuagaaaaccaaauuuuuguagagagagauggguagaaucuaauuuuauucuaaagcaauuagcauuacaucaucacagcagaaauaucuagaauauuaccucaugucagugaucuucugauauguuaaaaaggguauuuuaaaaucugaguuauuucuuuuucuuuuuaaaguuacaucauuaauuacauacucaucaaccaaaauauuuuaugcuccaaauuugaaccgauauaguauguaagaaguguucaaaaugaaauuauuuuggucuauuuugucuuugaagaagaucacagggauggaccucccaaaaggauuuuuaaaugggauuacauaucugacuuuuaaaaaaaauuaucugaccuugaguuauagugccccaaaguaagcaaaguuccaaacacacaguaucaucagaauugaguuaaaauuaucaccaggggcuuaauuucugaaauuaaaaaggaaauguuauuuccuuaugaaaagaaaaggaaccaaaaaugaacuucaagguagcugauuucugucuauguuaagacuuagguaaugggagaaagggaaaaggaaggacagaauuaggagaggagcaguguuuaacaauugcgggugcaagacucaaguuuuuuagaauccauuagcagagaacccuauuucucccauuaacugcuguccuuuuaaauccuggcaccagcucugaggacugcaggguccauagcuagugccccacucuacccaguuuaaagacaccacugccuggaaaugacagggguuuuuuucuuaaggaaagaggugcuuucugccacguauauauaaauugguaagcuucaaauaaagugcuuuuguccuuucugucuaucagaaacugugcaaaucgaauugcuguaaaaccaagggcaagagacaucaauccugcauucuauagcaucugauuuuauccuuuauccccaggcacauuucaaaaggaaaaaaaugagguugcauuuaaauugaguauuugggacuugccaggaaaaccucccgcuagacuaauaugauugcagggaaaacaagagaaaggaaaaguggagagggagugugcuaacagauccugggccucgucagcagagccguccugagcacaaggccauggucagacaucuggucccgcgaaugacguuuucuuuauggucauuaagaacaccagugugucgggacacaaacaaguauuccuuucagggauuaugacacauuuucucccaaaguaguauauuaaugacauuuccagagcauucuuuacuaucuuuuauaugugaucaggaagacuaauacauaucacuacuucuuuuacacacagcauuagccaaaacuaaagugucaaauacaauuuugccuaggaugaauaaacagaagaaauuuuuaugauacugcacuaucaauuccaaauuaaauaacaacaaaaugauaaguguuaaaauucauauuaaugauuguucccacacaagccggaaaaaaucuuucuaagaagucuuucaugaguuaaucccaucuuucaaaguguucaguggcuccgaauucaguuacuguuuccuaucaguucuucuuucauuaagucucuucccuuuuuuuucucuuugcacuauuucccuuagccggguacauaaucugcugugcuuuauucauuugugucuuaaguuuguuucccgaugacauaccuuuccagcaacgccaucuggggaguuugggcaacuguaccacguuaggaggaaacccuucuucacaggagagugugccuuugcugcagggaaggaauuaggauuugcuuggacugugguugcagcuggcuuuuaaggaucuccuuagaaugcaagcaacucaucaaugagaaucucugcaaugguugucacuggguagagucaugcuauguggggucauagccuuugaaacaaauaacaguaaagauaaaaaugcuauuaaaggaaucaccacccacagagguuaacuggguuuuguccccagaccaccucgaacaagaaagaacauuuuuaucagucauuuucuuaguuuuagcugauaaaacaaaguaccauagacuagguggcuuauaaacaacagaaauuuauuuuucacagcuuuggaaacuggaagucugagaucaggccgccagaaugaucagauucuaguuagggccuacuuugcuuuugcagacugccaacuucuagcugcauuuucauguggcaaaaggagauugagcuagcucucuggucucuucuuauaaggacacuaaucccauucaugaaggcuucaccuucaucaucuaauuacucuccaaagaccccaccuccaaauacuaucacauugggaauuagauuucaaauacaaauuuugcggggacacaaauauucaguccauaauaguaaugauuacucauuauacauagggcucuaaaugugcuagcuucugauaguuuuuacacucacuucucuuuauuagcuugucaagcauaauuagggcaguggccuuacugaaaauuauugaauuuaguuuccuaaggacagauauugaggaguuuuuucuucacuaaaaauucacguuccgauacagcuuucaucuguuacuacuuugugagauggaaaaucuuuuauuuuauuuuuauguuuggauugacccuucuuaauaaagucggcauguaauaugcuucauguguuucuaauaugugcuuaauuuugcaaaauguuuugcauaccagaaugcauuucucuuccaaaaaagguaccagccuacaaaaccuugcuguuacuguuuucaauuaguucauggaauuaaauguauuaaauguuuuaugcucuggcagaaauuaugauucucacuuaacuccauauaaaucuggaucugccugggccuuuauaagugacacaauuucauuaacugaauaaacaaaugauacaaagaaauuugguuuagccuucuaaaauuccaaaggcguucaacaaaauaucucagaauggauguuccaggacuuuuauggcacaggacaacauguauugcuuauuuuaagaaaauaagcuaaauagugaggggauucuuuuagcagauccucaggauguguuagguugaaucauaggcaaaugauauuugaucauugcaccuguuaacacauugaaccucauccuaaaauuguagagcuagaagaaagccuucuggcaguuuuuaaauagauugauuuacugcaauuuauccagaagcuucaccguugucacuggcuacaugugacuuuggccucuguggggcuauauccucauuuguaaaauugguggugagguagguggacaguugacuaaauaaucucuuagaauaauucuaguaucuguggaucuaaagcauccagggguugaauauguuucuuucuggccaagaaaagaugcaccugucaauaaugcccaaacucaucuucugagaauccucuuucccaagauacccacucucccuuggguuauauuauaguaaugaucagaagccccugccaagaagaaacuguuaaccugggaggucuauauuuuauuucacagccaucuguuuauacuuucucacaaguuagugcacaguauacccaucauuuucuaccauuuuccuuaauuuauuaauuuuacuaauugcauaauuaacaaaaguaagaagauuuuaccuccuuauccccaucugguaguuugcagauacuuggccugaugacaacugacagugaugagauacucaccaaguuuaccagggcaggaggcuuccuagagaaaaaaugagaaaaugaaauggggaaggggagugaaggauugaggaggugacaaucuggacucuugcaacugcauggcaagguuggcacacaagcuggguugcaacggagggaaggagauccuuaucagauguaaucagagcucagaucgagggcuuugguguguguagaaagagggagagacaaagaacuuaaaacagagcugccauuugaccuugcaaucccauuacuugguguauacccaaaggagaauaaaucauucuauuaaaaagacacaugugcuuguauguucauggcagcacuauucacaauagcuaagacauggaaucaaacuagguguccaucuauggcagauuggauaaagaaaaugggguaaauauaaagcaugcaauacaacauggccauaagaaaaaaugaaaucauguccuuugcugcaacauggaugcaguugggacccauaauccuaagugaauuaacacaggaacagaaaaccaaauacagcauguucucacuuauaagugggagcuaaacacugagcacacauggacauaaauaugagaacaauaaacacuguggacuacuagaggggggaaggagagagguuuguaaaacuaccuaucaggugcuaugcucaauaccugggugaugggauuuacaccccaaacaucagcaucauuuaauauucccauguaaaaagacugcacauauaccccuuguaucuaaaauaaaacuugaaauuaaaaaaaaaagaaagaaagaaagaggcuggaaauagaggcucacaccuguaaucccagcacuuuggguggccaagguggguggauugcuugagcccgggaauucaagaccagccugagaaaccuggugaaacucugucuguacaaaaaauacaaaaauuauccaggcaugguggagcgcaccuguagucccagcuaauggggaggcugaggggggaacaucacuugagcccaggagguggagguugcagugagcugggaucacaccacugcacuacagccuggguaacagagcaacucugucucaaagagagagaggaaagaaaaaagaaaagauggacagauaagaaaaugcacuuggagauuaagagaaagcagcaacauaggacccuggauaauguguuugcuuaauaacuauccugaugaguuaucugacuauucccaaaugaguacguggcaauucaggcugaaccaucagaguagcccuccggaaucuuacuuauguacaauagaccugcaugcacauuuacuagaaugagccucucucucugguaaucaugucugcuuccacuaauuccaucuguuuccucucucucccuccuauccugcuagaucuuaauuccuucgaccuuccuuuguuuuucuaacucccuuucuuucucuuguuauuuaaccugcuauacuaugcaauugaucuccucugcacuaaggaacaugcacuucagaauucuguugacaucuugcauuccuuuauauuuagugaaagaaugcaaaggagucuaccuggcaauauucacucugcaggaggcaauaauuauuauucaaauuaaaggaagcaguaaagagaaauucagaaaaaaugaaauauacuaaucuucagcuuuucauuucagccuacaaggaaaaaaugaaggagcuguccaugcugucacugaucugcucuugcuuuuacccggaaccucgcaacaucaacaucuauacuuacgauggugaguaaccuaggauagacauaccccugcuagcuagaucauuuggaaagguugacauauauuuguuucuuacagcuccugauauaauuacaucaauauuuuguagcucucacuauugacuugccgugucuagcuauuauguccaauugauuaccuauugcugaaaacaguuugaauuuggugcuaauaacaacacaucaaugucuguuaagaaauguggauggauucuuauuaacagccacauccagcauaucaacauccacaauaugucuaaggucuuucuuugcaaauaauuuaauaggcuaagccauaauuggaguagaucauaauuuguaagaaaaugcuuuauacuuagaaaacucaagagaaagaaucaacaaccauaauuguuuuugcuuuauuguagucuuuauaaaguuucuauacuuuguauauacaugucaaccagcuaaugauaauaauaauuggcucaauaaauaaaacugacuuacgacugaggcccuagauaaagagggucugaaaagaaaagccuaaagaauuagcauggcaauuaacaugauugaggugcaacucuuuagguuugauuuauccugauucauuuugcuuacuuuggcucugccacaauccacaugaucuuggucaaauagauacuuggauucucuaagucucauuuaacucuagcaucuuccucuuggaguuguugugagguuuaaacgguuuaauguaagucaaauaugcaaaaccaagccuagcucauuauaucacucuacaaugauagcuaucauuaucaacaucauccuuaccuaauucagucaauuuaacuaaaauauuuuauacaguucuauguauccuagauaucccuaaggcauauuuuacuaacucucaggcucacaaauauuuuucuuuuccauauauguaaagaaagacauuaaugacaaaacaaacugaccuuguggcaguuaaccccuucugcaccuuuaaagccuauucaaggacucaaaggcauuuaccuuccaaaguuauucuaucguagcacaaaaaucauaaaugcuaauuaacuguuccauaaggaaauguccuccaugugaaaggaauucugucuccaaacaaaacauucauuagaaugcagggccaaugccuacuuuguacaaauucauucggucagcaaauaaauuagacagaccuuuauuauuugcuagauguagcugugaagaaggauccagcuauguuucuuaugagacuaaugucgaacuauggguugucacugaggauccagaguuccauagggcguaguccucaccuucaaagaauucagggcuuaguagaagagucuuacacaaaugacuagaauguagaacacagagugguuaggacaaaggagccagggaugguuuuugcuggguuagggaaugaaaaaaggggaagaaaauaugugaaguuaugugugagcugauucuugaaauaagcuguuuuuauuugccugcguucucuuauaauccuuuuccauaggcuuccauaauuuuuauugagcuguauuuaaaguugaauagauaauucaacauuucucguaaacugugcuuccuaaaagaguccguagagaauuucaaauuucugcagucuuuaacuugaccugguauuucuauguuagauaauaacgugacuuguuuauugcaggcaaacauuauaacaauaaauuauuauuauuguuuacauuuguaagcacuaaguauauggcuugugcuuugcauucagcauccuuuaucauuuaaucuucacaaccaccuuagaaggaagguacucuuuuuauuuccaucuuuuaaaugaggaaauaaaagcauaaagaaguuaauuaacuuaccuagugucacacagcuauuaagaggggcuuacuauuuggaugcaaauauaggcaguucuaauuccagagccucuaaucuaaggcauuuaaaaccccaucaccuuaucaaauaagcuguuuuuauuugcccguguucucuuauaauccuuauccauagguuuccauaauuuuuauaaaauuguauuuaaaauuuaaguauaaucuuggaugccaucaggaaaaugaaaaacauuuuuacauuugugaaggaaaaagcccacaucauuuccaauauaguuauugaguuaguauuaucuagacuaucuauuagcagcuaaggaucugaggucaaggccugccagccuggcauuuuacuugaccacaaccuccaugugcacuaaccaggcugcuaaaagaacauuaacgggaacauaaccugcuggcuugguugccacaauuuuaaaaagacguuaauaaauuagagagcacuuagagguuaggaaauaauauggugguaaagaucuagaaacagugucauucuggggcacuugaagauguuuagccugggggaacaacuugaaauggaacauaacuguuuucaaauacuugaaaaaugguggugcaccacagagaauggccuaaucauggguagcuucagacuucaaacaaggaucagugggcuaaaaccagagagauggaguuugggacucaaagaaugcucaucugaaauugagggcugaccagcgagguucuuuuaaaaaucauugcauuuuacuaaauugugaguucuguaauuauaaauguccuagcaggugcuagcugucaucuuuucuauuauaaauuauacuauuuuauguuauaauuuguauuauacaggcuuaaaacauaagggucugauaaucugcuuaucuuuaauacauaagccacugauagaaaauaaguggcuaaccauucuucaguucuuuuuuuaauugacaaaaauuguauauguuugcgguguauggcauauuuugaaauauguauacauuagagaauggcuaagugaagcaaauucacauaugcauuaccucacacaccugucauuuauuugugaugagaacaaaaaaucuacucuuucagugauuuucaagaauacaguacauuguuauuaacaauagucagcaugguguacaauaagucuucugcggccgggcgugguggcucacgccuauaaucccagcacuuugggaggccaaggcuggcagaucacgaggucaggaguucgagaccagccugaccaacaugcugaaaccuugccucuacuaaaaauagaaaaauuagcugaguguggugguaagcgccuguagucccagcuacucaggaggcugaggcaggagaauugcuugaaccugggaggcggagguugcagugagucgagauagugccacugcacuccagccuggcaaaagagggaaacuccgucucaauaauaagucucuugcauuuguucuuccuguuuaacugaaauuauguauucuuugaucaacaucuccccagucuccaccccuaaccccugguaaccacaauucuacucugcuuccgugaguucaacuuuaugaauaguccacauguaagugagaucaugugguauuugucuuucugugccuagcuuauuucacuuagcauaguguccuccagguucacccauguugucaaaaaugacaggauuucccccaacuuuuuuaaggcugaacaguauuccauguguauguguauaaauuagauuaguagauguugccacucccuccuccaccacaguggcucuaucccuggcuccuggcuccagccgaguacacuagaggaggauauucuaaacagcaacaacacaggagcaaagacauuacaaugggguguugucuuauugcccccauuagacuguaagcaucuugaagacaaggacccccaucacagagugauguugucaucccuggagugggcacugugcaugauugaugacuggaagcaaugaacauacagaagggcaaaacagaaaucagcaggaugcuuugcauuucagcauugacuuugccaaauaugcccaacuguucagggaguuacauugguucuaacgaagcuccugugauuccuaagcacaggaauggugauaauauauauaauggugcaugcauauauacgcauaucuagauaaugauaucucauuauaugugagaacugaagaacuccguuauguuucucgucuaaccaaaaagggccuacagcuacgauaauuuccaaacaaauaaaucugugcuacuugauuuucaugcaaagcucauauuuguucaaaaggaaaauaaagcuuaauuuaaaaucaauuuaggcuauuuuuaucuaaguaugcuuaccguuauucaacucccugcagauauugucaaauuucucaauaugguaaauauuuauucuguuaaaauauauccauaguuacacuaaagacagagaggucuuauauguucuaaacaacauagagcaaaugcucauaaacagcauuuuauuccuaucucccggaauaacaacgcuacuuccaauugcuggaaucuaaauuauuaaaauaaacccaugcugcaagcuuuguaugcuuaacauucucaaauguucacuuuucagauauggaagugaagcaaaucaacaaacgugccucuggccaggcuuuugagcugaucuugaagccaccaucuccuaucucagaagccccacgaacuuuagcuucuccaaagaagaaagaccugucccuggaggagauccagaagaaacuggaggcugcagaggaaagaagaaagguaacuuuuuccauagguuuuccuucucucucucccuccccugcuccucccucucacacacucgggcacacaugcacgcacacacacacacacacacacacacacacacacacacacacacauacagagagcaaugacagcugaaccugugccaugccaacauguauagguuuucaguagacacagagccaggcuaguugggguaaaaacuguaagauagaugcuaauuuuaggcuagccaaaccagagcucucagaaauccaaagagcuucagugcucuagugccccuucccguauauugaauccccuuauuauaaaagccucccuucccuagaccaucaggcagaagcacuguagagaaaacacagcccuggcgaacuccagugguggggaggggaagaagugcugcuuccucccucucaggaucugugucacccccuuugucaggcgugguuuuccuuggaauuacaaauuaccagaucuucccuccaagaucuuuccugcccaggguaagggccaagagcuugccccuuuccucuucagagucccacugccugcccuggaaguugguccuuccaagaucaggaccuucucugaguucuuugaauauguucuuuaucuuuuucuaagacuugauggggauuuuucucuuuuugccauuggucccugcuuauauuaaagagcuuuccuuuugccaaaucuuuacuuuuccauaaucacauggcuaagaagagccaaggguauuauuugagaacacuuagaaauccuagggacuguguacacaaacagaaguuguuugaaugugucuguuccaaccaugugguuaugguaguuaaucccaucaagguacucacgaucauccaaaaauggaauucuuuuauguaauucauccccacauuguauuucccaauauuuuuuaugauauaauuuuagaaucagguaaucacuaagaacauguucccugcacaguuuuaugauguuuucucuaaaaagucagccaaaacuuuggacacuucuauguuggauaauuaaaaacagaaugaagauaauccuccuccuaaagauugaauucuccaagagagaaugcaggacaaacacagaugugcuguguauaguauaugugcauauauacaugcauauauguacacaaauauguguauuaucaaauaaugaggcucaaacauuagaaauccuuagauuaaauuuucuaaacaagaaaacacuaaucuuuguaguugaaaaaaaauccuccuaugauauguaauaugcugaucucaauuuucaccuaagagugauguucuccaaauguccgaugagcaugucauauauauauauaugaauuuuuauauauauaauuacaaugguaauugguauauagagauaucuauauuauagauauauauagcuaucucuauauauuacauauaccaauuauagauauaaauauaacaaugguaacugguguauaugugauguguauauauguauauguauaccauaauuauauauuaauauuguauauaugccauaauuauauauuaauauugguauauauacaccaugauuauauauuaauauugguguguguauguguguguguauauauauauauauauauaaaauacuaguuaucauuguucuagauuuaaaaaacaggaaccugagcuacuaacucgacuauauauauauauauauauacaggaaguugcuuuaaaacauuuuuaucagcuuuuuuauuguuauuuuuagcuuuauucucauaguaaagcuaaaauaaauuauucaacauuaucaaaacuuugcugccagcagauguaagcaauaccuaaaacaguggagagcauguugcacccaaagcaguuuaagcucugacccaagcacuggcaucuuauaggcacuggguagagauaagagucauaggucgacauauauugagaugcuaugacuugauuagaauauggagucagugacugaggugaaauuaaaacucaaaccacaauucaacauccugauuuaggauguugcugguguuucuagguacuacacuuaauuugaaagaaauuauugaggauaaaaaaagaacugggaucaacaaaauuaacuagguguucuuauaagagucccugagguuacuaauuaaugaaacugauaaagcuccugcacccugacagcaagaaauuaucaaugauuauacauuuaaacaauugaauugaacuagaaacuggccacaugguuaaaagacauuuacaaauguaaucauccaguguuaugaugcccagaaaaaaaaaauuccuuagaaugcuuuaaaagccguauuccaucaccuuuccaguuauuuguuaaacauuuuguaaugcaaaaauaaccauauagauuaugcccuaguggucggguuuuauuuuuaguuuuuuaugguuuuuuuuuguuaaugguagaguuuuaauuaaaagaaaauacaacuaauuagcagaaagugccaacuuuaaaaaaucacuaauugauuuuauucuauuggguuauacugacuuaauuagcacuaauuuaaagaacuauuaauuaucuuuaaagagucuuuagcaagugcauauaucucaguaauuauguuaguaaggacaugccuauaaccaaaacccaacucaacuaguuaaaacaaaaagcaaauaugugacuaaaaagucuaggaguggcuacagcaucaggaacagcuggauccagggaucacaguauuaucagaaaacuuucuuucagugccugucaucucuuccugcauuuaacugguuucauuaucaagaaaguuuaauuucaauagucaguuccaaauuauuuuucucacaacuuagcaacuccagcagaaacagagcuucuuuuucccaauaguuuaacaaaagucccgaaauugagucucaauggccuggccuggaucacaggcccaacccagaaccaaucauuauggccaagaggauguaguaguuugauaugcuagccugaaucacaugcccaccacugaccugcaaaggauuuuagguaagaucccugggguaagaauuguggagggguaguuccccagaagaaaaucgagguguucucacaagaggaagggguaauggaucuuaaauaaacaaaacuauagauguccacauuuucuaucuauaaauguuuaguguuacuauaacaauuagaauaauuauuuaguucauacacuauucaauuuguaucucccuucuguugcccuguugccguuauuuucuuacagauagaaugaaaaauauuaaucuaggcagcucugugaaacaguacuguccaaggaauauaacgugagccaggccgggugugguggcucauggcuauaaucccagcacuuugggacgccgaggcagguggaucaccugagaucaggaguucaagaccagccuggccaacauggcaaaaccccaucucuacuaaaaauacaaaaauucgcagggcauaguggcgagugccuguaaucccagcuacuggggaggcugaggcagaagaauugcuugaacccaggagguggagguugcagugaaccaagaugguaccauugcacuccagccuggaugacagagcaagacuccaucucaaaaaaaaaaaagaaagaaauguaaugggagccauauguguauuuuuaaauguucuagaagccacauuuuuuaaaauaaaagaaauaugaaaugaauuuuaguaaaauauucuucacccaauauauucaaaacauuauuucaauaugcauguaaucaauauagaaguauuaaugagcuguuucacauuauuuuauucauacuaaguguuugaaauccaguguguauuuuacguuuacaacucauuucaauucauguuagacauauuccuagugccuaguagccaaaggcagccaguagcacagauacggauauuaaaacagaaaacaccuagugaauaauggggaaauuuuaggccuaaguuuuuaaaauccauaccagauaauuauucagauucaaauuuacuuuguuuuuucauauauauucuuuaaaaauuacauuaauaugggaacucagaaaguucaaaagaaauuuccauucuaugguuuuagucuuuacauugucagaacuaaugcaagugugaaguuuaggauguacuguaaguaauaggaucuucuaaaucucaugccuucuucagcuaccuacucuguuucuauuucaguuccucacuguggggaggggacuucucugaaccuagguuucaucucucacucucguucaugguaaacagguuuuccuuuguggcaccuagcacaauuaguaaguaauuaguauuuacuggcauauuaguauauauaugcauauguauuuauuuaacccuaugucuucuacuagauuauaaacuccaugaagauagaacuugucuuuuguuuaauagugcuuggcaauaguuauuacuguaaacauuuuuuuucuuucuuauucaacuccuguuagucauugccugaguacuacaaauguuuuuaaguaaauuaauaaauaauaacuuucagggccaaaugugaaagcggcaauauauagcuuguuuugauuuuuuauuccacccucccauccuaaaacaauuauagucacuaaguuuccaaaugacaucugaaauugcacuaaggaaauccuagucugggcaaaaucacucagucaacagauauuuaucaagcacuuacuauuuggcaggcccuguucuagacacaggggauacucaucaaacuuacauuccagugggggagaaagagcuaauaaauacauacacagcauauuagaugaugcaaaauuagcaggacaaagagaacugggggugugggggugaaagaagcuaauauuauauguuauuauuacuauauauaauaauauaauuauuggauagucaaaaaaaaaccucuugaauaagacauuugaaaagaagcacaaagguagcaagggaguagggcgggcagcucuucucugggaccugaacauucaaaaugaugagagcagcaggugcggaggcccugaaauaggaauguaugagguguguuugagaaauaacauggaggccagcguggcugaagcugagagcagggggagagugguagcaacugaagucagaggucacaauuaaggacuuugacuucacaugaaaugggagaucaugaaggauaauaaagccauuucacuacuuuaugugaaucacagcaucuuuuuaaagaaguauccuuuuuuaaagggggagaugacuagaaaaauaaauaguguuagauaaauagagaaaacaggaaaacauucuagacuaagacagugauuccagaacuaaggauccacagaggcgagaaugcagaaaguguagguuucagagcaguggguagacuaaggguuuggacuaguggauuuggauagggaguuggagaguagcgaggugggauuagggagggcugugaaugccagguuagugugcaaacuccauuauauaagcaguaaggagucacuacagacuuuucaaaaauacauacauguuccaccuggcccacggguuagcaacauuuucguugcccuggacccauuuccuucccaauaaguuacagguuugugaagauucuaccuagcaaacauauuacuuuuaaauaacuauuaauaaauuaucuuaccaugauuauaaucaaaggaaucuguaauugcuaauuauuucugauuauuaaaagauaagcaguauugcacuaaauugacauaauucuaacucaaaguaaauauacagauagacauggcuauagaugugaaauaugauuucuguuagggcuuuuuaaauuuaaaaaaacuuacgaguucuccucccucccccuacccuuaauaccuugaaggccucuuugugggacuucagggaccccuucagggaacuaugaccuaggcuguauuuggggggcuuucuggguuuauagcuggaaggcugccacagaggcaucgccacuugggcucagauucacuuuguguucaauguuuuggcaauguccccaccuccccauuccaucuguugacacuauugcagcacugaccaucugguuacuagguuggaggauacucccucgggcuccuuugaaccagaauuagugcuccagugauuagauaauagaagaagcuugucauaaaaagaauaagcccuuucccugcuuuuucuccauucuuugauuaucgcugguagucagugaugaucaucucuaugagucuauaucaaucucaucaggucaguuugaaccucaucucuugaaaucaaaguuuccauaaugcaacugacccacaagggugaaaugacaugaaugcuuuaaccauccauuuaucauuuauucauucauucaaccaacauguauuuagcaagaggcagcagaguuagcauaacuauacaucccaguuggcccaggacaacuccagcuaacucucguuguuuugauaccauuauuaauuauuucucuuuacucucauaaguguuccacuuuggacaaucaauuacaugagcauccuuagcagggcacaguguuuaagggcaucuuuaaaauauugucuuuaagaacaugugguuaagagaaugucuguguucaaauccugguuccaccacuuaaaagcugugugaccucaagcaagugacuuaaucuccguauguccuccuuugucaaucuguaaaaugagacuaguaauagaacuuauggaguuagugugagaauuggaagguuacucuacaauaaagacauauaaccagcaugguaaaaggguuagcaauuacuaugugaagaagcauccaguuucugaccucacagagauuaucuagcaaacucaugauuuuauaaagaaaagaaguuucucaucaacagagacugaaaugcuaccauacaauauacguugcuuuuuuuuuuuuuuuuuuuuugagacggagucucgcucugccacucaggcucaggcuggagugcaguguugccaccuuggcuaauugcaaccuccaccucccagguucaagcaauucuccugccucagucucccaaguagcugggauuauaggcacccaccaccacacccagcuaauuuuuauauuuuuaguagagacaagguuuugucauguuggccagacuggucucaaacuccugaccucaggugauccacccaccucagccuuccgaagugcuggcauuacaggcaugagccaccaugcccggccaauauuuuuaaauauuauaaaauauucuuuaucaaauugcauagaagaaaagacaguuugauagguaauagauauauaaauaggucaggccaacuaaaaguguccugaaaaaauuaauauugugaaaacaaaaggauuuuaaugacauugauaaaaucucacccuaaaagagauuaaauuaaaaaucacccuacuugaaccaguucagugagauuucauuagcaugcucucauuacuggcauaaucagcuucaaagucacuaagccucugaaaggaagauguguugcuuauucuuaauaaaauggcauaaaaguagaucauuagucaccaaacaugauagacuuaccuuuuccauuuguuggcaucucacauuguagauggcaauuaaaauggaauccagggaaagagggggugguuuguauagcaauggauuaugaaacaaaguacuggauuauucaccgcuugacauucaggaaacauucugcuccuuacagaauauggcacgugggccacagaaucuuccgugugcuaccuucucggugaagaagagcacccccaaguuucuuuuccuaggagcuaaccacaguaaacccauuacacacuuuagcagaagggcucauucuaaaggucuuaggauuuuaaucauuuuaaauuuccuguuaugcuucaggcucuucaacacaaagugaauauuguacucuuugguuuuacauaauuauauucaauugucauauuucaacaggacauuauuugugacuuuagaugggucaauaaugauuuucauugucagcaguaaagucaauaauuacagacacaucaccuacccuacuuguguaaaagcauuuuuugguacuaggagauuuagugucugaucaacgguccuggauagcaaguaauauaucccccaaauaaugaaaagugacaagaaaauaaauauguuuacuucagaaauaaauggaaaauuagugcuaucuaaaauguagucuuaagucucaucuguguacauaaaguaaaaugaguuuuauguacuaguuacucaaauuuaucuuccacuccauuuguauaguaauuaaacucuuacacucaguaauauacaaauugguaauuaaccucuuugcaaaauguuaaaguguuccuaaauguacaauaagucuccuuuccugucucauuguuuuucgcuucacguaccucucauguaauuauuucaaugauugaguucagugugaggagguuuaugccuagaaaaggugcucaccaauaacgugccucaguucccauaauagcaagaucgagaagguucuuuagucucccggaacgucacguugaacaucucaguucuauauuuugccuugacauuugcauuauaucagcugaucauugucuugcccuaauuuucccuuuuaauauuuuagugaccuucuauguuagguacagguuauuuagaaguguuccuccaaggccagauacuuuuuccuugaacaauuuauuuuuaacaacuuuuagcgauuuucucacuucaccacccuccguuucauaaguccacgcaaucacaauuccuuucugcuaaucugcacagucaagauauaaaguaagaauaccuauuugaacauguagugagaacuuuacuucucugccaaaaaugaaggaaaaugcugccacuuuuguaugucacauguuuuuuauucuacagccucacucacuucaugucauguuuuagugcaguuuucuggacuaacugcuuauuuucucauugauuaaacugccuauuugcucauuggaauuagagccaauuuuuuuccuugagggucugacuagaagauuaaacuauguucaugugagaaucaauuucuaccuaagaaaugaguuagaggaguuaugggcagcaauaucuaucuggaugcuacacugugaaaaaggaagcgagguuaugccuuucuaccccaaugggguagcagagaccucaggaacugagguagaugccccccugguuauuagcgccccugaauaauuuguucaaaaauugacugcuggacaggugucguguugcacgccuguagucccagcugugcaggaggcugaggcaagaggaucucuugagcccaggaauuugaggcuauaguaaacuaaggucacaccacuauacuccagccugagcaacaaagcaagacccugucucuaaauuuaaaaaaaaauauugaaugcuuaugaauagagacuaauauaggaagucauaaguauuuccuugggauagaaugcuuuccaccauaauugacuugacauccuguauuuuuguauguguggacuuaaguuuuaaauauuugaaacacagacaauuauuaaguccugcaaaugugugaguuaauaguggauauaacauucccuuccaggguguaagaaaagguaccacagaagugagcagcccugaagcacagccuggccuaguuuggcaggucucugugaguuagcagcagacucacgugaccacacucuguacugccuucuguuucuguuucaccccauuaauugugcuaaagaaaugcacuugacaccuaugcuguguaaucucauuuagccccaauagcaacaaaaguacuaaccccauuaaauugagucauuucaaacugagccaaauguugcacuccaguaaauggaguaggcauugguuauaaugggaauucuccauuauucauaauggaaaccacaggaguuuguucaugcagaucaaaugugucccaccaaggcaagaaguauggaaaagugguguugcuguauuaccuuguaauuucaaagccuucccgucugaaucuuauuucccugcuguuuccucuugacuuugguucuuucacaaaggaaaauuaagaacacaaauauaaacauuaaguuaaaacacaacugaacaaagugccaaacuuaauuggagcaucugaaaaugaaacauuaggcaguugcaguggccucuugauaauaauucacaguaacucucuguaagcugauccugucugaagagcagcaggcacaaggccccuggccaugaaguccaucucaaagggccaggcucagcaaagcaggaugcaaacccaggcuuuccaaauaccagguuggggcucaugucacugugccacaggagcuucuguagaaaggcuacuugaaaaaaguggccauuaaaaauccagguggauccuaucuagggcaguguuggaaacacugaucuaugggaggaggagcaggaaggaauuguuuaaccacugagcagaaauguuacauugcuaccugccuuuagcagcuguggcugauggguaccaguugcuaagaagagcauuaccuaacaguguauuaagauagaaaaaugauuuuaaagcacggcacuuagagaauguugaaguuuuacuuugcuuuauuuugauuuguuugguuugacuuugucuccuggagcauccuccauggauuucuguucauuacaagagaaaccuagggcucuaacccaauuccuaauucuuggacacauugcacccuuguuuugugauaauccagccuucuuccuugagaagguuugcuggacuggagguuacauguauugaauuuucuaaaaugaaggugcaaagcugucuccucuuauuucuuuguggugcucacuucacugugagauuuccuaucaauacagcccaagucagugggcaugcaugagguggagaugagggaguuaggaaggacuuggacucucaucaaccaucaggaucccugaauccacuaacuguucauaaucaaagaaguuugaacaaauacuucacacacaugaaauugccaaaauuuugcauuugaguuguuauaccaguaaguccaguugccaucaucuccuugucacaagugucuuaaauuuugcuuuugauaauaaugauuaccacucauucaguacuaacuuacuugauauuagacacugcauuaaauaccuugcaaacauuauuuuguuugauccugacaaccauaugagauagguacuauucuuauccauuaccaaaaaaauuaauuucaugaagacuuuucccagagagagaaacuuuaaauauuuacacacacaccucucucccuguaacaauuccguaguccugauaacagcaaauaagcaaagucuguguaggaugcuuuaccaacagucccaccuagaggcaggagagugaaccagcuagaaaauauuuuauucauauuucuuccagaaaggcuccauuggaguuugaacucaauuuauguuauaauuuucuuauuauuuuuguauugguuuuccugaaaccaauacaaaguaagaaagcauugguuccacuaaaaauguccuaaaaccagccaagcacaguggcucacaccuauaaucccaguacuuugggaggccgaggcggguggaucacuuaagccaggaguucaagacuagccuggccaacaugacgaaaccccaucucuacuaaaaauacaaaaauuagcagggugugguagcacacaccuguaaucucagcuacucaggaagcugagacaugagaaucgcuugaaccucagaggcagagauuacagugagcagagaucacgccacuguacuucugccugggugacagagcgagacucuaucuaaaaaaaaauaaacacauaaauaguaaaauguccugaaaccauuaugggguuaaagcaagaggcagggcugguucccaggauuuucugucuaaucuccagugagccacagaccuauuccugaucaacuugagaauaaacacaucaguaaagauguguaaggcugucugacuuucccauuucuguagaauuuuauuugaagagaaguuucuccuuucuccaggccccauauuguuuauacaaaaagaccuuuccaguaaauguccacaaccacuaccaucaacuaaaauguuuucccacuaaugcuuucaaugguaaucaguauuuaacagggcacuuaggauuauuuuuugaucaaccauuguuuagauauucccacuuauaauuacuccugugaaggauugccucggggcaucagcugauccugagaaauuauccagaagccaugaguguguaauaauuuagucuuaaaccuaaauaggucaguauugggugggacuuuucucagcugcauaauggggagaauaaaaagaauauggaaagaaguuacguaacacauccugggucacaaacagagguaagacuugaacacaggccugacaucaaagcccaugccaguaugacuuacaaaagguagacuggacuaccugcauuugagucacuagugaugcuuaucacugggccucaccaaagaaccuuggaaucagaaucuuuggagguagaugccaggcaccugcauuguuaucaagugcuccagugauuaccauucacuguacagagccaaacagacuccugaugcuggaagaaaauuacagugcucaaagugcagggcaggguguacaucuggaucuaaaucacugagcaaccacaggguuucaagagagggucaaaacaaggacuuucugcucucuguggccaaggggacacuaaguuugcacuguucucagaucuccaaagagacuuugguguaugggggauagggaggggggaagggggugugaaauaaaaggagaaagugaauuugauuauuugauugaugaaaauugaaaagcuuauuguagggccuagccuacaguugaugaaaaaacaauggaucaggaagaagaucagaacuugucucaguccucaacuguuuuccucaggcuuugguugaauauugccauccuguaauucauuauagcauuuucuguugcauaaacgcuuagcaacaaagccuuuuuuuaaaaaaauuuguaacuccucaaugaggauuaaaugcuucuucuucuaagacaguccgaaauauacucacagcugaaaauucagcuaaccgcauuucccaacuagccacauucuauagaaaacucuaagccaugcagaugaguacagacuugacaauagugcucaaggcugggaguacuauucaucugaaaagaaugcucccuccaauuggugggccguuauucugcuagguuuguguuuggauaauuauaagauggcuauguuuuucuuccccagucucaggaggcccaggugcugaaacaauuggcagagaagagggaacacgagcgagaaguccuucagaaggcuuuggaggagaacaacaacuucagcaagauggcggaggaaaagcugauccugaaaauggaacaaauuaaggaaaaccgugaggcuaaucuagcugcuauuauugaacgucugcaggaaaagguaaucucagcagaguccugagcagauggauauauucauaugcagcacagcugggugaacuuccauaugccugagcacagagacgaagucaaaauuugcugcaggugugaggacaacuaacucccaugggcagggucucacaguguagcauugaguuagcaggaggugcaacaugguagagaaaugggaauccaucaugaaagcuggaauuuugucaaauuuucccauggugaguggauucagggaggcugauucaugcuuuugaaauguguaagacuucuauacaagccucacgaggcaaucuguaggaaaaauguuacacuggaaauauuaaugucuauauauuauauugauauaaguauaaauaacauuugauuuaauauuuguuuaauauaugacauuaaauauauauuuaauuaaaauauuaaauuagaaaaauauauuugccagaaaaggccaggguauuuaugaacacugguaagcccauucuaggguauaauagcaucacaugggaccauagcaaagauuagcucauaggggauguuucauccaguucugguauccuggugcccuucucuucaacaaccuaaacauauauucauucccaugagucaggaggagcugugcuggaguucuucugaaaaaugcugucuuucacuuuuguacucucuaugcugucucccaccuauccccucaaaaaaccuuuccuuugaaaauauacaguauagcugugaguaguuuagcuguguccguuuccagaaauuggaauaagcauugagaaaugggauguuugagaaagacgccucaauccuuuucugagcagucagucacccuucccgccaguagcaagugccuuugugugauaggcauuggagaugcagagcaaaacaggagugugccugucaucagagcccugagaguuuaauuagaugagccuccuguuuucuauuucucagaguuucaugucuucuguuagagauggcccuucucaucuaagguucaaaaaaccuuauccugaaguucugaugauucuguuuucauucucagucucugacugcaaauauccaacuagaaacaaaggaaaucaggcaugaaaacuuuuaaagauauaauugcauggagaucuucauuugugcucgugaggaauuuuugaaagcauugcuggggaagggugugugggcucugaugcagcaguaagacacugaggcucucagagguccguggacgaguacugcugacuugggcaagaaccggaauaguuaccugaugccuuauccgaaacaugaaaguucggauuaaauuuguauuuauaagcuaguguuuuuauacucucagaacaaugucauugcguuucacccaagugagucaagucacgauuuggaagaggcaacagaauuuggcucucuccaggugauuuauggcgguauaggaacacauguuuuacucagauacaggggagcaaaguuccauuugcuaaaguuuacuccccugaccuucaaccagucagucuuccuccaucugccaccacuuugcacuucuccagagaacuaaggauguucccgcuugaccagugcucauaacauggacagcagagggccacugugugaucucuuugagaucacugugacucaaccuucuucucacauccuaggcccuaaaacaauuaagugaaguugcuaggaacgguaccugcugaucuuauugcagcauucucaauuaggccucaaugcaagauuuauaucacuggcaguccuggagcauuuuuguuuuucaaauuacacauacccaaacacacggcauagccuccuuuuuuguuuguuuguuuuuuugagauagagucucgcugugucgcccaggcuggagugcaguggcacgaucucagcucacugcaaccucugccuccuggguucaagugauucucaugucucagccucccaaguagcugagauuacaggcguauaccaccacgcccagcuaauuuuuguauuuuuaguagagacaggguuuugccguguuggccaagcuggucucaaacuccugaccucaagugauccacccaccucggccucccgaagugcugggauuacaggugugagccaccgugcccagccagggcauauccuucuugauuucaauuguaaaauaguucaaaaauuuuccauauuuuaucuaauauuuccagaagugcuagcuuuuaacggaccauuuuuuuccucuguguguuuuuuucucuucaccuagcccagccaugcucagcucauuuuuguacucuuuccacucccaaccaaauuuagugcccucccccauacaugcauacauguacaucugcacaccacuuuuccugcaaauaaucaacccaaagagugcuuaaaauuccugacaucaacccacagaaucuccaaggaugggacccagcauccauacauuuuaaaaacucuccauauaguuccaauaugcagccagauuugagaacuagugguucguagccuguucugauuuaaaucucagcucucagcagucuaucccacgucacauaaugcagcccagagaaauucuaggaccacauuuuuuucugguauuucauagcuaaugaggugcuuuucaaaucuaauaggaucuuuggccagugucagucaagaucuuuuaucuccucaauaaaaaggaaauaccauauuuacuuugauuugauguauaucacauagguggauuuaauacaaaauugugguuuacauauugugaauguguauacuaaaacuacuuugcuuuuuccuaaaauaagacaaaguuuuauauuggaaguaauauuuagcauuuuguuugaaugaaguuacuccuauuaaauuagaaauuuaaaagagggucaguaauaacaguaaagccaaaaggcaugacacugccaacguaacauaagcugcucugaaaucuaccauaucaaaagauaauuaugcugggcaugguggcucacaccuguaaucccagcacuuugggaggccaaggcaagagaauugcuugaagccaggaguucgagaccagccugggaaauauaaugauaccuugccucaaacaaaaauucaaaaauuagccagcagugguggcacacuuguaaaaaugccuguagucauagcuacuucagaggcugagaugaaaggauugcuugggccaaggaguucgagacugcacuccaaccugggaaauauugugccacugcacuccaaccugggaaacagaacaagacccugucucuaaaauaaaaagaaaaaaaaagaugaccacuucugaaaugacaccuaucaaugaguuaaucauucaaugaauauguauugagucccuacuauaugcuuaggaaccuuuguaauaucauuaccaaccaugucuuucccaauacagacaauacaaaauucagcaauaaauaauauagcaccaacaauuagagaauaagacaacauguaguaugguccaauauagacaguaaauacaaagacacugaauaauaucaguaaaaguaaauucacaucaaggucacuacaccaugcgcccacccuuaugauagcccucacuggcccuaucaauuaagcaagagacaugauacaacucugugcaagcuuuuccacaaucugccuaccauucagcacucagucgcucuucccuucaauuaagagaauugagcauucaagcauauuuucaccaugaugcccauaaugguaucuucaaugucacugacugauaaauucccagaaaccccucagagccccagccauguuagcucaaagccuuuagcuaaaacugaaagccuaaagcaaaagcagcccuggcugcacuucggaaucuacuggacagcucuuuaagggauucugauuuaaugucuggaauagggccaagaaccuuguauuauuuuaaaggcucacuaguaggcucuaauauuuagccgugguugagaaccacugugcuaaauguuucuuaaauaugcuuugugaugucaucauaaauuauauuuuaguauuuuuugucuuuguugcauaaguguucuuucuuccuccaaagaagaauguuacacucauuucuuauuucaguuuccuguuuucauagcaccucaucuuaacacuccaggcuauuauauagaaaagaaucaaauguggagaaggcugugggagaagggaugccugugccacaaaggccugcauuaggcugaccuauugaugucauauccaggacucaaaagacuagucuguggauuaugacuggugaaguucaaaauguucuuauucuuagagugguaugagaaguagaaagagagagaaacagagaaggggaggagaggggaagagaggaagaugagagaaaggaaagagagggggaaacaccuguucuugacauacaggaaugauucaagacauuuucuuccuccccugaugugucccuuucuccccuaacgcacuaugcagcauccugcagaaaauucaccaccugacccuuuuagaaacccugaguaguaggagcgccaaaugacccaaucaagaauugcagugagacaguuaguuuugaaaaaucaguuaaagcauguauaaucauuuuaacaacaauacaucuauucacuaaacauauaauuuuaaugucaaauauuuacguguaaacauauugaccaaucuuucgauguaguugggcccaauaccuuuuccaaaaauugaucaguuaauggggguucuauggggguuucuuuucuugccauuauucacacuuaugucacauuagcuaugauuugcaguuuuaauuucuuuaaaauugaguagggacuaaagacaucuccaaaaagccuggauauagacuuuuuacaacuuuuccauagcuuuuauaguugacucacccaguaucuacuaaauacuucacuuucucacguauuuccaaagguuucucuccacccucacaauuuuccauuaauguaguacuuaauuaaauuagauaguuaaauuuucaaaugugaauugcuaaacagguguggaaauaccauuggcuauaaucaagcauauaacacaaccauuugagaaggaaaguauguggcaauauuagggaagagcccuuuccucucaagcaauucagcauuuaggaaccaucagacagcaggacgauggagggaacagagaggguuaacauggcaaguuacugaagaggacuucuacugaaucuuguugaauuccccacuuaauccagauuguaucauaucuucuuucuuuuguaauucuaccauaucaucuuagucaaugccaagacuucugagcucauaacaugguaacaaauaccaaaggagcuuucaguaucguuuagaaaggagagaagcaaguaacccagacaaacuugacaacugcuuuccccuauccaaccaugaaguacaguacuuaggaaauaaaagaaauugcuucacuauaauucaucauuucacuucuaauaucuagaaaaugucaaaugaaaauauuauagccauauuuuaguggcaauaguagcacauaauaugaugcaacuuaaaaugauaaaaauauuuucagggaauaagauucugugauucuuucccuaagagguaauuuugauaauauguaccuguuuuguaaaugucaauagucuuggggauacaggugguguuugguuacauggaaaaguuccuuaguggugauuucugagauuuuagugcacccaauacccaagcaguguacacuguacccaauauguagucuuucaucccucgcccccacucccaaccuucccccacaagucucuaaaguccauuauaucacucuuauaucuuugcauacucauagcuuagcucccacuuaugagaacauaugauaguuagugcucaauuccugaguuacuucacuuagaauaauggccuccagcuccacccaaguugcugcaaaagacacuauuuaguuccuuuuuauggcugaguaguauuacaugguguauauauaccacauuuuauuuauccacuuguuggucaauggacacuuaacauuaguuccauaucuuuguaauuucaaguugugcugcuauaagcaugcaugagccugugucuuuuucauauaauuacuucuuuuccuuuggguagauacccagcagugggauugcuggaucaaaugauaguucuacuuucaguucuuuauguuuuccacaguggucauacuaauuuacauucccaucaacaguguaaaguguucccuuuucaucacacccaugccaacaccuauuguuuuuugacuuuuuaauuacggccauucuugcaggaguaaggugguauuucauugugguuuuaauuugcauuucccugauguugacaauauuuaacucuuuaguuauagauuccagcuauuaucaauuuacaccuauugcauucuucucaucuuuuguuuucuugugauucugaugcacaaauaucauuugugcaaccacuuacuguugaacaugucugaugaacacuuacuauugaacaugucugaugaaugaauaaugaaauaggaaaagggauuaaaacuagccuuuauuaauuguuugcuauaggccagacauuuuuggauguacuaucacauuucauccaaacaacaaccuaaaagaaaauacugugauuauccccauuucacaucuaaggaaccuggucuuuaggaagauuaagucauuuggccaagaucacaaguagaccacagagacuagauuugaaugcaagucuguuugacuccaaaccuuuuuacuaucugcccaugaccccugaucaccaacaucucaauguaugaacaugugcuuucuuagcucacacaacucacuccugaccccuuuuuuauauugcaagugcauagucauuaguaaaaagaaggauuuuugaugauacugaccucaucuugaauuuaauuaggcucauaugacagaauuccauagauggaauugacauccuaggucauauaguccaaguccuuguuuauauuugauaccuagugagauuaaagggacauuaaaaaguaaagaaaggaaagaccucauauuucuuaccuuccaguagagaaaucuuucuaugaaaucagaggaaagaauuagaggaccagaauuuuuccuaaaaucaacuuucauacaucuuuuuucauauaaaaggcauagcugcauacaaugcuaaaauauuguauuacauuuccuuuauauugaugggaggaaggggguaaauugcagaaaacauuguaaauuuagauaugcuugggccucugacagugccuagcaaauaucaggagaucaauaaugaaauaaauauuaucaaagaguagucuucuugaugaaccuucucugaguaucacaacugcuuuaggaaccucuagauucaaggucuaguaauugcaaacagugagcugauaagaaaaacagacuguaugggaaauuacaugcuuccugcaugacugccuuuuguucucccacauuuugauauaaagucacauuaacaguucaugaguaaauauucgauaaugugaacguaaaguguucaaauaauagagugacuaaaaugccugaaaacaaauaauuuuuaauuagaaacucauaaucauuuauuuucucuuuuuccacauuaucucaagcucacaaauuauauuuauucuuuccuauggcaaaauccauuuuguuaacacuaauuuugaguuuaacaagaaguguacuccaaaguagccuaauaauacuaauuauaauguuuccugcuauguuaucaguuugaauuuauaugaaucuuuagacuugaggcuucuuuuuccuagcauagugauggucugggcuuuuucucaauuuuugccagagcucagcucucacuaauuaguuucuuucugcaugagaaaaagauuuugcuucaucuuuuuccuuauaauagcagaacaaaaagaagaaucagcugcauccaugcuaauuuccccugugacauuuccaaacaggauuugauuucucuaugcaugccucuuuccuucucuucaugguuuuugaacauauacaaaagcucauuuaaaccaauuaaauaaaauuguuuuuaaucucuuucucuagagucaacuuccugcuuacuccaacucuguaucuuugaaggaaguauaggguggucuaugccuuuuuucucccagaaucuacacuugaaaagacacauuuuuccaugcaacuauaaaauguucuccucacucaacauugaaauuguauagcagugauuaagagagugagcuguagagccagguucccuggguuuaaaucccacuuguuaguaucaugaagaugggcaaguuacuuacccuuccuguguuucaguuucuucaucugcaaaauggggacaauaauagaauguccacuauaagauuauugugaggauuaagggaauuaauacagguaaaacguguacugaugcaggucugguacacauuaagugccuaauaaauauucaguauuaugauauaaagaacccuauaaguguagacuccuugagauuaauagaguuuaacgauaaguuuuacuuuauagcuggucaaguuuauuucuucugaacuaaaagaaucuauagagucucaauuucuggagcuucagagggaaggagagaagcaauguaagcaacauucuacagaaauauaaauaauacuacuaauaauuagcaucuuaaaauuucaauucaaugaacauuuauuuagcgccuaugauauaugcaagacaguuugauuuuagucaucugauguauagccacauacuaaaaaauacugauuuuagucaucugauguauagccacauacuaaaaaauacuuccuccaucaguucccuccucaggaaguucaguucccaaucccaggcuaguaccuugguuccuuauguaaauaaacauccaccaauuacaugcuaucugcaaagcacucugcuaggcccugcaaauggaaaaaaaaaugauaaaacauaguccaggcccucaaugagcuuacagucaaauauaauagaggagacaagaacagagaggcucauaauacaacuagaauaaaaugacugccgaauaaaaggaaagauuuaugcagguguucaaauggaaagugagauaaguuugcagguuagucuuugcagucucauaaaaaucuuuauggagaaaaggacaauggucauagggcuuaaagaguaaguuuauaauccugaccaguggagaugaaagacuagcauugaaaauugcaugacaagacaauuccauuaaacugaaacaucaaguguguguaggaaaagauggggguuaugacuggaaacgucacuuggacugcaauuaugaagggccuugacaaacaggucaagaguuuaagaagcaguauagaaagucuucguccuggaucuagcccucccagaguguccaucaggauuauaaaguccuuaaaauauuagucaaaaggaacgacaucauuagaaaugauagagaaacaauaaugugauguuuuauuaccuuucucuggauuuauacucugauccuaauauucaaaacuaucuuaauaacaugaacuuuuggucauaguuuuaaacaaaaacaguguuaaauauauuuuuuaaaacacaguaagucuuguaagaucuuuucuaacaugacauuuugcagggcccauauuuuccuucugaaaugggaaaaauucauaaaaguagacaccaaacuggguuacuucuagucaagcgcaugguacgcaaaggaccagacaaaaagggccugugacauuucuucuuccuuuuguguuuuuuaggagaggcaugcugcggaggugcgcaggaacaaggaacuccagguugaacugucuggcugaagcaagggagggucuggcacgccccaccaauaguaaaucccccugccuauauuauaauggaucaugcgauaucaggauggggaauguaugacaugguuuaaaaagaacucauuauaaaaaaaaaaaaacaaaaaaaaucaaaaauuaaaaaaaaucaaugcggucucuuugcagaauguuuugcuugauguuuaaaaaauaccuuggaucuuauuuuguaaauacuuacauuuuuguuaaaaaauacaaguauugcauuaugcaaguuauuucauaaucuuacauguccuguaacaggcuuuugauguugugucuuuccacucaaaugaauuugcuaggucuguucuuuuugaagcuccccaugucuaacuccauuccaaaagaaaaaugaggucaguagacagucuauggugcuagaaacccaccauugccuaaugaccuagaaggcuuuguugucucugagcuugacuaagaccauaccuagaucacagguauuaugacuccacaugaaccuucacauuuguucgcucauaaucuacuuacugccuaaaaacuacaaaaccaggcuaagaaauaccaccagucauagcauuuacuucugcuucuccuggauuaugugcuacaaaugugcuuuggcuuuagaaagggauggaugagaagacagaccugagaccaaucuggguagaagcaaaaaguugaaccuuuuaaagugcugaacacaaauccaaauucgaaugguucaagcagccgugaaaucgcucuucauaaagugggcuuaauucucuaguuuaaguucuuuugauggaaugaauuaauuaaugugucagguggcuuauuuguggaugccaugauugaugauguucauuuuaagcucuuaccuauaguacaaguacaugaugcuacugaauauuuuuccacuuggaaacugugagcugguuguugcauuaaaacacacauacaaacaaaaucaaaaacacugcggacuuucacucaagcuggucuuucuuccccaguguaaggcaauccugccuacuaacaacaccaacaacaaaacacuccaucugugaagcugacgcaguuaagggggcuaggcagggcauuugugccaacuaagaaucaccagauacccaccauaaguaccuaucgcaguuuugaagucguuucuccccaacucccaacuccugaagguugcugccugcauauuuacucuucauuagugcuauuuuccuguaugucauugugagcaagcugugauuaauaaagaauuggaguucugugaacuaauaaa

SEQ ID NO: 13577 - RNA, 1786 nt, Homo sapiens
uaguggugagcagggcguugauuucagccaguucuguuuacacagcauuuuccuuccagaaccgcagagcucuacacagauacuaucucacuaauccucaauggagcuuucucaaagcgccuuuauccagccucucuccuaggagaaagugaggcacggcgggcagagguggugaaguccucgcaaaagcuggaaacaugaccccgggcuccugacgcaugggccauuguccuuugcacuccaccgcgccaccuuccugucaggugucugguaaacagguuaacugaucgcugauuaggggccucccgccuacgugcaaugaguggcggaaaggagcuuuuccuugucaauacgaaaaucuuugaguacaaaucgauaaagcuagagauucaaagacugccuuuauaaaacuggagaagaugcacucuggccauaggcggagggggcagcccggggccccugucaggaagccaagcggcccggggcaucccuggaaggcugccgagggggcagcgccuucucuggggacggcuucguggagaguccgggacgggcgagacagaaaaccgagcccuauuuguuauuaguauuuuuuuuuuuauacucucaaaugccaccggcacauucuuuuaaaaaaaaaugaaaggaaagaaagaaagaaaaagaaaauaagagaggaaaagguccugagaaaugacggacgcuugaaccucgggcccgggaagaccagcgcccuuuggcggcuaggccucgggggcgugcggagggcgggcccccgcgcggccgccgcuuucccaggccgccaggggugaggaggugacgcugcgggcuugguggcggcugguuuuucacacaggaauccuccucgccaccgcucccucgaaggccgccccccgcuccacccccagcacugggcgcccgcgccucccaacucagcccgccgccgagcagacggcgcgccgcgguaauugggcacaggggccuuuuucagagucgcucagucgauaaaugaaacgucagcuccccugugaucccgcguguguggggcggcgguggcugcgagccggggcgcagggccggccggcagccgcugcucuuucacagccccagacccugcgcggccugccggcggcuggcgaccucccuuccccucccgaggcgcccgagccucugauccccucccggggcgccuguggccucccuuccccucccggggcgcccgagccucugauccccucccggggcgccuguggccucccuuccccuccuggggcgccugugaccucccguccccucccgcggcucccgcggccuccgaccuccugccggggcgccucaagggccccugccccacaucagagggucuugcgguuuccugguuugguucaacaucucugaaacccagaggugaagaagaaaccauggaggagaauccgaaacagucuuccagaucagaccucuaaaauaacuaaauucuuguuaaucauuagauucucccuuuuauuuaauguguaaguccaaggggauuccuucugcuuccccauucaauuagacagcaaccucuuccucuaaaguucucucaucugaagccaucugagcaggagcacuuugaccaacucaauucugcucugaucuggacuacuucucccaguuuagggaucaguaaauugccaaacacuucccaauuuaucccugaaggaaucccugaaaaaugauggccuuuauucucccucagagagggagcuugagcucuugagaaagacaugaaggcccuugccgcugucgg

SEQ ID NO: 13578 - RNA, 2130 nt, Homo sapiens
gggggcccugguguuccaugggguaccaauccaaaggguucggcucaacugguaagggcgagcagaggaccugggggagacggggcugacagaggaaugcaagcugaagcuguagcgccacucagaccccuccacaggauuucugcgggaaacugcgcgccagcaccgcguccccaugaagaaaacggagggugaccugcgcgccacagggaacaaaagaugcgacagggagggaaaggggagugggugcugccacgaugggguaaaugggagagacagaaugguggcaggaaggggaaggaugaguaaagggggaaaaaagggaaauacagggucgccuggagggggucgaaagaagugcagcgugaggugacgggugcgcgcgcuaaaggacaggaagcaaugcggaagggcugccguuugggcgaagggaaagaagcagagguagguggaccacgggguggaccaccuccggaaucuugcggcccgcgggcgggcaagaggcgcgcacgcucccugcuccucgccgccugcccgcguggugcugcgcgcgcugcacccaacggccgcgugguggggaagaugggaggggauggggguaggccgccgagcaucuccugccccagaaucuggcacgcugacggggaccuagggacagacgaccgcacaacacgccacguugcaggcgcugccaggccgggugccucaccuagcuccuucauguauucaucaaagccuuugcuguccaccaggcgccaucuuccuuccagcugcugaacuguggccauggugggugcgggcgggcuggcgugcagagaggggucugcgucggcguggcagcgugcugugaggcacccggcgccggcggcugcuuuauaacggcggcccgcgcugggcggcgcuaugcggccaaugggaggcgggccucgcccgguccccgccccgcccgccgggcgcccccugggccuucucggggucgggaggugcuaaccagcuccucuugccaggguacgcgacggccucucgggcgccuccugcaagcagggacucgcccggcgcgccccacgccucauggacgccggcgccugcacguuucggcgccucugcaggcccaggaagccagaggggucaccuggaggccuggccccgccucuccugcaccccuccguuugacaacauauccaccgccguuuuuccuuucaaaauacccggaccaaucgauuagcccucgccggacucggacugcaggaagugauugaucggcuguuugguuuauugauucauuaacuacggugccucccugaccuucugcuccucgccagcgcacaagcucacaauccacacccuccuaagagaaccugcucucgccauccgcaggucucccuggcccaauaguggggauauaccugaguugagcuagaggauuuuaucccuguugggaugggggacgucucgggaagugugguuucuaaacuaaaagacugcaggaagugucaacuuuagugacugucauugccauucaagaauguuugauuaguuuauauucccuucguagugcacccuucaccguuucuucucagacaccagcggguuucuucucagacaccagcggguucccucuuucucuugaacuauaauaauacccuacacaugugcguagaacaugauacguuucaaaguguacucuucacaauuuauuacuuggugcucccgggugccuguuggaagucagauggacugaggugaggaaguugccacacaggcuggccguuucgauagcgguaaugugcauuuauugaguagcuacuaagugcuagaugugcuuccugggcacuuuauagacauuggucuccacuauauuuuugcuagggguguuaucccaauuuuucaaaagagaaaauagggcaaagauaguucucacagugguagaaccagaauccccauccagguccgucucacugaagaccuuaugaaaucagaccacaccugacugccuugggcucaggguagcugugauggagcucugaguagaccacagucaccgagacacuacuaguucuuguaucauccuugacaaaauugaaaucugagguugguuugcuaucucccaacaugcugcaggacauguac

SEQ ID NO: 13579 - RNA, 19647 nt, Homo sapiens
uuacggcgccggagagauggcggaguuggacaucgggcagcacugccagguggagcauugccggcagcgaggugauccgggagcuuccagcccccauccccggccgcgggagaccagggcuccgcuuuggcuccgcggaugguggcggcgggugaagggaggccacaaggcugggcagggccugaggagcggggugggagcguuucuucuggggcugcagugagaucgguuggugcggguuuuuuuuggccgugagcuuuugaaaugacguguggucuccuuggaaggaagccaugcaauuccugaggcagggccugaggagcggggugggagcguuucuucuggggcugcagugagaucgguuggugcggguuuuuuuuggccgugagcuuuugaaaugacguguggucuccuuggaaggaagccaugcaauuccugaaaacguaccuugcaguguucauuuugguguucgagugugccguguccgagcagugcacgaagcccacugcuggaucgcguggcucacacuuacucugcugagcgcggguauggggacgcguagguuuggucugggacuguugucuuuuggcuuugccacugcgaccuacggccagcuacuuucccauacuuuuuuuuacuuaucuguuacguagcugucaggaggaguugggggaggucaacucgcccaacuaguguucacguggauguguguccggaagaaggcccuuccuuagcuuuuaucaaauucucaaaggcauccugauccucagauuauuccaccaaauggucaucaugcucucccagcucugucauucccugauucucauuauuauuguuugaacaaacauuuacagauuauugauuuuggugcuuggaccacauaaggguguaaacuacagucuuuuacacggaagaccuuuccaacuaguaagcugcauuuuagagagaauuaguuaauaauauggcaaugggcucuccccauugcacugagagaccuugggauauaccuaguccaaggugauguggcauuggcuucaggaugccauacaccuugaaaaggcaaguuuuugaagcauuagaaccacacagacugcucagucguuguuacuagguuucacacacuacauaagguagcaaacagguuuaaucuccccuuggaacuucagucauugguaucaagugccugaauuaccgugucaaagacucuugagauuuagcccaguuucaguggaguuccauaauugauuagugauuucuacugugggaaugcgugauaggacaggugacacaaucccuucuagguucuuguuacuuauagccaucuaucuaucuaucuuucaccacuggcuguaauaacaagccagugugacuuuuuucauguggaagcuuagccauuuggguuuugacugugaauuaugugugucuaugccugauccuucgcuagugaguccaauacacauuauaugccauucaugacauaguucauuuuccuuuccagcuauauaugucuuuagugucaauaacugagaugaggccaggccuaucuguuugggacuaguggaaagcaguuaagauuuagacuacgucaaguguauauccuaaauuuuaucuaccuucuggagggauugaaggaugguaucaggugcugggaaguugucuugacuuaacucuuuccccuggguccuucugguuugcaucuaauacuugauuauuaaaagucgcaaaauauuaagcaucuccacccagucacugcaguauuguccuuuuuuguuuguuuguuuguuuuguuuugagauggagucuggcucugucacccaggauggagugcaguggcgcgaucucggcccucugcaaccucugccuccugaauucaagcgauucuccugccucagccucuugaguagcuggaauuacaggcaugaaccaccacgcccagcuaauuuguguguguguguguguguguguguguguguguguguguguguguuuucaguagagaugggguuucgccauguuggccaggcuguuuucaaacucuugaccucaggugauccgccccccucggccucccaaagugcugggauuacaggcuuaagccacugugccuggccccuugcaguacuguucugaguugaguauacucaaaagaaguuaauuguuguauuauucuuauuaauuauaguuacuguauuacuauucugaucuuucauauauaucucauuugguuucuguaaguacacugugaggucgguguggcauacagcauagauacagauauagauacacaugcauacacacauauacauauauacacagaaaggaugugcuuguaucuuuauaucugucucuguaucuaccugucuauaucuuucuauuuuucuuacccaauaaaagagcuuugguuuuguauauguuuauuuacauacauauauagaaacacacacacauauacuuuauacuaacuguacuauauauuacaucaaauuauauauauuugaaauaccauaaaucuuauagguguauauauaaauauaaauauauuugaauauagucaagcuuuggcgauauauauauauauauguuguucacacacauauauauuaguacacagauauaaauauauauauuuauuggauauauauaaaaauauauauauccaaaguuuuacuguuaaguaacuugccuagcacuguuagauuaguaagcaguggaaucagaauugaaucccagguuuuucacuccaaaugcggaauuuuugcaguauacagucaucaaaaacaacaccuaguaaaucugggaaacaaaacaaaaaagaaaaagaaaaccacuagaacuuauuuuugucugacuuaguaaaguuacaaguaacaucuauuaauaccuuauguuaauccaauuacuuucugucaguuauugaaguugugauuaauuuuguuagagugguuacauagugcuugcuacacuaggauauuagucaaaaugggaaguuuuuccauagagguugucuucuugcuuaagaaaacuaaaucaaaaucagauacugaccaguauauacauuuucucucaauuuuagauuuucuuccauuugugugugaugauuguucaggaauauuuugguaaguuaaguuuuuaugcaggauuugggaguaauuuuaguguuuauuaauaugagguuauuucugaaaaguagaaugauuuaaaauaauuguuacuuuagccauugauuauugauauucaguauaguuauagacucugauuacuucuccauauauaugacugauuuuuaaacuuccaaaagugggguuauguaugugaauuuuauauaaaaguuauauuuuugucuuuuaauuacaaggagaaaauaauauucacaauauaaagaauaugguaaagauccaguuauaauuauugcucuuuauuuuaauuaauaaaaugaaaagagcccaaccuauaaaugccuuaaaauaggaaucacagcauuugacuacauuacaugccaaguaaaaccugggaauuaaugaagaauuuuggaaaauggauuuuccuuacaguuaaacuuuaaaaugucaagcauuuaaauuauaaaauagagcacugaaagaaugaauuuuuuucagaauguaauucagaaugauuuguuggaaguaaauaaaaguaauguauauuuuuaaauuauuuggaauuagagcacuuuucacauuuuacuacugaugaucuuuuagaaauaaaaagagcugaaagauauguuuauauuuucaugcaacguaaacguaauuuaggguggugaauuguuuuuacucauauugaaguugaacauuuguguuuuaaaacuuuugagacuauagaugcuccaucuuuaucugacauuucaguuuuuucucauauucaaaguuauuaauguaguaugagcauaauguaucuuaaguauacugaacauuaaaauaucgcaaauuucugcaguuaucuuuaaguauguuauuuaaauaaacacuugcuauuauuauuuaagccuugaacacagaagcagggagucucaugguuguccugagguauguuaguauuuuuccaaucugauaaaauguauucguauuuauguacuuucauucagaauuugauuagauuuaaaggcagucaguaucacagauuaaaguuuggcauacuaaacugauuagguaaagaggcuuuugcuucauuuauauuauuuuucuuuguuugaaagaaaaauuguuuuacuugguauuuguaaauuuuuauccucauaauuuuuauuccuuaacauuuguuuagguagcccacuuacaguauaaggcuauauauuuauuuauuuguuuguuuuguuuuguuuuguuugagauggaguuuugcucuuguugcccaggcuggagugcagugguacgaucucggcucacugcaaccuccgccuccgggguucaagugauucuccuggcucagccucccgaauagcugggauuauaggcacgugccaccacgcccgacuaauuuuuguauuuuaguagagaugggguuuuaccauguuggccaggcuggucucaaacuccugaccucaggugauccacccgccuuggccuccaaaguguugggguuacagguguuagccaccgcgcccagccaaggcuauauauuuauaaauauacacguaaguuaauguccuccuuauauauucccuccaguucacuguguccuucacuguuguguucauuuucacugaugccugcugauaggaucugugguaguaaaucauucuggcucagucgacuuaagacaaccaggaagaaaccuauaguuuaauaaaauuccuacccuaauuuugcacaaaucauaaguuaagaaaggucuggcaaauagaagucaaaauauuacccuuauuacugguaaagauaaguugaaugaugaaguucagcauagagcaaauggguuugcaaagaauauccagaauuaggcagacuugcccagcagucacagcaguacuggaccagguuaggcuuucucccugaaggcaguacaguuccaagaggaagagagaaagcuaagcccaccauguucaauguguucuaacacuuuucaguggacauuuauuccugcccaccauuuaccaagugcuuuaccaaauauuuucacaucuguucucucaguuauagaaaguuauuaaaguuacaugagguucaguugaaaucugauucuuuccaguuuaaaugaucagucaaaaucugacccuuugaaguuuacgugaucuauuugaggaaaauuugaauuaccuagcauguugauuuuaugcagcauuaauuggaggaaauauucagucauacaauaaaacuuacugaaguuucuugcaguuuauaaaucuauccuguguuuucuuuuuucuuaggauauaauuugauuccucugaaugugucucagauaauuaggucucguuaauuaaauauugaaacaucauuaggccauugcaacaaguucaaaaagauacuuaaauuaauuccaacaagguguaacuauuauuuauaaaaaggaauucccuuugguuguaguuuucaagcaauuauuucccuacguuuacucgucuuuagaaaccugguuuguuaaugcucagaauagccuggcugauuuagaauuuuuuuuuuuuuuuagucuuauaaaaucuuucuuccuguaguggaguauuugcugguaauaaaaauaugaaauagggcauagagaauaauauaugauuaugaaaaccgucuuuaaccuuuuaucucacaaauaaauaaauauuuuuuaaguguuuuauucucugaguuaaguguuucaucuccuaaaauuaguguggaaauuagguugacuugccauuugaggguugaugagauaauuaccugagcauaucauaggggcaccuuuguaugagacuguuacaaagcagguuaaaauuauagagcguaauuaaauagucauuucaacuugacuuagaagacaaauauaccacaguaggaaaauuaugaaaguguggaacagucaguauaguaaucauuugucacauaaaacauucuuuauaaucuuugagaguaaguaacuugcucuaauaaguuuaagcaaaaauaaaaugaauacugccuucuagaauaagacacauugauuuguuuuaggucugaaauguaauacauuuccuccuuuuugcauuuucaggugacuguaaucaaugagagacugaagacagaucaacauacaucuuacccaugcucuuucaaagacugugcugagagagaacuuguggcaguuauauguccuuauugugagaagaauuuuugccugaggugauugaucacuuaggcuguucacacuuuguauaucuguuuaagugcuauacaaacacaugaacuagugucacucuucuguugcucauagacaccgucaucagucagaucaugagugugaaaaacuggaaaucccaaagccucgaauggcugccacucagaaacuuguuaaagacauuauugguaaguaucuagaaagcguguuuuguugcuuuccuaguuccagagcuccugcuucuuauaucuacuuuccaauuaugggaggcaucauuaauaaccccagugguauucguauuaacuuguauuuugaugauauucuugugacaguauuucuuaugaggucuaccugaccgauggaaauuuggaaauuauuuggagguacuccacuguaaguacuuaucucuuuugcugagccacuuagauuagcuaguuaaccauugggcuagaaaugguauucaugagauugaaguagucagcugcuuucucuacagauuaaacucuaagccuagucagcuguucugugaaugcugcugauaauaagagauaccaggaaugaauguaucugugacuuaaaucagucugccugccaguauguuagcucagaauuuuuauuccauauuaaggauaguaccuuuauuacaaucuugcauaaccaaaucuuaagguugucuguagaagcauuaaugacugcuuuagguuaaauaggcuuaaguugaaaagaagcacauuauaguggauuuuuugauguggagauugccuagaucaaucucaaugauauuuuuccauugacaauguaaauacaauaccuauacaaugaauguggucucuguauaucucucuuguguguaauuuauauauguuucugagccauaauuaauaaguguauuauaauaaaauucuauuuguaaugugaaaguuuuaugugauuacaugcuuacacuucuuagauuccaagacaggagaaacagcaaguaaacgauggaaaggugccaaaaauagugaaacagcugcaaagguugcauugaugaaauuaaagaugcaugcugauggcgauaagucauuaccacagguuggucuuagagauuuuuuaaaacacaaaaauuucaaauauaguugaaguccucuuuguauuccuccuucccaucaauuaacaacuaaccuaaaccugguauguaucauucuuaauguugcaugguauaugucugcauaaauaauacaaaguuuuuugaguuuuuucacuuuauagacaugauagugaaccauauguauacuucuucgaguugucuuuuuuuuucccacuugggaugugcuguuaauguuuauccaugcugagauuuagucaacaaaauucggauuuuuuucaauuuuuugcuauuauaaacugucuauggugaccauccuuguguauauguagaagaguuucucuaggacuguuccuuuaaaacuucacaauaucaguuauuuuauauaacaacccaauauauauauauacauacauaccuuaacacaguugaguguuauauguguuauauuaugauauuuguuauucuguuuuaaagauuguggcugggcgugguggcucacaccuguaauccuagcacuuugggaggccaagauggguggaucaugaggucaggagaucgagaccauccuggcuaacacggugaaaccccaucucuacuaaaaauacaaaaaaauuagccaggugugguggugggcgccuguagucccagcuacucgggacgcugaggcaggagaauggcaugaaccugggaggcagagcuugcagugagcugagauugcaccacugcacuccagccugggcgacagagcgagacuccgucucaaaaaaaaacgaacaaaaacaaacaaacgaacaaacaaaaaaagauuguuagaaccuaucagguugauuuuccaaucccuaauggauugagacuacuguuuaaaaaaugcuacuuuagggaauauaccuagaaauagaaaaccuggauuaugggcuuugcugaucuucagcuuuacuagauauggucaacuuccuguugucagugauuguacucauuugucucuuucuguuagugcuuccaacaaugucuauuuuuggccauuuauuccuuaauaaaaauuuuaggaucacuuugcccuguucggugaaauuaugauuuugguaggaauuaugcugaauuugagauuagagagaguugacaucuuuagaauuuugacucuucucaucuaugucugugguauaucuucccaacuuuucuuaagguuuccuuuuauguguaauuauagaaguaaccuucuauaaugcuuaccauaaauauuuacauaccuuuuccuaguuuuauucuuaggcucuuuauaauuuuuguugucauuauaaauaauaccuuuuuaaaaaaauuacauuuuccuagcuaauuauuguugguuaauguuauguugcccuucuauccagcaaauaaauuccuaauaguucccauauuuuguagauuuucugggcuauuuucuguguagucauaucuucuccaaaugccaauuuuugugaguuuuuucugcagauuuucucuucucuuguguucauuaucauuguuugucuuaauguugagaucuucagaacaauguugaauaauaugggcaauagaaggaaucuuaaucauguuucugacuuuaaugcaaauguaucuaaaguuucaucaaguauuagauauacugugaauuuguauaaguagccuuuuucuugauacuauuauuucuuucuauuccuaauuugcuaggaauuuacacuaugaauggauauuaaacuuuacuguaaauuuuuuuauuacaucuaguaagaugaucauuuuuuccucaucaauguaauaaauuuuaucgaucaguuuuucugucguuagaucaucaaauauuccaggauaaaucacugacucugguauauaauucuuuuaaaaugcacugagaaauugauuugcuaacauuauuuaguguguguuagugacauuaauagcaagauuaugcuuaaaaauuaguugaguagcuuucucucuucuauucuuugagguaguuguagagggugggaauuuguucucaaagguugguaacacucaguuguaguaacucuuggagaauuuugaauacuauuccaauguguuacuucuugcuuuaucuggauaaucuauuucuucugaagucaauuuugguaaauauuuuuccaaaaaacuguuugauguagauuuuucaguuuauuauuuucaacuuguucaaguuauucuguuauacuucagaaucuuuaugugucuuuagucauucugcuucuuccuuaauauuuuucauuuguacuuuuccuucuuucuccuuuagacagaacagcuagaaguuuauccuuauuuuuucguaguguuuucaaagaaccaugauuuggauuuaaagaccucuguguuuuguuuucuguuucacuaauuuuugcuuuuauauuauuuccuucugcuuuguuuagauuuuucucugacauccuuuuuccagccuuucacauagaaugguaauuuauugauuuuauuuucguuuuguuuuguuuugagacagagucuugcucugucgcccaggcuggagugcagucgugcgaucucagcucacugcaacgucccccucccugguucaagcgauucuccugccucagccuccugaguagcugggauuacaggcaugcaccaccacgcccagcuaauuuuuguauuuuuaguagagaugggauuucaccacguuggucaggcuggucuugaacuccugaccucgugauccacccuccucugccucccaaagugcugggauuacaggcgugagccaccaugcccggcaguuuguuuauuuuuaauauacuuguuuagguauaacaauauacuuauuuggugucuuuauuuuguuaccauuucaaacacaggcaaguuacaaacauaguacaaauaacuuuuccauauucuuuacccaauuguaccaauuauuuauauuuugcuguguuugcuuuaucaucugcugucucuuucugucuauauguaccauauguauauguguguacuuaauuuuuuguccacuugauuuaucacuuucucagguuaaaaucuccuacuauggauguguuuuugcuaauuuuuuuauauaacucuaauaguuuguagaguuacguauuaucaaguacauagaauuucuucauuguuauauguucuuuaugaauuuugccuuuaacccuauuuugaauuauaauauuguuucacuagcuuucuuuuggugaauauuuaacaaguauguaauuuuuucaucgcuuuauauuucaacuuuuuuuguuguuuuguuuuagggugucucuuguaagcagcauauagcugaacuuuguuuuuuuuaaaccaguuugauaguaucucucuuuuguaggugaauugaauccuuucuuguuuaugguggucauugguguauuugaacauauuucuuccaucauguauuuucugcucaucacccuuuuucuuugacucuuucucuuuccuuuuguauugaauuuguucugauggcuuagaaacaauugauuacaguuuucuuauuuuauugacuaccccugauauuuuccuuuuuugaaauuuuguuugauuuuuuuaaaauugcaaagguaguauaagcuuuuaacaaguauaacuaucaaaagaugcauauggagaaaaaacauacacacuccugugucucucauccauuuacauccccuaaagcagcaguucuuaacugaaagcaguuuugcucccuaaggggacauucagcaaugucuggagacauuuuuaauugucacaguugggaauggggugcuacugguauuuaguugguagaggccagagaugcuguuaaauuccuacauuguagaggacaaggccgacaacagagaauuuuuucuuggccuaaaauguaaauagggacaaaguugagaagaccugcucucaaguauucaguaauacuuacauuacuuugcaauucuucuauuacuuaaaacauaacaguaaaaacuucuauaagacuuacuuugaggcaaucuucuaacauauuucauccuugcaacaaguuuauaagguaugcacuauuaacuguuacccaaaaagaguaacauucuauuaacauagcuaguaaguggagaacuacgaauugaaacuaggcagucugguuucacaaaccaucuucuucacacacuuaacaauauaucauaaagcauucuauaaguuuguagauaaaaguuuuucccuuuauuauuaauguuuguguguguguaaguauagauauacuagagauauaugugggugucuuauguguuuauacauacauguauaauauauacaugcauauuguauucauguauauacguauauguguaaguguauuuguuauauguguguguauaucauuuuacauaaaugaaaauguauucuacuuguauaugugugcaaaggcauaaagaauauuuuucugucauuauuuuauaaaaaugguaucaaucauuuagucaacacacuuaaaaaaaaauacuuucuauauaccaagcccugauaauacaguagugaauaaaacagaaucccuucugcccuuaugaaccuagaguuccuggaguuuauaugccacugggcugagauagauauuaaauauauaauaauucauguagugauuagggcuauaaauaaaacuaaagcagguuugggguagacuauauauccuucucucauuaaugccuaguagaaauucccucaagugaguugguguggcccuaaaucauuuucuuuacaaacugcauucucuucugugguguggguguacuguggcuuauuuugucauuuuucaauuaaugagcauucacuuuguuuccaguuuuggcuacugugcuaaauaggcugugugguacuuuucuuucugugagauaaauucccaagaguguguuugcugugucaaaugguacgcauauuuuagauuuuaauaaaaauugucaaacaacuuuacaaagaaauuacaauucacauuucgaaucaaauuucauugacggauugccuauacuaaguauaguuuuguggcucuaguuuuuuaaucaucuuuaguacuugcagcucuucugagauauauuuuuauccuaauuucacagaugaguaaucuggagugaaguauuuuuaagagcacuaacuugguaagagccugcccuucuaaccaguuccguauacugccucuuguggccaaacaugagaguacccuuuuucuccaugguuuccaguagcuauuagcauucuuuuuaauauuuuacagucugguggcuauaaaaagauauuucauaauugcuuuaauuuguauuuuccugacuacuauucaguuuggacaacuuuuaauauguuuuuuaggcauuuggguuugcccuucucugaauuguuagugaguaugcuuugaucauuuuucuuuugggauauuuuucuuuuuauuuuguuuggucaacuuauaggagcuccuagacuauaaaagauguuaauccuuuaucuaaaaucauuauuuguaaauuguuuuucaaaucuaucaguguauugauauuacuuauauuucuaauugacauagcaauauuuuacauuuacauuuuccaaguucugucuuuucuuucauuccuguugugguuuuccuuuggguuuuguggguauguuuguuuuguuuugcauuagccuuuuuuuuuuuuuuuuuuuugauggagcuuugcuguuguugcccagucuggagcgcaauggugcgaucucagcucacugcaacaucugccuccugaguucaagcaauucuccugccucagccuccugaguagcugggauuacaggcaugugccaccauggcccggcuaauuuuuguauuuuuaguaaagacaggguuucaccauguuggucaggcuggucucgaacuccugacuucaggugauccaccugccucagccucccaaggugcugggauuauaggcgugagccacugcgccuggcuuguuugggauuaauguuuaauccaccuguuuuuuuaauuagcauaugaugugagcugagggcuuaauuuuauuuucuuccaguuguuuagguaguuuugccaccacugauuauuuaauaaguuaucuauguuuuauuggauugaaauaucaaaauaccaccuucaugaaaaguugaacauuuuauuucuguauauggauuuauuucuuaauuuucuguuacagucuacucauuuauuuuuuacucauaaguuaauaccaaauugauuuggugcaauagcuuuauagaauguucuauaucugaucaugcaagucccauccauauuuuuccauuuuuuucuuaguauuuuuauuagcauuuguuaauccaucugaauguuaugauuauuauauucagauuuuaaaaaauaccacucuuaggauuuauagguuaucauaauggggcaagguugugaauaacagacuucaacauagccuguuaaagaaguuggacucuuuaaaagcaaaauguggaagcugagaguaugauuauaaaaagcaacagauagcacagcauagucuuagacagaaauguggcuuccuacauccccucauguuucccacaaggaugugaugagugaauauugccuggaggaagugaggauuugaccauuuauuugaaggccccuuugccauucuccuggagauuuuauaccaucuuggccuccuuuuuuauguccugaggauuccagcuccuuuccugcuccuaagcuuccaguaaugcaugcaaaacauccuuaaugaauaccugaguggguucuaugaaguuaggugaaguacaguuugaaaucccagcaguaucuacuagcaagucuaggcuuuuggccugacucagaaccauuccugaaggauucacacuggauuugcuuuauaugccauacauuaauuuuggaagaaaugacauuuuuaugacauugucuuucuguaaggaccuuauaugucuuuauuuauucagauguuuuauucccuucuguaacauuucauauuuuucuucuuuuauauuguauuccuuauuuucauugcuacuuauuuuacgguuuuuguuuagguugagaacagaauauuuuccccacuucuauugccaaguacuuauuucuaauaaagagaaaaaaaaucuucagcucuguauacucauauuauucagcuacaucaccaaaaucuuuuauuaauuuuagaaguuuuuucuacuaguguuuuuuaauuuucuaguuaaaaauuauuccucauuaacaaauaagaauagcuuuaauuuuuuaaauaauuauacucauuauuucauuuuucauacuacauuaucuauaaucuccaauauaauauccuaaaaugauaauggugauaacaacuaugugcuuacauucuuaacauauauaauuaaauaucaauguuuuucucaaagccugaaguuaguugguauuauauccuccugaauacgagcuugaaaggcuuuauccaguugacucucuccuaucccaucaucuuuuuuuaacauaaaaauuaauucuaaguuaauagcuauuaaaauuuaccaacacuucuuuuuuuuuuuuuuuuuuuuuuuuguuucuccuuccuuagggcuuacuuguauuuuuacuaaaguacauucuuuagcaguucauuuaauaaaggucucugguaauaaacucuaugagucuuuuuugaacauguccuuauuuugcccuuacuuuuagcuggauugccuauuaaacuuucucaacacuuuuaauauacuuugucaucuauuauuggaggaacaucugugucagucuuacucuaugaguaaucuaucuuuuuugguagcuuuuaagauuucuugugauauuuuccaauuucuguggaauguuucuacguguggauuuauuuuaauuauuccguuugacacauuguaaauuuugacuuuuuggaaaauuuuacucauuuucucucuaaauagugcuacuucaccauuucuucuuuucugaaucucuugucgacauauuuuggggaucuauaauuguuuuuguuuuuguuuugagacagagucucacucugucacccaggcuggagugcaguggcacagucucggcucacuacagccucuacuuccccgguucaaacaauucucgugccuagccuccugaguagcugggacuacaggcgcgugcccccacaccuggcuaauuuuuguauuuuuaagagacgggguuuugccauguuggcgaggcuggccucgaacuccugaccucaagugaucugcccaccucagccuccccaagugcugggauuacaggugugagccaccaugcccagccuauaauuguuucuaucuuaugucucuuuaugcgguauuguggaugacuuccuuauauccaucuuauaauaaauuaggccuuuuuauugaggauuauagaaacuuaucuauaauaaauuuugaauguuuuacuccagaaacuauuuuuuaauuuucauuuuuugacuuggaucuucaugucuuuuauguuuuauuugugccuauuuugguuuuauaacuucuuguuuccuuuuuuaucuaauugugcauccuaacuaccuuuuuuaaaugucuuuuuaaaguucagcugucuucauuugcccauaaugaguuaaucuucaguuuguuuugaaauuucaguuaaugcauuuaaaauguucaucuugaauaggagguucuuccuauauuucuccuuccucucacucacagaucccugucuggcaauuuuauacuuaagucagcauucagcaguaacuuuagcugcccuuccuagagcagaggucccacacacuccucugcuuccgagcagggagccugacccaggagcuuuauacuuaucucccuguggugcuguuauuucccacuuaccuauaagcugaccuccuccucuucuggagcccugaaagccuguggcuuagccagccuaucacuuugcauuucuguuucauuuuugauccucauacauauuuaucuuuuuuaaaaaaaaaagauaaggcuauaucuuaucaauuuucucuuucuauauuuaucuucuugcugcuuucuuuuuggagcagguaauauuugauuauagagguggcucacaguuugaauuuccagugauuucuuguuuuuucuuuuaauacucguuaccuguaauaacacaccccacuggucuucaacaaaucuaaauuccuuagugcugaguugggaauuguguuggauuuauuauuucucagaauaauugugaucuuucccccacaaguuagagaugcuccuguuaugccaaaauuuuuguuuuagcaagaauugaccuguaaagccagcacuuuuaaaaagcaguuuuucggaaucagugaagagcaaaggccaagccuuuugcuccuacucauucuuuccugcuuuuuuuuuuuuuuuuuuuuugaaauagggucuuacuguguugcccuggcuggaguacaguaguauguucaccacuuauugcagccucgaccuucuugggcucaagugauccucccaccucagccuccaaaguagcugggacuaccagcacacaccacuauacccagcuaauuuuuugugcuuuuuguagagauggaguuuuaccauguugcccaggcuggucuugaacuccugggcugaaacaauuugccugccuuaaccucccgaagugcuaggauuauaggcaugagccaucaugcucagccauccauuuguuaauuaggcaagaaaauacaauauaaggagagggcagauaagauauagaauacuagagaaauccuuuccaaguccuuucuuuuguugauaagguacuugggguuuggaggucuuuuucuaucucuuuuuuuuuuuuuguuuuuaauguuuccuuguuccgaaaaguccuucugucuaaauacauagugaggucuuucacauaaaaagaaauguuguaugugucagaaaucuuugaauugcaagugacggaaacuugauuccaacuaggaaaaucaaaacaaacuuuuuuccucauauaauggggaauaaugaauugaucuggucuuaggggaugaauucaggaacucagauuauguugaaagagcucaucuguuuucuuguuauuucucuuucuacauugaccucauuuuuucccauucgaggaaacuuuuuccacauugguucaggaauggcuguuaggugacgggguuugcuguaggcaacuccagguuuaauuugauaaaacuuaaaaaaauaaggagaggccgagugugguggcucacuccuguaaucccagcacucugagaggccgaggcggguggaucaccugaggucaggaguucaagaccagccugaacaacauggugaaagcccgucucuaguaaaaguacaaaaauuagcugggccugguggcacgugccuguaaucccagcuacucagaggcugaggcaugagaaucacuugaacccuggaggcggagguugcagugagccaagaacgugccauugcacucuagcguuggcaacaagagcgaaacucccucucaaaaauaaauaaauaaauaaauaaggagagugcucuuugucuccuaagcuguugaacauaaaaucccaggaacagaucugauuggccuaacuuaggccacauaucugucuuugcacagaucacccuggccagggucuugguccuaugcccaugcauuuauguguguuuuuggcuacugugauugguauuccaaguagcagauaccuuguuagaagguaauucugcucugaccagaagagaggaacgguuggcaccagacaaaaacugaugucuauuuugucuauguaaugguuguuuuaacuuuuucuuuuuacagacagaaagaauuuacuuucagguuuucuuaccuaaagggagcaaagagaagagcaaaccaauguucuuuugccaccgauggagcauuggaaaggccauagacuuugccgcuucucuagccaggcuuaaaaaugacaauaacaaauuuacagcuaagguaacaucucauuauaauaauauuucuauauuaauaaagguuuuaugaugcuccauucaagcauguuuauuuauuacaguaugacuuacuucucccuucacagaaauuaaggcugugucacauuacuucaggagaagccuuacccuuggaucauacuuuggaaaccuggauugcuaaggaggauuguccuuuauauaaugguggaaauauaaucuuggaauaucuuaaugaugaagaacaauucuguaaaaauguugaaucuuacuuggaauagucauucaaagauucaagucagaaaucacagggaaaauucuauuacauguuuaaguccauuuauuuuacuacaaauacuauuuuuguaauuuuuaaaaguugcuuuuuaacuuauuuccccuuaugucacauuuuaaauuaugaguuuucuauuagaguuuuuugguuuuaaguuuaauuguguacggauccucaauuauuagcaaauucuuauauuuaauuagcuuucauuaguuuaugcuguagugacaacaacaaagauguauuuccuggugggggaugucagcuguugauuggcugugacacugcuuugugucaucuucuuaccaugaucaaaggcaaaggaagggaucucuuuugggacauugugauuguuuuagcagagagagaaagagaugaaauacacuucgguuuucucuuaaaagaugcauguaucauacgugcuuuaagcaagucauguggccaagccuagcaucauggagccagaaaguauagccuugcugucugucuacaucaugauguauaaauugauauaucuacaugaauuauagaaacuuagaagugaucuuuauucagucuuauaauuuuuacaugaagaaucuuaggccuaggaggagaaaaugauuuucuuucuauuaccuaacuagauuggggcauauuucugauaaagacccaccucuagugagauucaucuuuuuuguuugugugacuauauuccauagagaagaaagaugggauagcucaacuucauuauauaccaaagcaaaacacaugccaaaugaugacuacauuuuaccaacauauuuagacgaguauucuugacuaguguuuacuaucuauacccccaaaacuacuacuauauagacagaauggaaaguauuucuauuuguccuuuuuuuguuuucuguucuaauugucagggacauauguaguggcuauagguuuacuuaaaaggaauaaauuuggaaugcucauuugguuuauuuccuuucuaauucuucauauuauuuuuaugugaggaauggagauaauuuccaacuuuuau

SEQ ID NO: 13580 - RNA, 5439 nt, Homo sapiens
aaaggcuuuguaccauucuucauauuuuuaagauuucucaccaguaugauuuauuuuauguuuagaaaaguuugaagguguugucaaaaucauugucacaucuuucagguuuguaaaguuuccaguauuaauuuucuuauguuuaguaaaguuugagauuuaguuacaagcauugccacauucuucacauuugcaggguuucucucaaauaugaauugucuuauguggaguaaggguugaugauagguuagcuuugccacauucuucacauuuguaggguuucucuccaguacgauuuuucuuaugugcaguaagguuugaggauaaguuaaaagcuuugccacauucuucacauuuguagaguuucucuccaguaugaauuauauuauguauagcaaggugugagaacuguuuaaaagcuuuaccacauucuuuacauuuguacaguuucucuccaguaugaauuaccuuauguuuaguaagcguugaggacagguuaaaggccuugucacauucuucacauuuguaggauuucucuccuguaugaauuuuuuuauggucuguaagguuugaagaucgguuaaaaacuuugccacauucuucacauuuguagcauuucucuccagugugaauuaucuuauauguagaaaggguugaagacuggcuaaaagcuuuagcacauuuuucacauuuguaagguuucucuccuguaugaauuuucuuauguguaguaaguuuugagcaucgacugaaaguuuugccacauuccucacauuuguaagguuucucuccaguaugaauucuuuuauguauaguaagaguugacacuugguuaaaagcuuugccacauucuucacacuuguaggguuucucuccaguaugaauucuuuuauguauaguaagaguugacacuuggcuaaaagcuuugccacauucuucacacuuguaggguuucucuccaguaugaauuuucuuauguguaguaagguuuacguauagguugaaagcuuugccacauucuucacauuuauaugguuucucuccaguaugaauuauuuuauguguaguaagaguugagaacugguuaaaagcuuuuccacauucuucacauuuguaggguuucucuccaauaugaauuuucuuauguuuaauaagguuugaugaucaauuaaaagcucugccacauucuucacauuuguaggguuucucuccaguaugaauucuuuuauguguagaaaggguugaagauugguuaaaagcuuugucacauucaucacauuuguguaacuucucuccaguaugaaucaucuuauguuuaguaaggguugagaaaugguuagaaguuuugccacauucuucacacuuguaagguuucucuccaguaugaauuuucuuguguucaaugaguuuugaggaucagguagaagcuuugccacauucaucacauuuguacuguuucucuucaguaugaauuaucuuauguguaguaaguguugaagauugguuaaaagcuuugccacauucuucacauuuguaggguuucucuccaguaugaauucucuuauguccaauaaggguugaagaucgguuaaaggcuuugccacauucuucacauuuguagaguuucucuccaguaugaauuuucuuacauguacuaaguuuugaggauagguggaaaacuuugccagauucucuacauuuguggggauucucuccaguauggauuaucuuauguguauuaagggcugaggacugguuaaaggcuuugccacauucuccacauuuguaggguuucucuccaguaugaauuaccuuaugucuaguaagguuugagaguugguuaaaagcuuugccacauuccucacauuuguaggguuucucuccaguaugaauuuuuuuauggucaguaagauuugaaaauuguuuaaaagcuuugccacauucuucacauuuguagggcuucucuccacuaugaauucucuuauguguaguaaggguugaggacugguuaaaggcuuuaccacauucuucacauuuguacagcuucucuccaguaugaauguacuuauguucaguaaguuuugaggaucgguuaaaagcuuugccgcauucuucacauucauaacguuucucuccgguaugaauuaacuuauguucaguaagcuuugaggcuugguuaaaagcucuaacacauuucucacauuuguagggaauuuccccaguaugaauuauauuauguguaguaagggucgaugacugguuaaaggcuuugccacauucuucacauuuguaggguuucucuucaguaugaauucucuuaugucuaauaaggugugaggucugguuaaaggcuuugccacauucuuuacauuuguaagguuuuucuccaguaugaauucucuuauguuuauuaaggguugaggaccaguuaaaggcucuuccauaugcuucacauuuguagaaauucacucuaguuuggauucuuuuauguugaguuaggugugaaagcaugcaaaauguuuugcgacauucuuuacauuuaaaauguuuauuuucaguaugucucaucuugugucuauuugaauuugaaauuuuauggaaaacuucuacauauuuauuacauugaaauauuuugcucaagguaguuuucaaacauugguuaaguccacuauaaucuccuuugugcuguuuacacucaaccacacuuuuacagccuuuucuuaacuguaaauucucauauccacauuuucuauaucuucuuagggucacuuucuggaaagaaucucuuauguucugcucuggccaaagguguugggcaaaauaauaaaacauaacugaaagaaauaaaaguaacaaacuacuucacuugcucgacucagaugaauauacuuuacaaaucuaacccauaaaguuacagaaacuacauaagcaagauggcauagcaaaauaccacagguucuaauuccuucauagacauauaaauguaacaagagcauauugaccaaaaugcauuuauagaaaauuuauaaaugaguuacgugugugcaguguuccagguuaucacaauuccaaaagccacauggaaggaagagaaaaguugguuacauuuacccaacacagcucuuucugcuccucaguauaacauagugucuuuagaaguacauuaccaacuuuugcuuucuuuuucaacagacaagaaaaauaacacacccacaucuuuauuucuggcuuuauuaggugcuuuggcggacacugguuucugucuccaaugacauaaagugcugaaauuaacagugguauacuuuggaaugacauuuugagucugcugagaucaaagguaaauguuacagcaggaaagagacuguacuacagacagggaacaguuguggcaagugaugacuauuaagaagaaacaugaauaaagucuuuuaacuaaaaaacaacuagaacauuucagacaagacacauccuaagaacauguuugaaagacucucaggaucucuagcuaagacaaaugguuucagacuuugccaggacaaagcuacauuauagacacugugacagguagcuuguuuuuaauguucaaauuucaauuaaagauuacaaugcauacaaaauuuuagggcaacauagcucuaucagauauuauaaaauuuucagaaagcaaccauuaaaaaauuaauuuuaaaaaguuaacauaaauugaauaauacuccaugaaugaaauagaaacacagacaacuauuaaaaaucauaaaaauugggauaacaaaaauauuaaaaauaucaaaaaacagauauuguggagguaaaaaauauaaaaaaggaacugaaaaauuauaagaaaaacugauguaaaaauuaaaaagguuaacaaagaaacuagaauacacacaaagauauuuacaacaagaacauauauaagcacaauuuuaaaagucacagacaagagaauauugugaguugcaagauaaaagugauauguuauuuauaagcauagucuuaugagguaaugagugaauuucucaagaaaauuugcaggccagaagggaacuaacugugugacauuguccaaguccugaagaaaauagcugucaagugagaauaauaccagcagcaaaucuguccugccaaauaaaaagaaaaagccaauccaaaauagccaaauccugaaaagguauauuggcacugcauaugccuuacauauguaacuauauuucaaagcuauaguaguaaaaacagaauggaauauacagaaaaauaaacaacaacaaaaaaaccaauggaacagaaaucacuacucacacauuucagacuugaugcaaaaagagaauuuaaaaaacuguuuaacauagaguuucucaaaauuaugcauauuugugugucccccaaaacaacaacaaaaaaaaaccagucagauugugcagucuuuuauaucccaugaagaggauguuggcuuucacugugaaauugaagacagaucacuaaagggaaagaggaauccuuagagaauugaaaaacaauacaaaauauguucuaugugagagaaaaauaaaaaaaaacucgggcuuuccagaaacuauuuccuuuggaacacagcuuaccaaaucacauuuuaagcuguggccuucuccuuggccuuugaccucuucucugugccaucuguguauucacucucacuuaccuaaauguuuagcuaccaucucaugucucuucauauuccagggcucuuuuccuugcuccagacagguaaucaggucuggcuuagagacagcaauaccuguuuuauugaaaauaaauaacauaaaucuugcacauauucuccaauuaccaacuugguaaugugcucaguaaagagaaugcaauagaauauucuaguaaauuaauccccaaaugcuaauuuauaacaaaaauuucuaaagauuuagaaaauauuuuaaauuuguaguuucuuaauuucacuaccugguacuacugaaucaaaacaauuguuguugggaguuagauuuuaaggugugggcaacaauauuuuaugccaauaaauuucuaaaauuaccacuaaucaagacugaaugauaaagaucaucucaggaauguggaaaguuaugguaaagaugaaacaucuugaauaaacuauuuucuacaaugacaaaucuaaaagauuuuuuugaaaacagggaucugaaacucaauuuaugcaaagcauaaaucaccaaaaacauucuacaaaaaagagaauuaaaaccuuuaggguauauuagaaaauguguauugaaguuaccuucacccaagaaaaccagguuucuguaguucucucacaucacaugccuauauaaauucugcugugcaguguccaggcauugccacuccuccaaagagaauucuauggccacauccauaaaugucaauggucccugaaaaacacaaaaacacacacau

SEQ ID NO: 13581 - RNA, 1406 nt, Homo sapiens
agagucuucuuguauuccaagcuuuauguuuuuagagaacugcucauagaauuucuugcaguucucuuuaucuuccgccaguucuguaaagaguucuaagcauuuuuugaccaaauuuuuccugauaacuuucaaaauuuuacuuuguugcaacaucucacgggaaauguuuagagggagauccuccgagucuaccaccccucuaaugaaguucagauauucagggauuagcuccucacaguuauccaugaugaaaucucugcguacauacaauuugauguuguucuuuuucuuucuguuuucaaacaggucaaaaggagcacgucaugggacaaauagaagggcucugaauuccaacuguccuucaacugaaaaaugcuucacugccaagugaucuucccagucauuggucaaguucuugcagaauucuccguacuccucauuaguaauaucgucgggauuucugguccagaugggcuuuguuuuguugaguucuucuuggucgauguacuuuuccuuagucuucuucuucuucuugucaccauccuucuuuucuucuuccucaucagaaccaacaucuucaauuucagguuugucuuuggacucuuucucuucuuuuucuuuuucuucuucuuugucuuccuuuucuucagucucaucgucgcugacuucuuuaucacauuccuucuccacaaaaagaguaaugggauauccaauaagcugagaauguuucuucacaaucuccuuuauucuuuguuccuccaaguacucaguuuggucuucuuucagguguaggauaaccuuuguuccacgacccauacguucaccugugucuguccucacugugaaugaucccccugcugaggacucccaggcguacugcucaucaucauuauguuuggugaucacaguuacuuucucagcaaccaaauaagcagaauaaaaacuaacaccgaacuggccaaucauagagauaucugcaccagccugcaaagcuuccaugaacgcuuuggucccagacuuggcgauaguaccaagguuauugaucaagucagccuuggucauuccaauuccaguauccacaauagugagaguuugaucuuguuuguuugguauaagguuaauaugcagcucuuucccagagucuaauuuacugggaucugucaagcuuucauaccagauuuuguccaaugcaucugaugaauuugaaaugagcucucucagaaagaucucuuuguucgaguagaaaguauugaugaucaaugacaucaacugggcaauuucugccugaaaggcgaaugucucaaccuccuccuccuccaucgguuggucuugggucuggguuuccucaggcaucuuggcuaagugaccgcacaggacccacggcacagcaacaccaggaugcu

SEQ ID NO: 13582 - RNA, 4491 nt, Homo sapiens
aaaauguuugaucaaaauauuuuaauaaagauucuuucugacauagauacacauacaaauggucguacauagcugucauagucugauugaccuauuuaauauauauaucauucuuuacacauccaaaacccgccaacagauccaucacagcucccaacucaccauccaaccugacaaacugaauuuguauuaucugcaaggaguggaaaauagcaggacuccauuuuuaaaaaagauuuucuugauuuucauagggcggaaaggcagucaaacagccaugcaaaacuaaaacugaaagcucacuuuggguaaauagcuucuuguucuuccuuaguuuucuuucuuuuuaaauuuuauuuuuuuagaaaaauaacaaaggauuucacaccauaggcaaaucaaaccagucuuuuaacuuaaauaauucuccacaguuaaaauaacauauauguacauauauauuaaaagcaauuaaauuagaccuuuuaaaaaugcacagcacagccuggaaaaauauuugcuuagcauguucuuacguauagcaacuauugcugugauguuuuucccuuuuggaauguaaaggaguccccuuucaaaaaagagaucaauucauucaucaauuaagaauacaccuuuccuguaauuuuuggacugaagcaauuuauuaaagcucaauuuaaauacagggaugaugcaacugaaaauauccaggugaccuuucauaaaccuaagcagcucagauacaucaauauuucucuucauacuuguuggcaaauaaaccuuuaaacacuuggcacacagcauaaguaaucuauaaaacaauuuuagaggcauuaaaaaaaucugcacauaagacccaugacuuuaacacaugauaaauacuguugauguggaagggucauugaagaauaacaaauaaauaccaugaauuguuaauacaucauugcagaguagaaaguaacaaggugcacauaaauauuuuuaaaugcaauucuuucagccacagucaguuuuuuuauaucacucucgccaaaacuuugagcauuuucacaggauuaaaguucagagacaauaaaaaauacaagucuuucauaguaacaugucucucucucucgcucucucucucucucuggguuuuauuucccccucacuuaagucaacauuucaaguuuuucuccuggcucagaaucaaaauuuauuuucaagugcccuuucugauuugucugaaugaauauuccaucucucaugcuacccaaccccuaaccccuccucucccccucagcacuagccaaauccacaauuauuaguaggauuaguauuuugccauucaaacacucuccaggcuuaauaaccaagcacuacuucucaacuuauguuucaccuuuaaggaagauuccacuuccucgcggucuaggcugccaccaaaguugccacuuuucugagaaaaaaaagacauccauacuccaucccaacuccaccucccuccucccucccuccccaccccaaagaccgagauucuggggaugucaaggcuaaaagucccguuugucucugauacuucuccucaguucuugccucugcuuuguuugcucugcaaguguuucacaacuacgagaggaccaaaauaaaggggguggggagcagcuuuucgcuuuccucuagauuuugggucggucuuguguuuuucggggguguguuuaaggcuucuccgugcacuguuugcagaggcuggaggagacgcuguuaaacagggcgcacuucuccgggcaggaggcagccgggggcaguccggcgcugaacggguagccggcugccugcucguaggcgccgagcgccgggugcagggcagcagcugcugccgcugcagccgccgagcugggcagggaggcagccgagauggccuggcccugguugagguaggcgacuaggcgccgcaucuccuccagggccugcgccugcaugaggauguaguucuuggcgagcagcagcguggcgaucuuggagagcuuucgcaccgaggggcugugcgcguaggggaucaccgcgcgcagcucguccagcgcgucguucaggucgugcauccgccggcgcucucgggcauugauguuaagccgcagcgccuuuugcucuuuggauuucuugcugcugcugcugcugcugcugcugcugccgccgcugccgcuaccgcuaccgccaccgccgccacugcuaccgcugcugcuacccccgccgccgccgccgcccaggccccccggggggacgcuggcgccgccguggaggugggcauuggagcagcccucggcugccuucgcgccaccaccucccgcucccggggaggcccgcgggucggcuacuccggcccgcagcacgagcucgcagcgaccgucgcugucgucgucggggcucugcucgccgccgcugcucucggccaccgagccccggcucgcgcuuucgccguacuugaggcaaagggcggccccggccggcaggcugcuuaggcuagggucgcccccaacgccggcugaaccuacuagcagcccggggacacccaccccgccgccgccgccgccgccacuucccgcgcugccgccgccgccuccuccaggcggcggcaacagcagcccugcccccucggggucagccggcucgaagcagcccaggggcgacgaggaggaggacgccgggcguucccgaggcggcggcgccagggacagguccaugcccgggggcguggagcggaaagccgcuuccaagcgcuuggagguggaggcgcucaggcucuugugcaggaagaggucguccucgccggcggccgcugcaccgaggugcaucccgcgcuccauggucccgcgccggcgcgcagcccgggccgccgcgcccgcugccgccgccgccgccucggccccggagucaggcggccccacagacgcgcgcgagcugggcuccggagcuggugcgcgcgucgguccuggugcugccgggagcccucuccccuucuuucuuuuucuuuuucgccuucccccgcgcucgccgccuccucuucuucuucuucuucgucuccagccgauggugcuggcugcuggggcucaccaugggccgcggccccgcauggugggagggugggcgcggagggaguggagccgccgccgccgccgcucugagcccagccccgcgccuccucuccgcaccguuuaucuugcuuggauucaccuucaagagauuuccggacccaucaaacagccgccgccacagacgggggagucuuuuacaucauuaucucugaguagguuauuaugaagaagacucgccuguugggacagcgcuuucuacccaaucagguuaacguuuuaauuaauaggauuaaaacgguaacaaacaaucgcaggcgcuaucuggccgcaagucugaauaguuucauuucccaggucugaagacaggcagcagcuagagcuuuauaaaaggcgccugcuccauuauucugccugccaucuguauacacagcuuagcgcauauguuugcaaggcgcuggguccuguuaguaacccaacaacugccuuuagcuugacauguguggcgacuuucacucaucaaugagcacacuaaaagcccuacuuagagccgaggauguucuuugcuccuucagcaaauuguagaucggcggcgaagccugggaguccuguggaaagcagacgcccccacccaccgcaccccaccccccacugcccuucccucgccacugcugucucagcuugugcuaaauuacccuuccgggcgagaauuauacuccaccccuguucguaggaugacuggucuggauuuggggaugggacuuuccgagagaagguggugucccagcuggcuugcccaaaauucacucuagguuuucagcuggucagagagcaaagcagucguccccccgaacacucugccucguuuccacacccgccacugcccauuuccuacccagauuggaaaaaaagaaagaaaaaagcaaaaugaagagcaagugaucaugcagcccauuuuuuuuuaaggugggguggcagugauuuugcaguggucuccaaauaacuguuacagugaugguaauugugaaguacacaauuuccuaaacaggaagaaaacaaacaaacaaaccgguuucucaaacuuuccuuaagaugaaaaucugauugcuucaaaagagucaacuucaccaggagucaaauccgcucccacacgaagugaggcauuuaugcauauuuauuuacccggaagccauuuaaggacaucuggaucagccucgguuguucuuggaggguucgggaagggagaauguaaaaacaagugcuccucuccggaugggcacugguacacgcggucaucucacuccugaguucggucucuggguacacaugguauuuagcagcugguuuucauccuuaugacauaaguaaaaacaauauuucccaacaccuuccaauaacucuuucuuauauggcagaaguacug

SEQ ID NO: 13583 - RNA, 6983 nt, Homo sapiens
auuugaaaugcuuuuuucuuuccacaugaaggugauacgucagguaguuuuuaaaaauagucucuuuuggccugccacaucuuuucugucauugcuuaugcaaauaaugcuccaauuaauguacuuuuucaucagcuguggucuuuuguuggcaguugguuaggcaguuuuagauaacaagguuaaccaaacaguccuuuauuauccuucauaaauauuauuauuauaaauuuucaauuugggacuaguaugucuuuuauacauuuuuguaagagucaucauagacgagagaauacuagaaucguguauuuuauugcauuaucugaauguuggcaguaauuuaugagucuaugugaaggauguagucuacuuaaaauagacuuuuuaauauguagccuauuuaaaacguggucuauuuaauuguuaaaauaauauaguauauguguccuauggaaguuuacaaaacugagaaguauaauaggagguauaaaaaauggagaguuacaccauggaagggaaaacgaaacaucauaaaaaugguaguuuuuccaaauuuaauuucuauucuuggugugacuccacuuguuagugacaaaggaguggacguugaggacgaaaacaguccccauugcguguagcagcucuuuccaaaaacucggcucuguagggggauggagcaggugaaacuggagggggccaggagaggcugugauucuuuauuguuucagagaugagagaaucuagaacaugucugaaugcugaugcuuguugagacaauauagaaaagagagagagauugguggggugggguggggauaguuguaccugauagaacaaggaauaucucugaggagguguggauggauuggcuuuugaaagaaagggaaacuuggccaggcgugguagcucacgccuguaaaucccagcacuuugggaggccgaggcgggcggaucacaaggucaggaguucgagaccagccuggccaacaaagugaaacccugucucuacuaaaaauacaaaaaauuagccgggcuugguggcgggugccuguacucccugcuacucgggaggcugaggcaggagaaucgcuugaacucaggagguggagguugcagugagccaagaucgcaccauuguacuccagcccaggugacagugcuggacuccaucucaaaaaagaaagaaaaggaaacuugagggcuuguauuauuucugugacauaugaggcuguggagaaugaggggguggaugggaacuaaguauguugaaaguuuaagaagagcauaaaaggcuugaaaauaggcauuuuaaaacgugaaagagccauuucacuggaaagacaauaugauugcugggcaguguugacuacgaguuuguagcgauauucugccuaguuuugugauucccccuccccacccccccaagcaacucucagauuuucugcagcuacucuggaaaagcaaguggcugaguucagaguuuuuaauccugaugaucuugaggucauugaugccuccuccuaacccuguauggaugagaauagacacauucuccaccuaacaaggcugcagccaaggaagugugcucuggggcagucaguuucagugaaagcaagauggcagaggcaaugucaggagggaggucaggugcagccacacugaguuagguuacuaugugggacaauuuuuaaaguuuucuauugucuauucucauuauuuuggugucuuuaaaaaauuaaucuauuugaaaaugucuaguuuucaguucuuugguuguggaaaaguaaaacaacaaaaauuaaauuuuucuuauaaugaaacaagaugugacauauaaaguucauaacugguaagaagaugcauauuuuugauagacaaaaagugggaauuauuacucuuuccauguuuuauauucaaaaucuguauuucaaagcauaauauaauuguguugacuuguauuuccuacuaauguaaugucucuucuuucuuuuuaggaaauagucuaguaagcuuaaccuuucauuuauuuagucuucauggauuaauugaguacuuccauuuagauaugaugaaacuucguagauuuuuagguaagugauucuaacccauuaacaguaacaagauuuacauuuauacaagaaccuguuuaaguuuuaucucaguuauaucgguuagcuauugcucuauaacaaaccagccaaaauuaguggcuuaaaacaacacacaguuauuuagcucuugcaucuguggggcuguuaaaugcuucuuuuggucuggucugggugagcucauuugugcaccugcagacagcaacaggugggcugcauguugguuuuguagagaccucagcuaggauaccaggccugacccaucucggcucuacauagucuucuguuaaauuuaaaagaagcagaggaguuuggcaccauaauagauuuacauuaaaaacaaaaaagaauuauuuauuuuacaauuagccgagcugguucaaacaguaguggcagguuuccgagagagcugauauccccaggccgcuggagcccugggcucagaaucggcccaccuucacuucugcaugcagcaaguggccacagcaagucagaccagggaugcacuacaccuguuggugcaaaggcugcaaagucacagagccacagauacaggaaauuguggauacuugauuucauuuugcaauguuccuuacauuggccacagauugcugacaaagaugacacaauuucuguacuuuucuaaauuuuugaaggcuaaaacuuuaaaagagcagguauauugcaguuagguuucuucuuuuucugaccccuagaaucucuuugacgguaggcuuuaaagauuauuuggggccaggugugguggcucacaccuguaaucccagcacuuugggaggcugaggcggguggaucacgugaggccacgaguuggagaccagcuuggccaacauggcaaauaccccaucucuacuaaaaauacaaaaaaauuacccaggcaugguggcgcacgccuguaaucccagcugcucgggaggcugaggcacaagauaucaacucuagucuuccuucuuguaauaggcaccaguuucuccuaguugguucuaccugaggaaggaauucaugauuccugguaaagucuuuguccguccuuuagguggauaggagaacuucugagaaaguccucuccugcauuugcugcucugaguuugaaguccaaagcagcauauuuuggggucucauuuucugacccucauugugauauuucauauagugcccagaucaagagauagcuuaauuuguaauuuauuugguuauauacaauuuugcuuauauacagcaaaaagauuacaacuuaaugaagguucacauaaugauuagcauuuuauagcaauaaagucuuuuaaauuaagguguauacaucguuuuuuuuuaaagacauaaugcuauuguacacuuaauagacuauaguguaaacauagcuuuuguaugcacugggaaacccaaaauuuugacuugcuauauugcaauauucacuuuauuuuaguagucuggaacuuaacacuaaauaucucacugguaugucuauacuuaauagugagagaccaucacauugauuugauauccuuuuuaaaaucuuucaauuuuaaguagagagaaauuacaaauuauucaggaaguaauuuauuacuguaggaaaaugguaaaacuguggaacuauaaaauaaguuaagauguugcugguggggacauuuaauauuucauacaugcugggcaugguggcucacgccuguaaucccagcacuuugggaggcugaggcagguggaucacuugaggccaggaguucaaaaccauccuggccaacauggugaaaccccgucucuacuaaaaauacaaaaauuagucggguguggaggcaugugccuguaauccuaccuacucgggaggcugaggcaggagaauuacuugaacccaggaggcagaggugagauugagagagagagagugagccgagaucgcgccacuguacuccagccugggcaacagaaugagacucugucucaaaaauaauaauaauaauuaauauaaccauuuuugcuaaucugcaacugcuuuaucuagguaaacagaagccugugugacucuacagauacaauuuugcaguaaauucucaaguuuauaauuaauauagugugaguagccccaguagcuauacuggcaauuauaaagaugcauauccccacuuugcacauuguucauaugaauacuuggcuguuuaucccuucauccuguugccgcuaauguggaagccacuagaacagguuuaugagagaauuaagccuuaaagccauaaggaauccauuggcuucaauggauuaucuuuugugcagcauaucuggaauggcuuuggcucuauacuguccuugggagaauugagaaaauaauaacucagguguuuuuaguuaguuuguuuguuugagacagggucucacuauauugcuaaggcuggaaugcaguggcaugaucauggcucacugcaaccucaacuucccaagcuccagccagccucccaccucauccaggcugaggcaggagaaucacuugaaccugggagguggagguugcagugagccaagaucacgcuacugcacuccagccugggcagcagggcgagacuccaucucaaaaaaaaaaaagccucaauaccaagaauguacagccaaaugaagagcuagaaauauuaacucagacuucagacuucuacuuagaacucuggcaaaaaaaaaaaaaaaaacagauaaauuuauuacauagggcuuuugagaagcuuuuucuuuuggagagucuugcucugucaccuaggcuugagugcaguggcgugaucauggcucacugcacccucaaccucucggcucaugcgauccucccaccucagccucccgaguagcuaggaauauaggugugcaccaccacaccagacuacauuuuuauuuuuaguagggacaaggucuugcuaauggccuaggcuggucucaaacuccuggccucaagcaauccuccagccucagccucccaaagugcuggaauuacaggugugaggcagugcaccuggccuugagaaacuuuuuaauguguauuaauuauaaguaguaugccugaaauacuguacaguaguccgccuuuaucucugguuuugcuuucugugguuucaguuacccauggucaacuguagucugaaaauauuaaauggaaaauuccagaaguaaacaauucauaaguuuugaauugcacaccauugugagcagcgugaugaaaucucauugcauccugaaccguguugguuaucagaucagccauguugguaucacagugcuuguguucgucacccuuauuuuacuucauaauggccccaaagcacaagaguugugaugcuggcuuauuguuauaaucguucuauuuuauuuuaauuauuguuaauuucuuacugugacuaacuuauaaauugcgcauuaucguagguguguuuguauaggaaaaacauaguauaaauaggguuugguacuaucugugguuucaggcauccacugggggucuuggaacauaucccccaagaauaugaggggacuacuauacuaaaaauauaaauuauaaaacacauacggccgggcaugguggcucauaccuguaaucccagcauuuugggaggccgagguggguggaucaccugaggucaggaguuaaagaccagccuggccaacauggugaaaccccauugugacaaaaauacaaaaauuagccgagcaugauggcaggugccuguaaucccagcuacucggguggcugaggcgggaggaucacuugaacucaggaggugggcguugcacaguuagcugagaucaugcuguugcacuccagccugagugacagagcgagacuccaucucaaaaauaaccacauacaaaaauagcuuauuagguggggcauaguggcucacaccuguaaugcuagcacuuugggaggccaaggcagguggacuccuugagcccagggguuugaaaccagccugggcaacauggcaagauccugucuuuauaaaaaauacaaaaaaaugagccagacaugguggcaugcaccugugguuccaacuacuugggaggcugagguggcaggauuacuugagcccaggaggucagggcugcaaugagccaugaucaugucacugcacuccagccugggcaacgaagugagauccugucucaaaaaaacacuauuaaccaaggguacugaaaggcuauuuuaaaggaugggacggaagcaagugcagaauucugauggucugucccgcucacucggcgauuguguuuccccaucacagguaggcucgcuuuccuuugagaccacuggauuuguguguuaugcugcuagggcugucaaguagguugauggcagggggcacagcuccaccccgaagccuagucuguucguccaugauagcauagagagucaaauugauauugauucuuuugguauacaugugaguugugaggugauuaucaucugcccgaaucggcacgauuuuagccgauagcuacaugaaaaguaugaguggguaacucauaauuaucacaauuuuuguccuuguauauguugcucauauacaauaaaaucgggaucucuuucuuugaugcaguuaugauucaagaagauuaccacagucaaaauccuuaccauaacgcaguccacgcugcggauguuacucaggccaugcacuguuacuuaaaggaaccuaagguaagagguugacauugauuucaggugaaaaucauaagaaaauuccuuuugauuuacuuucacauacuucuccugaaguuacugcuuugacugaaaaucacagacuuccuucacaagaaugagaucuagcuggaucaaguuucugaaucuggcuguguuucagagugcaacagcuagagaauugg

SEQ ID NO: 13584 - RNA, 883 nt, Homo sapiens
aggacuaaaauguagcaguugugaaccuuuuccagauggagccacgaacaaccucuccagaucaaauucagaugagaguaauuucucugaaaaacugagggcauccacugucauguaccauccagaaggagaauccagcacgacgcccuuuuuuucuacuaauucuucucugaauuugccuguucuagaaguaggcagaacugaaaauaccaucuucucuucaacuacacuucccagaccuggggacccaggggcuccuccuuugccaccagaucuacaguuagaagaagaaggaacuugugcaaacucuagugagauguuucuucccuuaagaucacguacuguuucacgacaaugacacuuuauugccuuuuaauuuuuaaugaugacaaaaaauguuuuaaagaauaugacuuuuuauaaaauggcuguaaucauuuguuuacauuugaugcaugucuuuuaaaaugcaauguaagcauacuuuguaaauaggauuuuuagaauuaaaaaagcauacuucuaggauagcuaacuguaaaucauguugaucauguacuuuuuaguaauuucuuuuuuuccuuuuuaaggucuuucaguacuuuuuuaaauauuuucuauuuuaagacugauuuuaauagggaauauaucucuauuugagaauagacccuuacuaggaagaacguuuuuuccucagugcauuugugcuagaaauuuucaagagucuaauagucuuugccagucauucagcagcaaauuuucagcauuaagcuguuccuguucaguaauaaaaccggucacugaugggaaaacugccaauauagaaaaauaaaaaucucuuuuccacuccauugucguauaggcauguaaacagccucuuuuu

SEQ ID NO: 13585 - RNA, 2150 nt, Homo sapiens
uaggcaaaugcugcgugguuuuugaagagggucgacacuauaaaaucccacuccaggcucuggaguggagaaacucagagaccaaguccauugagagacugaggggaaagagaggagagaaagaaaaagagagugggaacaguaaagagaaaggaagacaaccuccagagaaagcccccggagacgucucucugcagagaggcggcagcacccggcucaccugcgaagcgccugggaagguagggagcgccuggacggaacacgccaccaacuuugcguugccugagcugccgcgaugugcgccgcggagccggcugccccugccuguguacguguguaugcaugugugugcgugcguguguguguguguaugcauguguguaugcguauguguguguguguaugcgcgcgugcgugcgugugugugugcgcgcguguucgcggacuauuccuuaagauuacaauaguagcugggauguggcaaaagcaaacuuagacggcugcucuucguuacccgugcugccaguugcuccuugcuggcuguguaaaggagcucccccacccccuucuauccuaacccccgagauaaggcagcaagggcagaaguggagagggaggaccaugaggcaguaguucucaauuuggaagaaaaugcugaaauauccggaagggagguagucagcgcgggugggaucuuaaaucuguggcucuucucuaggaucgggaaaauuaguuuugaggaucguuaggaagaggacgcagggaccguccuuucagagucuagaaagaagggucacuccuggccggugagcgcaugagcuuaggugcggagcccugcaggcgcccccuuuccccgcuccccaggcgcuucagcaccgcggacagcgcccauccgaaucacugaggccaaagcccagcacgucuaaggcagucccguaggaagaccccgugugcaccucccagcugagcgaacucuaaccaacucuuucuuucucucuuccccucucucauuccgcccuccgcccaccucugugccgcagcgagugccccuaacaugcggcugccgcugcuuguguccgcgggaguccugcugguggcucuccugcccugcccgccaugcagggcgcuccugagccgcgggccggucccgggagcucggcaggcgccgcagcacccucagcccuuggauuucuuccagccgccgccgcaguccgagcagccccagcagccgcaggcucggccgguccugcuccgcaugggagaggaguacuuccuccgccuggggaaccucaacaagagcccggccgcuccccuuucgcccgccuccucgcuccucgccggaggcagcggcagccgcccuucgccggaacaggcgaccgccaacuuuuuccgcguguugcugcagcagcugcugcugccucggcgcucgcucgacagccccgcggcucucgcggagcgcggcgcuaggaaugcccucggcggccaccaggaggcaccggagagagaaaggcgguccgaggagccucccaucucccuggaucucaccuuccaccuccuccgggaagucuuggaaauggccagggccgagcaguuagcacagcaagcucacagcaacaggaaacucauggagauuauugggaaauaaaacggugcguuuggccaaaaagaaucugcauuuagcacaaaaaaaauuuaaaaaaauacaguauucuguaccauagcgcugcucuuaugccauuuguuuauuuuuauauagcuugaaacauagagggagagagggagagagccuauaccccuuacuuagcaugcacaaaguguauucacgugcagcagcaacacaauguuauucguuuugucuacguuuaguuuccguuuccagguguuuauagugguguuuuaaagagaauguagaccugugagaaaacguuuuguuugaaaaagcagacagaagucacucaauuguuuuuguuguggucugagccaaagagaaugccauucucuuggguggguaagacuaaaucuguaagcucuuugaaacaacuuucucuuguaaacguuucaguaauaaaacaucuuuccaguccuuggucaguuugguuguguaagagaauguugaauacuuauauuuuuaauaaaaguugcaaagguaa

SEQ ID NO: 13586 - RNA, 1046 nt, Homo sapiens
uggucccguccaccauuucaggcaaacgcccccauagcuguaauaaacaugugauggguuuccugcaccaagaaaggaaaauuuuccuuaaaaauaacaaaaagagguggggaggggacucuaaguuccauuuaagauuuuccaaacucguugugucucaugcauacgcugaggcuuaacaugaaaauuuggagcgaaaguccccacgguucaccacagggaaugaaguaaaguaucucgccgguagcucuaggucucguaaaccguggagcuccuuuaguauaaggcccuauuaugugccacauuagaugagaagaaaauaagaggaaggauacgguagagccuuuagaaugggguucagucuuaggacucguaggauaaaggaaggucguuucccuccguuugaggcagggaaucaaacaaaacaccggcaccgcaggcaccgcagucgcacuccuggggccucguggcuuucccgcgcgcccgccuugggggcggggaagaacccggauggaaccacccuugcagcccggaccccccgccgucuuugaauggcagcggggcggaguugcccucccuucugugcucugacugguuuggcuccgcacucuccucuucgugauugggcuuuccuagugccagucacagagcgacgcuggucucccagauuguugcagaaggagacggcgucgacgucugacuggacucgcggcgacuuaccuuucagucgugcgcuccugauccggcgcucggaauuuguccccggcuucagggcugcggggccuggaaggaggcguaucgaggcggcucgaaaacgauccaggggagccgaggcgcuccucuugucaucccacucagcgccauguccuggauguucaagaggugaagggggcggaggggguggggcgcucggucuaacggccuggaggcguccccaaaugaaccugaccuuccccgcguuccucugcguucccugggcgauuugugcagcuguauucguucuguuggucgcauauguggccgccggagaaauaaaugcauugucu

SEQ ID NO: 13587 - RNA, 18898 nt, Homo sapiens
cuguuaauggcgggcaguagccgcugaggggauugcagauaaccgcuucccgcacggggaaagucuacccugccugccacuuucugcucgccgucagcgccggagcucgccagcaugucugugguaccgcccaaucgcucgcagaccggcuggccccggggggucacucaguucggcaacaaguacauccagcagacgaagccccucacccuggagcgcaccaucaaccuguaagugcggcgcggccuuggcgggcauuucucucgugaaagcuccuauagacucuccgacgcgcccccggcuuuucggcgcgcuucacgccucugcaccuccccgccuccaacucccgcuggcggaugcgcgccuuccucccucucucaggccccuuucucauccuccagccuccaggguuagaguccuuuucugaaaggaaggcuuguucccauccuauguauucggucauaauggggaaaaacggaguuugcuuuuaacucauccuuuccccaccucuccagagguaaccgacuucaaaauguguguuuuuuuaauccuuccagugaauuguuuaugcuuucgcaucacguacaugguauugcuuugugaguguugaugugauacgaaugguauaaccuaguaucauuuuugcagauuucacucugacaguaagguuucgagaucuagcuguaaugccuaggucuaguuuucuuccuuuuaggugccacuuaauacuucaguuuuugaauacaacacauuuuauucaugugcucagggcugucugcccugccccaugccuuaugccuucgcgucgucugaugucucaaugccggcaucccaggcaccacaaguaggccccuccuugggaguaaggaugcugcuaugguugggcuuucagacuggagggaaccagaauguuuguaccagaaaacccauugugggcuguguuuuauuuucaacaccuuucuguuucaacacuucaaaccauugcauuucaaggucauucucagaagcagacucgcuguagcagguaauuggcguuuggggugucuuaaucaagaaauugucaguaaugcuuuuuaaaaucguuucugaggauuuguuuucgaggcaacgcggugccuccauuuuaugccaggauggaggaaaguggccaguuuaugccagucaggguacaagugcaaggauuuggugguauugauguuuucguaaggcaguuuagguguuucucuguuucauauuaaaauaaacggacauugucuccccgucccccaaccaaaagugauuugaaguugaaaagaugguuaacauuguuuuauuuugcaaaacguguuggcuuggaaauuuagauaauggaaaugcuggguuuauaaaaucuggaauuaguugauaguuguguguauaaaaguucucaggaguggcggcucacgacuguacucccagcaccuugggaggcugaggugggaggaucacuugaggccaggaguuggagaucagucugggcaacauaggcugucucuacaaaaauuuuuuuaaaaauuaagaaaaaauccaucaaaugguaaaggcaaauguuauccuuuuuaaaagugugaaagcacagcuucuggauuacuuucggugguuauuagaacuaaaacccacagucuuuucuuguuuugucuugauuacugaauuaauuugcauccaaccauuuuguagaauuggcaaaauaguuagcuuucaguaagauauuuuaaucuucgcucuauuaaaauuauggguugauuuacaguacauuuccucuccuguguaaauacaaauauucagaaauaauaauuguguugugaacuuaaguucaccugaguuaacauuaaguugaaaacaaaugcccucucccccaguauauuuuauuuuaggaaauauugcaugaaugccuacuuuguaccaggcacugugcacaauacuggauauacaguggugaggaaguaagguguagccccugcuuuaugaagcucacaguaugaugagaacaauauguaugucugggcuggcacucugauuucacaggugaaaauucugacauuucaucuucacaucuccuuacugauauauuggagcuggcucuugcaacagagauguguaauggcuauccuuaauucuuucuaacucagguugucagaauuaaauguuaauauauguaaagcguuuuaaaaaauugcuuggcacgucguucuauguagcauaucugcugcugcuauggaugaugguuuuagauuuagcauuggaucuaccggggauguucuuuaaauuuuuaaagcauccuggaaugguauauuuuaauuauuuuagagcuuuuucauaugccuagaacuuggcuucuggaauuaaaguaauuuuuaaaguuuuggcaaccuugauuuuuuccccuuucaagaauggcugagugggguagauacaauaauguugacuauuaaugucaagggcuuuugguagaauagauaccuuggaugggcaaauguggccuaaauucguacucaaaggcuucuugcuguaaggcuuuaauuaagggcuuacaacauauaaguauggauuuuuuaacuaucuuuaaagaaaaauuugauccuuauuaggcaagaugaaaacugucuuuaacaguuugagccauauuuuaaauuauugguaaaggaagagaguuuucgauuagauaugguggguagaagauucagaugaggagaaggaaacaauaaggagacugaauagaauaaaugccaaaggcuaguaaauagguuuagaggacaaaaagagaaaguagaagaguugcugugaaaaggaaaggcuguggugcaagaaaaaucugaggauaguugacugagagaaauagaaaauaacuggagggauguugaugaaaaacgguggcuuaguuuuaggaaaaagaaauuagccauuagcacccauaauuaaaacuuucugauuagauuaguagucaguggaaugcagggggacauuaauuauuagccaaauugguaauguugaaauagcagccaugguauaaaaccagaggauuacuaauguucagauaaccauuucucuaagcauuuaaggauaguguuaucuacacuugaaaguuaaaguauggaggagcagcuugaucuaauggaagcucuggcuuuaagaguccagagagcaagauuccagucucugcuguuucauuaacuuuaguuaacuguacaaauccugugucugaguacaauauaugcacuuuuuuuguaccaugguuucuuuaugcuaaugucugucaugguaaauuacauucuucaguucucauguuagauguuugucuucggaucacagguacccucuuaccaauuauacuuuugguacaaaagagccccucuacgagaaggacagcucuguugcagccagauuucagcgcaugagggaagaauuugauaaaauuggaaugaggaggacuguagaagggguucugauuguacaugagcaccggcuaccccauguguuacugcugcagcugggaacaacuuucuucaaacuguaaguaguguuggaaauuaacagcaagacaguuuuuaguaggauugcuguuuaugcagcucuggaauacaauuuuagcccucggucauucauuucaacaaacacugcuguuaaugaugucuuuagaaagagaaaaucaugaguaauuuuucuccauugcagugcucauuuauuuuccuaacuaguaaucuguauguuucuguauguuguugauguuaaugauugagcuugguagaaaccccauggaauaguugaguccaagaucaaugucuagaugucauuguagcauuaccaagaacaauugauauuucuuucuugguaugauuagcauuuccuguucuuaagaugacuuagguuuuuguggauaacaguuuaguguuuuaucauuuaagcuccuacaucucucaaacauuugauccguaacuauuugacuagauuauaccaaaaagaaaagucuccaauacuuagaugacguucuugaaaaaguuucccauucuuuaggccuaaagaaugugauccauuccucucugagcauuucuagacuccauuaucaucagauagcucccagagaggagauugggauggacuggugguuagcaauuuuguuuauguuugugcuauguuauauauucuguuuguuuaaaacuaggguuuaugugauggguacauauggacauaaaguuggaaaaaauaaacacuguauacuccaaagguggggagggugagggggaggcgaggguugaaauacuuccuauuggauguuauguucacuguuucagugauggguucacuagaagccuaaaccuuagcauuacacaauauaccuauguaacaaacuuguacauguacccguugaaucuacaauaaaauaaaaauaaauauauacgaagaggaaaaaaaccuaggguuuguauacuguuagucuggggaauugacaugaauucaagcauauucucccccuucacuuugauacuuguuuugauugccuuauuaugcugaaauauguucuuagugacuugguagaaauaacaauuauuguguuauuuguuaucuccaaauuguauuaaguugaaagcugaaauucuuaacuuuuauacagaccugguggugaacuuaacccaggagaagaugaaguugaaggacuaaaacgcuuaaugacagagguauuuuucuguuuaaccacuuugaauaccaucaacuuacuaguuauuuggcuuuuaaugucuuguaaaaaggaugcuuauuuuggaauauuuaguuuucaauaaauacaacuuaaacuccagaagguuaguacaauguugauuuuuuuuuacaaguugaaguuacacuuauuucaauuuuuaaaauguuaaacugugucacagcaaugguaaauuaaaacugacauuuaaguauuacugugcuagacacuguucugagugcuuuacaugcgcuaauuccuuuaaucaccaccacaacuguaggaaguagauauuauuaaguuuaaauuacuucuuguuauauagcuaguguguuguagagccagagguuugaaugcagguaguuuuguucaagaguaggccucuauagaauuuugaaaagagaaagaugccuguguuuucacuuuuuucacauauuuuuuagacuuugcccaaauuauucuacuuuuuaaaaaucauuguaaugccugcauguaaagacuuggggccaaaugcauagauacugaggauuuugagauuguaaauuguuuucaauguuaguuuucuucuuuaacauucaauugccgccugccccuguuacaaagcucauauauucucugugcaaaaagcuuggcaaacacagaaaagcaaaggagaaacaaaacuaaagucacccguaauucucccacuuuugaccuauugguuugucuuucuaguauuucuaaaaauguauuauaacucuuaaacauuuuccugugcuuggacuuccauuuauauaauguaugguacaaagauauaaguccauuaagguugagggagugcaaaaugagagaaucacaaaagcaaaauuuuuggaaacuggaaaacagaugggcaaauuauaacuaacuuagcagaaaccuuaguccagcagacaggcaggcagaaucuagcauugcagaguaccagaaugacugaggaacugaaggugcuagguacuuaugaaagugggggcaugcaugggcugaaaacuggacugguucaaaguauauauggaguauauuuauacagguuguguauuccuuaucugagagcuugggaccagaaguguuuagcugcuauuugauagcacaacagggugacuauagucaauaaucacuuaauuguaaauuuaaaaauaacuaaaagaguauaauuggauuguuuguagcacaaaggauaaaugcuugaggggguggauaucccauucuccaugaugugaauauuacgcauugcaugccuguaucaaaacaucuuguguacucaaaaaaauuaaaaauuaaaaaagugguuaggauuugggauuuuuuucagguuuuggaauauuugcauuauacuuaccaguuaagcaucccauauacaaaacuugaaaugcuccaaugagcauuuccuuuuuuuuuuucuugagacgaagucucucucuugucacccaggcuggagugcaauggugcaaucuugucucacugucaccuccgccucccggguuuaagcgauucuccggccucagccucccgaguagaugggauuaaaggugccugccuccacgcccagcuaauuuuuguauuuuuaguagagacaggguuucaccauguugaccaggcuggucuagaacuccuaaccucaggugaucugccugucuuggccuuccaaagugcugggauuacaggcaugagccaccacgcccggccugagcauguccugugagcaucaugucagugcucaaaaaguuugagauuuuggaguuucagauugggauguucaaccuguguaucuagauugucuuccccacucuguaauuaggcaaagacuggcugaugauucucuguaguaauugaaucagagaacaacuagcaaugaaaaaaguuuaggggauggggagaauaagaguuccuauucugaauagucagacucuuggaccucuauuaggcugacagaauguuaacaauuaggcuuguuuuuuuuuuuuuuuguuuuuguuuuuuuuuuuuugaggcggaguuucacucuugucgcccaggcuggagugcaguggcgugaucuccaaugugagcaaugguugcucacugcaaccucugccuccuggguucaagcgauucuccugccucagccuccagaguagcugggauuacaggugcccacuaccaugcccagcuaauuuuuauauuuuuaguagagaugggguuucaccgugucggccagguuggucucgaacuccugaccucaggugaucugccugcuuuggccucccaaaguguugggauuacaggugugagccacugucagucuaggcuuacuuauuuuuuuuagagacagggucucacucuguuccucaggcuggaggaugguggugugaucauagcucacuguaaccacaaacuccugggcucaagcaaucuuccugccucagcuuccugaguagcuaggacugcagguaugugcccaugaugccuggcuaauuaaagaaaaguuuuuuauagagaugagaucgugcuauguugcccaggcuggucucaaacuccuggccugaagcaguccucccaaagcauugggauuacaugcaugagccaccaggcccagccaacaauuagauuuauauaucccaggcugaggguuggaauucuuguuucuggaaaaagugaccaguccaagaaaaacuucagauacugccauuugggagcugucuucgucuguuuaauguugcuauaacagaauaccugaggcuggguaauuuauaaagaaaaagauuuauuuggcucaccaguucugguggcaagauugggcagcuggugagggcuucauggugcuuccacucauggcagaaagcaaaaugggagugggcaugugcaaagagacauggcaagggaggaagcaagagugaauccaggaagccacacucuuuaacaacccucucuccagggaacuaauccauuccugauggaggaaggguauuaaacuauucaugaaggauccaccugcaugacucaaacaccuuccacuaggcccugccugccaacacugucacauuggggaucaaauuucaacaugaguuugggggcagggagacaaaccauauccaaaccaaagcaagaauuuucuauagaaauaauguaguccugggccaggcgcgguggcucacaccuguaaucccagcacuuggggaggccaaggcggguggaucaugaggucuggaguuugagaccagccugaccagcauggugaaaccccgucucuacaaacauaaacaaauuagcugggcgugguggcgggugccuguaaucccagcuacucgggaggcugaggcaggagaaucaguugaacccaggagguggagguugcagugagccaagaucaugccacugcacgccagccugggcaacagagcaagacuucgucucaaaaaaaaaaaagaaaaaaaaauauuguaguccuaucacucaugcacacagaggugacaauuaagcaucuuguugcuucucccuugugaguacacaaccaacuaucaccaggcuuuuggagaaaacuucuuaacaagaaaaagaucaaaagaagcaaaaggaccucaacagaagcagaaaauucaaccauugacaaaacuaugauuaauauucuuggugagaugagaggagauuuugcaccugugaaacagugcuauuaaaaagacauuuuagccaagaaaaaccucauggauauuaaaaaaauguuggaagaaaugaaaaauucaguaaagaguuaagagguucauucuaccagaaaauagaaugaaaagauaaaaagauagaauguagguaagaauagauaaaauuagugggucauucuagaaggaccaauauaaacuauagauaaauagaacagaguaaaaggaagaauuagcaaagcauaauuagagaaaauuucucaaaccucaaagggcaugaguuuugagauugagaagaccuacuggccuugccucuauagugaauguuuaaagauccacgcaaaggcauaucaucaugacguuuuagauccuacaaacgaaaauaaaaacaaaaagauguaaaagcuuccaaagugggagguggaggauugguaagcagagagguuaaaugcaaaacaucaaaaucagaaauugcauuaaacuacccagaaauaauucuggaagcuaagggaugguggaguguugucuuuguaauuuugagagaauauaaucucuguccuagaauuuucuaaucaaacuauaaaucaaguguguggguaaaaguuacuucuagacaugcagaguuucaaaaaguuacaucucuuguaccuuuucucaggaagcuacuagaggguguucacccccaaaauggaauaaaauaaggacuccagcugugaagcaggguugagacuaucaaguacagauuacagcaggaugauagaaaaacgugucuuaggcugggugugguggcucaugccugcaauuucagcacuuugggaggcugagaugggcagaucacgugagccuaggaguuugagaccacccuuggcaacauggugaaaaauuagccuggugcuguggcuugcaucuguagucccagcuacucgggaggcugggggcaggggaggcugaggugagagaagcgcuugaacccaugagguggagguugcagugaguggagaucgcgccauugcgcuccagccugggugacagaucuugucuugaaaaaaggaaaaacaugucuuagaaaagaugaaauuaauagaauaacugacaauugauauuugaauugggaagaaauuuaaguuaucauggagaaugugggaaaugaauuuagugauagcaaaggaaaugaaaguuauuaacuaaagaauaggacaguugaacaaguaaggagauacgguuugcuaaucauugcucuguugugacugaucuaccggaucauacuaacuuaaauacugaauauugacuuaaccaaauauugauaaugggaagaugguggaagaaaaaguguaacuaggaugugugauuuuaauaucuaaauucucauucauaguagaggguuauaggcuuuuaaaaaauguuuuuaaaaugaaaaucaagaggccaggcgcaguggcucacgccaguaaucccagcacuuugggaggccgaggcagguggaucacaaggucaaaagaucgagaccauccuggccaacauggugaaacccugucucuacuaaaaauacaaaaaagcugggugugguggcgggcaccuguggucccagcuacucgggaggcugaggcaggggagucgcuuggaccugggugguggagguugcagugagccaagauugcggcacugcacuccagccugggcaacagagcgagacucugucucaaaaaaauaaaauaaaauaaaaugaaaaucaagaaacugucauaaaagaauauuuuggcugggcaugguggcucacaccuguaaucccagugcuuuguggggcugaggccggaagauugcuugaggccaggaguuguagugagccaugauugcgucgcugugcuccagccugagugacagagcaagacccuaucucuuaaaaaauguaguuuugaggcccggugcaguggcucaugccuguaagcccagcacuuugggagagugaggugggcagaucaucugaggucaggaguucgagaccagccugaccaacagggugaaaccccaucucuacuaaaaagacaaaaaauuagcugggcaugguagcaugugccuguaaucccaccuacuccggaggcugagacaggagaaucacuugaaccugggagguggagguugcagugagccgauauugcgccauugcacuccagccugggcaaugagcaaaacuccgucucaaaaaaaaauuuuuuuuuugaaaaauaugacuuuacauugaagaaacgugauaaacaguaccucagcccauuagugauaagccauauugauauagcauguaccuuugauaugacgugaugagaauggcccuuuuaccucuguaguuuucuucccaaaagcucauaacuucaauuuaauugagggauguuuuacaaaauacuugaccaguauuccucaaagcuaucaagaucaucaaacacaaggaagguaugaaaagcugucacaauguagaggaaccucggaagaaaugaagauuaaguguaauaugguaucuuagaugggauccugggacugaaaaaugaaaaaggacauuagguuaaagacuauggauaucugaauaauauauggacuucaguuaauaaucuugucuugguauugguugauuaguuugacaaaugugcuuuacuagugugagauguuaacagucggggaaacugugugggguauaugagaagucucugaacaaguuuugcaaguuuucuguaaaucuaaaacuauccuaaaauaaaccguuuauuuaagaccaagaagaaugcuuuuaaaaauagaagaaaacaugaggggaaaaacaaccaagaguugaaaguuacagccagugggaaugggugaagcaggacagagaacugcaguuucucaccaugaacauuguagaacuauuuuuggccacuuaaaauauguagaguaugacuuugguuaaaauaaguuuaguguucugcuauacaaauuaauaaaaaugaaagcugaauuuugaacacaauuuuuauguugauacuagcuugccaguuuugaacuaauauuguaugucuugggcagagugacaucuauauuaacaaaucauagaaaaucuguauggaaggcauauuaucccuauguuucaauuaggagcacugcuaagaauuuucuguucacugaagaaggggauuugugaguacauauauuuaguuguuuacuggcuuauuucuuuuugacagauacugggucgucaggauggaguuuugcaagacugggucauugacgauugcauugguaacugguggagaccaaauuuugaaccuccucaggucaguguucaguuacauuugcugggcauuuuggaagcagaaagcucguuuaauucuagccacuuuaaaaaagauuaaaguagaauuugacuugaaauuuucuuuucuucccuccuuaauuuaaauuacaaaauuaagccaagcacuucuuauuuuaaaggaaaauguaaaacaaauacaaggccgggcgagguggcucaugccuguaaucccagcacuucaggaggccgaggcggguggaucaccuguugaggucaggaguuugagaccagccuggccaacauggugaaagcucgucucuacuaaaaaauguaaaaaucagcuggguuugaugguacaagccuguaaucccagcuacuccggaggcugaggcaggagaauugcuugaaccugggaggcagaaguugcagugaaccgagauugugccauugcacuccagccuggacaacagugagacuccuucucaaaaaauaaauaaauaaauagaacaaauacaaaagaagagagaaugguaaaagugaaugaauugcgcuacccgucgucugccuuuaacaguuagcacaucacaaccccucauuccaccgcuucauucuccuacccucaucuuggauuauuuugaaguguauccuagcuauucauuucaauuguaaauauuucagugugaaucauaaaaauaaggaucucuuuaaaaagauaacuauaguacuguuauuaucauacuaaaaauaaacaauuccauauuauugucaaauauauagucacuguucgcguauccugauuauuucuauuuucuuuuuauaauuuguuuggauuaggauagucucuaaagucucuuuuacacacuuggcaccuuuuuuuuuuccuuguguuuuauuuguuaaugaaaacaggcuaauguuuccauuucgauugcauuccccuguuguuguugaauauguagcuguuuccccugugugucuugcaaauugauaguuagaucuagaaauuguauucaggcucaguuaauuuggggagggguaacaaggcuugucauaggcgguauauaaucuauaccugcauaacaaauuaccucaaaauuuagcagccuuuaggccucugggaguugcuuagggugguucuggcuuaggcucugucaugaaguuacagucaaguugucagcugggacugcaucauaagguggaacugggguuaaaguaucugaucccgagcuuacacguguguguguuagcaaacuucuuaguuucaucugggcuguuagacuaaagcuuugcuucagguguugcuggcuguugucucaaggucucccucaguuccuugccaugagaacaucucuaaaaggacaacucucaggcagcuggcuuacccaaggcugugugauccaagagauagugagagacagagugcuagaggagugcccaaguaggaagccucagucugugauaaccuaaucuuggcaguggcauaccaucacuucugcugugugcuauuggucacacaagccaacccugguacgcuauaggagggacuacacaaagcagugaauaccaggagacaggaaucauugggggucaucuuaaggcagucuaucacaauugguauaguguacuuccaucaggaauuuaaaaauauuugguuguuucuuguuguaauguuagcagcucauugaugaucauuuccuggucuaugaauucauaaggguugugauccucauauaaaaagaaacuuauguauuacugaagugugugguuuguguagaaaaaaaaaauaugcugcuauuccuuuacuuaacauuuuucagaagaaugacuuaauuccuuagcauccucuaaagacuugacuuuauucaaaagagaggguaagaccaagacuuggguacaggcaguuugagaggugauuccaggaagcagcagaauacaggggagagagagaccagaagcagcagaaguaagacagggcauguuauugaucuuuuuacaccugugggcaacuggauuuguucuguuaaggaccaggaaccauguagggacuccuauaccccauuggauaaggguugcaugaacucccuugcauuuccauguugagucuugagugcuuguugagacaguggcagcaaacagggaacccucugauacuuuucaaacauagcugccccgaaaucagagguagcguaauguggggcacacacacacaaaaagcauguuucagugaccuuuaaagugucaguaugaccuuuuggauuuaaauaauuugaaauauuuuaauccaugauaaugagugaugauguuacugaugcucaaauauuccuauuuuugcuaaugguggaacuucuuaaaguuggauccugaauucuuuaggcaaauuaaaaagcccuaugacuuuauagcuccuuuacaugacaagauguuucaggucaagcauugcacaaaauaucaaccaagcaaaagaucguucuuuucucuugcuucugacucccuuguauggcagagggacaagaagauaggggcuguggaagcugaugcugguguucacuaccuaagaauugccaggaacacaucuuggcuuuaaggaagaacaauuucauauggaaacagugaaguuacuuguucaaagauacauaguacaguuauucuaaacuuuuuuuuggcuuccugaacaugccuugaucuaauuggaaaaugcuuaguagugaccccagugguuuuccagauaacuuuucugaauaucuucacucaucuccccuaccacuguccuaggacaguucucuucauucaguaaggccuagaguuggcccuggugguauuugacauaagguaaguguauugauuuauuuaggaagccuagaguauuaguuagaugucaguggaaaaggagcauaucaucuuccuaucucagucuuuuuguauaaaguacagucaacuuaaacauuaagaccagagaagaaaggcuuaaaaaaauaggaacauguagccuugagcagaagaaauuuggggaaaugcuacucauuuuguuugaucaugguuugggaacuuuuauuguaugugauccacagaucucuuagcuugugcuauucaggccacuuucucugugacuguuaauguaucugguuuucaugacaguuuaaggaaccuccaaagccugggacaauugccucaauucauuguacccuagggauggcucugauauauaauuauucuaacuggaauacugguuaggugccaaugaguaacacagugggaaauaacauaggcuuuuauaauuagauaagaguugaauagauacaguuaaaucuuggcuucacaacuuggcugaguaaucuugggaaagauacuuagccucucuuagcaugugauucuguguaaauugaggaugaugcuaauaccuccuuuuggcagcuucugcuuuuaucucacuuuccccuuauaucuguuuucagcaauuuuaaauuccccagcucucagauacaacuccaacagcaaaaguagauuucugaauguauuguggagagauuuauacaagaauuguauaacccuuagacuuuuuuuuuguucugugucagaauuuuuccuucccggguagcaacuucccucucuaauucucuucaucccuuuaaauucucuaaaauauacauauauauuauauauauauuuuuauauuuguuuccucgaguaauuuggcuuugcccaucuggcaaaacuucacuuagacugcucuucugguauuccugaagcaugcaccuuggcauacggggagguuugagguuggggcuggaaggaggagcaagaagcaucuugucaaaugccucacagcuuauauuugaauuuuuaauguaaacaggucuacaacaggauucuagacuguuuaacuuacugaucauauauauauauauauauauauauauauauauauauauauaauuuuuuuuuuuuuuugggagacagagucucacucuguugcccaggcuggagugcaguggcauagucucggcucacugcaagcucugccucccagguucacgccauucuccugccucagccucccgaguagcugggacuacaggcgcccgccaccacgccuggcuaauuuuuuguauuuuuaguagagacgggauuucacugugcuagccaggauggucuugaucuccugaccucaugauccgccugccuuggccucccaaagugcugcgauuacaggcgugagccacugugcccagccuauauauauauuuuuaaaaaaccagcuuuuaggcugggcaugguggcugaugccuguaaucccagcacuuugggaggccagagcagguggaucaccugaggucgggaguucaagacuagccuggagaaacccugccucuacuaaaaauacaaaauuagccaggcaugguggcgcaugccuguaaucucagcuacucaggaggcugaggcaggagaaucacuugaaccugggaggcagagguuguggugagccgagauugcgccauugcacuccagccuaggcaacaagagcaaaacucugucuuaaaaaacaaacaaacaaaaaaaagcuuuuauuaaagauacuaauuaaaaucggacuucauuauguuuuaaguaucucaagcuauaaauccugugacuacauauuuuaucucgaaugguugacugguuuacugcuuguuauuuuauaugcauuaaagcauuuauuuacuaguguaucuguuagauaaguccugguaaagaggacagaaaguaguaugcuucucccaacaguuuauacuauacuggggaguaaacauguaaagaaaugaagccauggaauacauauuaaaguuguauucauuuguaauuucaguauccauauauuccugcacauauuacaaagccuaaggaacauaagaaguuguuucugguucagcuucaagaaaaagguaaguuauuuuguuuucaaagguagccaucuaaaaauucuguagaauaauuucaaggauaccucuauuuguguuuucucaaaguuccuugaacuuuuggguuuguuguaaaacuaaagauguauaccaugcuuuuaguuucaaaucuguggcuaggaaaucuaccuugaaagacacaaccaaaauguauuaaugagaauuaucuuuuuucuuacacuuuuuauuaaauguaaaauugguaauuuaaaaaugaaauggaagcagugauuauauaauaacuuauaauaaugaauucuguuuuauuuuagccuuguuugcagucccuaaaaauuacaagcugguagcugcaccauuguuugaauuguaugacaaugcaccaggauauggacccaucauuucuagucucccucagcuguugagcagguacagaaaguugaacauuuuuugguucauccauauuaacugucaaauuuaaaauauucugagccacuugggaagguauaguucaugaauuuuggucuuuaaggaaacuaagaaaguagauagacucuuagaucaugugcaagccauagauuaauugugacuaauaccauccccagacucuuaaguuucggcaugacauucugguauuugugcaacugcucuucccuaauucugauauucucaagaguuaagguugaugucuuuauucaaaaaagagaugguuaaauagcagucaacaguguguaaauaugagcggaguugucuguauuaaaauguggcaaauuggcuggauguaguggcucaugccuguaaucccagcacuuugggaggcugaggcggggguguaucaccaggucaggaguucgagaccagucuggccaagauggugaaaccccaucucuacuaaaaauacaaaaauuagugaggcgugguggccagcgcuuuuaaucccagcuacuugggaggcugaggcagagaauugcuugaacccgggaggcagagguugcaaugaacugagaucacgcuacugcacuccagccugggcgacagagugagacuccaucuaaaaaaaagaaaaaaaagguggcaaaucgaauaucuugguguaauauauucguuuuccuuuuuugaaacuuacuauauuuuggcccaaauugaggcuugugggauuagguccugaacuuuuacgugggguuugaaucuuuaggcaguuagagugauaagaaaugcaguuuuuuaaaaguugacuuguacugguugaggucucuauuagagccagccauauauaggaauugcagaauaacauggugguuaugaaaguagauucugcagucaguguuuuggauuugaagcccaaccucaguacuugcuggcagugugaccuugaacaaacuauuauaccuauuugacuguuucuucuucuguaaauggggauaguagucucuacuucagaggauuaugaggaccaagugaaauaaugcauauaaaaugcuuacaacagugccaguaaucugguacauacuuaauaaauguuagugaaauuggccuuuugugaaagcuuauugaguaugaaauugcucuuucuacuucgucacuaaucaaaccuuaucuuuugccacuccacuuuggccuccugauagguuacaaguugaaaugcauauggggggaaaagagucauauuauuuauucaaacaccuacuugucaagugcaggaacugugcugaguagucagaguauaaggacauguagaaacuuuuccugccuuaaagaacuuauuaguggauaauuaaucaaauuuauagucuuaauuuuuuuuauuauaaguauucaacaaguguuuuuaguguguaagaugugaccagugagggaaaauugguguagaaaaugccaaacgugguaaaaaggcauucgaaggggaaaaaaagaaaaugccagacaugcuaagggagggcagaaacauccagauaaauuuauuuaucuaauauggaaaguaguauguacugucuuuaauaaagguauuguucuuuuuaaaauucagguucaauuuuauuuacaacugaauuccugcgcaguggagaaguaaaagaagccgcuugucucugugagcacagcuauauacaguguagaauaaaugugguagaaaaguuuuuuugguuuuaucucuuuugcgaucccuaaauugccaccuuucuauuguuugaauaguaaaauuaauaugaagaacuagauagugguguaaacaaaugugauaauguuuauuuacuuucgguucugcucauacuuuuuuguacaacauuaaagaaaauggacuuuuuuuauuuuaauuucucauuaaacuucuaaaauucuuaua

SEQ ID NO: 13588 - RNA, 13027 nt, Homo sapiens
agaaaacaucggagcaguguggguccgagcaaaccuguuucccagccccggcggaacaucguaggcugcaggauucagcauggguggaaagaggggaauggcccuguuacccaguggaaaggaaccguucuggaccaggugccuguaaauccuucuuuguaucuuauaaaauacgauggauuugacuguguuuauggacuagaacuuaauaaagaugaaagaguuucugcgcuugaaguccucccugauagaguugguaaguucuuuuuauaauuugugcauuauauacuuuaaaaaugauauugaacuggaugcuuuuuuuauuuuacauuauuaauacuucacuuuuauuggaacacaagcacccuucuugauaaacauuauauuaaaucaccgaaaaccacaaaaauggauccuaagcaguucaaggaacugugugagggauauagagauguguauuuuccccccaagaaguuugccacguaauaauuuauaauacgguuauuucuaacauuuuugcucacuguucucuggacucugauggguaagguuaucaguagcugaaauauccuauauguuaaucucaucucaucagauacaaaagauaagagaaugcugugccuuuagaaucuuucugugaaaguguaucuuuguguacaacguaaaugauaauuguacuuugagccaaaauuuaaacaaccaaaacguggucuuuauuauacacagagcuugauugaacaauguuuguggaaaugaauggcucuuuuuaaaugucauacagugccaguuuugcccugcaaguguuccuuaaggcauaaggucuaagguaaauaauaauuacugauuuuauuaguagggugggauacacccaaacuaauauuacuuuuuuuugaaguauuuauuuugaaauauuuucuuauuacagugaugcugcucuuguuuaaaauauugguuuauacuuuuagaauugucuuuauaagucuauaccauuaaauaauaaaguuucagcagaucuagacuugggagguaggaauuuugggaucaaauugucacaggaagaaauuaguucagucuccucgcuuuguuuuucuucagacugugccauugugucccugggauauaacgaguuuccuuaggaaguuaauucugccuuaguagcaaguuauuuuguuuuacucuucucuuuagauaucaaaugcuaaauccuugcucaucuguauaaauaugguucaguuuucaaagaaaucuuucuuuaaauuuaaaucuuuauuauuacuccuaaaaguaauauuaagucuuuguuauuuucaacauucucaucuauucuuaagugugacugaucaccugcucuuccucuugaugcacauccuacauuucuucuugaucauggcauuaauccauuucccauauaagaaacuuuaacauauuaaaaaucuuaacagcagaauuuuagucucugccccuucugagacgacagcuagcucacuugaagguuccugcauauugcugcaugaccugugguuguugguccuuuugucaucgaaggauagaaacuguacaaguaucucuggugaugggacuaaggguuccauguuguuuguaguuugguauuaucucuguuuccaacaauaguaauuuuguaaacauucaagcaauauaaaaagaaacccaagagcuuuucuguaaaucagcaauauauaugccuaauucagcuaauaguuguuauuaauuuuaguauucgugguauuagguuggugcaaaaguaauugcgguuuuugacauugaaauugaaaguaauggccaaaacagcaguuacuuuggcaucaaccuacuuuagucuaaaaaauuacuugcucuucacuuacguuuuacgucggaagcaauugcuucaggcaguacauuagaguauaauuaaaauuauguuuuucuuaagcuaaaguuagagaaaaaagucagucagccagaaugcaugugaugucacagagcagugguucccaaagcaaggccuggggacccuuggguucucugaagcccauucaggagauuugcaaggucagaaauauuuucauuuuguuaagcuguaauucgcgcuuuucacucucucuuuuucucaauuacacaguggaguuucccacuaucuauuuggaagauuugcauaacuuagugaacacaauauuuucuuuaugagcagugcaugguaccacaucaugcauuggugaaagagcuauucaaagugcaagacuaacuacuuuuuuuuuaauuguaaaaaaacauagcauaaaauuuacuguccuaaccauuuuuaaguguacaguucaguaguguguuaaguacauucgcauuguugaaacagaucuccagaacuacuucaucuuacaaaucugaaacucucuaccuauuaaacaaaacaaccuaccuuuccucccauucccagccccuggcaaccaccauucuacacucugucucuaugaauuugacuauucuagauaucucauagaaguggaaucacacaguauuuguuuugugaguaacuuauuucacuuagcauaauguccucaaaguugguucauguuguaacgugugacaggauuuccuuuaaggcugaaaagaacauuccauuguaucuauauaccacaguuuguuuaucuguucacccauuaauggacauuuggauugcuucuaccucuugguagaauguaaaauuguaccauguaaaauugugaauagugcuccuguaaacauggauaugcagauauuucuuugagauccugcuuucaguuguuuuggauauaggcacaggagugggauugcuggaucauaugguaauuauaauuuuaauuuuaguaucguaauucuaauuucuuagguagaacuaccauacuguuuuccacagcaguuguaccauuuuccaguccuaccuacaguauacaaggguuccaguucuccaucccuuagucagcaguugcuauuuacuguuuuugucauaguggucauccugaugggugugauacgauaccucauuuuguuuugauuugcauuucucugaugauuagugauauugagcaucuuuuuaugugcuuguuggccacuuguaaaucaucuuuggggaaauaucuacucacauccuuugaccauuuuuuaauuagguuauuuugauuuuuguugaguugugagaguucuuuauauguucuggagacaugaguuuuaauguaacaguaugacagauuuauuaaugguuucagauucugcauuguaacuaaccuuuaaggagcuaacuguugaauucugugguuucauauaaguauaucuagaauuaucugaaagacgauuagaauauucuuuucaguaucauaucuuugagaggcuggauuuuauaccugaacugaaagagcagaucauaacagauugagugcuaaagcagauaugagaaucuacuuguucuuuuuaaaaccuagacauuaggagauuugcaaaaauguaaaauuaagccacucuuaauguauuuugauaggaaauaguuauuuuuaauuuaaaaugcauugauauauagguauuuuuaaauaaauguuucuagauuuguuuuucauuuucugaaguaguaaauauugguaggcauuaucuauguaaacagaugcuuuuuuaggucuguaguaauuuccauuuauguuuuaauuuuuuuuuuagagacaggaucucgcuuugucacccaggcuggaguauaguggugugaucagggcucacugcugucucaacacguugagcucaaacaguccuccugccucagucuccugaguugcugggacuacaggcacucaccacaguacccugcuaauuuuuaacuuuuuguagagaugagaucucauuauguugcccaggcuggucucaaacuccuggccucaagcaauccuccugccuggggcucaaagugcuaggauuauagaugugagucgcugugcccagccaguaauuuuuaagaaugcacauggaguucugagaucuaagucugagaucuacuggcuuuaagaaacuagugggguuuuuuuacugucauacacggggggaauucuguguaauuuuuuauuauuacugcguacuuaaaaccagccauacauguuuaggguuugcugauaaaauuaaauagcaauacauguaucaagaaaaucucacuuuuuuguuucuuuugauguaacagaaauagaaguuuguugaaugaggaaaauaggagagcuaauuguuuguuguuguuguuuuuguuguuguuaagacagggccucacucccguagcccaggcuggagugcaguggcgccaucuugucucacugcagccucgaccucuggguuuaggugauucaccaccugagccuucucaguagcugggacuacaggccugcacugccacaccuggcuaauuuuuuguauuuuuaguagagacgggguuuugucauguugcccaggcuggccucaaacuucugggcucaagugauucgcccgccuuggacucccaaagugcuaggauuacaggcgugagccaccgugcuugucucuaauuguuuguuuguuuguuuguuuguuuuuuaaagauaauuguuuaaauuugguauaaagacaguuaucuaaaauuguggacuggagaagucuuaaaaccaaugggauccuucauaguuuuuccaguauuaaaaagaugaaggugauaauuuucaccacuuuugaaaaauauuaagggcuaggaccguuaaucuaucauuucagagaccugagcucccaaccacaugggguaucugauuaaaucauacaaauacugaccugcuaugaucuagguauaaaacaagaaagggaaggucucugcuuucauggggauguacaagcaacuaacaaguacacaaauaacauaaagugggauaacuuuagaucauggugaauguuauuaagagguaaaauuggguaaugugacugggauuuguggggcuaccuuguuggucaggagaacuccaaaaggaaccggccuucugaagguauggggaagagcuuaucaggcagaggagaguguguccuaaugggagaggaagaagagcagaguagagaacgcaugaacaacaaggaggaagaugggaaaccugagggcagaggcgugaaggcuuuuagggcuugggggcuauggugagcaguuugguuguuuuucaaauuauaaagggaaggcaugggaacauuuuagaucacacaaugugguaucagugacacaacgauuacuuugguugcagugaagaauaagauuguaggagcaagagaguaaaaaccuaugccuuaauaaaaaaauggaaauaagacugaaggaaaacaaacaccaauuucuuuaaaaaaaaaaaacaaaaaaaaaacccucugugccuugaauagcuuuucuaaguuuuaaauaaacguucugugguuauguaagaugcuaauacaggagaagcaaagugaaccguauacaggaacucuacuauuuuuccaguucuucuguaagucugaaauuaucucaaaauuuaacuguuaaguaaacaauaacaaacaguauuuuauaccuugaaugaacaauuaaaacuuuugauuuggguacagaaccaagagcagaugaguccagaaaaauaaaaaaucauauuuuuuucaauuaacugacuugggacaaaauacuucuauucuguugaauccaucucugagcuggggcccaguaguuugucuuugguuuuuguacuuuuuaaagcuuucccagauucugaugcuugcuaauacguugcauggacaaaauuucagguguagccuucuuuaguaaauucagucuucauagucgguaaucagcgaaacacuuugucaacuuuuuuuuuuuuuuuuuaauccccagcgacaucucgaaucagcgaugcacacuuggcagacacaaugauuggcaaagcaguggaacauauguuugagacagaggaugguucuaaagaugaguggaggggaauggucuuagcacgugcaccugucaugaacacaugguuuuacauuaccuaugagaaagacccugucuuguacauguaccaacucuuagaugauuacaaagaaggcgaccuucgcauuaugccugauuccaguaaguauauauuggcaacuuuuauaugugauaauuagaagggauuuggacuucaguacaagauauuugauuggcucuuuugcagauacauuuuuauuuuuggauauaugauucuuuuagucaugcacaaacacagccuuugaaauuuuucauccaguuguuauaaauguuagauaagaaaauauuugauagucaguucugcuuggcuucuguaauaagauacaaguuguuuuauaauuauuaacacuacuacauauuacuucuugcuuuuauuuaaaaacaugauggaauagggaucaguaaaauacguccccguguacccugcucagcuuuaacaguuaucucaucgccugucuaguuuuaucuguuaguccccccagugcaauuauuuugaaucuaaucccaagacauugauuauuucaucuguaaauacuugaacuucagagcagcgaucuucagccuuuuugucaccggggaccaguuucauggaagacaguuuucuguggauuggggguuggguguggauauggugguuuuggaggcauuagauucccauaaggaacacacaacuuagauucuucacaugcguaguucacaauaagguuugugcuccugugagaaucugaugccucugcugaucugacaggaggcagagcucagacggcagugcucucuuugccgcugcucaccuccugcugugcggcguggccccaggugucugggacuccugauuuagagaacaucaauuucagaaaacgauugacugcuaacuuuucaguagcaaguggaguacagagucaguguuuagacaggugauuuagcuauuuccacaacuagucuguucacacagguaagguagaagaggaugugaccugggcuaauuucauuaggccuagaaaaccuuuauugugguuuuuguuuuuggacagagucuugcucuguugcucaggcugggcuggaguguaaugguguggucuuggcucacugcaaccuccgccucccacgcucaagcgagucuucugccccagccucccaaguggcugggacugcaggcacccaccgccacaccugguuaauuuuuguuuguuuguuuguuuuguuuuauauuuuagagaugggguuucaccauguuggccaagguggucucaaacacuugagcucagguaguccaccagccuuggccucccacaaguguuaggauuacaggugugagccauuacgaccauguuaguccauauaguuaguccauuuaaaaugugcauuucuguacuuuuuaauauacgcacagauauguacaguccucaccacagucgauuuuagaacauugucaucaccucaaaagaaaacuuuguaucuguuagcugucaguccuuuauucuucgaacccccuggccuuaagcaaccaguaauacuugcuguguaaauuucccuguuguggacauucauaugaauggacuauauggugugagguccuuugugcuagcuucuuucccuuagcauauuuugagauuucauucacgcuguagcauauaucaguacuucauuccuuuuaauggccaaauacgauuccauuguauggauauacuacauuuugauuagccauucauccaguaaagcacaucugaguuguuuccccaccucuugguuauuaugaauaaugcugcuguaaacauuuuuguacaaguuucuguguggacauguuuuauuuccuuuggguauauaccuaggaguggaguugcugggucauaaugguaacucuauguuuaaucguuugggggaacugccaggcuaauuuuaaaaacggaaauaccacuuuacauuuccaacagcaguguaugagacuucugauuucuccacauucucaccaacuguuacuguuacuuugauucuggccauccuaguggaugugaagugguaucucauuguggcuuugauuugcauuucccugaugaguaaugauguuaagcaucuuucauaugcuuauuggcccccccccuuuuuuuuuuugagacagagucuugcucugucgcccaggcuggagugcauuggcgugaucucagcuuacugcagccuccgccuacuggguucaagccauucuccugccucagccuccccaguagcugggacuauaggcgcgugccaccaugucuucuaauuuuuguauuuuuaguggagaugggguuucaccauauuggccgggcuccucuugaacuccugaccucaaaggauccaccugccuuggccucccaaagggccgggauuacagacaugagccaccaugcccggccuauuggcccuuuuaauaucaucuguggugaaaugucuauucauauccccugccuauuuuuaaauugaauuaucugucuuucauuauugcauugugacaauuuuuuaaauacaagaccuuuaucagauauauguugcaaauguuuucuccuauuccaugggcuguuuuuacuuucuugaugaugaucuuugcacaaaaguuuuaaacucugaaguccgaguuauguuuucucuugcugaguaugcuuuuuguguccuaagaaucuuuugccaaaucugaggucauaaagauuuacccucguuuucuuauaagaguuuuauaauuauagcucuuacuuagagaucuuugaugcauuuucaaguuaauuuuuguuugugguucaaguuaaggguccaacuucauuuuuuuuugcuugugacugccuaucuaguuguccaagcaccauauuuugaaaagacuauucuuucccccauugaaugguuuuggcauccuuguugcgcgguggcucacaccuguaaucccaguacuuugggaggccaaggcggguggaucacgaggucaggaguucgagaccagccugggcagcacggggaaacccugucucuacuaaaaauuagccaggugugguggcaggcaccuguaaucccagcuacucgggaggcugaggcaggagaaucgcuugaaccugggaaguggauguugcagugagccaagaccgcaccauugcacuccagccugggcaacagagcgagacucugucucaaaaaaaaaaaaaaaaaaaaaaaaagaaaaucaguugaccacagauacguggguguguuucuggacucucaauucuguugcauuaguuuguaugucuguugcugugccagugcugcauugucuugauuacauugcuuugugguaaauuuugagaucaagaaguuugaguccugcuuuuuuuuuuccuccuuuuuuugagacagucgcacucuguugcucaggcuggaguauaguggcacgaucucggcucauugcaaccuccgccucccaaggaacugggauuacaggcauacgccaccacauugggcuaacuuucguauuuuuaguagagaugggguuuugccauauuggccaggcuggucucaaacuccuggggugaagugaucugcccaccucagucuuccaaagugcugggauuacagguguaagccacugcaccccggccccuccuuucuuuuucaggaguguuuugacuauucugggucccuugcaauuucauauaaauuuuagaaucaacuugucagaacaaagaagucaccugggauucugacagggacuauguugaauuuguagaucaguuuugaagaguauugcccucuuaacaauguuaacaagacuuuauaagucuucuaauccauggcuugaucucagcucacugcagccucugccucucagguuccagcgauucuccugccucagccucccggguagcugggguuacaggcacaugccaccucgccuagcucauuuuuguauuuuaguagagauggcguuucaccauguugaccaggcuggucucgaucuccugaccucaggugagccgccgcgccuggccacuuuuuauuuauuuauuuuuugagauggagucuugcucuguugccaggcuggugagcaguggcacgaucuuggcucacuacaaccuccaacucccagguucaggcaauucgucuaccucagccucccgaguagcugggauuacaggcacacgccaccacgcccaucuaauuuuuguauuuuuaguagagacagaguuucacuguguuggccaggauggucucgaucuccugaccuugugucucucaccuuggccucgcaaagugcugggauuaaaggcgugagccacugcguccggcuccacauuucuuuuauuaaauuuacuucuaaggauuuuauucuuuuugaugccauugugcauaugaauugaauuguuuucuuaauuucacuuuuggauaagcuuguuccuuuaaaaacuacucaguggccuuucuucaaacacaugaaucucuggccuuggacagauguaacugguaggcccucuccauacauuagccaugcgucagucaucuuuauuucuuuuuuuaaaaaaauucuuccuaugaauaaguuaguuaacauacuaauuuccucaucuggccuugaauuucuacuucuucaauacauauuuuuaaaauuuuugggcugggcaugguggcucacgccuguaaucccagcacuuugggaggccgaggcgggcggaucaccugaggucaggaguucgaggucagccuggucaauauggugaaaccccgucucuacuaaaaauaaaaaaauuagccaagugugguggagggcgccuguagucccagcuacucgggaggcugaagcagaagaaucacuugaacccgggaggcagaaguugcagcgagucgagauugcaccacugcacuccagccugggcgagaagagcaagacuccgucucaaaaagaaaaaaaaaauuguguacauuuguuauaaagggguaaugcaacuuacauacucaggaauuugucaugagaacauuucuuuaaaaagcauuucuccaaccuguaugaggugacuugaacauuuuuuuauagauaaauagagcaaguccuguuaaccuaaucauaggaaaugcaagggcgucugcaauucugcaucgcuuuuccuagccauuuuuugaucuucccucuccuuuaauucuccaaacuugugugugugugugugugcacgcgcuauggaagcuuauuaccuuuagaaacaguggugaugcucugaucuaaugauuucugaaaggguccuggucgcguacccgcucugaugguaaaacaggccucuacaugacucccuugguuagcugaguuacuauaaaauucacgugcgauuguguauuuguaauucuuuuguaaacgugccacaaaaauauggcaguaugaugauacugcuuaagggaagagaauuuuuaaagaaaagaguucagcuuauauuucuuuauuucuuuuaaaagaauugauuaugcucagauguuuuauuuuuauuucuugugacucuuaguaccagagaucacaguagcaguuuuuggauugucauucagugagagaauuuauuguaaccgaagaggcagacuacuauuaauacauguacauuauauggucuacaccaggauaccugugagaguaaaaugacauuacuaccaauugugccaggauaacauggacugucuuauguagcuggauccucugguugcccuaccugaaggccaccugcuacuacgaggaaaagagcuucgaguuuuucagaacccaugcagaguuucuuaaaauagaauuauaauugccuagcaaacccccucucuuuuuuuucuuuuacuuuguuuuuuuguuguugguggugaugguuugcuguuucuguguguuuucuuagaggcuagaggcaguacauuaaucuuggggaccuuuuaaacaguacagaugccugugccauccucagagauucccuuguaguuguccugggcugaaguucauucagcaccaauuuuuaaagcauggaaagcuuaaauuuuggaacugaguuaggaagaugaugugaaaugcagugaaguugagggggaagaagcuuuaaggauucacagaguaaaaccaaugguacuuaggcauuuuaaaugugugccauauucucaguaaucccuguaggaauugucugcuuucaaauuauauuucaaagccacucaaacuuauuuucauuuaagugcagcuacagauuaaacaugggccaaagaaauuuuugguuaugauuuucaaaauuguucauauaucuagauggaggucggcaaacuaugaaaaaaaguuuuauuauuggaacacagccacaucuguuuauauacauaucaucaguggcugcuuuugugcuacaguggcagaguucagcaguugggacagagaccauaugacccuaagccugaaauauuuacugucuugucuuuuacgaaaacguuugcugacuccuggucuagauaaucaugaauucaggcuauuaaaauuuuuuuuaaguuaugaaaauaaauaugugaguugauuuauaucuaaaaauugacuuagaaauuuucucucucucucuuuuuuuuuuuuuuuuuuuuuuuaauauagaugauucaccuccagcagaaagggaaccaggagaaguuguggacagccugguaggcaaacaaguggaauaugccaaagaagauggcucgaaaaggacuggcauggucauucaucaaguagaagccaagcccuccgucuauuucaucaaguuugaugaugauuuccauauuuaugucuacgauuuggugaaaacauccuagaugucaucacaaacucugccaaauuuguggaacuaugaaauguauuauuuguagacauaaagacuugauugcuuuccaguuuaaugaaagcuuaaaugucccugcgaacccacaaucucugccagcagaacugguuuuguucugaauaguacagauugaugugaacacaaagcauuuuguguaaggagaaccccuuucuuuuaaaagaagucugucuauuucgaggggaguuacaggcaaguu

SEQ ID NO: 13589 - RNA, 1982 nt, Homo sapiens
auuuuuuuuuuuugaaguaaaggguggacuuuauuguuuauuuauaggaugcugcaagauaagaaauuccacacagaaauaagaaacccauucagaggacaagcuuccuacaguauguacaguuggaacuguucaaguauaguuucaguguaaaaagugcuacaauaaccaaccacauuuaaaaagaguucuuaguagagaaacaguaagacaaaauaccaaauauaguacacaacaaauacauaccucagcuacaugaucuaaaaguuaaacguuccaggagucccauucugaacuuggaagguacagccuucagaguuaguuucuggcacagcauuuugaucuuccucuuccucuaccaagaaauucuucucaauuaagcuuaacaaagccuuauacacagacucauuuucaugguuuuguagagccucaauuuugucuaagccuccacauucuucaaucauuauacuaaguuucucaguuucaccuaguuucucagcagccugaaagauguucgaaauggcauccaggauaaccagaauaaccuugguaucuuuugaaguuaagagauucaucaaugguuuuauuaggccacaaugaaugagguauacagccuguucaacuguuccaccacugguauaguuggucauggccccauacagcuuccuuuugugucuuuaaaaucugccuuagagagaacauugugaggaacgggacuaauccaugauucacaacuugcuguaucucauccugagggucagcugugauguuugacauuguccauguaccuuccuucugaaaguuaguuuuggaguugaugagcagguugggaaagacagcaagagcuccugcaucgaucacaaccugagucucuucaucuguaccagugacaauauucccuaugggucuuagugcaggagucacaguuggcaauucagaagcuccuagaagcuucacaaguuggggcaaaacuccuauuuucaagaacaugucaguucguuuauuuggaccaucaguaagguaggaaauagcccaacagcuaucugcuaauacuucuggaucaucaugaugcaggagccaaacuaagguagaaagaauuugcucaacagcaucuaacuggggugcaggauucuuguagcagcagaggauugaaaguguccagguaagaugacauaaguaaccacauacuaaagaugacauaucgggaacugcaagaagagccaagagugggucaacugcaccauacuuaauaaccaagucucggaaaacuaaaccaucaccugcaauguuuccuagagcccauacagcuuguucacugaugugagcauggggagaugcuaacagagaaaugaaugcugggauggcaccuccaucuaccacagccuugguuuauucugaugucccagaagcaauguuagcgagugcccaagcagauucaaacugaaugggacuacaaucaguucugcccaagaaggacacaaauuuuggaaucaaaccagcccagauuauguugccuauggggggcuguuuuucucuagaaaguaguuucauggcagcuugaguagcuuggagcugacuuuccauauuguugcuauuugugccuuugacaaugucaucaacagaccaauuuacagugcccugguuuuugcgguuuuucuccagcggagaagcagcaacaucaggaaaugagcuugcauuucuccucuucagcaucuggucauuccucuuagcuuuccucagcuucacauugacuucuauucugcgacaccucauuucuguacugucuuuucacuuguucuugaaucuguuaagucgggcaacugguauauuagcauucucguugguagacaugguugugagacaaagggaggaaagcugcaaagcaggcccaggguucuacaggaagcgacgcagggaucggcggcuguggggcggcuacgcucaaagcguccacuucgacucagcucaaagaaguguugucc

SEQ ID NO: 13590 - RNA, 1982 nt, Homo sapiens
ggacaacacuucuuugagcugagucgaaguggacgcuuugagcguagccgccccacagccgccgaucccugcgucgcuuccuguagaacccugggccugcuuugcagcuuuccucccuuugucucacaaccaugucuaccaacgagaaugcuaauauaccaguugcccgacuuaacagauucaagaacaagugaaaagacaguacagaaaugaggugucgcagaauagaagucaaugugaagcugaggaaagcuaagaggaaugaccagaugcugaagaggagaaaugcaagcucauuuccugauguugcugcuucuccgcuggagaaaaaccgcaaaaaccagggcacuguaaauuggucuguugaugacauugucaaaggcacaaauagcaacaauauggaaagucagcuccaagcuacucaagcugccaugaaacuacuuucuagagaaaaacagccccccauaggcaacauaaucugggcugguuugauuccaaaauuuguguccuucuugggcagaacugauuguagucccauucaguuugaaucugcuugggcacucgcuaacauugcuucugggacaucagaauaaaccaaggcugugguagauggaggugccaucccagcauucauuucucuguuagcaucuccccaugcucacaucagugaacaagcuguaugggcucuaggaaacauugcaggugaugguuuaguuuuccgagacuugguuauuaaguauggugcaguugacccacucuuggcucuucuugcaguucccgauaugucaucuuuaguaugugguuacuuaugucaucuuaccuggacacuuucaauccucugcugcuacaagaauccugcaccccaguuagaugcuguugagcaaauucuuucuaccuuaguuuggcuccugcaucaugaugauccagaaguauuagcagauagcuguugggcuauuuccuaccuuacugaugguccaaauaaacgaacugacauguucuugaaaauaggaguuuugccccaacuugugaagcuucuaggagcuucugaauugccaacugugacuccugcacuaagacccauagggaauauugucacugguacagaugaagagacucagguugugaucgaugcaggagcucuugcugucuuucccaaccugcucaucaacuccaaaacuaacuuucagaaggaagguacauggacaaugucaaacaucacagcugacccucaggaugagauacagcaaguugugaaucauggauuagucccguuccucacaauguucucucuaaggcagauuuuaaagacacaaaaggaagcuguauggggccaugaccaacuauaccagugguggaacaguugaacaggcuguauaccucauucauuguggccuaauaaaaccauugaugaaucucuuaacuucaaaagauaccaagguuauucugguuauccuggaugccauuucgaacaucuuucaggcugcugagaaacuaggugaaacugagaaacuuaguauaaugauugaagaauguggaggcuuagacaaaauugaggcucuacaaaaccaugaaaaugagucuguguauaaggcuuuguuaagcuuaauugagaagaauuucuugguagaggaagaggaagaucaaaaugcugugccagaaacuaacucugaaggcuguaccuuccaaguucagaaugggacuccuggaacguuuaacuuuuagaucauguagcugagguauguauuuguuguguacuauauuugguauuuugucuuacuguuucucuacuaagaacucuuuuuaaaugugguugguuauuguagcacuuuuuacacugaaacuauacuugaacaguuccaacuguacauacuguaggaagcuuguccucugaauggguuucuuauuucuguguggaauuucuuaucuugcagcauccuauaaauaaacaauaaaguccacccuuuacuucaaaaaaaaaaaau

SEQ ID NO: 13591 - RNA, 2379 nt, Homo sapiens
gcacguaaacaagcuaauauuaagaauuuauguuuuuaaaaaaguucaagguuaauaugccauucaguucaauugccuaugccguauauaguauuuaaaaauuuuucauaaugcugaucuugaaacacuauagcacuugaaacagcuucugacucaguaagacuaaguuacuuguaucauuguuuuguagguauuugaauucugugaaaaccuaugcaugcaauaaauuuuucaccgcaaauacagcuaucugcuagaagugccaugagaacaaggcccauauuugucuugucacaccuauauucucagugcuagcauaguaccuaaugggugcuuaauaguuauuaaaugaauaaacuaugauuagguuaaucaggacauccagucucucaaacauuaugaaugaacuuggaucuagcucauucacucucgaaauauuuauuugguaccuacaugugaagauuccuguguuuauuagagagcaauguguaacauuugccuuugcaguacuagcuuuuugaaaauaccugaagaugagggaucauguuuuacuuuaccagacaccagcccucugcuaggugcaauuaaguggcauaugaucaccuaugcacacgauuaucugaaauacuccucuccacauugcuuucuuugagccugcagacagaucuauacuagacuuuauuuacacucaucuauuauuucuggguucuaaugcgggcuaaaauauuuauuaggagacacuggguaaguuacuuaaaccuuuccuacaguuucaugguaucaugggacuaugauaccuacuuguggguuguuuuaaggauuaaauaagguauaaagugcauaguaaaguaucaguauguucauucucuuucuucucucccuuauacuguaauuaucuguuuaucugcuaauuucccucaccagauugugugguccagacaggcaguuuucuaugccuuauucaucuuuauaaccccaacaagcacaauggcugucuuaaaauuaguaaauauuugcugaguaaaugaagaccuaagagagugaaaaagguuguauuacccguuuauuuguuaaucuaacugccacacaucccuuaaaagaaaucaaguacagcuuuuguuagggaagcuuaaaauucauggcaaugauaccauacacaguuaaucauuagcuuuggaaagucuguugagcagaaagcggugcacaaaggaaguagggcugcuucccacaauagcuuaauauguuuucagugaugaacguuuuuggaaugcugggcacacccgacuuccaaauacgcaagcacauuccaaauggaaauuucaauuacuguuuuucuuuuuuucugccguaacaguuaucacagcauuuuaaugaaggucagacuuaaauacugacaagcagggaaaccaauaauuaccagauugcuucauucauuuuguggacagcauuauaaacuuuucaggcauucuaagauugccugacaaaauuagaaaaaauuguuaaguccccacaaccugcuugagaugcucacaaguguuccaucccaaaguacacguuugccucuucuuauugguauuuagguucuggcaucugauuccccuuucuucuucuauuuauauuagccuucaggugggaacuauggaaaacccaccugguggggguguauuuuucuuaagagauuguguuauaugguaucauauuuagaaaauaaagaaauuauuuucauaauagcaacgcuaaucacaggaaaaacuugauacauucuugacuagacuuuaggggaaaguacaaguucuuagugggcggaggggggcaaagacgaagcaauuuggcuccaaaaauucuagaaucucguggcauauuuuuaucaaauucaagcuuaucuuuaaaaaaauccgagaauuuuucuaauuucuaagaauugauucuaacccgcgauacucccuagaugggagcgcagugcuuuaaauaauagcauuuaaauaagcggcugcugauuugaaguccaccuggggaguccgaguucuaggaccgguccuuggcccugccacacgccaauacaaccaucaaagucaaaaucccuuaacucaaauuuaaauacauuccuaaagcagaaagcaucccgauaggaaaauccuacagcucacagcaagcagcagggaaacauuuaucucuggcggcacugauuuaagcuuaaaagauuugguaucguuuaaaaaaaaaaaaaagcuggguggggccgaggagaauccacccaaacuuuccucaggaaguaggauguuuacugaguaaauaugcgguagucacagaaacaccugcuacuccuuuaagaccucaggagccaccaccgccaccuccuggccacauccgggcacuucu

SEQ ID NO: 13592 - RNA, 20289 nt, Homo sapiens
ggcggguaagggcggggaggcugggguguggaaaguguggcggccccgccccgucucuuggaacugccgcggccgccaccgccgcugccggcgccgcugcuguaggggaccagcgcgggugcgcagacgaaaggcgcucuuugccagcugaaaggugaagaccuggggaaaagcugguggggaaaagcugguggggauggggccagagugaggcagggccggggaaggcgcccagaacugagcgcugaccgagagaaagaaggagaauggaugggggaacagaggcgagcgcgggacccgccggggcucaggcccuaguggggccgggccgggccgagcugagcccuggaugccggcagaacagggggcgccugugcggccgcggcggcgacguugaaggguggagggcggggugcgcgccagcuagcagagggccgggugcugcuggccagguucuguuaccccgcauccuucgcggggaccugcggccugggcugggucccccgcaguaggguucggggcggcggccgagggcugggcggcgggggaaggucgccggcuucugcgguggggcgaugggggccgcaaccugcuguuuccagcacggaggagcgcccagggcggguguccccacccucagcgagcuccucugcgacuucucaucccaccuccccaagcaguagcuggaaaaguuuguagaggccagaguuagaaaguggccacuagucuaggguggguguuccuuacaugcagaaauaacgggcccaugaugcuuggcacauaacuuguccgaaaugagacguuucccugccuacauacccguuguuaaaaagcaaacacaaacuuuuuguguaguucccacggaaaaacuaccaucuccccugcccaccauggcagacgaaauugauuucacuacuggagaugccggggcuuccagcacuuacccuaugcagugcucggccuugcgcaaaaacggcuucguggugcucaaaggacgaccaugcaaaauaguggagaugucaacuuccaaaacuggaaagcauggucaugccaagguaaguacccuugcagaucaggcuuuggcuucggcguugggacuuugaucauuuguauuccguuacagaucaugagauuucuauacuuaaaauuuuguaauaagcacuauuuuuuccuucccacaauuacuggguaaucaguuauuacguugaauacuuaaagguagcauucccuucuugggcccuuacaauguucauuaacugggaacugaaacuuuccugaauccuagugaccuauaagaucuauuuaguuuacagaugagaaaaccuguucuagcaauucuaagaaaucuacacuuuauuuuucuuguguaaucucauaauugaaucacuggucuauauugggucuugacaugucgugauacuguuuaguuguuuacugccucuuaauuguaagaccacuacauuuuuuuuuaaguaaaauuagaugaccuuggaaggaggagaaaaagaaucuguuguaaucagcauugguauugugcucuuguguguguaaugagugauauacuuggcagagauuaaacagguuuccuguucuccucuguuagguucaccuuguuggaauugauauuuucacgggcaaaaaauaugaagauauuuguccuucuacucacaacauggauguuccaaauauuaagagaaaugauuaucaaguaagcacugauuuucuuuagaauguugcuuguuucuucaaggugcaaauacuuuguacuaucaguaauaauuugacaaaacccaagaguaguuuuguagguuuuucuaaccaauuauuaggcaccagcuaucuuagaaauuggagaaauagugauguuuaacacauguacuuuucuaggauuauugcuaguuugcuauuuuuuucacauucuugcauuuuuuaaaaagucaaauacuuauuaguguucucaggccaagugacugcauauugcaauuaaguccaauguuuaguaaaaguacuauucucucuguuguaaaauauuucuuguucuaauuuaaaacaucccuccuggauguuuuguuucuuuucacugaucagaccugagacauucaagaaacuacugaaauucauguuccuaccaaguuuuugcauuaaugaauguuagucagaacuugacauucuuaaguagagaaauaaguugaaagccauaaauauaaaggauaaaguaccuggucacugaguauggugaagaaaacacaaaaacuauauaauugguuaaauuauacuuagugaccaugcuaugaccuuuugcuaaauuauguauguaaauuucaaguuuuaguuccaguuauacauuuggguaggucauauuuaaugauagcauuuuguuguuugaaguauugaugauaacaaaauaauugaccuuauaggauguggaagcucagauuacuuauaacuaaagcuuuucuugaaagucuucaauuucuguaucaagcauaccauauaucaaacucauuucugcucauuuuacauagugaaaaauacaaaguugacacugguauuuguuuuauccgacuuaaacugauuuuuuucuguacccuuuguuguauuguauaaauuucuuuuaauguugcuaucaacugcacuuacgcaaugauuuccuuuugcuguuuguccacaugcaaacauacuuuuuugugguuuuaaucuaguaaacacuuuuauauuuucacuuuccuacuugucauaaauguuuucuagguugcuuugaagucuuuguagaaauuugaauugucuugcaaguggguuuuuuuaaccagguagaucuggguuuggaucuaguucugucacuuucuaguuggaugauuuuggacaaguuauacaccuuucugagccuguuuucucaucuacaaaauagugauaauaggaggauuaaaugagaaaauguaccccauuaagaacuccauaaguagauacguaccaaaaagugcuguucuguuucccccuuuuccuauguaaaaauucuacuuaaucauuucauuauuguuggagcaccaacuuugaugugguacauaguaggugcucgaaaaauauuuguuaaauguauaugugauuacugaaugugguagagauaguacagcaggcuaaaguugagcguagaauguugucaaaauuggguuucucuuuucgucuuaaaguaugaaagcuuugacuauucaauauuaauuauauucaguaauauucauucaauauagaaugcuuuugccuguugcauguuucagaaagaugguaucagcaguucagauaauuacuauuauacuaugauaagguuagccagucauugauuggagcucaagacuuaaaggaaaaauuugguuuggguccuagacuaggaugaggcaaaugaagugagggaggcucuugccucaggcacaaaauuuuaaauaaagacagaacuaguaacaaugacaagccauauaggagcucaaggcgcaaagaaaauuaauucugaucccaucuuuauuuagaauuuugguauuuuaucauaggauuuuugcauuaauucuaauuuuuuaaaauauugcauuaaaaugccuaucugaucacugagguuuuuuuggugccuucuuuaauuuugcacccaagacaagugucuuacuucacccuugucccaacccuugguauguacuccgcacugcaaaguggauaagaggaugauuuaagccaggcaggccugguccuagucuuacuuuggcacuuaauagcugugugaccuugguugacaaguuacuuaaccuguuuugcuuccauuucuuucuuuauaaagcagagacauaaauaauaacgccucaugggaucauuuugagguuuaauuaguuaauacaacaacgccuggcauagaaaguauucaguauuucucugcucuucauuuucaagucagcauagaaaaauaacuuauuucuguuaauuguuuaaaaaacuaguucuccaaccugggcaauguggugagacgccaucuuuacaaaauacagaaaaaaaaaaauuagcgaggcauggugguguacacagcuguagucccagcagacccagaggcugaggugggaggaucacuugagccuugggaggucaaggcugcacuaagcugugaucacuccacugcacucuagccugggcgacagagugggacccugucucaaaaacaaaaguucugugggccuuucuauuuauauuuauugugcuaugguggucuucacuuaccuaaccaagugccuugauuaaauaucuacucauuauuuggcguguguaauccuuuauguuugcugaauucaauauuuugagugccaguucggcaguuggcuaaagagaaauauguauucuguucauuaugauaauuaaaaaguaaacaggaaacaaaacguauuaauauuuauaguuuuaauuuuauguguuuuaaaauaaguucagaaugaaagaaaaauugucuccuaacuucucuuucaagauuagcuuggauuagaauugcucauuuacauuacuucucccaaaaguaguuauagauguccgggacugagugauguugaaaauuauaaaugcauccagauagaccuuugggaauccccaaauucauacagaaaugcuuauucagacuuuagcacucucuggaaucauauuucuuuagaaaguucuguguugauaugaacuucaccacaaguuaaaugccguuucugcauuuacuacaguuuuaccugucauuugaaaaccauuuuccagaaggaagacuaauuacuauagacacauaaaguauauauuguagaccuuuggauuauuagugaauugccaaaacugugacuauuaaauucuaguauauucuucaaauaaguaguauauuauuugaauguuuagauauguuaauugaauucaaauaaguaguauaucauuugaaugcugagauauguuaauugaauucaaauaaguaguauauuauuugaauguuuagauauguucauugaauuccuugagcuuaaagucuuuuuauaauuuuuaccuguuucaugggaauccuuguguucucagauggaagcagucuuucuuuggaaauagaaaaccucuaaagcaauagggcccaauguugcgaggacuagaagcaaauauuuguuacaggaucauuaaggguaaucaugagaagagccacuaacuuuaguuccuagaccuguguauucuaccuauaggaaaaauagcaucauauauugaaauauauuguaaccugcaaaaaacagcacuccaggccaacaaaguaccauucagcaggugccauauuugagucuucacuaggcugauccacagaggcaagcuguuuuggaaugauaggguacgugagccagcgaauuaucuggguguugcacugccuuguuacuuugccuguaaaauuaguuuucuagucagaagugaugcagugugagauacuaugacaggaacgaggcauucuguaaauugagaugagauuuuagcagaagcacugcaggcaagaaaggcaaauccauaugcagaguaaaacuauugcaauaagaaaaaauugcugccuguuucaugauggaagggguacagucagguggccagcuguucugggaaacauauuaagacuucuuguucuucuguucuguguucuucuucugccauaucaagacugaccuguuucugugagguuuucaguaguggcuguagucagaucagucuuggugagagaaagcccgugucauugaucccacugagcaaagaugagagaagcuacaaaaagaagcugaggccgggcacaguggcucacaccuguaaucccagcacuuugggaggccaaggcgggcagaucacgaggucaagagaucgagaccauccuggccaacauggugaaaccccgucucuaauaaauacauaaauuagucaggcgugguggugcaugccuguaaucccagcuacucaggaggcuaaggcaggagaaucacuugaaccugggaggcggagguugcagugagcuaagaucccgccauugcacuccagccugggcaacagagcaagacuccaucucaaaaaaaaaaaaaaaaaaaggaaggcuucuguacaucucuacaaaaaauacaaaaauuagccgggugugguggcaggcaccuguaaccccagcuacuugggaggcugaggcaggagaaucgauugaaccugggagguggaaguugcagugagccaagaucacaccacugcacuguagccuggugacagagcaagacucggucucaaaaaaaaaaaaaaaaaaaaaaaaggcugaauggcauucacacauuagcucauaaucagugcaaauccacacuucugguucugucuucuuucagguccagugcuugaaguucuucccaaacccacuuucagguugaccccugaauggugucaucauauaaugcauaaccaucuagaaaccauugugaauauuuuccuuucucagucagcuggucauaggcaacuguccaucuagucauugguaucaguugaaggagaagugucagugugguaagacaaaguguuuucugagucugagccacuucuuauacaacuuguuuguaccuuuagguccuucucaagcugaucucauauaugcuacuuccacucaaugauggagagcugcugugcguucccaguuguguggcuugaugggucagaugaugggucagguuauggugguguuauuugcuuaggcuguacaauaauagugauaaagcauucagucucucagaucacuguauaauaauagugaucaagcauucagggaccagcaacucuaaggaaguagcacaagagugcuacacucugggggaaaagaaggaagaaauaaaaaggaauagguguuaccuaaacaagucugguuguuuugaaauagauugagaaacaaaauuaaauucagaaauuagaacuaagaaggcaccuguccaggcacuguggcucacgccgguaaucccagcacuuugggaggccgaggcaggcggaucacgagaucaggaguucgagaccaccagggagguggagguugcagugagccaagauugcgccacugcacuccagccuggcgacagagccagacuccaucucaaaaaaaaaaaaaaagaaggcaccuguagggauaauauaccuucuccagccuucuguuguauaucaguaguacaaaugcaggcaaaauaguuucccaauaauucccccuuuucaguguucuuuccuauucugacuacaucuaagacagaaucugcagucauuaacucuccccacacucccuuuuagaucauguuuugcuuccuuagcuuacugugccucccagcacuuagugguuacagugcuuauucuagaauucauauauacuauagcauuuuuuguuucacuuuuuauuguggaaauuuucaaaguauaguauaaugaauccuguguaccugucacucagcuucaacaauuaccagugugauuaauucugucucugcaauuuuuugacaaagacacuggaucauuucuucuguagacuuucccacuguauggauuuugcuaauugcauuuccuuguuuuuuaacauguuccucugucccuuguguuuccugaaacuugguaguaagauauagagucuuaaucagauucaguucagauuuuuauuuucuuccuuucuuuccuuuagcaggacuacuccauaauguucuaugcaaucauuagauaaauaagucugauuguuucuccuuuugugauauuaucagauaugugaauacugccucaacauauuaauuggaggagaaaaaauuuaugaucugucauuccuucauuuguuucucuuagccagaauacuucuauaaaaagaaacuucccuucaucaauuuuuguuuguuuguuugccuuaagagacaguaccagugucugugcguguagcggggguggguguauuugacucuuucccuuuaagguacaguuuauaaaauaaauugguuccuagcauccacuaaagaugaugaaauacauauuuuuuucauuauaaacucgagcauuuaaacauauuuguguuucaauccauuguuguuaguguccuuauuuauucucacauuguuccaucuuggccagugggagcuuauucaaguuagcucuugagucccuuugacaugggccuaauuuuaauucuccuugauagcuccuugcuuuuuaguacaacagcuucuccagguucaucuuacacacuuccugaucuggaccuggaauuaugcaaggagcccuagaauauuuuaguaggaaauaaaaaauaccccauucuuuuuuuuuuuuuuuuuuuuuuugagauggagucgugcucugccacccaggcuggagugcagcggcgugaucucagcucacuacaaccucugcuuccuggguucaagugaugcuccugccucagccucccaaguagcugggacuccaggugccaucacaucuggcuaauuuuuguauuuuuaguagagacgagguuuugccauauuggccagguuggucucggacuccugaccucaaaugauccgccugccuuggccucccgaagugcuaggauuacaggugugagccacugcacccagccaaaaauaccacauucugauagccuuauaaccuuauauacugcucaggagcuugguacgccuccacaugccuaacaucucuaaaguuuuuugacccucaccucugcugucucccugcuugcuacuaacaauaauuacuuucuaccaaaaaaaaaaauguucaaaaacaucuaaaagugaucaaaucaguagguuuguuuaaagguaaaggaccagaagaagauacuuacaacaauuuccuuaccauccccaccuuccaacucuauggagucagagaggccuuugagagaagauagaaacauuugcacaaaaauaugcuuggggacuugacgaugacacuguuggcuuuuuuuuuuucuuaaagcuugcaaauuacaaagggggaaaguguaacuuuggaguggaaaaaucuggcagauaacuaccuuagucagcauaucaaaguuggcaucacuuguaaugggacaaauugacauuugccuccugauaggauacucugaggacacaucauuuguauaguauuccuuucaaaaaugcauuaccuuuaucaugaggaaacagugagacaaacacaaacugaggaauauucuauaaaacagugaacccccaggaguuugagaccagccugggcaacacaggaagacccuguaucuacaaaaaauaaaaauuaaaaaaauaaaaaauaaaaaaaaucccaacaggcauagugguuguaugccuauggucccaguaacucgggaggcugaguuggguggaucacuugagcccuggagguugaggcugcagugagucaugaucaugccaccacacuccugccugcaugaaagagcaagaccuggucucagaaaaaccaaaccccccaaaaaacaaaaagauaccaugaaaguuaaaggguggaggaaacuguuagaauuaagagacuaaacugacaugauagccagauaaauacaagguaugacccuggaguuagggaaauaaguugcuauccaggacaauacuaggacaauuggcaaauuuaaauauguacuauauauugaauaauagguuaucaauauuaaauucccugauuuugaaaaauaaauuguuguuaucuaagaguauauccuuguucuugagaaaaauacacugaaguuuuaauugcugaaaagucauggcuguugcacugaaguauuuauugcugaagaaucaugaucuuuggaacuuacucucaauaguucuguaaaaauaauaagaauauauaugauauauauauauauuggauguauacauagagaaaauagugcacaugugauuaaaugugaacaauggauguaucuagguaaaggauaugggauuucauugcauuauugcaacuuuucuauagaacuuaagauuuuuuaauaaauaauucaauuuaaaagauuguauuaguccauuuucacacugcuauaaagaacuaccugaaacugaguaacuuauaagaaaagagauuuaacugauucacaguuccacauggcuggggaggccucaggaaacuuacaaucauggaggaaggugaaagggaagcaaggcauguuuuauauggcagcaggagagacagcaagcaggggggaucugucaaacacuuuuaagccaucagaucucaugagaacucacuuacuaucaugagaacagcaugagggaaacugcccccaugauccaaucaccuccuaccagguuccucccuugacauguggggauuauaauucaagaugagauuugggugaggacacagagccaaaucauauuauucugucccuggccccuuccaaaucucauguucucacuuucaaaacacaaucaugccuucucaacagucccugaaagucuuaacucauuccagcauuaacccaaaaguccaaguccaaagucucaucugaaacaagggaagucccuuccgccuaugagccuguaaaaugaaaagcaagucaguuacuuccuagaaacaaugaggauacaggcauuggguaaauacuguuauuucaaaugggagaaauuggccaaaacaaaggagcuacaggucccauacaaguccgaaaccuagcaggguagccauucagucuuaaagcuccaaaauaaucuccuuugccuccaugucuuacauccagggcacacugauccaaaagguaggcucccaaggucuugggcagcuccaccccuguggcucuacaggguacagccucugcagcugcuuucacugguugguauugagugccuguggcuuuuccaggcacaugguacaccauucuggaaucuagaagauggugaccccccuucucacagcuccacuaggcagugucccaguggggacucugugugggggaucuaaccugacauuucccuuccacacugcccuagcagagguucuccaugagggcucugccccugcagcagacuucugcuuggaccuccaggcauuucauacauccucugaaaucuaggcggaggcucccaaaccucaacucuugccuucuguguaccugcaggcccaacaccacauggaagccaccaaggauuagggcuuacacucucugaagcaacagcccaagcuguaccuugaccccuuuuagccacagcuggagcuggaguggcugggacacagggcaccaagucccgaggcuauacagagcagcagggcucugggccuggcccaugaaaccauuuuucccuccuaggccucuggaccuguguugggaggggaugccaugaagauaucuggaaugcccuggagacauuuuccccauugucuuggcuauuaauauucagcuccuuguaacuuaugcaaauuucugcagcuggcuugaauuucuucccagaaaauggguuuuucuuuucuacuacauggucaggauguacauuuuucaaacuucuaugcuaugcuucccuuuuaaacaugagcuccaguuucagaucaucucuucaugaaugcauaugacuguacacuuucaaaaaaagccagguuaccucuugcacacuuugcugcuuagaaauuucuuaugccagguaaccuaaaucaucucucucaaguucauaguuccacagaucucuagggcagggcaaaaugcugccagucucuuugcuaaagcacggcaggagugaccuuuguuccaguucccagugaguuccucaucuccaucugaaaccaccucagccuggacuucacuguccauaucauugucagcauuuuguucaaauccauucaacaagucucuaggaaguuucaaauucucccucaucuuucuuucuucugagcccucuaaacuguugcagucucugccuguuacccaguuccaaaguuguuuccuuauuuucaggcaucuuuauagcaguggcccaaacuccugguaccaauuuucuguauuaguccuuuuucacacugcuauaaagaacuaccugagacuggguaauuuauaaagaaaagaaauuuaauugagucacaguuccacauggcuauggaggccucaggaaccacggcagaaggcgaaggggaagcaaggcacaucuuacauggcagcaggagauacagcaagugaggggggaacugcuaaacacuuugaagagaacucacucacuaucaugacaacagcauugcggagacugaccccaugauccaauugcgucccaccagcucccucccucgacauguggggauuacaauucaagaugagauuuggguggggacacagagccaaaccauaucaaagauuaaauaauucauucucauuauuuuuguuuuucguagcuuaguuuuauuuuugaaaacuaauuguauuuaauauagcaauuuaucuuaauguuuaauguuuguaaaugcauuguuuuacuagauguuuuauauauuuguacaucugaaaugcuuuauauauuucauuccacaguuuaugauucuuaacucuuaaaaaauaaaauagcuccauuacauacaucauuuucaaaauaucaguauuauuauuuggcuucuguguuucagucacuaguggcacaguacgaacauuuaacucuugaaauagacaagcugugcuuuagggaauuacuaaaagaacagaaaucagaaagauuugucuuggaauguugugguuguuuaaaaauuacacuucaagcuaggugcauuggugcacaccuauagucccagcuccuuggaaggcuaaagcagaggcucacuugaccccaggaguucgaggccagccuaggcaauauaaugagacgcccaucuuuaaaaauauauauauuuuuuaaaaaguuacacuucuaccucaaccuccuugcucccacuucucuaccagccaccucacaaauauuugagggucuaagagguuaguuaaaagucuuuguuguagcucuguaggauuucuuauuuuugagauuucuagacauauaaaaacucaaauuuccugugauagauggaguuucuguggagagccauaggcaguuuugguagaugguguauguggaggagagcaaucccaacgauaugccuggguuauaucauagugguuacagggguucaaggaccauugucuuugacuccuuuuguagauauuaguagcugguauucuggaugguagccuuuuauaaaacauguuaggauucgaggcauacuaauaguguacaugcuuuuauuaauagaauaaaugaguggagguugguuguuuacucauuccuguaguaaaagaaguucagugguaucaaaaccgugcuuuuuugcagguuggguugacaacuggguuuuuuuuuuucacuaauguuauccauacacuaguggauuuuguuguuguuguuguuguugacugaagaccaaaaguuuuccacuuaauuuuguucauacucaaauuagaaaaugcauuguuuguaauagcaaaaauaacuuuuaugcccaguaaugugaaauugguuaaaucaguaauaguauguccaugcagauaugugguaguuaacuaagguagguuuacauuuucugcuuagaaaguauuuauaagacauauuauuaagucaaaacagcucacuguaaaguacuuauaauaucucuuuuuuuuuuuuuuuuuuuuuugagacagagucucgcucugucgcccaggcuggagugcaggggcacgaucuuggcucaccgcaagcuccaccuccuggguucacgccauucuccugccucagccucccaaguagaugggacuacaggugucugccaccacaccuggcuaauuuuuuguauuuuuaguagagaugggguuucaccguguuagccaggauggucucaaucuccugaccucaugauccgcccgccucggccucccaaagugcugggauuacaggcgugagccaccgcacuuggcccaauaucccauuuugauuaaaaaaaaaaacaaaacagcaacuauauuuauuuugugaacauaaauggaauacacuauaaagaaaccuaaacuguuuaacaaggcagagauuggguaugggaaguaccgggaggaguaaacuuauauuuccauucuguacauauuuuauauuuuuuauauuuuuagcauuuuaaauaccaagaauauuaauauauuacuguauacuuauaugaauuaauaucaauugcaauuuaacuauguaagcauuacacagaaguggauauaaucuaaucagcacaaaugauauaauuucuucuaauagcugauaugcauucaagaugguuaccuuucccugcugacagaaacuggugaaguucgugaggaucuuaaacugccagaaggugaacuaggcaaagaaauagagggaaaauacaaugcaggugaagauguacagguaaagacuuagagaaggauuauuuuugaaaaccauuuuauaaaaacuuugaccucaacuaguuaacauaaaauacuacauauggaaugugguuuaaaaauacugcuaaaauguugaaaaugaucucucaggcagguuuuccauaaaacccuuagagacucauuaucaaagaaaguaucaaaguucauuuuugcuacaucagcauuacucucaaacccaaauuuguuuugaagcucugcaccugacuuuuuuuuuuuuuuugagacggagucucccucugucacccaggcuggagugcaguggcgugaucucggcucauugcaaccuccgcgucccagguucaagcgauucuccccucagccuccugaguagcugggauugcaggcgcgugccaccacaucuggcuaauuuuuguauuuuuaguaaagauuggguuucagcauguuggccaagcugguuuugaacuccugaccucaggugaucccccaaccuuggccucccaaaagugcugggauuacaggccugagcaaggcgcccagcccugagcuauucuuacagguaagaaaugaugcuaguggaauguuaaagagugaaggagauuuacugucuucguuacaacuuucagaaauguaacggguaguaaguguucaaacauuuauaguuauuuuuccuguucccuggaaguugucuuacaaaccacucugagaaauucugcuuuagaaaacuguaaagaaaguagcuuguuuuggaauaccccuuucagaaguccauauguacaaaauauccacaaauauacaauauaugaggaacuaauuauaucuucuauauguauugucuucugaauaacguuuugccugcuuuuuuccuucuaggugucugucaugugugcaaugagugaagaauaugcuguagccauaaaacccugcaaauaaacggaaacaucaggcaugaacacuguuuaugucugaaucaacugcagaucuaauuugguucuaaguugucaccaaagcuauagccuucauaagcaaccucauuucuuuuuuuaauuguuuucagauugugcuggguuaguuuugcaagcaauugauaauuuuuaaaaaauuaucaauauguauaauuuuuuuugaauuuuguagauauguuuccuauaauauuccugugguuuucaguaugucaguccaagaaacaaacaagauagcuucagcagaugugauuugucugagcaaaucauuccuguguuuuaguuagaugauaaaccaggguuuuaaaucaaacaauguagcauaaagugguauugaaguaccauauuuaaguugaacugcucugcauuaauuacagauuuaauauaaaaugaacugauuauauauuggaauuguugcacuuucagccuguguagggcaaacacaaauccuuaaacaaaaaucauguuaucaaaaacugucaguuauuuugguggccacaugcaaccaugugauuacuuuggucauacuauuuaccaaauuguuggcaaacuugauguaaccuuauauggugguuuuagucccuucuuaugguuggcagaagggcacugaacuguugggugaaaguuaguuagcaaguaagauuauaaggaagacacaaaagacaguggcaaagaggguugauuaaaucuauaaguuuuuaugugaggacuuuguaagucagcauaaaaaugaaaaguuguuucucaguuguuuuugcuuuuaacuuugcccccaacguuuaaagggagugaucugcuuuacaugauacuaugcaaugcuuguuuuccaacuauguugaauaaauaguaauauuuaucaguaaauacuccuuuccaacuuccuuuuuuuuuuuuuuuuuuuugagacugagucucacuccaucagccaggcuggagugcaguggugcaaucucggcucacugcaaccucugccucccgaguucaagcaauucuccugccucagccucccaaguagcugggacuacaggugcaugccaccacgcccagcuacuuuuuuguguauuuuaguagagaugggguuucaccauguugucuaggcuggucuugaacuccugaccucaggugauccaccugccucagccucccaaagugcugggauuacaggcaugagccaccacacccagccccuuuccaaccauuucuaaguagauuuuuugacauuaauguauuuauuaaacaaaaacugagaauuccuuaaauugauuuggaauuuuuguuaauuuuauguccuuuuuuuccuaaagugaauuaaagugaaucauggaagcagcauuacuuuauaugaauauuauuauuuaaguuaaguuauuuuaaguauaugcauuuuuucugauuguugugugacuuaauucaguugcuggugugaacuauaacuagcaaauaauucuauaaacugaauuauuuuaaaagguauuuuaggugacaccacugcauuucuauuucaucuuuugagucauauguauauuauuuccagaauuuuagacauuauuacaggguuugugaggaccuuugacucagugacaaucaucauauuggagcaaaacauagaacaaaaucacuaucucagaaauaccuuaauucucuaagacuggcucuuagaccucucccaucaugccuugaccucuaaaaagcccuuuguuccuaucuucuaaaggaaaguauaucauauaugaugauguaacugaucuaaucagugacuggaaauagcauuaguaacagaagaucccaaguuuuaguugcuuaauuuguacacacuuuuaaauauugucuuagccucggcaaaccaauuuggggaagaagcaagauacuuuaagagaaauacaaaggaaauuucuaaagcacaagaaauagugagguaguaguuagucgucuuuccuacaacauuuuagcuuuugcccaucuaaagcacaauuaaaauuaggcuacauucuuuccaguauucuauuuaaguaccuacuacauacugcucuaguuucuuaguacucuguaauguguaucuuaauugcuacugguuggcauuguaacucauaggaauuccagaaaauuauuaauccgugcugcuugcaguucauucauauggccccucuuaaccaugcugguguuaugauucaguauuaacucucaauuagcaugccccuguucuuccuaacuuguaaaauuucacauaaauauauuuucaauuguguacaaauuaaggguguacaaauuauaauaaugcaucucuaucuucauacuuugaauggcaaacgcuauuuaugcauaaauauuuucauuuuaaguaauauaugaaguguaaauacucgauauauaaguauagauuuuaaagauaugggacuuuauuuucacauaagucaauagauguuucucuagaacaaaauauuuaguaaagcuuuauaaauuauauuaaaaggaagcggggaacauguauuuuuuaacauagaacagaagugacuucauucuuuuuagacaucagaaauguuaaaguugauucccaauauuuguuguacuuuuuuguagcaaauguuaaaaaucacgaguuaccauguauagaauguggacugucauguugauaucauuguacagugauaagccauuuuuaucuguauacauuucaccaauuuauuaacagguugaauauuuguuucuuuuuagaacauuuuauuuauacugugaagacuuuguuauaccuuauuugcuacaacauagaucauaucauugcuacuuugacuuagcauuugcaucauaaacauaauuaugauguuuuuuucaugcucccuuccaggggcucagucacuugaagaaacuguugcuaaccaagcucuugacucuguuucccuuaaugauacaagucucuguaccagcgcuuuauguuaauuaccaaaacucuccugcaucagagcaugauaucuauaauaggagauacugcaauaaaaugauuaggcuguaaaauuuggagacacaauuuuucauuacaaugcaauuugcaugugcacaugugcgcacauaacuuuauauguuaguucuuuuuuccaaacucccaacucuuaaaaguauuguagucuguuggugccucaacuguugguaacuuuuuuuuuuuaaauuuacaacuuuccacaacuuguuuuuguacuuuaagguuucucaauuagaauauuucuaguugagcuguaauuugaaugcauuguucucagggcuauuugugcuaaaagcugaaauuucauuauuuuaaagcuaauugccugaaaauauauuggcagaauuuucccaaauuguaauaacugugauacaugcauauaaaaaaauccuuaaugucaacacacuuaaacuacaugcuaaauagucaagaaaaaaauggaaacaguagcauccauacuggaaucuugccauauuuuuuucauuuuagaauagauuuuggcagucucaucuuagaauccuauccuuaggauacaucugaaagcauuccuuuggcauggaccccagagauaguuuuggagccaggcauugauguagagguucaccaaacauauuuagggauaauagauaaauucauaaugcuuuuuuggguacacugaaauguuuacauacugaauucuguaauaugaacuaggaacgcauuuacuaugagaaaauauggcucuuaagcaguguaagagugaaaauauaagcauauuuccauuaacaguauauuguacugaucagcagcucucauuuuaacaucaguuaggcauaauauuucauaguuuucaagccuuuuuuuucugcuaacauucagacaaguaacaggcaacaaagauuuaagaaaaauuuaugguggaaaaccuuaaaaauugagacaauucaaucuauuuaaucuauuaaauuuuuucucugaauuggguauauggcaucauuauuugauuuuagcagggaacauuuggauuuagcuuaugaaacacagauguucuaugggaacauggcuugaagccaauauguaauuuaauguuuuuccauuaaacaaacaucugaacaccaacuuagcuaccaagugaggucaagugccugaaaaguacuguauacaucuaauaagcauguuuuccuuauguaaaagaugcacuuuauggcaaugcauaccaggcuuucaccugcuagaaacauacuuguugccaacuuugccaucuaccacuauucuccuccuuagaacagguagaaaccuauuuuacaaaaaaaaaaaaaaaaaaaaaaagacagguuauuguauuuauaugaagucccuaaaacuguuucuugguauugauagacuuaaguuuaucuuaguucaagauugcacuuuuuaaaaaacucuggacuauuuucagcaaugaccgaacagcuugucacacaucauaguugugaucuuuuuugaggaguuauuuauugugguuaauaucuacuauaaauaagcauucuugugcuuguuacaaagcauaaugcaaauuacuaguucuauacuaguauaaugaaaaugacuaguucuauacuguuauguacuuuugucuuccuccccaaaaaggaaacaguuuagcauugucuaaauucaguggcacuuuuuuaguaauacauuuuuuuuucuuagauacaggagaacuauugcuuuuaccugcagaaacucaaauguuuucgcuaaaacuuuaaaauucuaaaauacguaguauggguauuacuaauuguacauuuuacauuucaaaaauaguuaaaauucaaauguuaagucuuugacuuaaaaaaccuuuaaauauagauaauaccuuaacaauuauaacuuugugauauuauuaaaauauauuugucuguuaacuucaucaguuguauuaaauaaaaauaguuaacagcuugcacuauucuugu

SEQ ID NO: 13593 - RNA, 4005 nt, Homo sapiens
ggaggcgacaaucugacgcucucagcgcgugacgcagcacgcuuugauauaaaugcagaccgcgcggccguagcuuccucucugcucucgcggccgacucgcaagauggcgccggugagugagcgaugucuuggugggaguguuguguggcaauuuaaugauuuccgcuguaacgauuuuugcaucugucgaguggagacgucucagucaagauaaagggaggggaguagugaagucugggucagaaacacaaccaagacgcgaggauccugaacuguuuuucgagacucccuggcagcugccaugaggucuaguggaguuggagcugggcccggaauugguuuaggaugggugguuuuggacacgcgggaaagagggaggcacaacuguaaaugggccggugguacugcaaucugagccauuucuuuacuaucucgcgccugauaaugcuuuugccacucagcacuggguaggggaaugguggguaaucgggccggucugacgaccuuugccaggccagagggagcuccuaggcgcucagcucccgcgauggccgacaucacaaguuuuugagaacuuucaguuggggaagaaguuucucggugaaguaauuuuuagaaaaguauaagucuagauuccagcaaugugaaauaaacgugcuucagauguuuuacuuaagucauuaguaagggaaccaguaagauguuaaaauguuccuaagaauaucugaaaagcuagauauacaugcgcaauuuacaaauaaaguuaggauaaaauugcugggcuagcuacaaaacuggguaaugcccagcauggccauaaacccuauaggguuaucuguuccauuagacagaaguuguuugugucucccaaauuaacuucugcgccaacuggguaauuaucuuuuggcacauguuaccaugcuaccugagaaagcaaacuaauguguaauacuugguagccacuugggugaaucuaaauuggagguuauagucugauaaauacagauuuguuuguucauauugcagugaauguacaugguugcuggccacaguaacauuuugcuuauguagccauauuauauggucuugguauaaaagguuuggauauggaaaauuuaaguuccacgguguugguuuuuagguuuuuuuuuuuuuuugagacagagucuguugcccaggugggaguauaguggcaugaucaggcucacuacaaccuccgccucccggguucaagcaauccucccgacucagccuccugaauagcuaggauuauaagcaugcaccaccacaccuggcuaauuuuuguauuuuuacuagagaugggguuucaccauguuggccaggcuggccuugaacuccugaccucacgugauccuccugccucagccucccaaagugcugggacggcaccuugccuuuuuuauuuuuauuuuuucuuuuucuuuucuuuucuuuuuuuuuuuuuuuaccaaaguccccuucccuugccuauaauaacguaagaauugaauuuucuagacauagguggguggaauccuagcucuggcacuuaccugagcuugggcuaggcaguauacuaaccuauucccaucugcagugggguggcagaaaagcacgauaauuuaaaauugaucauugguaguauagaaaacaaugaaaguccguaacuuuuugacaacuugaacauauuaggacuugguuagagguucaaaucaaccccggcguggguaguggugguguuuuuuuauuuauuguuacauuucuguauauguaaccuaacaguacauuguacagauugcauugguacaaacuuuaaaauuguuuauauaaauugaauaaguuguuuuauauagcuacauaauuauuucucauuuauguagcagaaagacaggaagcccaagaggucaaccuggagguuuaauuuggaccuuacucauccaguagaagauggaauuuuugauucuggaaauuuuguaaguaucauucuacucggcuuauuuuuguaaucagaguuauugauaaugguuuaaauauauaguauuugauaauaaccuaagcucuauuccuaggguaccuucccuagugaauaucuaggguucucuucccuaguuuugcauuuuuucuguuuuaaaauaggagcaauuucuacgggagaagguuaaagucaauggcaaaacuggaaaucucgggaauguuguucacauugaacgcuucaagaauaaaaucacaguuguuucugagaaacaguucucuaaaagguugguacuuuugcaaauuuuaauaaaacuauaguaguuuuggaauauuucauagaauauguaguuauuacauguauucuguuuauaugcaagaauaaauaugaacuuuagacuaaaggccuacauaaaugggaaauucaguaaaugagugccaauugcugagucuaguuguaagugucauuuauugcuagaauaugagccaguuguguccacagucccaguccaguaaauuauaggcccuguaaauccaaauuguauauaaccuuuaaugcugaguacuuuaguauuugaguauguugcaagaaacaugucugauguguacauaggagaauugucucaaguuauuuauucaguagagguagccaguuaaagucaaagucuuaacaucuugcugccaguuuuuauuuguugaauuuauucaccaaauauuaaauacuacaugggcagcacaggacuggguaacccaacagugaaccaagcaggcaguuuacccaccaccaagaaacuucuaguggagaagagagagugaaauggaauuaaucaagcagugauaagugcuguaagggcauaaaacuaguugcagaguuuuuggguacguugguaaguuggucaggaaaugaaaugcagaagugagccuugcaguuguuacaggcaggaugaaccagaagccuggcagauuaaaguaauaguaacaaagccagugugucugggguauaguguucugggaggaaugcaugagauuggagggugucuggggagcagaucuugaaagccaugggauguguaaugggaagcaauuguuuauuguggcugaaaaagacuagggugauacaucugguggaaacugaagauguaagagcuaauuucagugagagacaaugauggcuuggacuaaagugguugcaguacauguuaacugagauuauaaucacuaaggauucagagauaaaaauguaguagcuguaguagcuguaaaucaaguaucuuacagauaaucagauaauuauuguaaaauacaacucuaguuacauuagauguagagagagcccaagaauuuucagagaaguugagacuuaaugagcauaguauggguuuaacccuauuauuaauagguugccuguugagccggggugggauugggagcuagggggcuugauaguggugaaggagguguuaacguuuucacauauauauacacagauaauauauuugaagagugaaaucauauugcuuaaauaauuuggcuguagcaguuugacaagagaaugcuacccuaacaaucuugaacaauauauaguguggcaguaugacaagaggaugcuacccuaacagucuuacacaauacauccugugaauggaaggaugaaauauuuuggaggaagcuagguacagaaaagaugaauaugaugauguauauuuuucguauaguaaaccuuuacauaguaggaauuguauuucuuaaugaaauuuauguuuuuauuuuaaaagguauuugaaauaccuuaccaagaaauaccuuaagaagaacaaucuucgugauuggcuucgagugguugcaucugacaaggagaccuacgaacuucguuacuuccagauuagucaagaugaagaugaaucagagucggaggacuaggcaaaggcuccccuuacagggcuuugcuuauuaauaaaauaaaugaaguauacaugagaaauaccaagaaauuggcuuuuaguuuaucagugaauaaaaaauauuauacucu

SEQ ID NO: 13594 - RNA, 1231 nt, Homo sapiens
ggauucugagcgcggcgccuccuuccuuccccugcugcuccaccaccaccuccgucucugucuccgccgucgccaacaccgcccccccucaggccccucacaacgcgcagccugcagccagcugccucgcggcggaaccccaccccaccccaccccaccucgcccuugcuuucgcucgcccuuuuagggggcuuuccccgccccuuccacuauccagcgcgccgaagcccccugcccagagcucggcuuugcuaccuggauccgcuucuugugucuccugcguuccgccauguuggccgcuccgcccgguucccucugacguggagcgaggagggggcgguggaaaccucgcgagaacgcgccccgaggcccguuauguaauccgccggcuggcgccccuggaauggggaggucggccgccuggcggggccagcgguccuuagcggugccuucucuccccucuucccuccgcuccugcugugcgggaacuggagaaucguuaggacguggaggaagcagagaaguggaucagagaacaggagggcugggaagaguccugguuucucaauccugacugagcaucugaaucaccugagaagcuacuaaaaugcagauuccccgaccccauccccuuagagucagagucugugcauuuagggugcggccuuucucagagggaucgacugagaccuacugaacccuagaagucuuuaccugaggcaguuccugcaauguacuguauauuucaugacauuccauguaaaagaugacaagaccgagaccguugagugacagagauaagaacugacuuaucuaaggcuccacaggugguagauggcagagccgagaccugagccaauuaucuuuucuccugcacugugcgggguaauacagcucguuuaaaacaagcuggagucuccauuccguuuuccgcguugcuucucacaacucacuguuagaauccagaaguaagagaacccggggaagcguaaggaagaugaauaggacaaagauucuaagaaggugggaaggaagaaggcugcagucuauuucaagucuggugaauuucaaucacuguagccuuuauuguuauuuuagagccaccuagaccaaaagagaaggagcucaaauugcugguaagugcuuagauagaaauucccuugacugacuuuauagagaucuuuaaagcguuuuuaauuguagaaaauugggaaaauucagaauagaaaga

SEQ ID NO: 13595 - RNA, 94264 nt, Homo sapiens
cagcccauguuagugauggaggagagaagauggcggaagcggagugagugacuagauggugacugaugucguaacuagggggggcgaguuggggcagcgacacguucccccaggggaaagcucagggcucuuuugcgggcaguguggggaaagagagacucgagacccguccuaucguggaggagccggcuaggcccgugucgcggggcgaagacgaacucuaggguccaguuacccuccaggcaggagcgccccuuccgccaucaggucccggaucugcgcggcccugcgcgcagggucacccuugggacuccgggagcugggguuuuccggggaacgagcccgggugggcuccucaggcgcugucauuccugcaagugggccccgcgggcagccuuguuacggcugccugcgcaggggcccgcggaggcuggguagggcagggcgggcacugccaggccuccuucgccuucuucuccuucccgccccggcgccaccccacuccuccucagcgggagaauccgacacgcggggcugcccgcuucccucgugccggaggcaucccggcgugggccugagagcggcgggggcugcuugcaggucuggugaggcugaaaacacccugaaagaaaggucuuucccucgauucucugggugcagcguugcugccucacacgcgggccacauucuugugugucggugugacgguauguuuaguuaacgacuccagaacuuacuguuuccuggguaggccucuugugcaccagaacugcuggcuguauuuugcagguauuaguaugccuagacgguggaguuaccaaaguuguucuuuugugccaggccucgaaaugcagugcgaugguuuggccaguuccgcucaaccgauguuuagacuuaugccgagaauuuggauucucugugaccauuuuugguuaggaguuagaacuguuuaccauacuguuuggauuggagggcauaguugagcagauuaacacuuuuaaaaaaccagaacuuaagcuggccuuuugcaugucacugguacacgauacgguaguaguaugacaggcagcaguucgguaaaaaguuuaccuuaccuaccacuaauacuguauaauguugaacaguuaccauaugaugcugugauuugauuggaaggcaguuuggaaaaaaaaaaaaaaaacagaagcauaaaaauguaugaauuauuuacuaauccaaaaaguaagugaggagucagcuuucuuccugacgguuuuccuuucacuuuuccucuuauuuucuuuuucuuucuuugugacagcgucucucacucuuaucucccaggcuggagugcaguggcacgaucauagcucacugcagccuggcccucuugggcucaagcgauuuccccaccuuagccucucaaguugcugggaccacaguccugugccaccaggccuggcuaauuuuuuauuuuucauuuguagagacaggguuucccuauguugcccaggcuggcuuugaacgccuaagcucaagcaguccucccccugagugguaggaugacaggugugaaccgccacucaaggcccccacuuuuccuuuuuuuuuuuuuuuguucgguuuuuuuuuacauuugguuccucagagaauauaaauacuguuuacauacguaauauagaacaaagaaaauuuguacuuaaaaaagcaacgcuaugguaauaguguauguguaccaauuagugccagauucauuuguuuuuucauggaauagaaaguguucuuacauuuuuaucagugcugcuaauguggggugggugggauuuaguuucucagaagaaaagaccgauaagaaaagggagauaaaaccaguauaaucucuugugugcuuuucaccuucgagguacauuucuggcccgacaaaaacuacugcucuucugguuucuaacaauauggagguccuuagaauugacuuaaaguguuugaauuuauucaaauacagauucuguauuuaguggaauuuuguaccacaacaaguaagauuauaguauuggagggaagaaagucugguauaaaaguguacuuuacuguccauacaugaggaagugacauaauuuauguuuucaaaaucuggaguaauucuuugugaaaaagauuuuguaaggguaugggaaguugcuguuugcugcuucucuguguucucacagcaaucugcuaauaaguauaacucagcuauuagaaguaguaaggacagcguuguagacugauuaggggaaaagccagugugaguuaaaaaaauuacuuuuuaacauuuuuuaaaaagaacuuauuuuuaagcaaaguuuauaugguaaacuaaacuaagcuaguuaacaugagucccuaggcauucuguucuaauguauagguaagaaugacuuuaguuuguaauuaguguggucaaaagaauguaaagaaauguuuuaaaauacucugauacugcuuaaauuuuuauuuuccuagguaguuuaguauucucucauuaccuguuuugguuuaaaaaaaaucuuucgguaaugcaaagauaaacuuuuggcuaugcguuaucugaguuacguauucugaaucauuugaauucaaauguaguagguauuaacuauuaaauaugcuccauauaugugaaguauuuuucccuucuaagugcuuauagugacuguguguuggcugucuuuuaugagagccuuccuagcaguuuagauuacugcugauuauuucuuuggaaugaauauucuuuaaagcucauaagauaaugcuuuuaccaauacaaacacuuugugugaccugccagauuuaaggaccauaguacagcuauggauacugaaccaaacccgggaacaucuucugugucaacaacaaccagcaguaccaccaccaccaccaucaccacuuccuccucucgaaugcagcagccacagaucucugucuacagugguucagaccgacaugcuguacagguauuucagcuguagugauggguagucuaagacuuaagaugucauauuacuuuuugcuuaagcuggauuuauguauuguuucauauucucaaauguacaguuagaauuacuaauguuucaaucaacugucucaauccauuuuguguggcuauagcagaauaccaagacuguguaauuguaaagaaaagaaacuuauuucuuacauuucuggaagcugggaagucuaauaugaaggagcuggcaucucacgagggccgucuuauugccucauuccgugguggaagacuagagagcaagauaccaaauuugcagccucaagcccuuuuaaaauuuccuuuagucggccgggcgcgguggcucacgccuguaaucccagcacuuugggaggccgaggcgggcggaucacgaggucaggagaucgagaccacggugaaaccccgucucuacuaaaaauacaaaaaauuagccgggcgcaguggcgggcgccuguagucccagcuacucgggaggcugaggcaggagaauggcgugaacccggaaggcggagcuugcagugagcggagaucgcgccacagcacucccgccugagcgacagaacgagacuccgucucaaaaaaaaaaaaaaaaaaaaauuuuccuuuagucuauucaugugggcggaguccuuauggccuaaucacccuucagggguccuaccucuuaacacuguugcauuggagauuaaguuuccaacacauacuuaauugggggacacauuuaaccacagcaacagccaacaaaguuaauuaauaaucauacuauuggcuaggcgugguggcucacgccuguaaucccaacacugugggagaccaaggcagggagauagcuugagcuuaggaguuggagacuggcugggacaacauguugaaaccccaucucuacaaaaaauacaaaaaucagcagggcaugguggcaugugccaguggucccagcuacucaggaggcugaggugggaggauugcuugagcccaggaggucaaggcugcaaugagcugugaucgcaccacuguacuccagucuaggugacagagugagacccugucucaaaaaaaaaaaaaaaaaaaaaaugcugggcgugguggcucacacuucuaaucccagcgcuuugggagaccaaggcuggcggaucacuugaggucagguguuugagaccagccugaucaacauggugaaaccccgucucuacuaagaauacaaaaauuagccaggcaugguaaugcauaccuguaaucccagcuacuugggaggcugaggcaggaguaucacuugaacccuggcggcagagguugcagugagccaagauagcgccacugcacuccagccugggcaaaaagagugagacuccaucucaaaauauauauauauaguauugagagggcuuacauuugucagcauguaguuuauaggauuauguguaaagaaaauuauaaggggaaagucucuaggugcugcuacaguaugaaggcauucaaccuagagccccaacauacagaaugguuguagcuuuauuuuauauuggaacucaaaauauagacuuagggagaucuguucagguauguagauauguuacgaaguuuauauuaaacccagguggccuaagaacccuaagcaggaggauccauucuaaauaccuuaggggcagagggggaagggaauauugaacuaggaagucacuuaguugagaaaguaaaguuuacuuaguuaacauuuaugauaauggagguuggggcaauaugguauuauauaaaaagggcauggaccuuccacucuauuauacuuuguuugaauuccauuuucauuaucuuuaggagcuauauagccuuggguaugagacauaauccccuugagccucagaaaacuaaaaugagggugagacuacuucuuucauuaauuacucugaggauuaaaugaaguaucuuugagauuaaugaaguaucuagaacuguguaaggcacauuauagguuuccaguagauaguaauagcuaauacuuauugaauaauugcuacgugccaaacauuugauaaauguuacaugaauuaucuccauuaaucauuaccagcccucugugaaguagcuauuauuauuaucuccauuuuacugaugggaaaauaaauguuuuaaaucagcuaaauaacuuucccaaacucaccuagcuaguucucagacuucagcccuugugcccuuaaccacucugugaauucuuauuuuuucuauuauaccugcuuucuucugguagaauccuuauaauugcauccacccugaaaacaacugcuugcaauauaguccuuccucugcuccauuuuuccaugguggauaccccaguauaaugucuauuuaacuguuuuugguuuaggauuuaguuuuccaaaaucacuguggaguggaaccagccaguucaccagaaauucaaacuugaaugcagagugagguuuuaauguuuuuuaccuuucucugagguaagggauacagggaaaaggauuuagaucuuuuuuuuuuuuuuuuuuuugagaccgagucucgcucuaucgcccaggcuggagugcgguggcgugaucuaggcucacugcaaccucugccucccagguucaagcgauucuccugcuucagccuccagaacagcugggacuacaggcaugugccagcagauccagcuaauuuuuguauuuuuaguaaagaugggguuucaccauauuggucaggccggucucaaacuccugaccuugugauccaccugccuuggccucccaaagugcuaggaucacaggcaugagcuaccgugcccggccggguuuuguuuuuuuuuuuuuugagacugagucuugcccuguagcccacgcuggagugcaguggcgcgaucuuggcucacugcaaccucugccucccugguccaagcgauucuccugccucagccuccugaguagcugggacuacaggcacgugccaccacacccagcuaauuuuuuguauuuuuaguagagauggggcuucaccauguuagccaggauggucucaaucucuugagcugguaauccgcccgccucggccucccaaagugcugggauuauaggcgugagccacugcgccuggccccccccuuuuuuuuuuuuucuucucucccucuguguugccuaggcuggaguccaguggcaugaucacaacucacgacccccugggcucaagugcuccuccugcuucagccuccugaguaguugagacuacaggcacaugugacuaugcuuggcuaauuuuuuuauuuuguagagacaggaucucacuaugucgcccaggcuagucuugaccuucuggcuuuaagcucuccuccugccuuagccucccaaagugcugggaugagccaccacgccugacugauaaugugaucgcuuaauauaccauuuuguccucuaguuuucaauuaagcugcauagauuaauaaaaaauuaauagaaagauauguagauguagauauaucucauaaauagcacugacucuguuucuuaugagaccauagaauugcuucucccaaaaugaaaucaaaucaauauuuauugaacuaccuaaguaauucuuuaaucuuccagcuugcuuuuucuguccugggaauucucuucacccuccuugggugaauaagaauuuauaauaaauaagaacaauuugcuguaucuauaacuuguauuuacucauugcugugaguaauugaauaguagugaaagacugugcugacaacagaaaaaaugaguauacucugacaaaaguaugugucaaauagauuguuauuucaguuugauuuuagaauuuuuuuccguauacaguccagugcuuuuagaauuuuguuauggaauuagaagaacaaauagagauugaucugacuaaaaaagguauauuguuauaauucugaaucacuuaaugcuggccuauaguccccugcagguagaggucaaaagcucccauugauuuugugacagaaauuuguaucaggcauaguagucuauaguuggagaggugagauauuaacacaugaaaauaaacaauaacacacagaaauaugcugucuugaaguuuagauaaaaggauucauggcauuauggcucaagauguccugagagacccucaagcuauaggauuauggcacuauuacucccuuagcucuuugaaaacucugguuugaugcugcgauuaggguucugugcuguuucagagucacagugagcacaaugugacuuucggauuugguuguauaggauugacuuauucugacuuaaccuuuuggagaaauguaagaauuuucucugauuuuaguagaguacuugacuuuucuauauuuauuuaugaaguuucaggcucagauuuuacauuuuacuaacaaauauucacaguaauuaacacuuuuuaaggaauuaaguaagaauaguuuuauucaauguugaagcaaaacaagguauuugacauuuaaaaauuuuuuaaauuauugaguaauuuucuaaagaagaaauagcuuuauaauuuuauuuuuuauuuuuauuuuauuauuauuauuuuuuugagauggggucuugcucugucgucuaggcuggagugcaguggcaugaucucuggucacugcagccuccaccuccuggguucaagcaguucucccaccugagccuccugaguaucugggauuacaggugcaugccaccaugccuggccaaguuuuguauuuuuaguagagacaggguuucacuauguuggccaggcuagucuugaacuccugaccucaggugaccugccugccuuggccucccaaaguggugggaucacaggcaugagccaaccugcccagcugcuuuguaauuuuauaugauuauuaauaauaccugcucauuguaagauuuucagacaucuauagaagaguaugaaguagaagcuaaaaaucaccucuaaucuagcuacccaucaguggucuuugaaaguuuuccuguggauucuuucaaauauuuuaauauaaaaaugguaucuuacucuauauacuauuuuguaacccacugauuuucuuuuuguuaguaaauauagaucgguaucagcaauguacacuauaguggccaguaguuacuuguggcuguuuacauuaaaauuaaaauuaauuaaaauucaauuuaaaauuaacucaauucuuuaguugcacuaaccacauuuuaagugcucaguaggcacaugugacuaguuguuacuguauaggacagcacugaucuacauuacuauuuguuaugguugcaugguaaagguauuucucuccacacccaagcccugaauucuacgaaguuuuauccaaaaagguuaugccaacuugaauuuuuacuagcaauaugggaguauugguuuccccagguaguaguaguauucuuuuaaaucuuuauccaucugaaaguuggaaaacaguaucuuguuuuaauuuguaaguuuuugacuacuggugagauugaaaaucuuuugaaaugcuuaguuggccuggccugucuuuugcgaauuguccacuggguuuuguuuuguuuuuuuuuuuuugagaugggagucuugcugugucgcccaggcuggagugcaguggcaugaucuuggcucaacugcagccuucaccucacagguucaagcgauucuccugccucagccucccgaguagcuggggcuacaggcaugugccaccaugccuggcuaauuuuuuguguuuuuaguagagacgggguuucaccauguuagccaggauggucuugaucuccugaccuugugauccgcccaccucggccucccaaagugcuggaauuaacaggcgugagccaccgugcccggcccacuggguaguuuuaauguguacaaguuagugauuucuagugauauguaacuaggaaagaaauaauguuaauaagcuugaugauauuauguauuaaagcagugaaauuuuaaacugccacuuuuuuauacuuugauuuucugauuaagauaaagguugagauuaugguuugacauugguucaauugacuuaucacagguaauucaacaggcauugcaucggccccccagcucagcugcucaguaccuucagcaaauguaugcagcccaacaacagcacuugaugcugcauacugcagcucuucagcagcagcauuuaagcagcucccagcuucagagccuugcugcuguucagguaagacuaaaauaagaguuuaugagaucaaaguuucuguuaucuguagguaguuacugaaaauaaauagauuggguauuauuucagaguucucagauguccugugguuauuuuucccggaggaaauauauuaauagguugccgaauagaaguuaauugagaaaaaggggauauguuuuuuuauguuacucuguuucuagcuuuugucucagugcuuuuuauccagauugaagaaaugcuaugcuaguuuauguguauaaaguucuagguacaacagugaguacuuaggcuuacauaaauuguauuuuuacuaaaaauaagauuaaaaaaauuauauaaguaauuauacucauuaaaaaaucaaacaauauuaaguuguuuauaagagauaaaguaaagcuguuccuuuucccugucuaucacuguuucccguucuucaaagguggccacaguaacaaucuaauacauauuucuccagaaauuuuuuauacaaagauagguauauccauuuuucuaaaauccaaucauauuauuccuacugauaacaggauuucauuauuaaaugcuuguuuuuaaaaaagauuuuuguuacuauuguacuauuuaaauaaagcuguguaagauuuaaucuuaaauccccucaccagaggaggaucucaauugacugaaccugaaaaagguuuauuucuguuaccaacagauucucagcuguugcuucuuaguaguguaauuuuuaaauaacauguuugugauacaaguuaggaaacugaaacccacucacuggcucuugcuguagcucuaauuucuuuuucauaacucuggaguagugauuccacuuuaaagaugacagagacccauaaagugaaacugacaauaaaguagcuaauaaaauaagauuagucuuuggauccccuguuuucaccauucagcuuuuccuuauuuaaaaaaucuguuuaaccgaagcuuaagccauguugacuauaaaauuaguuguuucauacauaggccuuuugacauuuauuguugugguuuuguguuaucaugguaccagaaaguucuuaacuucagguuuuuaccgacauauucuaaaagucuuacuauuuuaggcaaguuuguccaguggaagaccaucuacaucucccacaggaagugucacacagcagucaaguaugucccaaacgucuguaaguucccuaaauuuuuuuuuccuggauuuaaaauuuuaaagaauuguuuuccaaaaguaaacuguuguuauuuaugaagcuguuauuauaauuuguugcaugcuguuuaaaguaacaauugcccagaaauagaaaugauaaaauucaagaauucagaacuaauguuaaacuuaugaaaaucugagucuuaaaaaaaucuuuuuguauuauuucuuguauauccauuugcacugaucauguucagaucuuaugugguuucagcuuucuguguguauugaaagccuaaaauauacaaugcagggauauuggccaugaauuuacugugauauacaauaguaugucauguccuugguagacaucuaagcauuucuaacuuugugcaauucacauuuuagaaauuauacuuucagcuuacaugaguuauuuggguucaauuugcaaguauccauucaagauaggguaauuuauuuugagaaaggaguaaaagaaagcugauucgcuauauugcacauauauauugggaaauugugccaaguuucccagguaaaauaaauuuaugggcaugguaauacuuguuuagcuuuuaauuuugguauaauuuuaaacugcaauaauaauaaaaaaauuucuguaucuacucuacucagauuaaucaauuauugcauauugccccauuacuuuaucauucauucuuuuccacuacauguauacauauuuuuuucugagucauuuguaaguugagauauguuccuuuauuccuaaauacuuugauguguauuuccuaagaacaaggcuauuguuuuuugaagccacagaaaaauuacuaaauucaggaaauauaacauugauacagugcaguucauuuucacauuucaucauuugucucagguuucccaaccucaucacuauggacauuaugagccagauaauucuuuguugucaggggcuaucguguaauuuauaggauguuuagcagcaucccuggcuacuagaugccggcagcuuguggucuuucuccuuccucuagugugacaacuauagguguuuccugguggggggcaaacugccuguaguugagaaccuaauaauguccuuucuagauauuuuuuccugguccagaaugguaauacuuugauacuucauaaaauuggcuccaauacaauauaguuuguagguuguuaaggaauugaagguuaaggaauugugcucuauuucuucagcuaaggguauggucuuugcuaacuacaugcuguggucagcauauagcugugguuuuuuuuguuguuugguuuuuuuuucuggcuguugaucugacuuuuuuuuuuuggcgugggaauguccuggagugugaacaagauuaguuuaaaaaguucccuaugacuugaagauguuagauuaaaugaaaaacuuaaauaauguaaccuagcucuuaagcauuaauacuggaguuuuugucauugacaucagaugucuuuaauacaaugguaauuaaggaaaggagugguaaauauuuugugggcuacugaaggaaauuauauagacaaauucuuuauucugugaaauacuggaauaacaauaggauguauuuguauagauauguuauuuugaauuuuuuuccuucauguuauuaaaagguaucuuuuuaaacugucuuucauuauggcuuuauguaugugacauucacagaaguuagaauucuagugauugugcuuauauauaugacauuguuaauguuacuugucauaaaccagcagcauuauaccaugaaguaugccaaaagcuguaaauggcuggugggggaagauaaguaaguaggaagaacagauucccaguaaaauaaaggaauaauacauuacauuugcuuuauuuacuauccguugugagcuucugcucaaguaauuugacuagcaguaaaaauuacaaugcccaagguaacuuaguaaauuuaggucaauauccaaaaacgggggggagcaugguaacagaucucuuaaguagugaugauaaugagccaucagguaacagacuaguaguuuucagaguuuugauuauuuugaguuagguuuccagauaacagugaagccgugggaaaggguccauucuccagaagaaaaaacagcugucagguaaccagcuagguaguuggggcuuagaguaggagugggaucccaauggggaaauggaauauuauuuuaaaaaucaaguccaaaguccagucauaccaccugggggaacuguguaccuacugauugauuauuccuaauaugaaaacccgaaaugcucuaaaaucugaaauuuuugcacaccaacaugacauucaaaggaggaguguucauuggaacauuuuggauuuuggauuuuuagauuuggcaugcuaaaccaguuuguaucuuuccaaaaucugaaaaaaaaaaaaaaauccgaaacacuucuggucgcaaggauuucauauaacagauacuccaucuauaugugguuuggagaguagacuuguuaauugaauguauagguaacgaguggguaccugcauucuuuucuuuucucuaauuagaaucaugacuaauucuacacuauugucaguaguggaguggugauuuuuuuuuuuuuuuuuuuuuugagacggagucucgcucugucucccaggcuggagugcaguggcgugaucucggcucaccgcaagcuccgccucccgaguucacgccauucuccugcaucagccuccugaguagcugggacuacaggcgcccgccaccgcacccugcuaauuuuuuagagaugggauuucaccgucuuagccaugauggucucaaucucuugaccuugugauccaccugccucggccucccaaagugcugggauuacaggcgugagccaccgugcccggccguggaguggugauuuuaugauuguuuggcucuaaaacuaauucggacugagccuuuagguuuaugucuuuaguauuucaacuuaaauggagcaaagaucuaguuaaauuuuaaaauggaaguuaaaccaacuaaaaauucuacuucugccaaaaaacggcauaagcaaagugaaaacagcaaaaugggagaaaauauguuugcauaaauggguaauauuucuuuuccuuuuuuacuuuaauuuuuuuuucaaaagggaagacagggagaauuuuagccuuccuuucccuuucccuuugacuuugccuuuccauucccuuuccuuuccuuugacagagucuuccucugaggcuggagugcaguggcacgaucauaacucacuaccgccucaaucucccaggcucaagugauccuccuaccucagacugcugaguagcugggacuacaggcgcacaccacuaugccuggcucauuuuuaaaauuuuuauuagaguugaggucucgcuguguuccccaggcagacuggucucgaacuccugagcucaagugauccuccaaccacaggucacaaagugcugggauuaugugguauaggcaugagccacuacaccuggcugauaauauuucuaacauacugaagacucauauuaguaagauaaacagugagaauucacagaaguucucaguugguaauuuuuaaaagaaagacuuuuuuuuuuuuuuuugagaugaagccuugcucugucgcccaggcuggagugcaguggugugaucuuggcucauugcaaccuccaccucuuggguucaagcgauucuccugccucagccucccaggcagcugggacuacaggcauacgccaccaugcccggcuaauuuuuguauuuuaagcagagaugggguuuugccauguuggccaggcuggucucgaacuccugaccugaagugaucugcccgccuuggccucccaaagugcugggauuacaagugugaacuacugcgccuggcuauguuuugacuuuuaaacacaugaaaauauauuuaacauaucaauaauaaauguauguaaaaggcugggcauguuggcucaugccuauaaucccaacacuuugggagcccaaggcaugcgaaugaaaccccaucucuacaagcaaaauacaacaacaaaaaauuagcuggaugugguggcaagcgccuguaguuccagcuacuuaggaggcugaggugggaggcuugcuugagcccaggaggucaaggcugccgugagcugagaucauaccauugcacuccagccugggugacagagcaaaacccugucuaaaaaaauagaaauauaugcacaaauaacaaugaaguacuguugucaucuguuaaaguagaaaacaaggaaaaacguuuacacaauaccuguuguuggcaagaaugugaaaaaguagguauacucauacacuauuagugguaauauagauuggugcaacucuuuuggaggguuauuuggcaguguguguuaaacuuuaaaacguacaugccccugcugagaaugguggcucaugcuuguaauccuagugcuuugggaggcuaagguggggggaucacuugagucuagcaguuugagaccagccugggcaacguagaccccaucuaauaaaaagaaauuagccaggugugguggugugugccugcagucccagcugcucaagaggcugaggcaggagaauugcuugagccuaggaguuugaggcuacagugagcuauaauuaugccacuguacucuagccugggcaacaguaugaggcccuguuucaaaaaaagccaaaauaaucugugcguacccuuucauauagcacugucacuuuuagggacauaauuaaaaaugaccuagauaauuaugcccauaugcaggauguauaauagugaaaaauuauaaauaauauaaaugcccauuaauugaggauuaguuaaaaaaaugauaguuaauuccuacaguggaauauuauagcuacuaaaaaaugcuguauaugugucuacagagagacuuggauuuucauuauguauugaguguaagaagcaagaaugcauuguguaagcuuguuuaacuuauuuauuuugguuauucuauuugcagucuaaaauuauuauuuggggccaggcgcaguggcucacgccuguaaucccagcauuuugggaggcugagguagguagaucacuugaggucaggaguuugagaccagccuggccaacauggugaaaccccaucucuauuaaaaaucaaaaauaagccuuccauggugguacgugccuauaauuccagcuacuugggaagcugaggcaggagaaucacuugaacccaggaggcggagguugcaaugagccgagaucacaccacugcacuccauccugggcgguagagcaagacuccaucucaaaaaauaaaaauaaauaaaauuauuauuuggugguucuuuauauauucuguuucuuuggggagccuuuuuuuuuuuuuuuaauuucuuuuagguaugcucauuguugcuuauuugaaccauuuuaagagaugggucucacuguguuguccaggccggccuccaacacuugggcucaagugauccuccugucuuggcuuccuaaguagcuggaacuauaggugcaugcuacugggccugacuucuuugaagcauuuuuaugauggcugcuuugucauauaauucuuuuuuuuuuuuuuuuuuuuuuuuugagacaaggucuugcucugucacccaggcuggaguacaguggcaugaucuuggcucacugcaacuuccaccuccuggguucaagcaguucucaugccucacccucccaaguagcuggaauuacaggcguuuaccaccaugcccggcuaauuuuuguauuuuuaguagagacgggguuucucccauuuuggccaggccagucuugaacuccugaccucaggugauccaccugccucagccucccaaagugcugggauuacaagcaugagccacugugcccagccuucaucauauaauucugauaucuuuguuaucuggguauuggcuucuauugguuguccuuuucguucauuuugagguuuuccugguucuggacgugaugagugauuuuuuauugaaacuuggauguuuuuaguauuauguugugugacuggugaucuuauuugaccuuuuuauuuuggcuguuucucaaagggagagugugcugccuuaaugcaauaugagggugcaaguaugaguccccauauggcaugaaguacaggggguacaagugcagguuccccauuuagccuccauugacacuugaaggauguuccucuuaauugcuaagcuggggugggaguucuggcuccucacuaggcugcuacugaagccucucuaucuagaaggaauaggaguaccuuuuacucuccccacauggucuccacugagaccgcagggugcauuggggugcugguggugguuuauuaucaccuggcuaguaugaaaguccuguucucuauauggccuucucugacaugaaccuguuggagggguugagggaguuggaaaaucaaguucuuugcagacauggguggggccacaguuuuuuucuguaguguuugguuggaguagaguaauuauugucuaaaaguuuucuguguugcacggcugugcccuuccugguccuuugguuaaaaagagcaggcuuuuguuggggauuuuuguuugugccugugguguuucuggauuacugacuucuucauuuccacccuccaaguguggguuauaagaggcaaaaugaaaauccagagaauucauuaccauguuguuuucuugguccugaggucucuagccagucuauguauuuuuuccuuuaccuuuuggggucuucugagguuuauuuuauauguaacauaagaguuuuuaguuguucuuggcaggaggaauagggacaaguaugucuacuccauuuuuuuggaagcagaauucuugucauuuuacuuauuuuuuaaaaguuauuugcguguauccauuugauuacgcaagcagaagaucuguaaugguacacaacaaacuguuauuaguggucaucucugaggaaggagguugaagagcuuuauuuuguuaauuuuuauauugucuaaauaaaauugaacaaacuguuguugccuaaggaauagauaacacaaauauauagaguaaaagugacuacuucccuucaguagucccauuuucucucacaaaguuuuguuuaaagcucuccuguauuuuuuuguuuguuuguuuguuuuuguuaggagauacuaucucacucuguuggccaggccggagggcaguggcaugaucauagcucacugcagcuucaaauucucaagcaauucuccugccucagccuacugaguaguugggacuaugggugcaugccuccacacccagcuauuuuuguuuguuuuuuuauagagaaggggucucgcugucuugcucaggcuguucuugaacuccuggccucaagcaguccuccugccuuggccucccaaaaugcugagauuauaggcgugagccacugugccuggccugcuuuccuauauuauuacuaugccugccugccuuuuuuuuuuuuuuuuuuuuuuuggacagagucuugcacuguugcccaggcuggagugcaguggcaugaucucagcucacugcaaccuccaccucccagauucaagagauucucgugcgucagccucccgaauagcugggauuacaggcgcccaccaccaugccuggcuaauuuuuguauuuuuaguagagaugggguuucaccauguuggccaggcuggucuugaacuccugaccucaggugaucagccugcuucggccuccugaaguucugggauuacaggugugagccaccgugcccggcggacuaugcauuucuauacguaaauguaaaugggcuuuuaguuaauuuuguuuguuuucaugugaggacagugccaucacacacacacacacacacacacacacacacacacacacacacucuuuacuaaauauuugggaauuuucagauggaaaggauuauguggcugaaaacuacaaucauaagucucugagugacuuaagggcuauguauaugucauucucuuuccuuguugcauuuuggcccauaacuacaugaaucccugauauuuuggcuucgacucacuguacuauucugucagaaagggaaaaaacuuuuuuuuuuuuaugacuuucuaguuaugaugcuagacaagaugagcuuuugaagcccaguuuuaugacuuuguucauucaugcauucacucauucagucaucaaauauuuaucgagcguuuaauauucgccaaauccucuucuaggugcugaggauacaguaccacaacaaacaaaucucuuuccucauggagcuagggauagacgaacauuaaacaaguacguaguaugucagaugaugguaagugaaagagaaaaauaaagcaaggaaauaaaaaaggagaaaaauaaagcaaugggggaauaugccauuuuaauuaggauggucagggaaagccuuguuaauaaagguggccuuuuuaagaauggugaggagggcagacaugcacagggaacagaaaggaggacaguguggcuggaguggaaugugagagugggagugugguuuaaagaugacaucagagagguaauuguaauccuaaucaugaggaaauuauaagaccuuuggguuuuaguaaguaugaguugggaagcuguuggagagcuguucugguauggaagugacaugaucucaaauugguuuuugagaguagguucuaggggucaaagacagaagcauggaguuaaauguucuuguaauaauucaaauggagagauauuggcaauuuggaucaugauggugauauuagagguggagaaaaguaguuagcuagauuguaaauuuuuuuuaaccuuuaauuauagaaauuuggauauguuuugaaaggagagcuaacacaagauaugcggaugcacugaauaaaagaugugaggagucaaggaugacuccauaguauuuuggcucaagcaucuggaaaaauugggagcuaaaggagguauuggagaagaaaauuaggaguuugauuuuggacauguuaaguugaugauguguauuagacacccaccuauaguauugaguaggcauugguuauaugaguuuggaguucaugugggagguuucaugauuaaugaugucucauguggcuccuucaacauucaugucacaagaguacuugaugacuucacuacuguucauggugugaugagagaaaguugaguagaauggaagagaugagggacugggguucuaaucuuaaauucugugacugacuguuaaugugacuuauggcaagucauuuaacuucccugccugccaauuuucuguaaaauuaaauuaucuaauuaaaugauuuuagucuuuucauccagauauccuuggaucuguaucaaagagaaaguucaggaaaugaugcuauggacugaauuaugucccccauauucauauguugaagccuaacugaugugacuguauuagagauaggaccuuuagggaugugauagaaguuaaaggaagucauaagaguggagcccugaucugauagaacugauucgaagaagagacacuggcaauuucucugcuacgugaggacacagugagaagguggcaguccacaagccaggaggagagcccacaccagaaacugaaucugugggcacuuuaauuuuggacuucccagccucuaaaagugugcaaaauaaauuucuguuguuuaagucaggggucaggccauggaacgguacugcuuuguggccuguuaggaacugggccucacagcaggaggagaguggugagugagcaagcauuaucgccugagcucugccuccugucagaucaguggcagcauuagauucucauaggagcgugaacccuauuuugaacugcacaugggagggaucuagguuugagaaucuaaugccugaugaucugagauggaacaguuucaucccaaaacccauuuuccccaccuucucuguggaaaaauugucuuccaugaaaccgaucccuggugccagaaaguuuggggaccacugguuuaagugacccagugugugguauuuuauuauggcagccuccauagacugacagauuggacuaugggccuuaucuuauguaagccuuagccagccagagcaguucugugaucuguuugaaucucaaguucugaauaagacuguguuuauuaauaagaaaaaaguuugagaacuagugguuuagauguuaaucuaggauuaugugagaguuucuuaaauaguuuguauguguuauaaaaauacaugugcccaucacauaguagguacuuaaaaaauacuuguugaaagauguaugguagguaguaaguaucaacuagaauauguaaugauauuaaugcucuuuuuguauguuuguuuuuuaugggcuucccagcaaaaagcagaaagccugcuagauaaauucuaaaagaacuguaacacuauuaauguuaacucuuuuuuuguuuuuuugagacugagucucccucugucacccaggcuguagugcaguggcacgaucuuggcucacuagaaccucugcuucccagguugaagcgauucuccucccucagccuccugaguaacugggauuacagguuacccaccaccacacccagcuaauuuuuuuuguauguuuucaguagagacaggguuucacuauguugcccaggcuggucucaaacuccugaccucaggugaucugccuguuuuggccucccaaagugcuaggauuacaggcgugagccaccaugcccgaccuaauguuaauucuugauuauugcaaugcagagaauuauuuuaggauauauucuaauugccugagauugaguuauaguagaguuucuaauccugaccccagugaugagauucuuugguugcccauuauagcaaauauguguauuguccaacauugugcugcuugcucuggugguacauguaagucaaaguuucuucccucagggaguaugcauuugaagaacuaugcuuagauauaucaaacaguaaauaauauaauaguacuaaucaagugguaaaugucauaggaguuaacagaagagagaucuuugaggauuguauuauaguagcugaggaacgcuaaacuuuuaaaacagguagaguuugcagacaagaggucucaccgugagaucaugauccugagacagcagagguuagauuuagggauucauuacuaugugggauucuauguuagucuuccacauuccugaggacagucuaugccaguacuuuuuuauugagugccuacuuggugucaggugccaaggauugaaagugaacaaagguuuuagaguauaaugaggauacagacaaguaaauagucaaaggacaguaugauaagaauuuuguuuugcuggaguaucuuauaacuuucuuuuaaaggcuauguggaagaaaaacuaaaucuuugugggcuugaaaauuaccucuuuuuauaauuaucuuuacaugaauucuguauugaaaauauuuuuucugaggaaauuugaaagcaaagauuacuuuuuucaaaauuuuaguauugcugaagaaaaggcuguuguuaguuccauuaucauucuucugggguaacugccuguuuuuucuuuccagaaucuuugagauaugccuguuugcuuuaguuuuuuauuuuguaguuucauggcaaugugucuagaugucauuguguaggacaccuguugggcccucuuagugugaaacuagguuuuuaaugaucauguaugugaaacuaaacaaaucugcaagaaguuaauuuuguucuuuaaugaucauauaugugaaacugaacaaauccacgagaaauuaauuuucuguuuucucuuucuggagcucuugguugaauguugaccuuucuggauugauccuuuaucuuguuuaccuuuucacuuacugccuuuuuuugugugugggauauuuccuuaacuuuuucuuuuagcccuuucuuugacuuuuaaaaaauuuuuaguucagccacuauuuauaauuucucagagcauuuucuuguuuucucauuguucuuucaaacuaauauuccguuuuucuauuauggauaaaauacuuuggaucucuguuaugcuauuuaucagauuuuuuuuuuuuuuuuuuuuuuugagaccgagucucgcucugucuuccaggcuggagugcaguggcgugaucucggcucacugcaagcuccgccucccagguucacgcccguucuccugccucagccuccugaauagcugggacugcaggcgccugccaccacgcccugcuaauuuuuuguauuuuuaguggauacgcgguuucaccauguuagccaggauggucucgaucuccugaccuugugaucugcccgccuuggccucccaaagugcugggauuacaggugugagccaccacgcccggcccagauuuuauuuuacuuuuauuuucacuuuuuuuuuuuuuuucaagacagguucucacuuuguuguccaugcuggagugcaguggugcuaauauggcuuauugcaacugccaccucccaggcucaagugauccucccugcucagcccuucaaguagcugagauuauagucgugugccaccacaccugacuaauuuuuguauuuucuguagugucaaagucuugccauguugcccaggcuggucucgaacuccugagcucaagugauccaccugcuuuggccucccagagugcugggguuacaggugugagccacugugccuggccuaucagguuuuuuuuuuucuuuuuuugaaauuuuucuuuuuugagauggagucucacucuguggccuaggcuugagugcagugguguggucuuggcucacugcaaccucugccagccagguucaagcgauuucuccugccucagccucccaaguagcugggauuacaggugccugccacuauguccagcuaauuuuuuguauuuuuaguggagaugggguuucaccauguuggcaggcugguuucgaacuucugaccucgugauucgccugccucgauuuuuuguugagauggagucucugucacccaggcuggagugcaguggcacaaucuuggcucaccaugccuggcccgcauugaguauuuaauuaaggaucacauugaauauuuaauuaaggaucacauacugcauugaagacucuuuuuucuuuuuaauauaaaaauagacuucauuuuuuuucuuucaugacguuugaagagcucaggucagcuuaccuuauggaauuuccaauagucuagauuugugugauuguuuucucaauccuuuuuuacuguauuaauugcuauuucagugggguuuaguaggagggauaagcaaaugguuuguuucuuuauugucuucuuuauuuauugguuguaaauaugauuuuuaaugaguauauaauguucuaccauuuuuaaaaacuacuuuucucuugcuggugguuuuaauuuuucugucuuuuugcuaauauaaguaaaccugcauugacuauuuuauuauauauauuuguauauauuuuuaguuauuauuuucuucuuaaaaauuuccugagaguauauucagugggucagugagauuguuuuuagaucaagaaccuuaaaacuguucaguuuucucaaaaauguccaaaucacaucagccacauaucagaguccauuugauauauuuauacuauauaggggauguaaauuuaccugagagaaaaucauuugcuuauaaucagucauucucaguguucuacugcuaguguccucauccucuauuaucucauucagggaauuuuuuuaggcuucagaacucauuguuuuuaaggauucuuuaaaauauaauuuuaagugauuggguguagaagccuuuuccaaaaccuaauacuagugugagauaaaacuguagccugaauauuuguauggucacaagcagcuuuacugcauuuuuguaaaauauuccaacaguacagaaaaaguaaaaaagguauuaaguucccuaaagccucuuuucccuuucaguccgucugucuucuuaguugguuccauaccccuccacaucuuauccuauguauuauggacauauaugucauagagaagugugcauauaugcauuuagcacucuuuuuuacacauuguaaacacagguauucugcauuuuguuuuuuucccuuaacagugugucuugagaucuuuuuauguuugcagacagagaucaaucucacuuaagcugcugugugggguugcacugugugaauggauuuuauuuuauauaaccaucgcuguugcuggacauuuuaaauuauuuccaauaugauaauuguucugacauugcaaguuuucuuucuaggaugccaaaaucugaaaacauugggagacugugagguuuuuuauguuuguuuuauuuucaccagcuuguauugcagaaaguagaaguaauguuuuucuaaaauaaauaggauagguauuuuauuucuuugauuuauuaaaaaacacguagucucagcaggguacgguggcucacaccuguaaucccagcauuuugggaggccgaggugcguggaucacgaggucaggaguucaagaccagccugaccaacauggugaaaccccguuacuauuaaaaaugcaaaaauuagccaggcaugguagcaagcccuguaaucccagcuacucaggaggcugaggcaggagaaucacuugaacccaggaggcggaguuugcagugagccaagauggcgccacugcacuccagccugggugacagagugagacuccaucucaaaaaaaaaaccauguagucucuuaaaaagaaaauucuucauggauagcuauuacuacuuaaaaguccgggugcgauggcucacaccuauaaucccaacauuuugggaggccgagguggguagaucacuucaggucaggaguucgagaccuggccaacauggcgaaacucgucucuacuaagaauacaaaaauuagccaugcaugguagugggcgcuuguggucgcagauacucaggaggcugaggcaggagaagcacuugaacccaggaggcggagguugcagugagcggagauugugccacugcauuccaguccgggcagcagagugagacucugucucaagaaaaaaaaaaauucugcauagggccggauaugguggcucaugccuguaaucccagcacuuugggaggccaagaugggagaaucacuuaagcccagaaguuugagaccagccugaacuacguagaccccaucucuuuucuuaauaaaauaaaaauaaaauuucuauauagcauuuuacucuacugauacuugaaauaccacauagcaguucccacuaaauaaugaggcaauacuauuuauaagcugcuuuaacaugauaaaagcaaauuaauauacuaagguaagcauuaaagagaaaaauagcauuuccucucugauucuaaaauuaauaucuacauagaaaaguuaaaaacuuuaaaaaaaguaaucccggauuuuacuccuagaaggcauuauauauauacaccuuuaacauuuuggugacuguucucacagguaguggugcauggguguguguguguuucuauauugagucuagucauauaucauguuaugaguauguauuauuguguguauauccaaugcagucauuuuucuuaacuuuuuuuuuuggagacagggucucgcucugucacccagguuggagugcagugcugcaaucucggcucacugcaaccuccgccucccaggcucaagugaucucccagcucagccgccugaguagcugggaccacaggugugcaccacaaugccuggcuaauuuuuuguauuuuugguagauacaggguuucaccauguugaccaggcuggucucgaacuccugagcucaagcuauccaccugucucagcuucccaaagugcugggauuacuggcaugagccacuaugccuggccaucuuucuuaacauguuuuucacauuugugauacauauacacacacagacauuuguauguaccuauaugaaugauacucuacauguuguuuugcugccuuuuuacucagcaguggacacaaaaaucuuuuaaugccacugaauacagauacaucauucuuuuaaugugaaauguuucucuauuuaggguauaccugauugauucugaucagugaaacgguagaggcaacucucaaauggacuuuggcuauggguaguaaucgguuggaaacuccuuuugaggacauuaacagguaguugggaguuaaguggcuuuuucuggcagacuuguuucuuucuggugacuccuagaauuagcgucaguggggagacagcuugcaguaaucgggcucaguaagugaguuucuuuguggagugugacuugagauaugaagugacaggauuggucagggucuucagugaaagggaauuaggaguguugggauggaacugacagagaaauuaauggaaacugguaaagacaucugguuuaggucagcagagcaacacaggaaaaaggagagccuuaucaguuguggaaaggaaggacaguuuuuuaguuaggcuagcuagggagauggacuucuugcagagguggcuacugaucuguuggccuucaugaguuggguguuauuaguagauagcugcuuuugaaauauuacuuguuauauggaacuuaaaaguaaacacaacacuuguucuuugaucucacaacuuagaguagaauacaggugguuagggcguugcuaguugucuucacuuccucuuuucuuuuuuaagaaaaauaaaagcauucuguuuguacuuuguacuauacuuccuuaaaaagcauucuccagcuuguuagcuaucagccaaucauuuuuuaaagaagacuuuuauuacauuuuucuuuagagaauguguaaauauccuuacuaagaguacauuucuuucuuacuguuuuuugaaagaaucaccaacugaaaaaaaaguucuaaggcauuauuacugcagaguaaccugaacuagagagcuaucaggauauuaaaaaaguaccccgaaugccaaaauacaugagucagaaaaacuuggguccaguucuucccuguugguaauuuaaucucuggagcaaagcuuaaauauugcaugaauaugccuuaaaauaugaaauaugccuuaaaauaacaugacauuaauuaacuuaauaagcuuauugaaugaagaccuuucguagauacuggauauaugaagaugaauaacacauggcccccacccuuaaagaaauuauuauuuagaaggaugagauagaaauauaugcuaaaaguauauggacgguaacaauuaggcaacaaagagggggaauagucaguucugcuuugggauaugggaaugccugaaaaagcuuauuagagcaggugauuuuugagaaguuguucacuauguagcugcagaugggcugggacauggcgguggcaaggaugcucaaucuagucaggaauaucaucgccagugccauagaggacugagaucaugauacuacacauaccuugcuaugguaaugggaagguuguguguggagggggaggagaugaugcuagagagguugucagggaagagguuuaacuuuauccagaagauucuuuuuuuuuuuuuuuugagacggagucucucucugucacccaggcuggagugcaguggcgcgaucuuggcucacugcaaacuccgcuucccggguucacgccauucuccugccucagccucccgaguagcugggacuacaggcacccgccaccacgccuggcuauuuuuuuguauuuuuaguagagaugggguuucaccguguuauccaggauggucucaaucuccugaccucgugauccgcccgccucggccucccaaagugcugggauuacaggcgugagccaccgcgcccggccucagaagauucuuaaauggguaauuaauauuaauaaucagggaaagauuaucuggcaaguagaaggugacaagauuccaguaagagguaucaguuugcagauauuaaaguaaucaagccagaaaugacaugggcccaaagucucaaacuaagugaugaaaaaucaaaauggaaauuaggagacaaaaagauguauuagaaacaagauacgugacugauuuugugugugugguaaaggagagggaagcaucaggaugacuuccagauacugugucuuggagaauuuuagaaaaugccagugccauuugaggagaagcuguuuuaaaaggaauaauuaguuugcuguuugaacaugcugaauuugagcugguaaaggauacccagaaagauguguucuguagguauuuggaucuggaacuucaaaaaaggguuuauaguuaagaaucaagagucaucaggauugaauuguuugaaaccguggaaguagauaugauaaucuaggaauucaagaagaaaaguguggucuggugcgauggcucaugcugguaaucccagcacuuugggaggcugagguggggguaucgcuugagcccaggaguuugaggcaagcuugggcaacaugaugaaacccugucucuacaaaaaauaacaaagauuagccggguguggugaugcaugccuguagucccagcuacucaggaggcugagguggaaggaucaucugagucuaggaaauuggggcugcagugagccaugaucacuccacugcaccccagccugggugacagagggagacccugucucaaaaaaaaaaagaagaaaagugucaaagacagagcaugaacauuuugggagugggugcaaaagaagagcugguaaagaagacugagagggaauggucugaaaagauuccacugauuuugucaguuagauguuggugacuauuguuaaggugauuucagugauguguuaggaauaggaucuaaauuacagaauaggcugggcacgguggcucacgccuguaaucccagcacuuuggaaggccgagggggagggaucgugaggucaggagauugagaccauccugccuaacaccaugaaacccugucucuacuaaaaauacaaaaaaaaaaaaaaaaaaaaaauuagccaggcgugguggugggcgccuguagucccagcuauucaggaggcugaggcaggagaaugaugugaacccaggagguggagguugcagugagcugaggucgcaccacugcacuccagccugggcgacagagcgagacucugucucaaaaaaacaaaacaaaacaaaacaaaaacaaacaaaauuacagaauaauucuguauuguauuagugguauuuaugcauugauuuauacauuuaacuauuauauuaaaauaaaaauaugugauauauauacauuuagagaauuagauaaccaacugucaugugccuacuauacaguuuuuuaaacuuuuuuauuuuaaaauaauuauaaauuaaauuccuauaaaucauaggaaguugcaaaacuaguacagagagguccuccuauauaaacuucacucagcuuccuccagucaccauucaguuuaacaaguguccuggguuaguucagauguuaaugucuugggcuggguuauggaaccguacagggaguguggauguggauucuauaccccuaccugguguaagccuggaguuuugauucucauagguaccuccuucccugccuccacuaggagcagggcagaugcaagcuucuuugcuguuucucagaacguauggguggagcuuuuccagcuccuucuuacauauugggcagcucuuuucaggauuuuggcucaaaauagggauuugacuuguagcccuccccugaaauaagcacaaagauggaucuucuggcucuauagaaccaagauacccuuauagacugccuuggugucagcugaggugacaucucucuggcuuugaguuucuuccuuucuggcaccaggaauuuccuuucccagcuuuucucucccuuuuggaguucugcuguauauucugauuuuuucauguugaucuagcauuucagugauaccguuuggucacauggauguauuaguccagucugccuuguugcuugaauaagaaguccaauaaaguauucuuuuuucuaauaaaauauuuauuaauuguauucugugcuuuguuccacaaaaugauuugagguuggauuauauuauucucuguuuaaaaauauuauuauuauuauuacuaguauuugagacagagucucgcucuguugcccaggcuggaguguaguggcgugaucuugggucacugcaaccuccgccucccggguucaagcgauucuccugccucagccuucugaguagcugggauuacaggcgcgugccaucacaccuggcuaauuuuuguauuuuuaguagaaaugggauuucaccauguuggucaggcuggucucaaacuccugaccuugcgauccgcccaccucagccucccaaagugcugggauuauaggcuggagccaccucacccggccaaaaauauuauuuauuuuuaaaauggguaauauauacauguggucuaaaauuagaaagauaaaaaaaagaguaugcuuuuucuuuucccuauuacccuagccaccccacuccaaugucucuuuauagauacaaccaguuaccaguuucuuacgcauccuucuagagguuaacaaugcacuaguuuauuggguuuuuuucuuuuuuucuuuucucuuuuuagauggagugucgcucugucgcccaggcuggagugcaguggcgcaaucucggcucacugcaagcuccaccucccagguucacgccauucuucugccucagccucccgaguagcugggacuacaggcacccaccaccacacccggcuaauuuuuuuaauuuuuuuuuuuuuuuuuuuuuuuaguagagacaggguuucaccauguuagccaggauggucucgaucuccugaccuugugauccgcccgccucggccucccaaagugcuggaauuacaggcgugagccacugcgcccggccaacaaugcucuaguuuauucuuuaacagaaguuuuaaacuuuaguguuuauaauuuaauuuuguagcugauauucaggauuuuuccaucuguuugagaaguaguauuuucuuuugcuugagagcuuuugacuacagcuuuacacugguuauguguuacauguaugucuuuauauaugugaaugcauuaucuguguuuuaauuuuuguucacaaacuccucagaaugugacagaauaaacuguugauuaggauguuuuaaguuauguggaauauuaaaaugaaacaguagcucuuuuuuaauuuuuaacugacacauaauaacuauacauauuuaugggauacagggugauauuugaauacauguauaucauguauagugaucaaaucagaguaacuggcauauccaucaucucaaaucauugaucauuucuuaguguugagaacauacaaaauccccuauuaaaacuaauggaaagcuucaugaauuugaaugucauuuuugggcaggagccaugcuaaucuucucuguauuguuccaguuuuaguauaugugcugcggaagugagcacuggcccuaauuuuuaggagguaguggaaaugauauuuuaagauacuagaaaucuuauugaaacacguuguagcuauccuuaaaaacuguggccgggugcaguggcucaugccuguaauccuagcacuuugggaggccgagguggguggauaaccuaaggucaggaguucgagaccagccugaccaacauggagaaaccccgucucuaauaaaaauauacaaaauuagccgggcgugguggcguaugccuguaaucccagcuacuugggaggcuuaggcaggagaaucacuugaacccaggaggcggagguugcagugagccaaaaucgcgcacuugcacuccagucugggcaacaagagcgaaacucccaucuuaaaaaaaaaaaaauugcccugauuacuaaccaauccaugccauuguuugcauaugugcaaauaacugcccaaagaaaugagggggucugucaaagauaaaggcuucuccuuuggguuccuuagccacaguuuauaccauugauugccuaacugcagcucggugugaaauucaguaacauggaagcaagaaauggaagccuaugaccuaauauguuuucuuccuuagaucaaccucuccacuucuccuacaccugcacaguuaauaagccguucccaggcuuccaguucuaccagcggcaguauuacccaacagacuauguuacuagggaguacuuccccuacccuaacggcaagccaagcucaaauguaucuccgagcucaaaugguaagauaugagcuaccaaauuuuuucaguguuuaaggacuugagagaucaaaauguuucuugauuugauacaauaagagguauuuuuaauauuuaagaaauguuuaauugugugugugugcaugcgggcgugccuucagcucuuguacauuuaugucaugaaagauucuacuuuuaauuaauaggucuucuugguaucaaauaguaauuauuacauugagaagcuaauagagauucaguaacguaagagugauuauuuuuuaauaucaaauucauugaaaaccuuuuuuucauauuuuaauaucugugaaauuuggaugcauuuuauaacugauggcaucuugguacuuacagugguccauaaaaucauugccuguuuuugucaacuuagauuuggugaaauagagauguuaaaaaaacuuuguuguuaaaguuauaauuuguauccuaggauuuucugaauucuauauuggaguuccggauagucucccagaugauucuuaacuuugguuuuucccaucucaaauucugcaagguuauuuguguucuuguguucauuuugauauuuuaugaauauaggaauguuaauuugguuauucuguauuugaguaucuacagauuuucuaauuuaauuguugagcuucuuuaaggaauauagaaauugguugacauguauuuuauuugaugucuuuacaagaagcuagacaaaagcauugucccuaauauauauuuauauucuuuuuuguccaguggacugaauauauaucuggaucuccaguuuuuguuguuguuguuguuguuguuguuauuguuuuuugaggugaagucucacucugucacccaggcuagagugcaguggcacgaucucugcucacugcaaccucugccucccggguucaagugauucucccaccucagccucccaaguagcugggauuacaggugcccgccaccacacccagcuaauuuuuguauuuuuaguagagacgggguuucaccaucuuggccuggcuggucucaaacuccugaccuugugauccaccugccucaccucccagaaugcugggauuacagacaugaaccaccacaccuggcuuggaucuucaguuuucuaucuaaaauugcaaaguuuccaaucauuuaacucauacuaugcuuuaaaauuagguugaaccauuugagaugguugcuauuuggcuauuuuugaacucuaaaauuagcaguuucauacgggucaaacuaaauugaauaucuucuuuuuagguuuaguccuuucaggguguugguacuggaaauuaccuuuucaggaaaguuauaccauuugucccuuggugucugugguggauuguugccaggcccuacccucucuguccccuagaauacccaaaucugaggaugcucaaggcauaguauuugcauauaaccuauguauauccucccauauacuuuacaucgucuuuacauauauuuaguauaauauaaacaucauuuaaauaacuguuauacuauauuguuuagggaauaauaacaagagaaaaauuuguacauguucaaugcagaugcagcuauuuuuuuuaaaugaauauuguuuugaucuauaguugaaugacgaagcacagagccuuccauagguauggagggcucaucauuguacuuuguuguugaauuuacuuagauuuaguguaccaaagaacugaaguuuaaaaggucacuuaauuggucguuuaauuuucuaauuuuuuuggauccgcauuugguugaacauuuuaauuuagauagcaagaggaacugaauaacccuugauacaauuuugaaauaaaguauuuacacauucuuugaaacaacuugucaaauuuacuaaauugaauugguuaaucucugaguggauuguauugccuuagaaauuaauggcauuuggcugagcaugguggcucaugccuguaaucccagcacuuugggaggccgaggcagguggaucaccugagguugggaguucaaaaccagccugaccaacauggagaaacccugucucuauuaaaaauacaaaaaauuacucacgcuuguaaucccagcugcucgggaggcuaaugcaggagaaucacuugaacucggaaggcagagguuguggugagcggacaucgcgccauugcacuccagucugggcaacaagagugaaacucugucucaaaaaaaaaaaaaaaaaaaaaagaaaaaauagauuaauggcaguuguuugaauauugaaaaaaauugagcugggcacgguggcucacgccuguaaucccagcacuuugggaggcugaggugggcggaucacuugaggucaggaguucgagaccagccuggccaacauggugaaaccccgucucuacuaauaauacaaaaauuagccgggcguuguggcguaugccuguaaucccagcuacucgggaagcugaggcaggagaaucgcuugaacccgggaggcagagguugcagugagcugagaucgcaugacugcacucuagccugggugacagagacucugucucaccaaaaaaaaaaaaaaaagaaaaagaaaaggaaaaaaaaggaaagugauaaguaaaaaaauuaaaugucuuuguuuuuugaugugaagauuuuuuugcaggcucuuuuguuguugaacuuuuacauguguggcauuuacuuuuagaaugaaucuuucuuucuuuucuuuuuuuuuuuuugagauggagucuugcucugucauccaggcuggaguucaguggcaugaucucagcugacugcaaccuccaccuccuggguucaagugauucuccugccucagccucucgaguagcugggauuacaggcaugagccaccacacccggcuaauuuuuguauuauuaguagagaugggguuucaccguguuggccaggcuggucuugaacuccugaccuccagugauccaccugccuuggccuuccaaagugcuaggauuacaggcaugagccaccacgccuggccauagaaugaauauuucuuuacaaauaguuuuaaaaugaaagggcaaccuggauuuguccuuuagauccuuuguagcuaagugaaauauuggaguguaguauguggcauaguuauccuuaugauaaagaggacugaaaagacuuuuuugguguuucuuuuuguuucucacugaaauuuaauuugugucccaaaauagugacuaguuguuuacuucccauuuuaggaauccugccacaguaguucugagcuaggaaaaauuuaacuauaauagcuuauuugagacacaauuuggucugagaauuucauaucaccaaaauauauuuucuuuuuugaguacugcuuuuuuuugcacucaucagaaucaugagcuguuucaaaaauguuuaugauuuuuuuugaguucucuauuaucagaaacuucucuuugucauguagaaccuuuugcugaggagauaauccuaaacugcauugucuuucugucacaaauuucagucucucuugccugcuacacauugugugugggacauguucuuuugucuuaggguauuuuuuugguuuucugucuguacagcugauuuucacacccgcuaccacuguggcugcuguacagucugacauuccuguugucucgucgucaucgucaucuuccugucagucugcagcuacucaggugagcuugucuagcuucauaauguguuacuugagaucuggaucuucagguuaaaguuaagcauugcauuuguguuuaaguuacugaugguuucagugcucuuugucaugcauuucagauugaaauuuaauaaaauacaaugagaacuucaagaaaauguuuuuuguucuauaaaaauuauaauaccauuaaacacagauauuuagguuauuugacauugguuggucaagguuaaugagaguuuuuguuaauggcuuucuauguuuaguuuucucauaaagcagauuuauuucucaugugagauauauucuuuugcuuagauuccuuugcaguauuccuuauguaauaacuaagucaagauggauuuuaaguuugaaagugaauuaaacuagacacauuuaaaauuuaaaaaauuggucaggugcaguggcucaugccuguaaucccagcacuuuuuggaggcccagguaggaggauugugugaacucaggcauuaaagaccagccugggcaaaauaguaagacccggucuuuacuaaaaauaaaaaaaauuguuuaaguguggugcugcgcugcuguaauuccagcuuuucaggaggcugaggcaggaggauugcucgagccugggagauugaggcugcagugaacuaggauagugccauugcuuuccagucugggugacacagugagauuaaucauuacagaaaugcaaaucaaaaccacaaugaguaucaccauacacucacuagaauggcugaaaugaagaagacugcuaauacuauauauuggugagaauguggagcauccagacucucauacauugcuggugagaggguaaaaugguacagccacauguugaaaaacaguuuuacaguuccucuuaaagugaaacauacauguaacgugugacucagcaguucuacuccuuauguuuacccugagagacgugaaaacacauaaagacauguaaaugaauguuuauagcagcgguacucagaauagccccaaaguggaaacaaccaaauguccuuuagcugcugaguggauaaacaaauuuugauauauacuuuuuuuuuuuuuuugagacagaguuuugcucuuauugaccaagcuggaguacaguggcaccgucuccgcucacugcaaccuccaccuccuguguucaagugauucuccugccucaaccucccgaguagcugggauuacaggcacgcacuacuacgccuggcuaauuuuuuuucuuuuuucuuuuuuuuuuuuuuuuuaaguagaaacaggguuucaccauguuagccaggcuggucuugaaucucaggugaucugcccgccucagccucccaaagugcugggauugcaggcgugagccaccacgcccggccucgauauauucuuacaguggaauacugcucagaaauacugaugaaucuuaaaaaacaugauguuuagcaaaagaaccuugguauaagguucuugguauaagggauacauacucuaugauuccauuauaugaaauucuagaacaggaaaaacuauagugaaaaacaaucagauuagugguaucugggguagaaaguaggaggagauugauugggaaggggcaugagugaacuuccaugauuaaggugauguucuguauauugguugggguaguaauuauaugguauauagauaugucaaaacucauuguuuuguuuuauuguauguaaguuacaccucaauaaauuugacaagaaugaauuagagugaguacauuuuaaaugaaaacaauugaguuagaguguuacuuugcaugauauugcuguauucugguauucuucauaaugaauauuuuagacugcauauggcagaaauggguauuuuagggucaucuuuggcuucuuauuuguaauauaauaguucucaaucuucugguaaaaaauaaaaaaugagguaguaauaauauuccuugguauuuuugauaaaaccucuauauauuauuucauuuacaaguaaaggcuaauuuucauguauuaauuuauaaagaugauggucgguuaaauccagcuuucuucuaacuugcccuggcauucucuacaguuaacuuuauuggacuuuuuuucccccguauuuauaaaaugagaacuuuaucucuguuaacuuuaagauuuuucagcucuaaacuuuuuaugucucuguggaaugaauauguugaaguaaugaucaucuuuuuaaauuaauugauugauuuauuuaguuauuuaauuuuugagauagggucucacucugucacccaggcuggagugcagugggucaaucauggcucauuguagccuugaccucccugggcucaagccauccucccaccucagccuccugaguggcugggauuacaggugugugccuccacaccuggcuagucuuuguauuuuuuucuguagaggcaggguuucgccauguugcacaggcugguccugaaccccugagcucaagugaucugccuaccuaggcuucccagacuuuugggaguacaggugugagccacugugccagccugaaauaaugaucuucuuuuuuuuuguuuuaguuuuaugaaaccuaauagagcuagaccaucaucaacuuccagaacauuuuaaauuuuauuuuuucauuuauauuuggcuuuguuccaacuaagauuuuaauucauuuacaaggugcauacaguaaaauaucagaaaguaaguuggaaccauguaagaaaaaagacacaaauaaaacuaggaaaguggcauggagcuaggcgugaaguugcugcucaguuuacauguaugaaguucuguguggacuuaagcuccuacuucagucauuuauuguaugacuuggacaaguugccaaacaucucuaauauucauucauauuuguaggguaaaaggaugaguaauauguaucuuuaguguauaaaacauuuacaggcacucaguaaauaguacuuuuuuuuuuuugcaaaagucggggauaggaagacuuggauucaaauucugauuucagcaacaacauuugccagcagauugauuuuggucaaauucauaguauagcauaguguuuauaauacggacuuuggagccggaaucucugaguucaaauacuugcucuaccauuuuauuauuauaaguccuuaaccucucaccucaguuucaauuauauaaaauaaaauaacauuuauaauauauuucaaaagguugcuaugaggauuaaauauguuaauaaauuaaaauagaagugucugauagcauuuacuaaauguuucauuuacugaauuguuucauuuauuccuuaaaacaacucagcucuauucucggagccguuacuugcagcucagcauuguuauaaggaauaaaugaaacaaaaaguacuuaacauagugccuccacauaagauaucacaagcugcuaacuacuauuuuuguuaugcauugucugaagauaagucacaaaguugguucuuagcuuucagguaacuaauagugaagggagaaaagcaaccacuuaaagaauuuacaggccgggcgagguagcucacaccuguaauccuaguucuuugggaggcagaggcugguggauugcuugagcucaggaguucgagaccaaccuggucaacauggcaaaaccccaucuauacaaaaaauuugcagggcgugguggugcgggccuguagucccagcuaccuggggggcugaggugggaggauugcuugagcccaggaggucgaggcugcagugagccaagaucgagccacugcauuccagacuggguagcaaagugagacccugucucaaaaacaaaacaaaacaaaaaaagaauuuauaguuuccaaggugaaacaaacaaaccagcugcuuaggaaaacacagcugauuuuaacauguucugaggagcacaauuuuucuugcugguacucaugaagaaaacaucuuacuucauauuuaaagguauuuuuaaugugaauagagucaaaauaauuuauaaaaguggucuuugggguccagauugauguguucuaauuaugagccucugugaucggacuuaauucaaagauagauuuuugaggggcuagaggaauggauugaacuuuaggaauuucucuauggauauuguuucucuucucugugcuuuugaaauggcagugagugagucuggcauugguaggugaugcucacacuuaugcauuccagugauaacuuucgucaaguucaagacuguuuuggaaaauuucugcauaacuuuguugaguuuuagaauuauauuugcaguuaaaauuuuuauuuuaauugugaaauaccaaaucugaaguuguauuuuaauauucuuuaagcuauagaagucaguacaacaguuaauuuuuccuuaguauuaaacauucuuauaccauaguguaaaaaugagaaauuuggaauaucucacuuuuauuuacuauguuaaaugcuccauuccuucuccccaccaggcacacccacauaaaaaaagauuuuuggaaagauguuauagggcagaguguguuaagagaugagccgggcauaauggcucaugccuguaaucccagcacuuugggaggccaaggcaggcagaucacuugaggucaggaguuugagaguagccuggccaacauggugaaaucccgucucuacuaaaaauacaaaaauuagcuagguguggugguggguaucuguaaacagccuggcuaacuugcaaggcugaggcaggagaaucgcuugcacccgagauguggagguugcagugagccgagaucgcaccacuacaguccggcgugggugacagggcaagccucugucucaaaaaaaaaaaaaaaaaaaaaaaaaaagaaaaagaaaugaguaagaacucugacccagaggcuggcacaguggcucacgcauguaaucccagcacuuugggaggcugagauggguggaucacuugaggccagaaguuugagaugagccuggccaacauggcgaaaccccaucuuuacuaaaaauagaaaaauuagccagacaugguggcacaagccuguaguccuagcuacucaggaggcugaggcaggagaauugcuugaacccaggagguggagguugcagugagcugagauugaaccacugcccucuagccugagugagacucugucucaaaaaaaguaaaaaagaaaaagaaaucugacccaguaaauccaaagggcuguuuuuuuccucaauucuaagaguauuccccaguaaggcuaucuggggaauacucuuagaauugaggaaaaaaacaacccuuuggauuuaaaagcuaaaaacucagcucuacugucagcaaugugacccucacucuuagggauacuaugauaauugccauaguauuuguuagauuccaguuaaauaauugaugugagaguauuuuggcagggaagcccucuauaacagugugagaugugaaauuagcaaaaauaacucaggcaaaauguagacuuuuucaaaagccagaaaguuuucauaacuugaucaaaggaaagguucagaugaaaugaaugugggacaccagagugcccuaauauucuucuucuuagaaaggauggguuuucuuucaaaagggaggcucugucaaggaaauccguauauguuaucuuuucacuaacagcuaaauuaacuuuguaauauacuuuggcaguguagcguucauguuuggaauuuauuuaaaccaugucaauguuuaagucaaaaugaucauagauauuuuaaccauauucuaaaauauauauguucacauaaauaauauauauacaacauaguguauguaaguauauaaacauuuuccuucagaauuccagaaaaggaaaauuaaaaacaaaaggaguauuauucuauagaaauggauaugcugcagguuucggguucauugugucaaauccuuguuuacugugaauauacuuuucauuucagguuuuucagauuauuacccuuugguuaucauuacuaugcagucuacuuuauagaucauuugugucaaauguuaaauuuuauauugucuuucucuugcuuccuggaagauuuuaaugugccucuucuagauacuuguugauguuuuugguaaacaugaacagauuuuaauguuagccuaagaacacgaugaagagaacuaagugcuuaccaaaaaauuagccauguaauauauauuucaaaaucauauauaggagaauaccucaucuguuaagucugcagcaccgaacugcagggaguauaaaaaugaauguugagaugagagucuacuagcgagucucaguauuucacagacaaacauacauuuaguaauucuaaaacaaguuagauauucaucugugcuauaggccaguaaugacccaaaugcuaugggaaaguuguucuagaaggaagaaacucuuuucuaaccagggacuuucagaauguuucuuaaguagggaaagagggauuuuacugggcuuggaagaauggguuuggcuucaaaagacagcuuugagaaaagauggcauuuagucaagaagugcuugaauaagagcuccaaaugaaggaaguggaagguauauuuggggaauagugagcagaacaguuuggguggaauaugagaacuguaggcuggaggacuagaaacugggggcuugaaguggguuuuggccuagguuguggagggcuuugaguggcaaucugagaaaucuagauucuaauauuucuuuuucuuaucuuuuuuuuuuuuuuuuuuuuugagacagagucuugcucuguugcccaggcuggagugcaguggugugaucucagcucacugcaaccucugccuccggguuucaagcaauucuccugccucagccuccugggcugcugggacuacaggcaccugcccccacaucuggcuaauuuuuguauuuuuaguagagacgguguuucaccaaauaggccaggcugcucucaaacuccugaccuugugauccgccugccucagccucccaaagugaugggauuacaggcgugagccaccacacccagucaguauauuuuguuuuugcguuaaacuuuaauaaugcagugguuauuaguccauuuauguuuacauugguaugaaauauuugagaaaaaucagagaagacacuccauaugguuucaauuagaaaauucuuugaguagcuuagaauagaacugaugaaaaguuuggccugaaguauagcuuuuuuaaaaaauuauuuauuuauuuauuuguuuuuuugagacagagucuugcucugucacccagacuugugggcaauggcgcaauaucuuggcucacugcagccuccgccucccaggcucaagcaguucaugccucagccucccgaguagcugggauuacaggcaugcgccaccaugccuggcuaauuuguguauuuuuaguagagacagguuugccguguuggugaggcuggaacuccuggccugaagugauccacccaccucggccucccaaaaugcugggauuacaggugcgaggcaccacacccagccugagaaaggacagcuuguuuuggagacagagucucgcucuguugcccaggcuggagugcaguggugccaucuggcucacugcacccuuugccuccuggguucaagugauucuccugccucagccuucugaguagcuggggcuacaggugcgugccaccacgccuggcuaauuuuuguaucuuuaguagagauggaguuucaccauguuggccaggcuggucuugaauuccuuaccucaggugaucugccugccucgauuucccaaagugcugggagaagguauagcuuuugagcaucaguuaaugauguagagacggaacacacaugaaacugaagaauguuuuuauaaagcagcaguauaucauuugcuugaucacuucggagucucuuuuauuucaguuucucucccagggccagugcuagccugcauauauuugauacauucauucuagauaggcaagaaguucagcaacuuuuggagcagcauuuuucugucuugcaucuugcuguuuggaaagguuauaaaucucagcugagauuaauugggauaauccuugcuaccauccagacuggcaguauguuucauauagcccugaguguagcaggagccaccauagaaagccauuucagggucaugcagagucuuuucaguucaugagauguaguuuucaaaggcagugaauguucaauaacaccaccaccaaaauuuuacuaaauuaaaagaguugcuugaaaaugcuuuucauaauuuucacaauggggcagaugauuugaugaauuaauuuucuuacaagguuaauguccccuuaaucucuauagcuagaacugguaacuuuuaaaugcaguauguugcagaguaauuuccucauauucacaguucauacauauauaauacacacacugucuguauauauauauacauacugcuuuuauuuaguucuuuaugauccuucccuucuccuccccuucccucccccuuucuucuucccucucuuccuuucuuuuuuuucucucccucccucuuuucuuuucucuuaugucuuuuaaaaaauugccacuuaauauuuaagaugugauuacuuagaauaauaacucuccuuuccuuaaggauuaaucaguucuuucaagugcuuggagcuuuacguaugaaaagcauaauauaaauguguugucaguauugucauaaugguaaugaugaccacaucaauuaaaaccaucuguuuucauccuaauuuucuguuaugugguucuuagguucagaauuuaacauuacgcagccagaaguuggguguauuaucuagcucacagaaugguccaccaaaaagcacuagucaaacucagucauugacaauuugucauaacaaaacaacagugaccaguucuaaaaucagccaacgagauccuucuccagaaaguaauaagaaaggagagagcccaagccuggaaucacgaagcacagcugucacccggacaucaaguauucaccaguuaauagcaccaggugggauaaaacuuuuguugaaaauaguuguauuauucauuuucuuagcagacagagcaaaacaaaggauguucaugacuugaacaggagugacaccuuuaaaacauuuuaaaaugugaauuuuauaaacuuaaucuuaauguguagcuugaaaagagacaaaaaagcccaaaagauaaaauaaauuguaacaauauaauagguuuuuuaaaaucaaauuacauuugauuaucaucuuuaagcacuggucucuccuuauauugauaaaaccuucuaucuuuaaaaaaagauuugccuguaguuuauuuaauauacuucagugggauaauuuuuaaagcuuuuaaaaaagcaguauacuauuuuguuuaaaguuguuaucagugggagaaauuugucacuuugaaacauaggauuaugcauaauuauuuuccuuauguuguugucuuuuucugccuuugauuucaucucugagaggaucaucucaggcaaucaccugagucacugucauucuucucaagcuuugaauucuaccuuugcuuccuuuacuuuauccagauaaucuugccucaugguucucauacugaaaaugugggggccauccagagugagcuuacugucucuucuguucaucucagaauuucucaggauugaauuuuguuuacuuuugauaagauaaagaguuacauguauucuuaaacuuagcaccauuugccccuguuguugauccuaccuuuuuuuuuuuaaauuuccugaccuucuuuaguacauaauuguuacagcgucuuuuaucuucucaugcuagaccuuuuccuuuguuucucaaccauaauuaggucucccuuauucuuaauguagcugcauaguuuucuaaaucacuauaacuauauauuguuugaguguguguguauguguauguguguugcacugggcuauacaccuuacaaauguuucauuaaaaaaaaaaaucugggcgggugcaguggcucacgccuguaaucccagcacuuugggaggcugagguggguggaucacuugaggucaggaguuugagaccagccuggccaacauggugaaaacccaucucuacuaaaaauacaaaaauuagcagggcaugguggugcacaccuguagucccagcuacuugggaggcugagguaugagaguuacuugaaccuaggaggcggagguugcagugagccaagauugcaccacugcacuccagccugggcgacagagcaagacucugucucaaaaacaaacaaacaaacaaacaaacaaaaaacuuccuuuguuccagcaaccucaucggguaagcaucuuuuuucuguccuuuuacaacgcugcuuugcuuuuuaaagacuuguuuuauacuuagguguaaguguaaaauauuccacuuaaaccuauuucacuucucaaguuuccuguguuaauacugccagcauucucuacaucacugaaucucaauacuguggcauugucugauuacccuaguuagaaauuucuccucccucugaacuuuuauggucccuucugguucucuuuccuuuauaguuacuuauauacugaucuuagcuugucugcuagauaguaagcuccuugaggguaagauaauaauauugggcauuuauguaugugugaggcacuguguuaguacuuuacauuaacucuuuaaucccuuuuuggauucaucuuuucauccuuguaucuugacagcacuaaguuguaucuuauacguacuuacguauguuagguaggagguacauauuuguuggauuaauaguucauuuuuuuuucccacuuggauuuugggaauuauugcagucuuucuuauugguacuaauuagguaucacuauacuuagaauuguuaaaucugaaucuuauguaaguaggcuuugauauaauguauaaauuaauaaauauauucaagcugggcgcgguagcucacaucuauaaucccagcacuuugggaggcugaggagggcagaucaccucaggucgggaguucuagaccagccugaccaacauggugaaaccccgucucuacuaaaaauacaaaaauuagccgugcguaguggccggcaccuguagucccagcuacaugggaggcugaggcaggagaauuacuugaaccggggagguggagguuacagugagccggaaucgccccauugcacuccagccugggugacagagcaagacuccgucucaaaaauauauauauauauauucguaguauaguuagacacgaauucuuauuuuuuuuuuuuaaaccucugugugcuaggcgcugcucucuguauggcauaaaagcuggguuuuuacacuacuguacagaguauucucagccucaaaccagcgucuggcuaguuuugacaguguggagcaauggugacccaugguccuuaggaugacugcucagggacaauuucuagugauuccugcaguuuugauaaauuauaaugaaagguagauugauuucuuucuaaagagaacguuacuuucagagaaagccgggaacucuuucaggguuaguucaagcaaggaaaucuaguuuuggauuuuucagucccccuuaacucucaauaucugguucugaauugcagcuuauucuccccucuuucauuaauagugugauaauaugcuuauaguuugcauuccucugauggucaauaucuuguguaaguauggaggaaaccaguaagccaaaaccaccagagucucaggucaguuuuaaguccaaauucagaucuuacauauacuccaauuuuccuugauguuguugauuauaaacaaaccacgcagaaaauccugaacuacuuaaaaguuucuuaagccuuacacugcaguuauucaaagccauucauaucuucuauuaaggcuauagcuauauuuuucaccuuuuuaguuuuucugcuuuuauugguaagaaguuaaucuuggccuggcacgguggcucacgccuguaaucccagcacuuugggaggcugaggcgggcagaucaugaggucaagagaucgagaccauccuggccaacauggugaaaccccgucucuacuaaaaauacaaaaauuagccaggcaugguggcgcgcucuuguaauuccagcuacucuggaggcugaggcaggagaaucgcuugaaccugggaggcggagguugcagugagucgagaucacaccacugcacuccugccuggcaaaagagcgagacuccaucuaaaaaaaaaaaaaaaaguuaaucugaagcgaagauauuuugagauauucucaauugauuauuuguccucaauuagaaaaauguuccuucaagucauuuuaaauguaaaaaaaucuacuuguauucuaauguaguauagucuaauuauuauaguauacaugguuauuguuuucuuauauguauuuuuagggugccaaaguaacuugguuuucuuuaucauuucuuuuugaagguggaguuuccacuugauacauaguaaauucuauuuuuaauauguaaaauaaggucaaacuuuaaauguuuggaaacaugaacuguauuagagcugaaguuuuucuaucacaguuuuuagagcuuuuaugaaacuagcuuaauuggaaaaaauauauacuguuuuuuguagacauuaauucauuguguagugagaagguccuguauuaaucaaucugcuccagcugccauaacaaaauaccauagacuguggcuuaaagagcagaaauuaauuuucucacaguccuggaggcuggaaagcccaagaucgaggucuggcaguguucaguuucuggugaaggcucacuuccuggcuugcagauguccucacauggccuugagugugugguggguggagggagcagaagcucucugaugucuuuucuuaaaagggcacaaaccaugucaugucagggccccacccuaugaccucauuuaaccuuuguuacuuccuuagaggccccaucuacaaauacacauugggaguuagggcuucagcauacgaauuuugugccacaaacauucaguccauaacagggcccuagacucaguuaggaucauagguucuuuuagaccuaaugcuguccuuaauagccagaugauuuugggcaagucacuuaacuacucacaguuucuucaucugucguauguuggauugguauaguacccuaucaccuucaugggguuguuguaguuacugggugaaauaauauguguuacuguaaauaauagaauuauauauauaugugagagaugucagccauuaauucucugaauuuaaagccauccugacaauaagauguuuauuaaaaucagagaaauuaaccaacaugauaggauuuuuuuucccagagcacuaggucuuuucuuuuacagagguauugcuucacauagccaccuaauuauucuguaauauaugugcuuaucaauuggucuuauggacuaaaaauaaacacacuuugauuucugaucaaagaaaaauguaauuuagaugaaaggauagauugcuaaucuguugaauugucacagcucuaagauauaaaaagauugcuuacuuaccagagcauagaaagauuuguuauucuuuuuuuuugagauggcgucucccucuguugcccaggcuggagugcaauggcacgaucccagaucacugcaacuuccgccucccgaguucaagcaauucucccaccucagccuccugaguaauagcugguauuacaggcguguguuaccaagcccggcuaauuuuuguauuguuaguagagaugggguuucaccauguuggccaggcuggucuugaacuccuuaccucaggugauccucccaccucagccucacaaaaugcugggauuacgggcaugagccauugcgcccagccagaauuguuauucuaguaccauacugguacuucaacaguaugguaaauuuaaauuaaagcuuuacuuacaaaauugaauugaagugggcccuugcuguuaugcuugcaaaaaaaucuauuuacuuaucuguaagagggaaauaauaauacccaccuauaccacaggcauuuuguaaguaugaaugagagacacgugaaagcacuuucagccccuuggaugaagggcacgcuguagaaauccaagauuuuguuaauuuacccuuuuugaauacuguuuagcauagucuauaucaacacaguuuuaaaagacugacauaaaauuuucagucuuagugugaaguacuagccuagauacuuauaugaaaauuauuuuguugacuugauuuccuuuuuuuuuuuuuuuuuuaacaauuaguggauauuuauugaacuuuccaaacgccucuuuuuuggauguuaaucagauguuaauuucuuuaaaggauuccaaaaauuuuaaauaauaaccaaaugugaaaauuuuuuuuaaaaaguuguggaaaguuuuuauaaaguugucacaaaugugguugaacacaaaaauagauguaagguauaauauagucuuucuccuaauauuccaagguuaggaaaaaaaaaauugcccugucuuuaaaucuguguuaaauguguguaauuuuuacaugauauuaacauuaagcaauuguuucaguuuaucuucuugugaacucaguuuccauucuuacuuaggauuucaucagcaucucccuuucuauaaacaugugccaccaguuugcagaaaaggcaugauggggggcucccuaccacuugacugugcuaauucuuacauauauuuauuccuguugaguggcuucuuuguggagaaaaccucauacugucacaucaauuauugaaguuuuuuuuuggugagggaaaaggguuaacaaaaucccuuauuuagguagcaugggcuucugauugucucauucucugcaagcaaaacuaguguuuuccuagauuuggaauggccccuaaauuugaguucuuaguuacagugauuaauuaacugugcuacaggauucacacacgucuuuugcuuaaucacauuagauuauuauacaaaauauuuucucuuccugggucaaaugauauauauacccucaucucagcucaaaaauggaaacucauuugggaagcuuuauaaguaauuacccuauuaguuggaagcacguuuagauauggauuagaaaggaugagaucuuuauuuuaugaauuuuaauauaguauuuuuaugauuuugaaguuaucuuuauauauguuauacuuguucuaugaugauacuccucuuuuccugcaaagaagaaauucaaguguauaaacuuugcuaaaaguuaauguagauauucaggugaccuauaaaauauaauaagaacaaaccauguauagauucagauuauuaaguuuuaggcaguuuucuuuuagaacuuaucacaguacaguguauuuuaugauauuuucuaguuuuccaacuauaaauugucauuaaauauucaggccaggcgugauggcucacgcuaguaaucccagcacuuugggaggcugaguugggaggaucacuucaggucagguuucaagaccagccuggccaacguggugaaaccccgucucuacuaaaaauacagaaguuagccgggugugguagcgggcaccuguaaucccagcuacuccggaggcagagacaggagaaucgcuugaaccagggagguggagguugcagugagcugagaucaugccacugcaccccagccugggugacaagagcaagacucugucucaaaaaaaaaaauuuuuuuuuuuucaaauuacucuuguuuggaaaacuuguaauagaauucugaugauuaugaccuucugauaaugaacacuuuuuccuuuagagugauuuaaaaauuucuguauuuuugaaaucaguacuaauugucauuuuuuucucucacagcuucauauucuccaauucagccucauucucuaauaaaacaucagcagauuccucuucauucaccaccuuccaaaguuucccaucaucagcugauauuacaacagcagcaacagcaaauucagccaaucacacuucagaauucaacucaagacccacccccaucccagcacuguauaccacuccagaaccauggccuuccuccagcucccaguaaugcccagucacagcauuguucaccgauucagagucaucccucuccuuuaacagugucuccuaaucagucacagucagcacagcagucuguaguggugucuccuccaccaccucauucaccaagucagucuccuacuauaauuauucauccacaagcacuuauucagccacacccucuugugucaucagcucuccagccagggccaaauuugcagcaguccacugcuaaucaggugcaagcuacagcacaguugaaucuuccaucccaucuuccacuuccagcuuccccuguuguacacauuggcccaguucagcagucugccuugguauccccaggccagcagauugucucuccaucacaccagcaauauucaucccugcaguccucuccaaucccaauugcaaguccuccacagaugucgacaucuccuccagcucagauuccaccacugcccuugcagucuaugcagucuuuacaagugcagccugaaauucugucccagggccagguuuuggugcagaaugcuuuggugucagaagaggaacuuccagcugcagaagcuuugguccaguugccauuucagacucuuccuccuccacagacuguugcgguaaaccuacaagugcaaccaccagcaccuguugauccaccagugguaagcccuuggaagcucuuugacuuucuugcugaacugaaaguaaaaacuauuuuuucccacacuauguuuuauugcaagaucuaaaugccugugaacuaaaaaagcuugaaauuuccaugugucaguauucugacaaacaugcuguaugggcaaaaaaaaaaaaaugccauuguuuguuuagugugguugcaugcuuuauaauuugugaugguaauuaaagucccucguuaauuuuauuacuauuuaaacaaauccaucugcuaucuuuacagaguugauuuuuuuuccccaagggaaugcauuugaaccagugucaucugcacaaaguuuuuucucuuaaggugauuauccuucauagaucccuucuguuggcuuguauguucucaaaacguaugguuuaucuagccuaacccuuuuaguuuuaugcauccuagagucuugggcuuuuaggggauuuuguuucaaguuggagauaugcuuauaugauguaguuuuuugguaaaauuauacuuuguaguugaaauuuuguaaaaaaaaaauuauucuaggagagaguccagcuuugccaaaaauuuaacuguaggccaucuuauagaauuauuaaacuuaaugguuuguuauuucuacuaaggaaaaauauguacuuaaaauauuucucacuuaaaaaugucaaaaaaucuugguagaugaauuuaauacugaggaugaaaaaauccauuuagaggaguaaaaguuucgaauaauugagauuguagugggauuuuuaagaauaaaccucuaaaaacaauuguugccuagaaagaaaaauuaucuugaaaaauacuuuucuuuaaacauucucuaaaagacauuuuaagauuuauaaaacugaaauaaggucucuaauuguuuagucagaaggaucaaauucauaauuuguaacugaggagaagaaucuuccuaaagggagguuuuguauuacaccucauccaagagauuuuaucaccuaaaagcuaauaaauauuagcucagaaaggaguuucgaaguauuuuuuauuauuaauacuuguuuuuucuuuucauacuuggauuauccucaauguucuuuaaugaaaaguauuuugguucucaugauacaaauguauagauuuuuguauucuugucauucuuacugaucuuaauaggcacagagauugaauuauaccuucuguaaauuuuuauuaaaagcagaacuuggcuggguguaguggcucacgccuguaaucccagcacuuugggaagcugaggugggcagaucaccugagcugaggaguucgagaccagccuggcaaacagggugaaacccugucuacacagaaaaauacaaaaauuacccgggagugguggccaugccuguaaucccagcuacucgggaugcugaggcaggagaaucucuugaaccugggagguggagggugcagugggccgagauugcggccugggcaacugagcgagacuuugucucaaaaaaaggaaagaaaaauuuuuaaaaaguuuaucauucaguuaucaugucuauauuuucuuucaauagauuuuuggaguuuacuauggauauuguaacaaaaacagggguauaggaagcguacagcaccuucaaaaaauuuuuaauuuaaauuacuuucucacuaccuaguucagugauuugguuuuuaaccaguaaaaaauaaggcaguuuccaggcagggcauaauagaaaagaaaaaaaauacaauuuaaaaauaaaaacaaacaaaaaaaaacuucuuuauaguccuuauauauuuuuaauuguuuauguuaggggaagcuauagaggaacaaauuugggauagaaauauaaggcuggguguggugccucacaccucuaaucccagcacuuugggaggccaaggcagguggaucaccugaggucaggaguucaagaccagccuggccaacauagagaaacucaucucuacuaaaaauacaaaaauuagcugggcaugguggcgaaugccuguaaucccagcuacuugggagacauaggcacaagaauggcuugaacccgugaggcagagguugcagugagcugagaucguaccacugcacuccagccugggugacagagugagacucugucucaaaaaaaagaaaaaggaaaaaaaaaaaaaaauauauauauauauauauauauauacauauggagcauaauacuuugaaaacuaaagccaaaaauauuuuguugcuuccugcacuucuaccuuaaaacauuuuuggaaguuuaaaaaaugauauuaauaacuuucucugcuaucacugauaugguuauaaugcuugcuauggauguuuccauguuaccuuucuaaauauuuuuuaaucuuuuaccuuucuuugaguaacauagcucuuuaauaauuuauuaagcuuguuuuuuuauuaccuuugaccaaauguguuauuuuuuccauucaaacacauuucuucacagguuauauuuuucugguuguuucaaacacuuaaagguagaaagauguauuuuuuaagagauguggaaauuugaaagauaagggugaauuuucaaaguaaaaucaguauguuuuuuaagauacuuaagaauuaaaguuuuuuguugacauuuggauauaaguauguugaggguagauaauuuagaacuaauaaacaaauauuccucaguuuauuuaggaaagggaaacagaugggaauauuggacuuuauugagguaaguuuggcagucuuuguuauuuuuagaauaguuauaguuaugagcuaaacaguaauugugaugugcaguuuccuaaugaucuugugagugagcaaaaccuccacuuugcuuuuuucaacauuuuaauuguugaacauuuagauuuguuaaugcugauugugccagaugucugugacagauuuguuuuugccuacuucuuuuauucaugcacuuauuucgccuuuauaugagaguucuggaaguacauauaguuagcuuuaaguauaaugaguggaaaguauuuuacaguauuugauggauuauuucaaaauaugcuauuuguguuauggcucuuuucauucuuuaaacucuuguuuuuaaaaaucagaauucuauguaugaucaagcuuugauuucuuaaaagauacucuagcagauguuugaauaacauguaacugcauuaggauuaaagagaguuucagcauuuuaagcaaagaucauguucuuuggaagaaaaguacuaucuauuauacugaaggaaugcuacauagauaaaauugaacuggucgauaaaaccauacuuguuuaauuaucucugaauuaacaucucugacacuaaggcaaauuaaaguauucacugugacagcacuugcccuuggggacuagauuuuuuuucuuaaccccccagacacuuuuuagaaugauuuuaccuauauugggcauuaucaucauuuaaaaaacuguuauuaucaugaaccgaucuaguauaauuguugcuccgaacaauaacaaaugacugcuuucacgucugagauucaggcaugaggcacagaaucucucuuaguguaacugguuuccaggugcaggguugugagcaaauaacuuuaaaaaauguugccuacuuuguagcugauucagaucacaguucugaauuuuauauuugguauaauauuauguuugauauaaaauuauccaguaacaguagaauuuuaaaguuguacaaaagacaaaagaagauguuuuauucuuaguggagccuuggaaagauuuuuauuuuauuuuauuuuauuuuugauugucaccuauuguuaccuuuauaacuuacuguuauauccuuauaggugaaacuugauugucccuuuuacaacacauggguuuugcugguuucagaaauccugaucacuuuuauguauaauuuuauauacuuuaaaacaucagacuuuuaaaauaguuugauuaaaaauguacacaauauuagauguugcugaaagguuucuugugaauguugaaaguuuguuuguuaacauuuguggggcuaggugugcaguggcucaugccuauaaucccagcacuuugagaggccaaggcaggaggaucacuugagcccaggaguuugagaccagccugggcaacauagugagaccucaucucuacaaaaaacauuuuaaaaugagcuggguguguuagugaacaccuguggucccagcuacucaggaggcugagcuuggaggucaaggcugagugagccauaauggagccacugcacuccagccugggcagcagagugagacccuuucucaaaaaacacuuuuuuaaugggaagauuagucaguaugguuaaauaagauuuuaaaaacucauaauuuuuguaaacuuaaguaauaagcuuuauagauaaaagaagggaaaugaacucuuauggcuuuauuuuuaguaaucauuuuucauaaauaaugguuaaguaaauaauaaaugauaacaaauuaaauuaaaauacccaugucaaccucuagaaguguucuuugaaauggaaacauuaauaauaagguauuggccgggugcgguggcucacgccuguaaucccagcacuuugggaggccaaggcagguggaucacgaggucaagagaucaagaccaucauggccaaccuggugaaacccugucucuacuaaaaaguacaaaaaauuagcugggcaugguggcacgcgccuguagucccagcuacucgggguggcugagccaggagaaucgcuugaacccaggaggcagagauugcagugagcugagaucgcaccacugcacuccagccuggcaacagagcgagacucugucaaaaaaaaaaguauuucuaguuacauagcuccuucucagggugccuucgauuccauuuuccuuuuucuuuuuuuugagauggagucucacucuguuacccaggcuggagugcaauggccugaucuuggcucacugcaaccucugccucccagguucaagugauguucuugauucagccucccaaguagcuggaacuacaggcgcccgccaccaugccuggcuaauuuuuuguauuuuuuuaaguagagguaggguuucaccauguuggccaggcuguuguggaacuccugaccuccggugauccacccaccucagccucccagagugcuggauugcaggcacgagccacugcaccuggccccauuuuccuucuuaaguauaaucuuuacaauuggauaacaaggugguuaaguuauagacuuaaaaacuuucucccauaaguauggaacauuauaaaaagaguaaaaaaauaaggugucaaagagcuuaggcuguguguguguguguguguaugcauuucaaggaaagauauuuucuguuugcauauuauauauaaagagucauuagauuguugaguagaacagaaaaggagagauauaauugcguaucuuuuuuuguagauucucagauguuacuuuuuauaauuuaaucuuuaaauuacauaauaauaaggaagagccugggauagaauccuacauguccuaauauagugugucauuguaggaauucgcuuagugugcuuaugaaaaauguuaguaucuguuuugauucaugacaguuagaaguuaacaaaaacaguugaauucccaaaaucguuauuuuauuuguauuuuuuaauuaucgaaauaaaaaauauuuucagacuugacuaccaucuuuuuggaaaccuuggugauuuuuggucuagauacugauccacagcuugcuuucagucaaauauuaugaagaaauaugaaaaacuucauucgagcaauuuuuaaguuuuccuuucagucuguuagaguagucauuuuugccuuguuuuuaaauuuaauacacauagaauuuaauuuucugaaauuaagaacaccugauaaaauauaguuuuggaaacauuuuaaggcaguaugguuugucauugcagguuuaucagguagaagaugugugugaagaagaaaugccagaagagucagaugaauguguccggauggauagaaccccaccaccacccacuuugucuccagcagcuauaacaguggggagaggagaagauuugacuucugaacauccuuuguuaggugagaaaauaccaaaauuugugggaauuuuucuauuugauaaauguuaauaauaggaaaaguugauuuuuuucccuuuccuccuuucacccuuuuuguagcuggaacuacaggugcacaccauuacagcuggcugauuuuuuauuuuuuauggugacgagguuuuacuauguugcuuaggcuggucuugaacuacuggccuuuagugauuuuacugccuuggccuugcaaagugucaggauuacaggugugagccauugcacccagccuguuuauucacuagagauaauauuaaacgaauuuguuaugguaguuaauuguaacaaaauacagauuugaguuuaagguuguuuuuugagacagggucagucucugucauccaggcucaaucauagcucauuguagccccuaucuccugggcucaagagauucuuuugccccagcuuccaaauagcugggucuacaggaaccuuccagcacacuuggcuaauuuuuuauuuuuuagagauagggucucaucccguugcccaggcucaucccaaacuccuggguacaagugauccgcuugccucggcuucccaaagugcugggauuacaggugugagcuaccaugcccagccuggaaaauucuuuaauagcagggaagcucaauagcuuauaaauuguucaguaccauccagaugaaaaccuaucauuucaggcuucuaauuuuuagugauuugugcagacauguuucauaugcucauucacauucaugugucagacuauuucuaguuuaaaaauuagaauaaaugaaaauucuuucaaaagauuuaaauaaugcuuuccaaaaaucaugaagcauucuaagccauauaugauauuccucacaauuguuugugauucagacugaguaagugcuuuuagacauggauuaaaaaaauucuuaccuggacuucuuggugcaugcccggagucccagcuucgucagaggcugagguaggaggaugacuugagcccuggaguuugaguucagccuguacaacagagcaacacucugucucuuaaaaaaaaguucuugugcuuaaccauucaaauucuuauucacuauuucagugcuguuuaugaguucaaacaaauaucccguaugugccuccucacaaagcuacuguguauucuagguauuuuacuaaacacaaauguuucguguuauuuuuuuaaauuuaugaauguuaggauuagagguuggcacacugcucacuguucagaucuuuucugcugccuguuuucuuucuuuuuuuuaagagauagggucucacuauguugcccaggcuggccucuaacuccugggcucauguaauccugccucagccuccugaauagcugguacuauaggugcucuccaccaugcauggcuugcugcuuguuuuucugugguccaagcuaaugauggcuuuuacauuucugaaugauugaaaacaaaagaagaguaauaguucaugucaugaaaauauauauaaaauucaaauuucguuguccauaaauaaaguucugugaaacauagccacacacucauuuguucagauauuguggcugcuuuuuacuaaccacagaguugaauagccauagaaacucuacagccauuuauggaaaguuugcugaccccugaucugaauaauacuaaucuugguuccggcuuuguuguacguauucuguucuguugaauaucuuauugcccucaugaucauuuucaguuaagaaggacugcuacaacaggcauggaaacaaacucuuaugggaccacuaacccugucugccguccaggcaacccuugcucucugcuuucuuuagcgugccauauccccuucccuucuuuucucucgagcuucuauucccucacuacuauuguaaaucucuagagagcauaaaaggggaaauuuaauuuucuuuuaucuuuuccuccuccugaaaaguagaaaacagucaauaaacuuauauaaaauauuuaaggugaguuuuauauuauuguuuuuuuuuuugagauggagucuggcucugucgcccaggcuggagugcaguggcaugaucucggcucacugcaacuuucgccuccuggguucaagugauucuccugcuucaguauccugaguagcugggauuacaggcgccuggcuaauuuuuguauuuuaguggacacgggguuucacuauguuggcuaggugggucucgaacucuugaccucaggugauccacccacuucggccucccaaaaugcugggauuacagacaugagccacugcgccuggccuauuauugucuuuuuauucaaaguaauaccucauaagacuuaagaaaguuuauaguauuaaaucuuugugguuuacacugaaauggauuuauguugcugcggauuaacuggaguuuugauuuaaaggcagaaauguaaguuuuauugcuaaucugucaugagauuagaguuaccaaaaaaaaagucaguuuuauugaauaguaaacuuacauuuuaguugugauuuaauuacaaaauaagcauuacuaauaguacuugaaggaaguuuaaacauuucugaaauauuggaacacaagaacgucuuuccauguuuuccucaggaauguagucugagauccugacaagcacaucucucuggcuaaauugucaaaguacaauguagacuugcaucuuccucuaauuuaccucauacuuauuacucuucuguaauauuugagggggaacuaaagcacagguugauuuuuuuuuuuuuuacaguaacucaucaaaucuugaaauaaacuaacuugcagaaauagacuuguuuccaucugagauucaguuguuauaaaucuuuaaaauuuuuugaaagugaaaagcaucuauacaaaaagguagaaaaaucucacaucucuugcucaguaaaugauacugagaauagacagauuuguggcaaaauuuuaucaguuagaacuuggguuuucucucauacuucucuuaaaucuagagggcguaauaauugucuuucucuucuauuguaauacaugaguguuucucauguuuucgauuuuuacaacuuauguaaauagcuauuaccaucuucaaaaaguuaguaauuuauagcucuauuuugaacaaaauuuaggacuauaaguuuggcacauuuaugcacaugaucuagauauuaauuagaauauacagcaagcauuauuucuugaacaaaccaaauuauacuuagugcagcuuuauauuuuaaaaguaaaguaucucuuaucucuaaaucuguaagggacauuaaaauuuuaauuuagguuucaguucuccauagauuuauuuuuuccauucuauagaaaagugccuuucaguccuacuucagaauuuuuaaaucuuucauccuuuguccccuagaaguauguaugaagauuugguaugugagauaggauuuuugugaaguuccuuaguuugauaauauguuuguacaauuguguauuuguuccuagaaaucagcacauuaacauuuucugcugauuuucuuuucuuuucuuuuucuuuuuuuuuuuuuuuuuuuagcuuuuuauagauugugugacuuugugugacuuuaaacagguuuuccaguacgguuuauuuugguggauuauuuggugaaacuagguuaauuuauggauauaacugcugugaaggcugggcaugguggcuuauaccugcacuuugagaggugaggcaggaggaucacuugagucuaggaauuccagaccagcuggguggcuuauaccagcacuuugagaggcugaggcaggaggaucacuugagucuaggaauuccagaccagcugggcaacaaagugagaccccaucucuacaaaaaucauuaaaaaaauuuauccaggcagccaggcauggugaguggcucacgccuguaauaccagcaauuuggcaggccgaggcggguggaucacaaggucuggagauagagaccauccuggcuaacacagugaaaccccaucucuacuaaaaauacaaaaaauuauccaggcaugguggugggugccuguagucccagcuacucgggaggcugaggcaggagaauggcaugaacccgggaggcagagcuugcagugagccgagaucgugccacugcacuccagccugggugacagagcgagacuccgucucaaaaaaauaaaaauuuuccaggcaggcaugguggcacacaccuguggucccaccuacucaagaggcugaggugggagaaucaccugagccugggagguugagacugcagugagccuugaucauaccauugggcuccagcuugggcgacauguaccuggucuccaaaaaacauauaaauaaauaaaucuacuuguucuguggauuucaugaccccauuucauuuaagcauacuuucaaaguacuccacugccccaccuauaccauuuggaauauauaaauaggaacauaggggauuuaauagcuuaaaauuaagaaacaucaaaacaaaaccaagcaaccauuuuaguauaaauuauuuguaaguuuauaucuuaaaacauuuucaugucucaugggaacaauuuugcuuuuuuuuugagacagaguuucacucuugucgcccaggcuggagugcaguggcacagucuuggcucacugcagccuccgccuccugggcucaagugauucuccugucucagccucccaaguagcugagaugacaggcgugugccaccaugcucugcuaauuuuguuuuuuuuuuuuuugguuuuuuuuuuaguagagaugggguuucaccauguuggccaggauggucucgaauucuccucaggugauccacccaccuugaccucccaaagugcuggcauuacaggcaugcgccauugugccuggcccaauuuguuaaaggucugaauaacuuugagcaagcuacccuccucuauaaaguggaaauaauagucgcuucuaccuuagaagauuauuguacagauuaaaugaggucuuaagguucuuagaacaguuuuugaaaguaccagauauuaacuguuguuauuauuuauuccuuaauucucuuucauuugcuugggcaaaaugcuaaaaaaauuuuuaaaugacuuuuugguuuuuuuuucagagcaaguggaauuaccugcuguggcaucagucagugcuucaguaauuaaaucuccaucagaucccucacauguuucuguuccaccaccuccauuguuacuuccagcugccaccacaaggaguaacaguacaucuaugcacaguagcauucccaguauagagaacaaaccuccacaggcuauuguuaaaccacagauccuaacccauguuauugaaggcuuugugauucaggagggauuggagccauuuccuguaaguagcaagcauauuuguguguguguuuguaauuuauauaacauuauuuuaaaaguuacauauuacuguucucuaauaaaaagcuuguaauuuuauuucaagaaaguuguccauuuuaaucuagcauuuaucuuucuacuuccuuuauuuccaaauguuuauguagaauuuuaugccagcuaaguuuagaugcauaaacuaagggaaaaaaugaaaaaaauuucaggacauauuuuuauaauuuuuagagaaagguaguuggaaguuuauucagugaaaucaacuuuuauauuuuuucuuucuuuuuuuuuuuagacaggaucuugcucuguugaccaggcuagagugcaguggugcgaucauggcucacuguuaccuugaccccuggggcucaguugauucuucuaccucagccaccugaguagcugagacuacaggugugcgccaccgugccccacuaauuuuuguauuuuuuuguagagacaaggucuugccguguuucucaggcugguuuuuaacuccuggggucccaaagugcugggauuacaggugugagccauggcauggcgcucggcucauuuuuucuuuuuaagggaacugaaaugacagcugaaguguacuacuauuuuuauuuuuauuuauuuauuugaguuuuugagagagagucucgcucugucacccaggcuggagugcaguggcacuguuucagcucacugcaaccucugccucccagguuuaggugauucucaugccuuagcuaccucaguagcugggacuacaggcaugcaccaccacgccugaccaauuuuuguauuuuuaguaccgaagaggggguuucaccaucuugaccaggcuggucucaaacuccuggccucaagugaucuaccgccucagccucccaaagugcuuggauuacaagugugacccacugcaccuggccauaaaguguauuauuuuaaaucaucugaaguuacaucugaagcuacccaauugaugguuuguaauuagcaaauauauuuucucauuccuaaauuucagccuucaaucauauuuuucaaaugcuuuaaaaugucccgcucaaaaugaagguccucuaucacuacaggucuuacaacuugaagcuaagcuguacauaauuuguaugcuaauaucuagagauaaacauuuuuccuuagaaaauauaucaaagacaagcauauauaaaaauaugaaaaauuuuuugaaggccuuuugagucaucuggauuuucagauucaugggugaaaaucuugcauuaugauagauagcuacccaaucaguuguuuuuguguucaauuucgugugugugugugugugugugugugugagaaacuuggauuuccuauaacaauucucauacaguggauggaggaacagucuuuuuucccugucugcuccauacugacuggguaaccuuugucaagucauucaaacuuucugaucuuuauuuugcuuauuugucagguggagacggugcuuugcucuuagaguugucgagagaacuaaaugugcauaaauuauucuguaugguaccuggcacuucauggccauagccauuauuaucuguuaucacuagugagagccauaacuuuuauuuucacauuauaaaacuaauacauguucuaaauggaagauuugggaaauguacagggcaaaugauccccauuaauaccacaauauguuuaugucuauauauaccacaguacacauuaauaccacaguauguauauguguauacauauguauugugguauauauguacauauguauuguauauauguacauauacauacugugguuuuaauguauauguguuuguguauauaauguauauauguuauagauacauacauauaaucaagauuaugguacauacaguucuccuuucacugaggaaauuugaguauuuucucauuauuaauaguauuggaaacauuuugaaagguuacauaauauuucacuuuaugaacauccauaauuuauguaaucuuuccauuauuguuggacauuagguuuccauuuuuucacuguucaaauaguucugaaaggaauaucuauauauauaaaucauacacauuuuaaauaaguuucuuaguaugaauuccuagaaauagaguuauuaugucauauuacauagauauucauaagacucuugauacguauugcugaauuauuuuuuggaaaaugauuuaaauuuauucaucugugagaaguguaugcccuuagcauugaaugugaguuuuucuuuaagcaauaacuucuguaaauuuuaauuucacuugaggcauauuaaauaucuaacucaaaugaacaaaauguuuaaaaaguuugugaguaauuauacucuaaaguuaaauguagaaguuucuguccaauaagcuguuguuccccauauguggcagauauuggagacuuaaccagcauucuugaggaauaagauguucuagucauucuguuuuuuaaauuagcugagggcucaccagugaaucaaugaauauauuugaucugaguuguuuuuguugaaaauacuucuaaaauagguaguauuccugaguuaaccaaguauacugaauauaagugaauauuuugauguuaauuuguuaauauuugaggauuuuccauuucuuuugugauuauaguggauuaguuugcuaaacuaggauucaggagacuugaguucuaguccucauucuguuuuuguaaacaaaucaccuaaacauuuugaauuuuaguuuucuuauccagaaaauacauccaauaauuuugucuugaucauuaacccuacaaauaaaaagcuuugugcaugaaaaaucuuaauuaguugaggauacuggcaugucagcauuuacugaugaucuuuuguuugucuugcauucguauggaaaacacuaaaauuggccgggcgcaguggcucacgccuguaaucccagcacuucgggaggcugagguggguggaucaccugagguugggaguucgagaucagccugaccaacauggagaaaccccgucucuacuaaaaauacaaaauuagccaggcgcgguggcacaugcccguaaucccagcuacuugggaggccgagacaggagaaucacuugaauccaggagguggagguuguggugagccaagauugcaccauugcaacaagagcaaaacugugucucaaaaagaaagaaagaaaaaacgcuaaaauuuauaaaggaaaaaaguuagucuccacaaagaacuugagagagaauugcuuaauugaguagacuuuuuaaaguuaaaaaaaaaacccaacucuuaaauauacugacaguuauugccuuuguuuuucaguguuggacugagcuaccaaaauauuugcagugcaggauaacuggaugauuaguauuaauucugaagauaaagaauugcugaauauuaagacuuuuuuuucaaaaacuccuugccuaaacucagacaauagguuccauuugacagagacuuugaagcagcuguacugcuggugaccagaaauaaaccauucauguccacucugccucaucuuuucccaaggaauaaggcacuuacuaaauggaucugaucaguugaacuaguaaauuaucacaaauagguuucauuuuaagaguuuuuuaaaccaaaguauuucugaaugucuuuuuggagauuguuucauuuuauuauuucuccuuuuuuaaaggugagucguuccucuuugcuaauagaacagccugugaaaaaacggccucuuuuggauaaucaggugauaaauucaguguguguucagccagagcuacagaauaauacaaaacaugcggauaauucaucugacacagagauggaagacaugauugcugaagguuuguggguuucacuuaagauacccuuuaauuuaacuuugacuuuuacugcuuaaaacaggauguggauuuuuauucuguacagaauuucacuggaaguauucaacuuuuauuuucauauaaugcaccauuugacuaaaauaaugggaaagcuaaucagacucucaauggucacauaacuaaaauagcaagauuagugcuaauuucuucaaugucaguuugacuuuugaaggagugugagugggaaaaguuccaucauaugugagagaaggcaauucagaauuuuaguaucaaaacaaucaauuuucuuucuuuuuuaaagcagacuuaaguaacaaaugaguauuuuagugaguuagcuuaaaauuuuagagcuucuggguuguuucguuucagacuuucugcaugcugauguuugacaucagguggauauuauaauuguauuaaguauauacucuucauucaagaggugguuacauuuguucaacgagaaaacuccuuuuuuauagacuuuauucuaauaaagaaugaaauaaggccaggcacgauggcucaugccuguaaucccaacacuucgggaggccgaggcaggcagaucacuugagguuaggaguuugagaccagccugaccaacauggugaaaccccgucucuacuaaaaauacaaaaauuagccaggugugguggcaugcaccuguaauaccagcuacuugggaggcugaggcaggaguauugcuugaaccccagaggcggagguugcagugagcugagauugcgccacugugcuccagccugggugacagagcaagacuccaucucaaaaaaaaaaaaaaaaauaggccaggcgcgguggcuuaugucuguaaucccagcacuuugggaggcugagguggguggaucacaaggucaagagaucaagaccauccuggccaacauggugaaaccccaucucuacuaaaaaaaaauauauauauauauauaaauuagcugggccugguggugugugccuguaaucccagcuacuuuggaggcugaggcaggagaaucgcuugaaccagggagucggaaguugcagugagccgaaauugugccacugcacuccagccuggcgacagagcuagauuccgucucaaaaaaaaaaugaaauaaaguaaauagaaguccaagugguauccaaaaugacugaaggaaagcaaacaaaaaugaaaaugaaaacgguauuuuauaccuugaauuugcuauuuaaaagcagcaaaguuuuuacuguuuuuugggcugagauucugaauugccguguucuauaggagcaucuuuuugaucauggcccuucaggugauagaguucaguuuaaugcaguagcauuuagaauagucaaggcccuguaguagugaauuaacacuugugucuaaguaauuauccucaauguauuaguauauuucauuaaaauuaauuuauucacuuuacaaauauuuauugagccuauacugugugccuuuacuucgcuaaauuaagcgaaauagcaugcugguaagcaaacuagauacugucuuugcccacagauuuucuaacuuaaaaggaugacaucucugacauuguuagcucuuuauaaacuguugcaacaugugaaucaccguuuuacuucuuauuugaacagcaaggaguauauuaguuuaaaauuugauuuuuacuacuuauucugaguucaguuugauugguuuuaauuugaaagaauguuaaccuugaaaaauuucaaacauucauuagaaucguauaauaaauccccagucacccagacucaacauuaucacccaauuucaacauuauuuugccacaguagcuucauucauuuuguuuccuuccuccauuccuaacccccacccuucuuuuuucuucucucuucuccucucuucucuucucuuuccuuucuuucuccuuccuucuuuccuuccuuccuuccuuccuuccucuuucuuucucucucuuucuuucuuuuuccuuccuucccuuuccuuuccguucuuuuguucuuucguucguucguuccuuccuuccuuccuuccuuccuuccuuccuuccuuccuuccuuccuuccuuccuucuucuuguuuuaaagaaaaucguagucaccgguacauacgucagugugccucucucaaaauaauacacauuuccuuauaaugccauaucacacauagcaaaauaauaauucuuugguguuauauaauaccuggccaauauucauauuucccuaacuuuuuaaagucauuuuauaguuauuuaguuaaaucagguuccaaauaaggucuguauugugccuuuuguuuuugugaauuucauuuccuuuaauucucaaauacugucuuuuaauugcacauacuauuuuaucugagagcauucucaugugaagugaaaaguaacaaagaaugugcagguauucuuuuuuucuuggccuauaucuacaauauguauauaaaugaaaguucuaggcuaaaaaguauuuauaaugugucucccuguguacacaauaggaagaacauggaaaucugcuuaggaaacuuuacaacauauagugugauccucaguuuauaauauaauggacauauaguauauguuagacuauucuagaacaugacagguuauguauguauauauuauuuacauacauaaagaaguaaaauacaauccgcuuucccuccagcagcuuuuaauguaguuuggaacuaggaaucuagggaaucuccauacagaaagguaacgaaggagcuacagaugguauagucacacugaauuauauagacagaauuuagaacuuuaaaacuggcuaagauuauuccuaguuugguggguuuccuauaaaaaugagauuugaagugggucguggauuuaaugcauagauuuaggauaaacagcgagaacauuucagauuagaacacuaaguaaacgcacuaagaauguguaagugcuagguaacuucgagagagggcagugaagaguagaggguuggauuagagggguagugggaaguaugacuggcagagugaguuucuggagaaccuuggauauuagacaagcaaguuugaaguuagguggaugguuugaagguggguggauaguacugaagauuuuuaggaagguguuacgaauaaaagaguguuuuuggagacuuugauggccgucuguaggauguauguauaaauuuugcauguaauugacaccuguagucauggcaggaagaggaaggaaaggacugauguucucaaaggaaaggacugauguuaucauaucagcaggauaugauaucagaguaaggaaaggaagauguagagauaauauauuucauaggggagaaauguuuacauaaaaugugcuaaaauuuuaaauacuuucuaguuuuaauuucccaagguaauuuuauaauuuucauguuucuguuacuauguacuucaguguuuauaggaaguacuauaguguaaaauggugaggucacuuauuuaguggcuuugguuuuaguaguauauauaguuucaacauaaaaaaccucugguaagcauauaaaggauaaacugugguucucuuuagacugguucuauaaugagagucuccaaccaguagauugugauucaucaaaguagcuuauggucuuccuugguauaucuucacacugauuaugauuuccaucucauugccucuuuuugcugcuguccucaugugauuucaggucuuugggggaaauaaaaaauaacuuccccucaugccagaaaaugggggaucuagauuaggaagcagguuuggccacuucaguagagauccagaauaauauuugauuaaagaagauaggaauuuaauuuucucugacauaacccaaagaucaguccagggcuuaugugguaguuccuuaguauugggcacucaagcuccagggucuuaugucucugucaucuguagaauguuacuuuuauuuccaagauggcugaucuucaugaucacauucuaaccaaugagaugggggaaagagcaccaucuggaauuugugagcauuuacagucauaugccauugguuacaaaucagccacaccuagggcagaaacuuguuuuuaaucuggguggccauguucguaggguuuuguuacuaugggagaaaagcaaagaguggaugcuggagaauuaccagcugucucugccauagaaucccauuuuuauuagcuaaaucagcaguuuuaaaaaaguguuuuggcaguuuucuaauucauaaauguaaaagagugaccuugguaauauuaccaaauuuguuaaaaaucugacugaacauuagaacaagaauuuuugaaucuguuaaugucccucgcuucuuuaugagaaauaaaacuuauacuacucuuauuuuuguucgguuaacuguaaaccauuucuguuugguauuuccucucugucaccaacaaaaacauuuccuucuccuucauaagguauucugacuuaauaucagguguuggacauugcuauguuaauuaacaaaagaucuuugaaacaaagcuuuuagcauauccuguuccuggaauaacccugaggaauggacucuuucagggcuggaacuaauggcaguggugguugagugagaaguucugucucccuauaggcuucucagucagaucagauuauaguaagaucagauuauaagcaugacaaaauaaaaacaguacuucuaggaauuauguuuucaggucucaggaauguguugguggaucuccugacugggccguuggaaggucauuggaaggggcaauuuuuaauuuacuuguuuugagacuguuucuuccucauugcuacuaaauugaugacuuuugcuuaugaagguaguccugagaauuuccuuaaacuggucacgugucaguucaugauuucauuauucaggauaauguauuuggaugccccaccaaugucaaauauuaauucacaguuuguuuuuuuaguaguucuugcuacuucacuuaauuuagcacuuugccaucugcuuccccaguaaaacugagguaaugugaguaccugagcucacugaguacaugccacccaugucuacauuucugaguccuuguauuuaucuuagucuuuauuaaaugaguaacauagaaagagcacacauauggaguucacagcuaaaagcuuuaguuaguaaaaugcuuuucaguaaaaugcuuuuguugcuuuuuuuaauaugacuuggcagaggaauuaugaugaugcaagaaaauggcaaaaugugguugauuuaagaauuuaacaaguuuuaccaaaguauuucuugagcgcuauuacaugucauacuacccuuuuaguucuuauguggaaaauaggaaauggaacuaucacuuuuaaugccuacuaccuuuugggcacacauauaauugccacuucaauucuuugggaaauguauuauaaaccccauuuuacagaugagaaaauugugggucaugaagauuuaguuguuugcuuaugggugacuccugccgaguacccggggauuuagcauggaagggucuuugcgcuuuguguuacugccugaagauaguuacauauguaggguggaagaaggacauucuaacuuaguagggagcacccauuaaguuaaagaaaagcaugaugaaaaaaagcaucagugguugggaauuaugaaacugauuuuuaagccuaguuuuuauuuuaaugcaauauaacuaaaaggaacuguuuuauaauuagauauaugcaucuuuuuaaagaauuuuauguauguauauauauguaugaaugagauggggucuugcuaugcugcccacacuggucucaaacuccuugucucaaacgauucuucugccucagccuccugauauaugcaucuuuauauauuuuaucauauacugcagaucuucgagagaguuaauuauuuugcaugcuccuguaaaaucagacauaucacaauuucaccauuuugaagccaucuuuauucucuccaguuagaauuaagaguucccugcuauguaucuccacagugcaauuuaucaaaauucauaucccacccucagcuuuuugaaaguguuccuccuggaggauaaugccuauguuauucaucuucauuucucucccaguguuuauaaauaauuuuuuuuuacauuuuagauggauuguaagcaagaugaaccuuuuaaaauguuaugcuuauuuauauagaaagaaacuccuuguaauuuuuaugcagaagcaagagggaauuaguagcagugguuguguuuugaaggcuuuugcccugccagaguggcuguggauugaaaaguuaaagggccauugguuugcuagcaguauccaaccaaaguauagacuuaaagaaaauuugcauaauuaaauuuuuggaaccuuuuuuuccuuuguuuccuucuuuuuuagagacauuagaagaaauggacagugaguugcucaagugugaauucugugggaaaaugggauaugcuaaugaauuuuugcggucaaaacgauucugcacuaugucaugugccaaaagguauuucugugcucuugaauuucccaaaggacagauaaauagccauugcaacuaaaccaaaaaacccuugaauagcuuaccaaggauaacuauagauauuuuaauauguaauauuauagaagaaaccuagauauuauuauauagaagaauaauacaaauaggcaguaucuggagccaccuaguauuuaguuacuagauuuugcuuugcgaaaauuacauauucauaauacuuaaaaucaauuguacaguauaaucuaauauuaaaguaguaaucuccugaugguaagaauauauuuaggagaaucccuucaaugaagucaucacgauuucaucaugauuauauaauacuaguccuuaaaguaucaaaaacaguauuuguuuuaucagcuguuuuaucauuauugaaauacuuugauuuacuuuguguuguuuuaaaauguuuucauuuguuugaaucauccuauuuauuuuagauuucuuaugggacagcuguaguauaaauuccccacacuguuaacauuaucagacagcaaaauacuugucuuuucugaauuaguauuuucaauagucauuauuucagauaaguaguauuuuuuuguuuguucguuuguuuguuuuuggauauagagucuuacucuauagcccaggcuggagugcaguggugccgucucggcucacugcauccuccaccacccagucucaagagauucuccugccucagccuccugaguagcugggauuacaggcaccugccaccaugcccagcuaauuuuuguauuuuuaguagagaugggguuucaccauguucgccaggcuggucucaaacuccugaccucaggugaucugcccgccuuggccucccaaagugcugggauuacgugugugagccaccacgccuggcugauaaauaguauuaauaacaaaauaaauguuuagucucuucauuaaucguauaauucccaaguuugguuuauguuaaagaaccccacccuaauuccaguaauaaauccuaguaauacagauacuuaccacuaaaguugaagugugugcacacuauuuugaaauugguucucuguucaaaaagguaauuauucuuucaaaggauuuaagaucuucaguaggaugacuauagcuuguacuguauuucaaaauagguagaagagaauuggaaugguucuagcaugaagaaaagacaaauguuuaagauguggauaucccaaguacacugauuugaucguuacagauuauaugaauguauuaaauuaucacacauacccuaaaacuauguacaucuauuaugcauccauaaaaaauaaauaaccuuaaccucaugaaaaaaauuaauauaauugcauacaucuagggaauuucuuacuugaauauuuuauuucguauagguuauuuccaaaauauacuuaguaaaacuuaaguuaaauaauagaaguguuuuccuccaaaauugggcucauuguuuugguugucaaucuguuuuucaaauaugcuuugauguuacugauaaaucaauaaucaaauuauguaacucauguuuuaacuugaguuuucuaguuugcauauaccacaagaaagaacaaugguuaucugauucuaagugauuuaaaaacucuaaaaauuuggggaaaggacucccuuucagaauauuuuaaacuucuugacuauuuaaaaauauuugagaacacuuaaugcugccaucagucuucucucagagaugauugcugagcugucacauuaguauccuuucgaugaaccucuuuagcaggguaggggcccuaacagggaaauguggaugagagaggguagauuaggucagggaagaaccauugccauuuacaugucugccuagcugucuuggaaagcuaaauauuuagggacaaaauaucaaguauaaagcuagccucuuuucuauucuuuucuuaacggauaaagaaguuuuaucaguugauauaaauggaaaucagaaaccuacauugcugagcccacaaaugagcacauuaugaacacagcaggaucucgaauuguuuuaggguaaaaugaauuggcuaucaagauacuuauauuuuuaugggaaaaauagcauauucauuaucauaguacuuuuuauuuccaccucuugauaucuuuauaaaauguaggugaggagaauuuguuuuggugucagcauacugguucuagaauaguuagcaauagcaaaguuaauugggauuuauucuuguaacuuucuuggagcaaaggaauuuugaaggguaggugugguggcacaugcuuguaaucccagcacuuugggaggcugaggugggaagauugcuugagcccaggaauuugagacccaccugggcaacauagugagacccccaucucuacaaaacagauuuuugaaaauagguuaccaaggcguuucauauauguaaaaaugaaacugcauauauuuuuccuagcuuugcauagcuuuucagaaauuuguuucuuagaucauuucuucucacucuucuuucuagggaaagguuggcaaacucacccaggccaggucuuucccauuguucauuuuuuuguaugggcucaugagcuaaggaugauuuugaaauuuuuaguuuguugggaaaaaaaucaaaauaauauuucaugauacaugaaaauuaugugaaauucaaauuuuacuguuauuguuacugaaaauuuuacuagaacacaaccaugcuuauucaauauuuucuauuuauuuuuuauuuuuuuauuuuuauuguuuugagucagggucuggcucugucaccugugcuggagugcaguggcgcuaucacagcucacuacaaccuuggccuccugggcucaagccauccacccaccuuagccuucuaaguagcugggacuacaggugugugccagcacaccuggcuaguuuuuguauuuuggguagagacggguuuucaccguguuggccuugaacuggucuugccauuuacuggucuugaacucuggagcuuaaguaauccacccaccuuggccucccaaagugcugggauuacaggugugagccacugggccuggcucaggguauuuucaauggcugcuuucacacuacaguggcagagguggguaguugugacagaaacuuauauggcccaugaaacuuaaaauauuuaccaucuaguccuuuguagaaaaaguuugccaguccugguuccagggcuuuaggauccauuaaaagacauaggauucuuuuaagcugucaucaugucuuauaaaggucuauguucaaaaauacuaggcagucuauugugauaaaagaaaaucuuucauuaaagaguuauauacuucuaaauuuucugaauagugagagcaaugaauuccuuguguaacuuuaaaaucuccacuuuacauuuucauucuuugauuuuaauaauauuugaaaaaucuuuuguuagcugcuugagauccucucccuaguauauuaaacuuuuaaaaauuaaugucucuuuggaaguuauuacuuagaaaaaucagauugaauaaacauuuagauacuacauaacuucuuuuucuuucggaaccuuccauuuuuuuuacugcuaugaaaauugguuauccucuguauuuugcaggcaguuucccacugucaugcuguaaucaggaaaaaauacaauaccuuguuauagauguccaguauuauauugagagauauauuaugguauacacagagccuguuuuuugaccuuuagcauaaguaaauccauugaacaguguaguuacuuuaugaggucuuacauucauuaaugauguauugugguacuuacugauucacaguugcacuuuaaagucacaauuaaauacuaaauggauugucccauauaucauuaaauauuuuuucuuucuugaauuucuuagguacaauguuagcuguucuaaaaaauuugcacuuagucguuggaaucguaagccugauaaucaaagucuugggcaucguggccgucguccaaguggcccugauggggcagcgagagaacauauccuuaggcaggucuguauaaaccuugcuucaauguaaaauacccuuuucagaaaugcaaggaaagugcaaugcuguauuuugcuuguacuacauuuuccagcuuccaauuacuuauccaucugcagaagaagacuuggcuucucaugaagauucugugccaucugcuaugacaacucgucugcgcaggcagagcgagcgggaaagagaacgugagcuucgggaugugagaauucggaaaaugccugagaacagugacuugcuaccaguugcacaaacagagccaucuauauggacaguugaugaugucugggccuucauccauucuuugccugguauguaauucaucacuuuggccuuaauauuuuucuugugcauucacacacagcaauguuagauacauccacaccuuuugcacaaaagggcuagagaaguacuguguauauguauaaauaaaaugacauuuguuauugaaauaugaucuguuuccucuugcuuauucccucagcacuacuggguauuuucucauaccccccaagucgauaaaaacugacuaguccugcuucugcugugacaccucagccggugaagauauuaaaggugcuuucuucucuucagucugauuucucucgagaggucaguagagagauugaaucagacacuucuuccuuucugcucuucuauuuuucuauucuauuccuccuuauuuccuaauuuaaccuuuuaaaaaaugaaguaagagagacuuuuuucuuuuuuuuacauuuuugaaagcuaaucaaaaccuuuuaaaauguaaaaauuugguuucuuugaaaaaaucaagcuaguccuuuuaaaagaagguacauucuuugauucuuuucaauaaauaaacaucaagagccuuucugaaauuuuauuuuucaaauagagagcugaaauucaauuauauucauucuaauauugaggguaacuuucuuauuuauguuuuccuguucucucauuuugauacucuuuccaucaccuuaagucucuaucuuuuuuccuuaaaacaacaauaaucuuuuauauccaccuucuccaaggggcuggcuacuaaagacagcugcaccuuugcucaugaugagacccacacuaguuauauauguuaagacuauacauauauguauauauauacuuuuuuaaaucaguaaaucuugucauucacuuugaccuuacgcauauggaaaaugaggagacuaaaacaaaaaauuuauuuccuuuugguuuuauugcgaaucauaucauuucucuugauacaagcuuucuagaagaauacauccuauuugaacuugucuacuaacuuuuuacaguuuaauaagcuaauuaaucagcuguuguugcuaauuagucuuucucugauggcaacuaaagucuuggaagcauacuuagagcuaacaugcuauacaagaaaauauauuuaggaaugauaguuguaaagaauccgucacccacuuuaccucauauacagaauucugugagauuuuguuaaauuaguuuaucaauagcuuguuuuagaaaugcuaaguuuuaaaaaaauauggccacuuuuaaagaaagauggaauuguuuaaaguggagauacuucaugggaagauuuuuaaacaugugcaugugcccacgaaaacuuagaugugaguuaauugcugaccauguggauuuagaaucuguuuuaaacuggguguauuuagaagacagugggucuucauugguugugguuuuaguaucuaaugaaaccaguuuuaguuuuuagaccaguauagcuaucuugagaauuaacuuuggagucuauguggauaccuggggcugggcuuugauucugucaucuucagaaguagugucacucuuccagguagggcacaugaucuguuugugagccugauuuuucauuugggggaaauuuuucuuuuccuuugcagaagagaguugguuuauauccugagaaaaguaguugcccaaauaauuaacaaauauggauacugcugauucuucuuucacuucuuuuuuuauuuaggcuaauuuuccccagcauccuuugccauguggcuacuuuaccagaacaaaggcaaauuccuuugccucauucuugcaucauuugaguuaaaaaaacauaaaacuuaauauuccucauaacuuaaaaugcuugucuuauagaguucaucuagacacuuaauuuuguugccagguauuuagaaaacauuauauaucauaaaaaggacacagcuauuauauaauuuagaauugcuuacuacuauuuuagagucugguuaauaugacucucuucuuuacuuaugaaaugggaguguuuccaaacugcuuugacaggccaaauaauaagcuuauuugugugauuaguuguaucaccuuucucacaguuuucucugcauaaugccuauaguuuaagguaaucucauaccagaaaaugccuuaguguucauuucuuucugcuucucuggacuuuguaaauuucguuuugagcuucuuuuagcucucauuaagcgcuguuuguuuucccugaguagucuacucccaagcuuuucucauaggaugaacaagcuuguaaauuuuguaaucucuuuuguauuuuguuucuuuccaguugagauaggcuuccuucccucuuuaaccagggcauuuauauuuacuccuccaguuuucucuucucuuuguauaucgucuuguuaaccauccuguucagacuauguuagagcuuguaugcaguagaccagaaucucagagcuguuaacagaaugaaaaauuaccgccuucuaauuuucucugcauuaaaaaguuaucuacaggaauaauucuuauuuucaauuuacugcggguuaucuucuuuaaccuuuccuugcuauggugaacugccuuuugcagagaucaguuuguccucuguuuauugaagggugaauccacaguagauuugauuuuucuguaggcauauaaacuaggaaucauuuuuuaaaacaugacuauuuacugguuuuuguaauaucaguauugggacuuguuuauucuguaguauugaguggcaggugauaccuuuucaccaaccuuacuguggucaauuuuugugcaggguguuuuauuuugaguuuagcuggagaagugaugccagacacuugaaagaucaguugggacccaugugcagagguccuugccugugcugagagcugcacuacacuugcuucuggugaggugaagcuagcucagcugacuggcugugucaguugguguauguuuuguacacauccccgggauccaggcauuuuaccaaaguagauguuaaugucagaaacucagaacuuuaucucaguauaccuugagcacuuaaaauuguuuuuaaaauauauuuuucuguaaugagauucuggaagcauacuugcuuccaauuuuucuaagucacuuuuuuuuaaauuucuauacugauguaacuauacuuuuuuugugguuagcuuaagaaaguugugaucuaaaaugcauuccuauuugaucgugcuaauucccaaaacacuuuuuguucuauauuauuuugcuaauacauuuacuguucaccuacaagaggauauuugaagaggaaucucacaauacagaggaacaggaaugugcuacauauuuuccucauggagaacuccuuguuucuauucccaaauguagcucuuauaguucucauuacuucucauugcucuuguuuucugaaucuaaguaagucccacccuaucuuucucucucuucuuuucuuuccuguguucuuguaaguaagacugaagagagaagaacauuaguucuuucauaaaaagaaggaugaagucacaacuagaugcaagauuagucaguuuugucugcccaguuuuguugagagcuaccucugggaaaagaaaaggggcuuuucuauggugaguaaucccauuucaacuauaguuucuuuuauaagauaaaugugcaaaagcauaauaauuucguagaggguauugaaaugucaauuuuucaaagucugagaaauuauuaaaauagaaauugaaaagcuaguuguuauauaggaaacaguaaagauacaaguaacagaggacgugagaaaagaaauaagcaagagaaaaaauggacacacagcuguacacaggaaaaaauguuuguauuacucuuacagauagcucuucuauagcagauuauauuuuuguuuauuguguauucacuaauucaguccuuauugacaaauauuauguauucaguaccuauaaugcuuugugcuuugugcugggguuguaagacaucauaaucuuacauaaacaagaggaugauacauuugcaaguagaaaggauaauugaacuagcaaaauuguggcauccaaaaguguaauguaacuauuuucauuuuucauuaucuuuuucuuuguguuuucccuuagaaugcugauuugaauaaaauagaaaaacuuaagcugucaguuuuuauguguauucuuaaauucaucuuaaaauuuuacugucucucaagaaagcuuccauauuuuuauauucucucaucucagcuacuuaauugauuaccuuuccuauugguuucuuuacccuuaauggguaaguuuauugaguaauuuggaugugaaaauuugguagacaguaaaaacauuugaguuucagguagauacuagcauuguuaccugcuaaagcaccugguuuagacugagagcuaaaauauugguuauauggcaggaaauucgccagcaagcucauaauuucaaugagaauuguuuucuuaacaaaaguggagacaagcccagugauagucaagucaagcagcguaauacauuucagcagcauugcaauagauugguaauacagucuugagaaauuugauaugucccgagugaacaauaaaaauauuuuaaauguacuuuucaagugaaggucauaaauuaggauaagguacaaaugauaaugaaagugguacuuacuugagaaaauauuucuagauuguuauuuaaaugacaaaacauauuuuuguuuccucuuuaccuauaugugaaggauauauuauacagagauaagugcaugagguauaacuaguuaacccaaaccuguuauguggcaugcuuugagguaacaccauaguccuuuuugugaaggaaguauuauaucuagacuucccucuuaugaauuauuucuauaacauuauuuuagagcaagaauuccaagcaaauugcuuuaccuggauuuugaauucuuauuuucagaaugcaaauacucuauucuucaagagugaacucaagacuaccauaaauaaauuucauuuguuucucagccuguauuucagauucucagacccagugagagcauaacugugacuguuaggaguaaugucuaauuguuguauauuuaauucuaacuucuguccucuggucaaauuccaggcugccaggauaucgcagaugaauucagagcacaggagauugauggacaggcccuucucuugcugaaagaagaccaucucaugagugcaaugaauaucaagcuaggcccagcccugaagaucugugcacgcaucaacucucugaaggaaucuuaacaggaacaugaagccuugauaaaacagcaguuuuacuuuucucacaaaaacuuguaagguaaaggccuaacuuggucuagaauaugacacuuauugugguggauagccaagcacauugggaucuccacaucaaauacugacauuucuucuacagguauaauaauucaucaugcauuuucauaauuaauaaacauugguaaaauuaauuuuacagguuacaugaaacauugaaagacuuguuacagagggccaugauauuuuucaaagaaauguguuauacuagauaauuuuuuuaaaggugauguuuaucauuaauauaaagaauccuuuuaaaaguaauuuaaugauuuacauuucuccucuuuugauucaauuuucuuauacauuuuuucuacccuauuaguuuucuaaagguugucaugagagguauauuauggaauaauuuaguaguccagugacagaaucguaugaaaucaguguacauuuuaaaaaacaugucuuuuagacauaugcuuuaucuauaaaaaaggaauuguguucuaguaugaacaauacugaucuggaagugagaagaguuaguuucuauuccaaacuugaccaagaauuugguuugacugagaacguuuuccucucaguuuuuguacauuuauuuagagcagugguucucaguggaggucaguuuugaucgccaggggacaucuggcaauguugagacauuuugguugucacagcuuggggguggguucaggggaggguugcuacuggugucuaguaguuagaagccagagauguuucuaaacaucuuauaaugcacaggacagcaccccuccacuguaaagaauuauugguucaaaaauaucgguacugccaagguugagaaacucugauauagaaggagugauaaauauuguuuucacccaaaggaauacuuuuaaaggaugaagcuuacuaaacauauaugauggaaguauuauucagauaacauuaauauucugcugaauaauuuuuucuaguuuaaucauacuagaaaaagaaaaaaaaucuacaaauuguccuauaaaauaaggacaaacaugcaaauaauuuaacucucagaaaguacuaauucauucugauuaucuuucauaccucugugcuccucugcacugacgaagacauaauaugauuauaccuaugaacuagugcacagccuuuucuggcaagaaaauaguuuguagcagauacgugguugcucuuuggauuuuuuucuauuguugaacaugcugggacuagcuagaaugcacauuccuacuuccuuuaccaaacguuugcaugcuuccugcaaagcacuuaccaagugauuucucuugaaccaucggauauaauuuuguauguacauguuugaggaaaaaaauguaaagcaaaaccuuuuacugaacaguguucuauagaauuaugacacuaaaacaaaauuguuuguggaagcccugaaagcuuuauaguccuggacaucaaaaauuuuauuugagaugaugaauguuuuguuuucaucuuuucuuauauuaccacaauugagauauuuuaguaauugaaggaacauacacagauauuuggcagaagucgaguaaggaggggaaaaaaagaguccgugaguuucagucauuuucacugcucuuuucaaaaagauuguguugagcugguagaagacuaaagaugucacugaagacaucacagauacuauauuuaucuuuuggcuuuguguacauuagagaauguugauuauuuuuauacaaaaauacagcggguaauuuuuuuaaucuuuagaugccucuuguuugaauguaugcuuuguggaauucuuuguguaguaauguuuuaaaaaaagauguuuacugauaguuacauguaggauuagaauauguaauauaauauaaggcucauguuccagaccuacgauagcuuguagucuauguuacguauuucuuuauaucacauuuuuaaucauuggauuaaaguaucaaggaaagcuagguacucuauaaugaguuuucauuuauuagcaguuaaucaucaugacagaauugucauaugcuugacuuuucccucuucuuggaauuucagaacacaaauacaggcuaagcauuaguaagagauggcccacaguaugagagagagaggugcaacggaaaaucucgccuggaauuaaaacuuuucauagauuauccacgguuaauacaaaauuuauuauauggggauagacugcuccagcaauaaugauuacauccuauaacuguauuaccuauggccuuuaagguaucaauuuugaacuguguuguaggcucuccuuuuauuuguucucuuuccuaauagcagccauucuguacuuauugaaagccccugugccuacugcugucuuaaguauucaggaggggcuuacaagaggguuuucuauuggagaauaccguauaaucuuaaaucuaguccagaucucuguuguccccacucaaaacauacacaaaauaugcacuugcuuuuuucaagugaguuuuuauuuaaaaauggcuuguuugcuaucacauuggugcagcuguuucuuucaagaugaguuaaucaucuuaauuucaaagcuucagcuauauauaauggauauauagacaacacugagcauccaccucucuccugagcuuuaaagcagaguuucaguaugauauagguggggagaguaaauuguuuucauauccuuucauacuacuacuaauaguuuuaggauuuugacuggggagagauaaugacaaacagaaagggaacauggagguucuuccuacuuuugcuaccuaaguuugcauuuucugacuuccuugcaguguugcacucuuugucccauugggauaaaaagcauaaguuugaaauuuugcuuuaagccuuguguuccuggggaaguuaaacaacuaagagagcugauuuguaaaaauuauuuuuuauaugacauuaauauucaucaagccuuguguaggcauguguaagacacagcuaugcagcuuugaguagucaauauaguaugagauagaguguugucccaaauccuccugucacuuuuuaaguagcauauuauuucccugaugguccuguuacuuugcuguugaaugcucuaaacagaacuuuuuaaaagguguguuuuaagagcagucaccuaggaguagacaagguggaaugggaggagagaaaugguaaugcaaaagcuugagcaugggaagagucagaggaggaggccaucauccuuguuagcuuagccuacuucaacacugagcacauuucugcacuuuugaagugaaauucauguuuuacuuagaagaaauaauuuucuuucauuagggaucccaguugauuuuuguuuccugguguaucaaaauacuuagaacuaugaaacaaguauuauugugaucaugccuuugaauaauuuuugacguagcuuaucuucauguaucaaguauaaaauuauaaugagacaucuauucacaaauacaagucuuagauugaauugaaauguguuauagugcccugucucccacugacuuguucaguuaaaugucuuaaaguacauuauguacaucuucaggcuuuugguaccacaauggcacaaguaugguagggaggcaauauagucuuaggcuauaugccuauauuaaguguguauaaacaauuuuugaaagaauacacuauuauagauguaugugagugaugcugaccugacagccauauccaguggaugaaacugacuggacacacuguuaaaauguuuuaaagauguauuuucagccagaacagccugguuauaguuugugguuuucaccuugguggauugcaggaacacaugcagccuacuggcauugagcauuagcuaauggcaugaaagggccucaucucacuaccucucuaaggccucuagcuccaagaaaaccaugaaaacuucuuucuuggagagaucuuugucucagaauccuuagagaggauuucguaugggggcuaacuuuaggaagggaggcagcuggggcaggacuuucugauaccugacagucauguuccagagcaaccuuugggcaguggaaacuggcgcaucuaugcaaaaugauugcucaaucucuaucuuguguacuacauauguaacuagcugggcccuaaggaagguuuucuagggggaaggauagggaaguagaggaggagacaaguaggaggaacaaagcauucuagacccaagaggauagaagauauuuaggauagauauggcuuucauccauaguucaaaauaaugcguuuuguuagaugccaguuauagcaguaaauagguuauaguuuuuauaugucaagauuuaccuguaaucagacucauucuuucacucucuauacccacugucuccaugcuugggagcauggauauuaauaguuccagugauguagaaguuagugauuuuugauuucugaaaaaggugagaaccuuuuauuacaguuggagaauauuugucaaaaauucaaagguuguuguaauugaguugccagaauuacagaguuuccauuuucagauaucacaguugaaucaccucuguagauuguuauaaagagaggcauuuuaagauaguauuuuauuugcuagguugugucucagucuaagaauugggaaaagaagagcuauagguuucucuuuccuagucuggauuucaguaaacacaagccuaccucugcuucuuugguucacagcaguguggaucaugaaaugaacuguuuacccacauucaucaauauugguauuuuacaaaucuacuuggagcauuuaauuucaucucaaagauugugauccacuuuagauaagcacaaauacaguauuaggaaaaguaaauaugcaaucuuacuaaaauuucaacuuguuaagcuguauaucuuaaaagaaauuauuuggggcugggcaugguggcucacaccuguaaucccagcacuuugggaggcugagguggguagaucaccugaggucaggaguucgagaccagccugaccaauauggugaaacccuaucucuacuaaaaacacaaaaauuagcugggugugguggcaugcaccuguaauuccagcuacuugggaggcugagacaggagaauugcuugaacccaggugguggagguugcagugagccaagaucacaccccugcacuccagccugggugacagagcgagacuccaucucaaaaaaacaaaacaaaaaauuauuugggaagauacguccucuuuuauuagaaguucauaaaauguaucauauaguuuuguucacaguaguuauauaagcuuucuucaaauaaauuuaaaauuagauuaccuucuuuggaaaaagaauuuccuaaauuuuuaagaauuuucaaaguuuuacauauuaguuuuuagaaccuaauccguuuuaaaauuguacuaugagaaagcuuuuuuuugaaaguuguaaagcauuaauacaaauaauacaaauauaauuauuaccaucacauuccagagaauauggcuuuuucuaaacuuucaauuuagaaaacauacauuaagggagaaucucugcccuccuuuucagcucugaagaucagcuuuucuacucagacacaugcacacaccccuuccaagugucauguuuaugggaacauuugggaaauguuuuccagauguuuuauuuuuucccuuuuauaguuuguugacauuuaauuuuacuuaaagaugacaauuuuaaucggaaauguuagagguacaacauagugagguucuagcuagcuuuauacuuuugaaaaauauuuuuguuucuacugcuuuuuacaaguacuaguccucucagugauacuggugguguucaguaugaauccauagaaagaaaacaaaauuuguuguuuaaaaaaagcagaguaaugaaugaauuucaguuuugaaaacaacauaauuugaaaacacuguuauacuaacauggcaagguguuaauuaaauauaagaguaagguaguaaguucuuuuagagcaccuguuuaaauuuacuccaguaaucaucuuaaggauugauagucaccaucacuuauuggcuuaaaaguuauauuucauggaauauuaucaguguuaaauccaagcuuuguggagcuuuaagugaugguggugaaaaaguugguguuuaugagagagugguggggugucuagucauuagugaaguuaaacaucaaccuguuuuagaaagaauuuuuuagucuugccuaaaguaaaccagaagugucuaguguuuaaaucuuuauuuagaaugcuucucuuaaaaguauuuuuuguuuuggguaguauuaaauaaucaguaaauaaucuauuucaguaguaaauaaugaauuaagaugaugaugaaugaggauuaacacacuggucuggagacugggguuuuauuucaguggguuagcugugugugacauguugggcaauuacucagcuguuuuaacagcuuccagauaugcaguauggugccuguacuacucaaaaguugauuuugguuuaauucaucuuuaagguaccucccagcucuaaaacuaugauucuaggcuguguaaugggguuauuccuacuuuauucucuuuccuuuuuuaaggguucauuuuauacuuaauaagcauccauuucuugggucaccuacagucuuuguucuccuaaggauuaaaauagaaaauucauacauaacaagcaaaugaugacauuuuccuaaaugcuccuuauugguuaaccacugaauauaugaacacauaugaauauugucauucauguacuuaaauucauuuagcaaacuauuugaacacuuacaugugcaguguuuggugaacaugacaugaggaacuaguaguaaguaaaaucuuccccccaaaauucauuguggcuuaaauaaauaugaacauaaucauuacuacuuaauauacugagagggaaucuuaauaaacuuggaacugggagggaauauuuguauacauuggguaaaggguuaggcuagaugacaucuaaggggucugagugaaucauaucauaauuuuuauaacacauuucacauacuaaacaucaguuggccccauaccugauuaaguuacaaaauuuaggagacuuaacauuaaggacuuacagguugagacagcccguauuucacaacauuauuuugacacuugacucuauuccagaguuguugcuauacaaggcauguggcagaacaaaaaaaaagcugguguugauauaagagcuuuuuacccaguauugacagugagcaacuuucuuucuuuuuuuuuuuuuuucuuuuuuuuuuuuuugagauggguucgcucuguugcccaggcuggugugcaguggugcgaucucagcucacugcaaccuccaccucccggguugaagcgauugucuugccucagccuuccaaguagcuggaauuacaggugcccgccgccacaccuggcuaauuuuuguauuuuuaguagagacggggcuucaccauguuggccaggcuagucucgaacucuugaccucaagugauccaccugccuuggccucccuaagugcugggauuacaggcaugagccaccacaccuguccgacaguguagcaacuuucuaaaacugaaaaaucucaaaggagaucauuggaacugacuuguucauuuauuuuuuguuuuuaaauuaagaaagauuacacaaaauaaguguuacuguacuuuaagcuauuacaaauauccaacuuuuaaagauauguaagaaucaguaauauucuagaaagcacauauauaguaaaagggcauccuuuaaauguagaacggguaaacaugaaacaguuccaugcuugaauuguuaaguaucuaggggguaaacauugaaugggagaaucauuuauuggguuaaggucccuuccuugucauucugggaucugugaaucacauuguaauuccuguugacaaagcuuuacuuguuaacaucaguugauacugacauucuccauaaagauauagaaugaaaauaucuauuaaaaauaguuuaucauuguuuuagcuuuuuuguuuuguuuguuuugagacagagucucacugucacccaggcuugagugcagcggugugaucuuggcucaaugcaaccuccaccucccagguucaauagauucucccaccuuggccucccaaguagcugggauuacuggcaugcaccacuaugccuggccaguuuuuuguauuuuuaguagagaugggguuucaccauguuggccaggcuggacucgaacuccugaccucaagugauccgcccaccucagccucccaaagugccgggauuauaggcaugagccacugcgccuagccuguugcagcuuuuuaaagcaggaaaauauccauauaaacuguuggguuagaaucuauauuagaaucuuucaaacuaauugaaaacaggaagacuaucaucuaaguagccagauaaucuggguuucaaaaaguuauuccaugguacugguuuaaaaaauacuuuucaaguguuuuaauuuuuaaaguguaacuaauucuucaaauauguuaugcuguuaaaauauguauuccauaaguacuuuuuguauauguauucuuaaauuuuaaaaagucaacugaaugcgcaaagaugauauaauuuuggauguagacauuuaaacuagauucccaguccucuccuucaaaagcuuggucuuuguuuuuccuauagggaaaaaagucaaaauaaguuccaaaaacuauccucaaaguaguauugugcuuguaguaaaugaagguuggauggauggauacugacaaugguggcaggcauuucaagccuuuuaaauuaguacuuuuugucgucuugcuuauuaaaauuuuguuaauuuuagcaaagaccaauuguugugauaaacugguguuuuuuggaugcuucaagcacacguuaaccaauuuuuuaauuccccuuuugguuccucccauuguucuaaaauaggacuuucauauuauuaaaaccucaaaagaugauccacccaggaugaacaaagaucaccaaggggaaagaaaacauuuuuuaucuuuacagaaaacauguuaagauuauauauagauguauucuuuacauuggauauuguauuagaguccuccuuacaagaaaugaaauaguuuuuagcacucuuagcauuagaguuccuagauugguguugauagcuacaguuuuaaaauguauaaccugaaaaugaagguuaauuuugcauuguaagagcacauuugaucuauguaaaaaguguccauuugguguauuuuuuuaaaaaagagaaagcacuuucauauuaaguagcauguguaugaauuuagauuuucauauuuguugugucuguauucagugaaguaaauugagcauuuaaauguuuguugauggcaacauuaacuauuaaauuaaagcaccuuauacucugcugcuuaacuugcuuguaauugcaccuuuguuaccugcacauuuucauauagaauauuguuguaacauugcuucaugugggucuggauggaagauuagugggccuacaggaucauuuauuuauauuguuuauauuacaauaauauauuguagaucaguuguaaguucauuucuuuacaaauaaaagccucuuccauuugacuggucuauugaauaauuuuuuuuucuuuaagcuuaugagacauggggaauccucuguguaaacaaaacaaaaagcuuagugagguuugaaaugguuuuaaaa

SEQ ID NO: 13596 - RNA, 39976 nt, Homo sapiens
agcuugggguuuuuuauuuuuagagacaaggucucacuccgcucacucuuacccaggcuggaguacaguggugugauuauguaacagcucaccacagccugaaacugcuacuccuggguucaagcgauccucccaccccagacucccaaagcacugggauuacagguaagagccagugugcuuggccaucuccuggauuucugacauugauaaauugugggguaauuuguuaugcaguagauaacuuauaccagggauuugguaaggauguuaaagcugaagucuaaaaaucauuaaauaaucacauaaugcugguauuuucaucaccugaaauauugcauaaaauuuccuguucuacaauaaaacacauuuuucaaguuaguguguaacgaauaauguacuuuuuuuuuuuuuuuuuuuuuugagacaguuuucgcucgucacccaggcugaagugcaauggcacgaucccggcucacugcaaccucugcuuccuggauucaagcgauucuccugccucagccucccaaguagcugggauuacaagcaugagucaccacacccggcuaauuuuguauuuuuaguagagacagcguuucaccaugcuggccaggcugaucucaaacuccuucaccucaggugaucugccugccuuggccucccaaagugcugggauuacaggcaugagccacugcgcccagccuacgaauaauagacuuuaaaggaacaaagaagaaaaugucaaucuuagggaaugagaaaguuaagcucacacacgauacugaaauaacuugaaucaaauuuaauuggcauuaaaaguuuuuauuuaguauuugauccacaaucuauacaaguuauuuacaaggcaugaaaauggaaaacagcacaaaauacaauugagguauaagcucagagcacaguaugucauguuucaauaaauauaauucaaaauuuguaaacuaggugaccagauacaugagucuuauuuuuaguaaaaccauauaaaauauuuauuucacgugagguagaggacaguuuucugugucauguaaugcaaccaaccacagcaacuuuaaccauaaaacuguacaucauuggcaaaauuuuaacuuuaauuauggucaauguagccaauuauuuguuucaacaguugcagaacagauauuucauuuacugccuucacagauuagaaauucaaaaguaauuuaagacuacuauguuggcuuaaaauuaucaggauaaacaaauacuucuaacaggauaguaaaaacaaguaaaauuuuauuucucauaaacuaauuccucaaaagauguccuacauuuagcaacuguuuucuaggacauguuuacuagaacuacuuuaaguaugcugugcuuucuuuucaagugagguaucuauauugaggaaaaaaaucuuauaaauuccuuuuacauuaaacuaauuuaauacacuauuuuguuuucugggcugaauuuuuaaauuuuuuucuuacauuugaucacuuucuaauucaaaaauuguagcacuacauaggacauuuaauucuauuacuaaauaggcuccaaauuacauuauacaguuuagaaaccauuucaaugaauggauuuacaaaaaaaaaaaaaaaacuguccuuuuaaaugaaaugcaauauaaaauacuaauacacuuuucuuccaaaaguggaaaugcuuaaguacccuauacuagaaaaaaaaaauuaggcuguuuauucaauuccacaauguauaauacagcaguuuuaugucccuuauugcugacagcuucgauaaaaacuauuaacaaguaguuccaagcacagaaacagauguacaguaugagcacgauuuuucuuuauauuaauuuuuaauguccuaucauguggauuaaaugcauaaagggcaaauaaaaaugaggaaucuucccuaaguaaucaaaacauaugccuuauugagaagaaaauuuuagaagcugauuaaaauccuucagcacuagcuuugcaauuaauucuggagaaauaccuugacacaucuuauaguauuugaguuuccuuauaacuuuaccuuccuucaaacagaagcuaccuaugugcaaauaaacugguuguucugucaggacuucuaaaagauauggauaaccggcaaauauauacuuuauuucaccuacuuuaauagcugcuuuacaauucgcuauguacaaaugauuuuauaucuuaacugguaauauauuaaauauguuauaaaauuaguucaagaagcauaaaacacccuaacucucaugaacacagaaauucaagcaaaagaauaugcuuaaacaaaaacuaaagcacacagcaaacguaaauuguuggucaaaucuuuucauaguguuauaaguuacauuugugaaauuuaggguaguugaagagcuuccucaauaacagcaagagguuuuacauuuauuaccuuuauagaguagguacacuuuucucauaaaguuuagccuacagaaacuaucgccacccaaauuaaacaucacccaagcuaauauucuuucuuccuucuaaagaugagcuagcaaaacuuuuuauagguugucccuuuaaugcagcuuuuuagaauaaacauuuuuacauuuuuucuuaaaagaauuauuuuuugaagucugaggaaaaauccgcuugccuagugaauuuggcacacaaagaguaacaacaaaucaaacuuuaagcuagcaaccaacacacaaaauaagcaugcaaagaauagaauaaguuuuauauggauaagguauuuuagccaacuccacuuauaagguauuacaaaaucucuauauuguuuugaagcuauguguugcaguuuaaaguuacuuuuaacaauaauacguauauuuacaauugacuuaaaaaacuauuuucaaggaaguuagaaaccuauggcacaccaacgcaucuucuggaaaaugaagacgauacaaugucauguggcaaguuuucaauauaugaaggacuagaaaaaauauuucuuuacucaauucugaauuacaaguucauaauaauuuaaugguguuuaagcacugcuuaaaauuuuccaauaacauauuucaaggauuaagcaauuuauuuuagaaguuuuggguuaaacaaauuaucauuuucuagguaacauaaagcagaaagguuccaagugaauuagaaauauaaaugaaauuauagguguuugaguuugucuuccaaaaagcugagcugugacacaaauaauucaaaauuaaaauaaaacuauaucauaaauaucugauuuuuccuucuccagaucuaaauagauuguauugggagaauaugucauuuuaaauauuuguuucuaaaaauuagccgggagugguggugggugccuguagucccagcuacucgggaggcugaggcaggagaauggcuugaacccaggaggcagagcuugcagugagccgagauugcaccacugaacuccagccugggagacagcgagacucugucucaaaaaaaaaaaaaaaaaaaaaaaaaaaaaaauuuguuucuacaugucauuuuaauauuuguuccuccuugagaagauuccaagacucaacgaauuaaauuagucuuaauauagcaaaauuuaaauggaaaauagaaaacacacauuuagguuauacucaauuuaguaaauaaauuacauuuggggaaguacaaaauucuuuuuggauauguacuauuaagcaaaauaugaaaauaacugguuaaaugacaaccuagugauucuuucuacaccauuagauuaucuaccuucuaugcuggaaauagaauauaaccuuaacccuagcuaauuuauuuuaaaauaaauauagcucucugaaguaauuucauacauaguaucuuauaagagaacaugaaaaacauuuauuaucccauaaaauccaugggguaauaaugucaauuaaugauaguuucaggaaacucccuuuaaaaacagaucuaagaauuuuaccuaauauauuuugagccaagaauuaacaaauaugaaauuugccauuagagaaugacagacuuuucugugcaaaaaaaaagugcagaagauguugucccuccugaaacuauggaauuccuuuaucuucuaaaacuuaucuaaaaaucuuuuaguagcagguaacuaaacuguccuauaugcaccuaucauguacuaucaguugacuguaaauuccugauuuugauauuaaguaguaaaugaaaaugguccauucgugcaaauuuugguaagacaacauuuaaacauacagaaguccaaaauaaccuucaagguguuuaacauuuuacaacuuaaaggaaaacaaguccauuauauaaauuuuaguaagacucauaacuacauguaaaaacuguacaggaggauuauggauuguauagaaacugauacacaacagugguaucaguuuuucucaagaacguuaauauuuucacaccacuauuaacaacacaaacaaaaguucagaaauuaucacauuuuauuuuugaaaaguugcugcuuaaaaaaaaaucuaacuauaaccacauuuaaacugaaaaacaaauuacaacugcugcuucuguuuagcagcagcacauaacaacacauucuucuuccccacugugcucaugggguaugcuauaaccucaguaaaauuccuccuaggguacacauuaaaaagaagagaacugguggaaauucauuccacaaucugaacaaaguaaaaguaaauuugguguauguuaaugaguacaccauaucaacuuagaaaaauuguguuaaugagaaaaggggagauucaacuccuugaguagcucuauauacuuaaaauauaaagccaccauuguaucuaaaauugagucugaaauauggauaacaaaauugaccacagcuauuuuccaacacauauugcagcuuuuaaaaaguacacaauuguuaaguuugcauuagaaauauaagcagauuaccuacuaguugaaaccauauaguauuguuacuaagcugauuuuuuuaaaaaaguacaaagaaacauacauuuucauucauuuggaaaauguaaaaauuuaaguacuaauauauaaucucuucacuuucucugaucuacaaauggauagaaugccuaguuaucgucaugcagauaaauucuucagaauucaauuaccaaagcaagcaacaaacaaaaaaaaccuugucaguaauacacagaugaaucucuuuaacaguuucuauucuuuagcagucuuugaugauuucagaauuugcagcuuuagcucuuuuaucaucaucucuaacuucugucuugcuucccguuccugucugaguucaucuuggaguucuugccuaucggccucagcaugguccaaucucugccucaguucugccaacuaugugauuuaaaaggcgcuaucaauuuuaauuguuuuguuuuuccauuuaauccucauaucauagaaaauaucuauuuucaaauuacuuuuuacaaaacgaacuauuucauguauacuaaauccauuaagcaucuaauacuauuaaucugacaucugacaggacacuaaauuuaagaaaaagcaaaggaacaagaggaaggaacacauccagcauguucauguucauuaugcccuauacuuuacuauaccgcucaucacagccugcucauguuaguuauuuguucauguuccuuaaauugugagauucuauuaacaaaagagaauugcuuauuuuugcuccagugcuuuugaacauaacaggcaacaguuccuguuuguuaauuuguagauuugaaagcucauauacuacauuaaaauaauauaacauauaauauucagagggcuagagauuagcaauuuagguaacuaaacugcaguaacccgauaaaaauuuaaacuaauaaaagcaacaaacaucaaaauaaucaucuuggacaauacagcauaaagcuauguuuaacagaauuaucuauuuugaaaucuagcuuaguaaacugagcuugacaaaaaguaauuccuuuauuagagaaguaacgguggccgggugcaguggcucaugcuuguaaucccagcauuuugggaggcugaggugggcagaucaugaggucaggaguucaagaccagacugaccaacauggugaaaccccgucucuacuaaaaaauacaaaauuuagcugggcauagugucgcacgccuguaaucccagcuacaaucaggaggcugaggcaggaaaauugcuugaacccgggaggcagagguuguggggagcugagauugugccacugcacuccagccugggcgacagagcagucucugucucaaaaaaaaaaaagagagaaguaacaguuuccauuuccaugcugaaagggcaccauuauacaaacaguaauucuuaccuguccugcauauucagccucuuugucuuuuucuaaauuugagucacagguacauuuuugcuucauuaucugcuccaauuuuuucucuaagucuuucuguucaacauaaaauucuuccauucuuugagcauguucauucugcaaagauucaagcucuuucuguaaauucugcuguucuucagugaguuccuucauagauuuugaacuacucaacauuuuuacuuccuguaauguaaagaaucacaauacaaguuuuacuuuauuuucaccauguuaaaauuuucaguucuggaaaacauagcacagaaaauaccuaaaauucagcuaucauuaucaguucuauauagagguaauuauuuuaaaaaacuauuuucucaaaaaauuuuaaaauauauuaaaauugcuuuucaguguaaaacaauaaucuuaaguacauuuguagcaucucguuuugacuuuucuuacuaagaauauacaggggggcugggcgcaguggcucacaccuguaaucccagcacuuugggaggccaaggcugguggaucacaaggucaaaaguucgagccuggccagcauggagaaaccccaucucuacuaagaauacaaaauuuagccaggcaugguggcacgugccuguaaugcuagcuacucggaaggcuaaggcagaagaauugcuugaaccugugagguggagguuucagugagcugagacugcgccacugcacuccagccugggcgacagagcaauauacaaaaguaucuuuucauaauggacuaucauuuagauaacaauuuuaccaucugaaguuguugcuucuuuugcaaaaucaaguuuaguuuuuccuguuguuuuaaauaaguucucauuacuucuuccaugauuuuucccuuaucauccucacaaaugacaucuuucacaagaagcggagaugaagcggcagcaacaaggccaauucccacuuuguuuaugucucugacuaaguugcaaguggcagacucagauuuccuuuuacuuguagaauuauuugagauugaugcaucuuggagagaaaaaaaucaaguaacaaaguaugaauaucacuccauuaaaaaaaucacuagaacaauccauaaauguaauuuuuaaaacauuucauuuauaaauuagaccaaaacaaauaaaauaggaauaaauuuaacaaaagcagugcaaguacaaugaaaacuacaaaacaucacuaaaagaaauuuaagaccuaaauacauggaaagacaucccaaauucauggauuggaagacuuaauauuguuaagacaguaauagucuccaaauugaucuacuuaucagugcaaucccuaucaaaauccccacuggauuuuuugcagaaauugaaaagcaguuucuaaaauccauauggaaaugcaacaaacccaaaauaggcaaaauaaucuugaaaaagaauaacgaaguugaaagacucacaauucccaauuucaaagcuuacuacaaagcuacagaaaucaagacugugugacaugauuuaaagauagacauacagaucaguagaacagaauucagaguccagaaauuuaaaaaacucauacuuuauaaggcaauuguuguugacaaaggugccaaagcaauucagucaggaaagaauaaucuuuucuggccaggcgcgguggcucacgccuguaaucccagcacuuugggaggccgagaagggcggaucacgacgucaggagauugagaccauccuggcuaacauggugaaacccugucucuacuaaaaaauacaaaaaauuugccaggcuugguggcgggcgccuguagucccagcuacucgggaggcugaggcagaagaauggcgugaaccugggaggcggagcuugcagugagccgagauagcgccacugcacuccagccugggcaacagagcaagacuccgucucaaaaaaaaaaaaaaaggaaagaauaaucuuuucaacauacggacaacuauauccacaugcaaaagaauaagguuggaccuuaugcuguauacaaaaauuaacucuaaacugaucaaagaccuaaauguaagagcuacaacccuuaaacauaaauuucuuggcuggaugugguggcucacgccuauaaucccagcacuuugggaggccgaggcagguggauuaccugaggucaggaguucaccaccagccugaccaacaugguaaaacucugucucuacuaaaaauacaaaaaaaauuagccaggcaugguggcgcgcaccuguaaucccagcuacucaggaggcugagacagaaaaauugguugaacccgggagguggagguugcagugagcugagauggcaccacuguacuccagccugggcaacagagugagacucugucucaaaaauaaauaaauaaauaaauaaauacauaaauaaauauuucuuggaauugggauuaggcaauaguuucuuagauaugauaccuaaaacaagaaaaaaauagauaaauuggauguaauaaacauuuaaaacuuuugugcuucaaagaacacuaacacggccaagcgcgguggcucacaccaguaaucccaacacuuugggaggcugaggcagguggauugcuuaagcucacgaguuugagaccagccucaacauggcaaaaccccaacuccaccaaaaauacaaaaauuagccgagcauggugguacaucccuguagucccagcuacuugggaggcugaggugaaaggauggauuaagcccaggagguagagguugcagugagccaagcuggggugauacagccagacuuugucucaggaaaaaaaaaagaacacuaacaagaaaguaaaaagaaaacaguaugguaaaucaaauaucugauaaggauccaguauccagaauauauaaagaacucuuacaacucaauaguaaaacaaccuagcauuaaaauagccaaaagaccugaauagacauuucuccaaagauaugcaauguccaagaaaaacaugaaaagauacucaauaucaucauucacugagaaauugcaaauuaaaaccaugaaauaccacuucacaaccacuaggauggcuauauucaaaagacaaacaauaacaaguguugacaaagauaugcaaaauuugaaacucccaagcuaccacaggaauguaaaauggugcaacugcuuuugaaaaguuuggcaguuccucaaaacauuaaacauaauuaccacaugaccuagcaauuucacuccuaaauacauaccaaaaaaaaacugaaaauauaguucuacacuuaaacuucuacacaaguauuuauagcagcauuauucuuuuuuuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuuguauuuuuuuuuuuuuuuaguagagacgggguuucaccguuuuagccgggauggucucgaucuccugaccucgugauccgcccgccucggccucccaaagugcugggauuacaggcgugagccaccgcgcccggccuauagcagcauuauucuuaauugccaaaaaguagacccaaugcaaauguccgacugacgaaggaauaaaaaaaaugugguauauucacauaauggaaucuuaucaggccauaaaaagaaguacugguacaugcaacaacauggacugugaaaacauuaucuuucaugaaagaagcauaagcuucuugaccagacaugaaaagccacauauuguacaauuccuuuuauaugaaauguccagaauaagcaaauccauaaagauagaaaauagauuagugguugccagaggcuucgagaaagggagaaucagggagugacuccuaauggauuauaggguuaauuuuuggagugaugaaaacauuaugggccgaggcggguggaucaccuaaggucaggaguucaagaucagccugacuaacauggcgaaaacccugucucuuacuaauaauacaaaaaaauuagccaggcguggugacacacgccuguaaucccagcuacucaggaggcugaggcaggagaaucgcuugaacccgggaggcagagcuugcagugagccgaaaucaccccacugcacucuagccugggcgacaagagugaaacuccaucuuaaaaaaaaagaaagaaaagaaaacauuauggaacuaaauuagcugugaugguugcacaacuuugugaauguauuaaaaaccacugaauuguaggcuuuaaaaggguaaauuuuaugguauauaaauuaucucaauaauuuuuuagaagucauuagaauuaauuuaagaaauaaaauacaauguaaauauggcauaauagucauuacuaauuuuuguuuaccauauuuaaaucugaagaaaacugaguuuuaaaaaucucaaaauuggccaggcaugguggcucacaucuguaaucccaaugcuuuaggaggccaaggcaggaggaucacuugaggcuaagagcuuaaugccagccugggcaauacagugagacccugucucuacaaaaaaaaugaaaaaaugaggcaggcgcaguggcacaugccuguaguccuagcuacuagggaggcugaggugcaaggacuaugagcccagcaauuugaagcugcggugagcuaugaaugcaucacuguacuccaccagccuagagcaacagagugagacucugucucuaaaaaagaaaaacgaaacaaaaaacccucaaaauaaauguauagaaaaccccuggccgggcgcgauggcucacgccuguaaucccagcacuuugggaggccgaggcaggcggaucaccugaggucaggaguucgagaccagacugaccaacauggaaaaaccccgugucuacuaaaaauacaaaauuagccgggcgugguggugcaugccuauaaucccagcugcucaggaggcugaggcaggagaaucacuugaaccugggaggcggagauugcagugagccgagaucacaccguugcacucuagccugggcaacaaauacgaaacucugucuccaaacaaacaaacaaacaaacaaaaaaaccagaaaacccccacccaagaaucagccaggcgugguggcucacgccuggaaucccagcacuuugguugggaggccgaggcaggcggaucaccugaggucaggaguucaagaccagccugaccaacauggagaaaacccgucucuacuaaaaauacaaaauuagcggggugugguggugcaugccuguaaucucagcuacucaggaggcugaggcaggagaaucugggagguggagguugcggugagcugagaucucaccauuuuacuccagccugggcaacaagagugaaacuccucaaaaaaaaaaaagaaaaaaaagaaagaaagaaagaaaagaaaacccccaagaaucucaauucucuauaaaaacuuaaauaaauagaggacccuccaacuguuccaaugcagcuaaaguaacugucacacugccuaaucacuaagcaaagcugugcugcuauauggaugguaacacaggcaauaucugcagacaugucucauuuaauccacaguauuuuaaaaggcacgguaaguaaccagcuauuuuucuuuuaaaugaccagucaauauuccacauuuaugcuauaugccuggcccccagagcuuucaauccuugcuuuauuccauaacuaagcuuccuugaguucuauaccuaacuacucuuacuuacauaauacuucuuauuauuaaauggugucucaguucauggcaaaucagaaagaaaaauaaagguugggugcgguggcucacaacuguaaucccaacacuuugagaggccaaggcaggaggaucacuugagcccaggaguucgagaccagcuugagcaacauaccaagaccaucucuacaaaaaaaaaaaaaaaaauuuuuuuuuuuaauuagccaggcacaguggugugcgccucuggucccagcuacuagggagggugaggugggaggaucacuugagcccaaagguugaggcugcagugaccgcaaucucaccacugcacuucagccuaggcgauaaagacucugucacaaaaaaagaaaaaaaaaggaggaaagaaaaacaaggaucuccugaagacugacagcaaauaaaagguaggaaaggaaaaaaauucggacaaaaauaacuugcagucugaggccagguagccuguaucuaucucagucuccugagcuaucaccacgcuagaaaaguauagcaacugagauuaaaauaaaucacccagaguuuugaaggguagcauuuuuaaagguaaaagcuccaauuaucugaaaauuuagcucaaacaaaaagccuguuugaaaaugcucaauaaauguguucauuagauauuuaauuuuagaaagauaaucucugaauacuuaccuaaacggcuacauaauucucuacuuguuuuuaaauccauuuucuccuguuccucaagugagacaucuggauaagacacuguuuuuugaaguuuaccacuacugugagccuucucugacugucuugauauggacuuacuugccucugucuuugugagcucuuuagacugggauacagcagaaguaagugacacauuuggggcaaccacuuuaucacacauguauaaguaguagcugaaaacaaguaaaagcaaaacaagacauauauuacauauuacaauuaaguaaaaaucaaauauguaacaugcauuucugugguuaaacuuuuuuuuuucuaaccaaaacagacaauauuacaacucagaaaauaaaggucacaguaaagaauucuuaggaaaaaaaucaacacuuuaggcauuacaaacaaaauuauaagggauuuuuuguuaguuugcaaguaacccaggcuggagcguagugguaugaucauggcucacuguaaccucuaacuccuggguucaagcaaucuuccugccucagcaucccagguagcugggaccacacauacccauuuuuuuuuagagauagggucuugcuaugcugccaaguuggucuugaacuccugggcucaagugauacccucccaccuccaacucccaaagcacuaggauuacaggcauaagcaaccauaaccagcuugcaaguaauuucguguuuuuuuuuuuuuuuggcaaguaauuucuaagcacuaaaaagauacacagaaggaaaaucacaggcucuucuccuucccucaaaaccaccugagaauuaaaagcauuaaggacuuuauacagcuguguaacaacucugagcagguaaguuuuacuccagaaaaagaauaaucuauaacuacuuuggaggacuuuaucuugcccaccacccuuccaaagcagggaaucuuugcuuuggugaggcugcuucaguggcagacugcaaggcuauguccugacucacaggaggcucagugaggagcucccagggcucuucuuauauaccucagagagagagcucugaaugucgcccagcuacugggcaguucuuguaucaaaccccacugagcaaucuucuugaaauacuucacuacuuccuacucauuugauaaaauggcaacaauaaauuaugcaaaacuaagauaaaagagauuaccaauuuugaccaaaacucacauaaaauugcccaguagacucaugugagaagcucaugggacaaacaaauuucagcuagauauuuaaguaccauauuuguaacuauauucugaguaacacuuagcaaaaagauguaaccauuuaagacuugacacucuauccccugaacuccagacaaucuccucuuacauuucauuuucuuuguacuaagacaucuauauuguuccccuuuguuaauaacauccauuuuugagccaaaaucucaguuuucugacaggacaagaaaauugacagguuuaauagggcucaaaagacuuacugcaaauacaacagguaaaguagugauuguacaaauguaaauaagacucaguccccuuaucaccauacuuggagggaauacagauuuacacuaguagaaaaaaaucuagggcucaacaacaaaaaacuuacaaucuagggugaacauuuauugaaacaguaaaacucugauuuugagaaguacgguuauuaagaaagcucuuaguuucaaaagaauuucuuuuuaaaauaucaaaguugcaggccgggugcagugacucauaccuguaaucccagcacuuugggaggcugauggcaggugggucacuugaggucaggaguucgagaccagccuggccaacauggugaaaccucgucucuucuaaaaauacaaaaauuagcugggcguagcagcggaugccuguaaucccagcuacucaggaggcugaggcaggagaaaugcuugaacccgggaggcggagguugcagugagccgagaucauaccauugcacuccagccugggcaacagagcgagacuccaucucaaaaaaaaaaaaaaaaaauugaaguugcggcucggggcgguggcucacaccuguaauccuagcagcacuuugggaggccaaggcuggcagaucaccugagguucaaaaccagccuggccaacauggugaaaccccaucucuacuaaaaauacaaaaaaauuagccaggagugacagcuggcgcucaggcucagcuacaggaugccaugacaagagaacugcuugaaccugggaggcagagguugcagugagccaagauccugccacugcacuccagucuggguaacacagugagacuuugucucaaaaaaaaaaaaaaaaaaaucaaaguugcacaccaaauucuugaagaguuuguuuaccucuugaagaaaaguaagaaauuaaaggagaacuuccauuuuuuacuugagggcaaaaagaaaaugaccuauuucuagaaaacacauagaaacacauaguaaagguuauuucaaauauucagugcaauuuacaauucauuucauuucagauucuuucuuugaaauuuuuucuaauaagaguaacaauacaauucaccuaccauuucccuauaaugauaaauagaaacaaaaaauacauuaaauaccaauguacuuauuuaaaaauaauuuugaauuuucuuuuuuucuuuuuuuuugagacaguuuugcucugucgccuaggcuggagugcaaugacgcgaucucggcucacugcaagcucugccucccagguucaagcaauucuccugccucagccucccgaguagcugggacuacaggugcccgccaccaggcccggcuaauuuuuuugcauuuuuaguagagacaggguuucacuguguuagccaggauggucucgaucuccugaccucaugauccacccaccucggccucccaaagugcugggauuacaggcaugagccaccgcgcccagccuaauuuugaauuuucaaagauaaucuaugauuaacaagaaagccugaaaauaaagaaauaaauucguggucaggcacaguggcucacaccuguaaucccagcacuuugggaggcugaggcaggcagaucacuugaggucaggaguucgagaccagccuggccaacacugugaaaccccaucuauacuaaaacuaaaaaaauuaggagggcgugguggugugagccuguaguccccgcuacucgggaggcugaggcaggagaaucgcuugaacccgugaggcggagguugcaaugagacgagaucgcgccacugcacuccagccuggguaacagagcaagacucugccaccaaaaaaaauaaauaaauaauuaaauucccauguccuagaauagugcauggcauauaguuguugaaugaagaaaugaaugaacaaacgaacaaauaaauaccaacucaccugggguguaaaaaugaaugugucugagaaacauggucaccuuccugcuuuauaacaggauaccaugacuguaauuccauuccugauggugcaucugucugcagaaaaacauggaagggaaacauuuauugaaguaaaacugugaagguuaauuuuaugugucaaccugacugggccacuggguaaagacaacuaacauuauuuaagagucaucaugccacgcacagugguucacaccuguauucccagcacuuugggaggcagaguggggaagauuccuuaagccguggagucagccugggcaacauaggaagacccagucucuuuaaaaaaaaaaaaaaaaaaauuagccaguugcagugguguacaucuguggucccagcuacuugggagacugaggugggagaaucccuugagcccaggaaguugaggcuugcagugaaccaugauugaaccaugauugcaccacugcacucuauccugggcaagagugagacccugucucaagagucaucuuccaauaaggcagucuucccuugaagaagccugauuaucaccugaaacucagagacacccacaugaacuaucccaucacaagaacaguuucaguaugcaugcuaacauggaguaccagaaaugacugcaucaaauuucauacuuacgaaaucuauuuuauuuauuuauuuuuuuuuuuuuuuugagauggagucucgcucugucacccaggcuggagugcaguggcgcgaucuuggcucacugcaaccuccaccucccggguucaagcgauucucugcuucaguauccugaguagcugggauuacaggcacccaccaccacacccagcuaauuuuuuguauucuuaguagagauuggguuuugccauguuggccaggcugaucucaaacuccugaccucaggugaucccugcuccucagccucccaaagugcagggauuacaggcaugagccacugagccuggccagaaauccauuuuaaauaauagaacucuauaaagguauagcacuggaaaauugauucuuauuccuguacuacaaucggcuagacuauacccuaucccuacaguauuuguuagcauauuagcuagauaccauucuacagcaauacuuugccaaauuaaauccaaaaccacauaguuugcuaacacuugucauuaaacuauauuuccuaauaaauauaaaaaggauuuuuuaauacuuaaagaugagcuauaacuaaaaauaaagaaaaauaaggagaaagguaacugguaacuuaaugaacaucuacgggcugagaacuuuauacaucauucuuaauucuaacaaauaucccccauuaaauagguaucauuaccauuuuacagaugagaaaacaacugacguucagaaauugaagaggggcucgguucaguggcucacaccuguaauuccagcacugugggaggccgagguggguggaucaccugaggucaggaguucgagaccagcauggccaacguggcaaaaccccaucucuauuaaaaacgcaaaacuuaacgaggcaugguggugcgcuccuguaaucccagcuacucgggaggcugagacaggagaaucacuugaacccaggagauggagggugcagugagccaagaucaugccacugcacuccagccugggcaacagagcaagaaucgucucaaaaaacaaaacaaaacaaaaaaagaaauugaagagaaaaaaagaauaaaugaucugugguuacuaacuucucccuuauuuugguuuacuuuauuuacacuuuguccucccuucauccccuacauauuuccuauuauacgaaauuaccuugcuuuugugggaaaaggauacuuaaaagggggggcaagacucacugguaagggaaaggggaaagaaggaaaggagagcugaaauguggcaugguuaaggugaccaacaaaaauaggaaguuaacagacaaacccaggaaacugagggagaaugcgauuaggaacgaguuaaacaagggaaaaaacaaaaaagagagcuggauauuucucuaaacccuaccuuuaagagguuccauggccaggcgcaguggcucaugccuguaauccuagcauuuugggaggccgagaaggguggaucaccugaggucaggagcaagaccagccuggccaacauagcgaaacccagucucuacuaaaaauacaaaaauuagcugggcguggugguacgagaaggguggaucaccugaggucaggagcaagaccagccuggccaacacagcgaaacccagucucuacuaaaaauacaaaaauuagcugggcauggugguacgcacuuguaaucccagcuacucgggaggcugaggcaggagacucacuugaacccaggaggcggaggcugcaguaagccgagauugcaccaccgcacuccagccugggcaacugagccagaauccaucucaagauaaaaaaaauaaauaaauaaauaaauaaauaaauaaauaaaagaagcuccaauucuggucgggugcagcagcucaugccuguaacuuugggaggcugagggagguggaucaccugaagucaggaguuugagaccagccuggccaacauggagaaacgccguuucuacaaaaauuagcuggacaugguggugagugccuguaaucccaccuacuuggguggccgaggcaggagaaucacuugaauccgggaggcagagguugcagugagcugaguucgcgccacugcacuccaaccugggugacagagcaagacuuugucuccaaaaaaaaaaaaaaagagagagagagagaguccaauucccaauucaacaaauuaggaaaguagcaaagcuguuuugccugaugucccaauauuccaguuuggaaccaagaaacuaaggacugcaaacagaucucuggauguuaagcaguagugauuaaaacaaaaucaacucuaaacuauccaaacucugguuugauuacugagauccuacuaauggaggaaaucaaugagaaugaagaaaccugggagagaucugacaaguaacccacugcccucaacaaaacaggcugaaaacagaaaggaaaccgcucuuagaauauguaucuuaaaaucugaucagucaggagaugacuuagggccaacuaaaggacaaaaauaggcagggcacaguggcucacgccuguaaucccagcacuuugggaggccaaggcaggcaaaucacgaggucaggaguucaaggccagccuggccaauauagugaaacccugucuuacuaaaaauacaaaaauuagccagguguggugguacgcaccuguaauccuagcuacucaggaggcugaggcaggagaaucgcuugaaccugggagguggagauugcagugagccgagacggcgccauugcacuccagccugggugacagagcaagacucugucucaaaaauaaaaaaagaaaaaaauauguaugugggagaucuuuauuuuuguuaagaauuaggccaggcacaguggcucacaccuguaaucccagcacuuugggaggccaaggcggguggaucacgagaucaggaguucaagaccagccuggccaagauggugaaaccccgucucuacuaaaaauacaaaaaaaaaaaauuagucgggugcggcagcaggcgccuguaaucccagcuacucaggaggcugaggcaggagaaucgcuugaacucagagggcggagguugcagugagccgagaucgugccacugcacuccagccugggugacagagugagacucugucucaaaaaaaaaaaaaaaaaaaaaaaagaauuauugagcaaugaauuugaaauacuaauaagaccucaaaauuauaagaaaaaaauuaauauuuuuaaaagauuuaagaguugaauauucagugaaggucucuacaugauauguaaauguggaauuaaaaaaaaaaaaaaaggccugggcacaguggcucaugccuauaaucccagcacuuuaggaggacaggagaaucaaccgaaacaggggaacagagguugcagugagcugagaucgcuccacugcacuccagccugggcaacaaagugcaacuccaucucaaaaaaaaaaaggaaaacagaaaacgaaacaucacauuuugaacuaauauucagaaucugggcaaauuccacugcuuauuuauaaaacaaacugaucacuuauuuacauaguuccucagccuauagcuuaguuauagcaguaagaaagggaacugacuucuggcaacagaaauacuaaaugauagaugcuaagugacagcugacagccuaaggagagaggaaaauuacaagaugcaaacacaaaaacugcuucaaaaagcaagacaaucugaguaaaggcuuuagcauagaccggggcaaauaauuuaauauaucucaauuguccccuaccccaauucaacaaaguaugguaauuaauguuuaagaaucuugaguuggccaggcgcaacggcucacaucugugauauuaccuagcacuuugggaggccaaagugggcagacugcuucagcucaggaguuugagacuggccugggcaacaaggcaaaaccccaucucuaauaauaauacaaaaauuagccaggcaaggugaugugugccuguagucccagcuacuugggaggcuaaggcaggaggaucacuugagcccaggaaacagagguugcagugagcugagauugcuccauggcacuccagccugggugacagagccagacccugucucguuaaaaaaauaaaaacucuugagucaacgugacauagcuaaauuauguucuguauaccacuuagauucaaaacuuuuucagacauuuuacaauucaugaaaacaguuuuuuaaaaaaacacaaugcuuuuaaaaaguagcuuaacggguagaacauuuugcaccccagcucuacaugaccaaagaggugucaaugaacgaggauaaguucauucuaacaaaucaguaaaauuuaagaucaguuugagggcaggaacaguggcucacaccuguaaucccagcacucugggaggccgagguggguggaucauuugagguccggaguucgaaaccagccugaccaaauggugaaaccccaucucuaauaagaaaaaaaaaauuagcugggcaugguggugcaucccuguaaucccagcuacucgggaggcugaggcaggagaaucacuugaacccaggagguggagguugcagugagcugagauugcgccacugcgcuccagccugggcaagacagugaaacuccgucucaaaaaaaaaaaaaaaaaaaaaaaggaaaaucagcuugaauuaaaugagaauuucuuuucuagacaucauuuguuaaaaaacaaagaaagcuccucuuuaaauaaguguuauaucugaaagaauucuagauguacugcccaagaaaucaauuguuuccagauuuuuuaaauuaaaacuacuaaaauuggcccuacccaguggcucacaccuauagccccggaauuuuaggaggccaaggcacaaggacugcuugaguccagcaguucgaaaccagccuggacaacauagagagacccccaucucuacaaaaaaaauuguuuuuaauuggccagccguggugacgcaugccuguagucucagcuacucaggggacugaggugggagaaucaguugaagcuggcagguuugagguugcugugagcuaugauccugccacugcacugcagccuaggcaacaguguggggcuugucucgaaaaaagaaaaagaaaaaaauauaaaauuacuaaaauugauuuauauauuucaaaguuuuuccuauaaugaauacuggaaucucaaaucuucagaauaucaagcaaauucuaaauuugcucaaagaccuugacuugaaaucugacucaauuuugaucaaguucauuucaaaacccuacaguuugauuuauaagaguaaguuuuaucuuuacucaugagccaaaccuagcaucuauuuauuucugugucucuaaacuucaggugccaccuuaaauaacugcuagcacauuccuuuauuuuuaaacagucaucccucuuagcuccuauucuuuauuuuauuuccuagucuugaccaacccaguaagagucagacuagagcuucuaaggaaucuuaaagaucaccuagcauaguccccuagccaaugucugaauucccuauuuaaaaucccuguuaaguggcuacgcagccucugcuuaaacagcagcuugaggucaagaaccagccuuaccuuuguauuuuuaauaccuagcacuauaugccuagcauguaguagggacucaucuaucaaauaucuauuauuuguugaaugaauucugaaugacagugcagcucauuaauucccaagguagccuuuuacaagguuauucugcuaccacaaaacucuuggucucuuucacguuugauaucccucuacuccaugaagcaccaaggaagcccaacaguuucuaaggcugcauuuuucagagauauaaauuaaacaauacaaaugauggggacacgcacaacacuaaccaugauaaaauguugcaagcuaauuuuaccuaauaugcugugguaagccauaaacacauuuauaacaaauuauccuaacuguauguuaaaaacaauuaagaaaagcacaauguuuaugauacaacaaaacauucagaggcaugccagauuuucucaucuauucugcauuugugucaacauacaaauuagguuuucaaaaaaagaacaauauaauuaaaugguucagcaguaaugcuacuaaucaggaauaaaaauuagauaccaaauuaugaguaucuacugccugguaucuuaccuuucaacauaggaaucauuuauuuuuauguguauuuaaauuuuaaaauacaauacauuauauaacuugccaaagaaguggaucauuuaguagcuuaaguuagagccuuaacauuucaaaaugcucuuaucacccaauuuccccaucauuauuuaccccaaaaugaacagauagcauccucauuucaaacacauaagcaaaauuucagacacaaaaauuucauuccaaagguucuuuccucuuaggucauaaaacuccaaaugucuaugaauguacaauuuaaacaauuccaaaauauacaguaaaaaaauauaaaauaaguaaaaacuaagaaacauuuuaugaaaguuucucuaaauuucugcaccuuccuaugcuuauucuguauacgugacccuuugauaaucagauuuccuaaugaagaaccacucuauuuuagugauacgaugcuaaucagucucauaaugaaaaauaauuuagagagcuugauuucauuuacaaaaaacuucuugucacuccuuucuaaauacaaaagcuauuccaccugcucagcauuauucauacaaguauucgaauuuguaccaaaaaaaacccuuuaaaauucuuagacauuuuuuuuuucccuugagacagggucuugcucuggggaacagugguauaauuauagcucacugcauccuccaacuccugggcucaagggauccucgugccucagccuccagaguagucaggacuauuggcccaugccaccaagccugacuaauuuuuuuuuaauuuuuuuuguagagacagggguugcacuauguugcccaagcuggaacuuauuuucaaauacuaaaucuugcuuuuagguggcacucuaauuuuuaauuacagcaucagauuacuauuuugaucuuuaauuaaguccuaaugacaaacauuaaugaacuaaagaaaccaagauaaugccucaaaacacuagugggaauuccaaaauuccaacaaaaaucagaauuaagccuuuuuacaaauauaugagccggaaggccaggcacagugacucacaccuguaaucccagcacuuugggaggccaaggcggaggaucaccugaggucaggaguucaagaccagcccggccaacauggugaaacccugucucuacuaaaaauauaaaauuagccaggcauaaaggcugggcacgguggcucaugccuguaaucccagcuacuuaggaggcugaggcagaagaaucgcuugaacccaggagguggaggguguagugagccgagaucacaccacuguacuccagccugggcgacauagcaagacuaucuaaaaaauaaaaauaaauaaaaaaauuagccgggccugguggugcacgccuguagucccagcuaccgagggggcugcaacaagagaaucgcuugaaccugggauguggagguugucgagguugcugugagccgagaucacgccacugaacuccagccugggcgacagagugagacuccgucucaaaaaaaaaaaaaaaaauugaaaauuauuucuaaaaacagaauuuuuaaagugcuauaagugauaaagauuaauuuuuaaauuuguguucauaagacagaagcaguaguguagguugguaaauuuaauagucuaucucccuaauggccuauuuacacaagaaauaaaauauaaugcauaugaaaugcacauuacuuuguucugacccaaaauaaaucauuagcaaccuuacuaaacauaugacuggauacacaggaagugaauauaucucaucagggucuuuuugcuguguauaauacuaagacauucaaguggucaauaaaugauuucagaaguauaaagacacccuaccagauagcugccaacaacucuuaccaaaagaaacagaaucccucaguacacuaucagguuuccuuaauauuuccaacauguugugaguuaguguuucaauaaaugaaacagaacaguguuacaagguagcaaauagcuacuuagagauuucaaggcuuagucuugggccucacuucucuguaaucaauagaauugaucaaauuaaugcaaaacugggacaguaugaucuaagcaucugcacuaacugaucaaaaacagaucgucaggagucacagcaauggcagcuguuuccacaggcugaaagaucauaccaccuaccucacaaagccaauuuuagguuugagauacuuaaaaaugcucacagaaaaugcaaaggcucgaguucuuguaauauuuugcaacuauuauuuugaguccuuaauggaaacaaagccauguaaaguugguaauauaacauccccuuuagaacuugaagaaaaauacacugauaaaaauccuguuaauccugugacauuuuauacugaaggucugugaugcccaauaaacuuaauacugcaacuacauggaaaucucagugucauacacauuauuuuccacuauuugucaaaaauuuuaaucuguauaauucuaaggcuuuacuuuucuaucucauuuuagcauauaugcuuaacaauuuacaguccuggauuauucuggccuucaaauaauguaaacuggcaauuucaaaacagagauugauuaaucuuccuaugugcaauguccucuauuuuccauuuuauucuacuucagguuuuuauguuuuuuaaugcuggugacccacuaaauugauuucaugacccuccuggcgguuuucaauugagguucucaggagaauuuaaaaugccccaaggcauccauuguauguaaugaauuaccuucucuccagugcauuuagaaugguaccaguacgaucacugggagaaaugacaaaaccagcacucaauucauuuucuguagugcuuaaaucuccccuuauggaacccugcuugagauggcuacaugaaugacaaauugcaguuagaaaaacacugcucuaaaugaacugucuuaaaauugguccaaaaguauuauuccaguaacuacuccuuuuguuuuucuuuuucuuuuuuugagacagagucucacucuguugcccaggcuggagugcaguagcacgaucuccgcucauugcaaccuccgauuccuggauucaagcaauucuccugccucagccucccaaguagcucuaauuacaggcgugugccaccaugcccagcuauuuuuuuuauuauuauuuuuaguagagaugggguuucaccauguuggccaggcuggucucgaacuccugaccucaaaucaucugucugccuuggccucccaaagugcugggauuacaggcguuagccaccgcaccaggccuacuacuccuuuauuaauacuuaugcacucuagaaaugcuuuugcacaaacacaguuacaauuacauacgcaaaugaauaaauuccagaggcaguuaucacauggugcaauuaugaggaaauuguguuuucuucuuuguacuuuuuuaguauuuacuacaaugggccuauauuguuuucauaaucacacaaaaaaauuuaacauagacuauaaaaagcauagaagucuuaaaucauuuuuauuaaguuuuguuuugucuuguuuuuuuugagaaaaacagggucuugcucuguugcccaagcuuggagugcagaggugccaucacagcucacugcggucucaaccuccccaacucaagcgauacucccaucucagccccacaaguaguugggacuacaggcaugccccaccaagcccagcuaauuguuuuuuucaaucuuuuguaaagacagggucaaacuauguuacccaaacuuuuaguaaguuucuuaagcuuuuuaauuccuuguucccauaaaaaaugcaaaauauguacuuuuaaugccauuugaaaucucagaauaaauucaacaucacaaauaaaaacgaaaugcugguuuguuuuaaaacuaaaccuguuucccucuucgagaaucacugguaacuuuauagggccacuuagacuucacuguuauccaaaccuuuauuaggcaucuaccacauucuagauucgaagacuguaagauauaagaagacuguaagacuauaagaugaacuccugcucggggggggggggggggcucucucucucucucucuguauauauacauauauauguauauauagaaauauuacauauuucuaugauccacucuuaagucuagaagucaugaaaucaaaaggacucaaacuaauuuuauaucuuuccuauucauucuuucugccuaauauaaugaguuagugauugaagcaaaccacauuuuauuuuauuuuauuuuuuugagacggagucucacucugucucccaggcuggagugcaguggcgcgaucucggcucacugcaagcuccgccucccggguuuacgccauucuccugccucagccucccgaguagcugggacuacaggcgccugccaccgcgcccggcuaauuuuuuguauuuuuaguagagacgggguuucaccauguuagccaggauggucucgaucuccugaccucaugauccgcccgucucagccucccaaaagugcugggacuacaggcgugagccaccgcgcgcagccggaagcaaaucacaucuuacaacaagaugcauuguuuauauauucuuuugcuuucuagagucuaauaaaauccuuauuuuauguaauaugaaucccaguagaauaaaauucuauaugugaacaaaauacagauucaagcuauuaccaaagcuauucucaaacaaguucuaccccuuuacuaggaacaaacugaauucuagcucgacaaucacuuuccacucccagaauucuaaagggauuaaaauuagcccaauucgcugggugcgguggcucacgccuguaaucccagcacuuugggaggcugagacaggcagaucaccugagguacggaguucgagaucagccugaccaauauggugaaaccacaucucuacaaaaaauacaaaaauuagccagcuaugguggcacaugacuguaauuccagcuacuagggaggcugaggcaugagaaucacuugaacccaggaggcggagguugcagugagccgagauugccuuauugcacuccagccugagcuacaagagcaaaacuccuuaucaaaaaaaaaauuagcccaauucuugauuacuucuuugguuucccaguggcauaauugauaacauaugcacugcuacgagaaaacuacuggcugacuaugaugauccaggccuacucugaaaacacggccaucucuuuuuuguuuuucuucuuuaaaguuucuaaguuuuuucccauuucucaaacaaaaaggauaaauuucuaacuuucaaaaaucauaugcuaacaauucuauuuuuuaauaauaaaaauaaagaggcucuauuuccuaaaccacagggggcacuauuugcaaagccacucuacagauuucaaaaaaaaaaaaaaaaaaaaaaaaugccagggauagggaggguccacauauccuguuauuaacagaaugagcuccaaaaacuugauuacucugaaguuauuauaaaagucguuuuguaaaaaaugagaaaggcacuaaacaaaaccuuauccaaucuaagcaggucuguauuggucuccaucauucaaaaccccaaugugguaucaaccgaauaaauggaaugggcacuaucuccaaucaauguaucuuuuuggguaacaagucgaaaauaaugaaauaauucagaaaaugcuucuauaauaaaaaaacuguuucacacuuucuucuugcacacuucauuuuaguaagcaaauauccaacuacuguaauuacuguguaaaaaaaacuauaaaugagauacauuugaacccaacauucaguuaucuuguuugucucagaaauauaauucuagauaagaaaaugaggaaaggaggacuccucaaauacauaauauuucaauaguaguuugaaauaccauccuacauuucugcaguaaaggcucuuaacuuccaaaaugcucauucucuuguuugaugaauuauauuaacaguuuaugugcaaauuguaucuguuuaaagguuaagccaucuuuaaaagaaaauccaaauauucuaaaauauaguuuaguguuauuuuucaaaaaucuauucaguuaaaaaaagaaaaauuuaauugagugccuuugacaugccaggcuuugaacucgguuccaaaaaaauagaaaaaauacucuguaaacuagugggaacaguuacuaauuuuagaaaguuagacaaaaguauucauaauggucccucauaugagcacaaauacuucaucugacucucaacuuauccccacuugaucaaaaauuuugcuaauugcaaaauauaaucuguaucacugggguagcaaaucaccaucaaauccaccacaauuauuacuagaucacauucugucccaacacaacucuuuguaguugcccauucuacuguuccuuaucucaauuagguuuauacugacaaauacgcugccuaauacaaguauaauuaaaagcuugcaagaggggagaaauauuuuguacuauuauuacuccaaugaucucuacagaaaugaagaagugaaacgaaaaugcaaaauuaaacucucaaacggcuaauacgcuuucagggaaaaaaaauuuuuuaaguugcuaucuuuaggucaucuguuuguaucauaaguaaucuauagagauuuuuccccccuaaguagauuaaaaacuaaaauauuuuacuuaccuaagaguaguccagucuaaauguuaaaaguuuaaauuuuagccaggcacgguggcucacgccuguaaucccagcacuuugggagacugaggcugguggauugccugagaucaggaguucgagaccagccuggccaacauagugaaacccccaucucuacuaaaaauacaaaaaauuagcugggugugguggcaggcaccuguaaucccagcuacuagggacacugaggcaggagaauugcuugaaccugggaggcggaaguugcagugagccaagauugcgccauugcacuccagccugggcaacaagggcgaaacuccaucucaauuuaaaaaaaaaaaaaaaggguauauauaguucuuaacuuaguaaaguggagacugucagccacaugcuacaauagggaagaaucggccaggcgcaguggcucacgccuguaauccuagcacuuugggaggaugacgacgucaggagaucgagaccauccuggcuaacacggugaaaccccgucucuacuaaaaaaauagaaaaaauuagccaggcguggugauggguaccuguagucccagcuacucagggggcugaggcaggagaauggcgugaaccugggagguggaguuugcagugagcugacaucgcgccacugcacuccagccuggucaacagagcgagacucucgucucaaaaaaaacaaacaaacaaacaaaaaaagugaagaaucaccuacaacaaaugaccacuuccaauauguuugaaaauaaucuuaaguaaacauuacucuucaaauuuuauuuacaaaugauuaauuugccuguugaucuuuuuuucauacaaacguaauauucaacaaaauuagaauuagaucaaauuuauuuuaauuuucuauuuuuguuuacauauauuugaucuacuucugauuuugcugaauauccacugaagaugugaaaaagaaucaggaaugugauguuugcauguauuuauacaguuuaaaguaaaauaaugauuauuccaauaaaaaacacaaaaagcucguaucagguaaguaacuugacaacauucuguagaacaacauaggcagaucuaaaaucaaguaugugugugugugugugugucuguguguguguguguguguguguuuugagacagaguuucacucugucacccaggaugaagggcagugugaacucggcucacugaaaccuccaccuccuggguucaagccugccucagccucccaaguagcugggauuacaggcgugugucaccauccccugcuaacuuuuguauuuucaguagagauggcguuucaccauauuggccaggcuggucccgaaccccugaccucaggugauccacccaacucagccucccaaagugcugggauuacaggcaugagccaccgcgccuggccuaaaaucaaguauauuucuuauggcgacuugaguaagaaagaguuauuagcuauauuuaauuaaguugucucauuucaaauuauuuauaauuuacaagauacuacaacuuauuaacauuaaaauguauuaauauauuacauauuuuauaauuguaaaauaauuaaguuguuucauuucgaacaacuuacugaguuucaggacuuuuuuuaauccaaaagcaauacuuugauuacauaaacuauauacgcaugucaaaucaugucaguauucacaccaaacaucagguccuuuacauaacacguuaauauauuuaguacagucuuaaaaaaaaaaaaaaaaaaggccaggcgcaauggcucaugccuguaaucccagcacuuugggaggccgaggcagguggaucaucugaggucaggaguucaagaucagccuggccagcauggugaaaccccgucuggacuaaaaauaaaaaaauuagcuggguaugguggcagacgccuguaauugcagcuacuugggaggcugaggcaggagaaucgcuugaauccaggaggcggagguugcagugagccaagaucgcgccauugcacuccagccugggcgcaagagcgaaacuccaucucaaaaaaaaaaaaaaaaaaaaagccuaguuugacuuuuuaaaaugagcucccucugggucaauuuggcuuguuuggcaaccaacucaaugacucacagaagaaaauaaaaacuguuccucagucaaggacuaucucauucucaguuaaauaccuuaguauuuaaauuuauaugcagguuaaaacagaguuugagaaccaucauagaggcugaauaucccuuaucagaaaugcuugggaccaaaaguauuuugaauuucugauuuuuucagauucuggaauaugugcacgauauggcaguugagcaucccaaauccaaaaaucaaaaucugaaauacuccaaugagcauuuccugugagugccaugucagcauucaaaaaguuuuggccuuuagagcauuucagauuuuggauuugggaugcucaaccuguacuaagguaaauugauaagaaaaguuaauguuucucaaaauucaguuucugcuacuaacaugugcuucaggggcaaauagugaaaaauuacuaaacuucgaguuagaagcccuguauucaacuccugauucugguuauacaaccaggagcaugugacucaucuaagagguggaaauauugucauucaccuuccucacagacccuaaaaaauaaguguacuucacaauguucugaguacguuuuuaaaacgugaagugguaagcauaauaaaacaaccacucaaguacguauuaaauaugaaccaaagaaaagaaucuuucuuaaaguauggguguuugaaauuuucuuaaauuccuuuaaauuucucaaauucacauaaaauuacaagcaauaucaaaauacaccacaaacacuaauucaaauacugcaaaauauaacacagcaaaaagaucagaaagaaacucacaccuuccuaaaaucgaaaauguauucaaaucagugaauucugggacaaaaagggauuacaucccagacgaaggaugguuucaguguuaaccaaaccucagcacauuguuucaguuaaguaaauuaauccaucaucuuuuuuuuuuuaaaccuuuaucaugguucucagauguuuuucacauaaacacagagcaagaauauuaggaaaaguaguuuauccaaaauacacuuaugucagacuaauaauuagacuggggcgggccaggcgccauggcucaugccuguaaucccagcaauugagaggacgaggaggucggaucaccucaggucaggaguuaagaccagccggcuaggcuguaaaaucccaucucuacuaaaaauacaaaaaacaagcuaggcaugguggugggcaccuguaaccccggcuacuugggaggcugagacaggagaaucacuugaaucugggagguggagauugcagugaacugagaucgcgccauuguacuccagccugggcaauaagagcgaaacucugucucaaaaaaaaaaaaaaaaaaaaaaaaaaaaagacgggagcaacaauaucuggcaaauguggccuccaacagacauguaagaguagaccaccacugggcaugguggcucacgccuguaauccuagcauuuugggaggcagagacaggcgcauugccugagcucaggaguucgaggccagccugggcaacauggugaaacccccucucuacuaaaauacaaaagaaauuagcugggcauggcggugggcgccugaagucccagcuacucggaagacugaggcaggagaauugcuugaacccaggaggcagagguugcagugagccgagaucgugccacugcacuccagccucggcgacagagcaagacuugucucuacaaaaaaaaaaguacagcaccuaauuagcuugggggcaagauaucacaaauaucaaaaggggcauuccacauuuugaaauauaaucucugagcacaaacuucagcacgggacaaguccaacuguaagcaaguucuacacugagcacuggcuugaagucaauccugauuuaaaauuaguuaauaggccgagagcaguggcucacaccuguaaucccagcacuuugagaagccaaggcggguggaucacccgaggucaggaguuugagaccagccuagcuaacauggcgaaaccagucucugcuaaaaauaacaaaaauuaaagggugugguggcugaugccuguaaucccagugacucaggaggcugaggcaggagaaucacuugaacccaggaggcggaggcugcaaucugccaagaucgcgccacugagcucuagccugggcaacaggagcgaaacucugucucaaaaaaaaaaaaaucaguuaauaacuacaccugaagaauauaaacuuaucuagcagccacuggcaagaaauuucaaagugcuggucuucuggaagcagcaagcagcaaacuaccauaaaugagucuaaaauuauuaucuucauuaggcuuaaccaaugucuuaaacuacacuguuaacuaaauuucccucaaaaccuuaaaggcaccagaauaaagcucaggaucccaagucuuaaggacuaguccaagcucuaacuuugcugugaauaaaccuucagucagucauuuaauaugcuuuauucauuucuucuguaaaauagaaaugggcaaggauauuucaaggaaucaaaacuaauaguggaaaaauucaaaguuccuaaaugaaacacagccaaccucuuguuaagaauuaaauaaaauuauauauguaaaacugcucaagaauaauguuugccacauuuuaaacacuuaguguuaggaacuguuauuacacauuaauuuuagucaaauaggaaaaaauauaaaacaacccgaucaagaaacuaaauauuuaauaaucccaaucuuguccauuaccucggcauucaaaaccuuggaaugaaaauaauaguuuagccuacuagauaaugcagcaggaaaaauaaaauuaugauaccuuggcugauaggugguuguguuuuuuuuuuuugaaauggagucuuacucugacgcccaggauggacugugguggcgugaucucggcuuacugcaaccuccgcuucccagguucaagcgauucuccuggcucagccucccaaguagcugggacuacaaacacacaccaccaugccuggcuaauuuuuguauuuuuaguagagaugggguuuuaccauguuggccaggcuggucucaaacuccugaccugaagugaucugcccaccugggccucccaaagugcugggauugugagccauucauugcucccaccuguugauagguuguuuguuuguuuuguuuuguuuuuugauggaguuucccucgacgccuacgcuggagcgcaauggcacaaucucggcucacuacaaccuccgccuccgggguucaagcgauucuccugccucagcuccugaguagcugggauuacaagugugcgacaccacauccgucuaauuuuuguauuuuuaguagagaugggauuucaccauguuggccaggcuggucucaaacuccugaccucaggugauccaccuacuucagccccccaaaguguugggauuacaggugugagccacugagcccggcagguuuuuauauuaauauuuuauuaguuuaaaauaacuuuuccuuacucuagcugucauuuuuuuuguuauuccuuucaaaucacaaauucuucagauacaugucuuuuccauuuguuucaaauauugagcaagccugaauauccaaacauagaaacaucagaaaucauagguguaucucugaaaaaugcuguuuugagcccacgggaauuguggccauuguaccauuugcaaauggagauaacaccaaagcgcaaauuaucgaguccuagaaaaacaacagauguaguggucaagaagcaagaugugugccaaagaggauaagaaaaagaagcccuggcuggacacaggggcucaaggauguaaucccagcccuuugggaggccaaggugggcggaucacgcggucaggaguucaagaccagccuggccaacaugcugaaaccuggccucuacuaaaagcacaaaaaaaaaaaaaaaagaagcccuaacuccuccacucccuggcuacauaauuuugggaaagucauuuuaucucucugagcuucauucacuuuaucuguaaaacggaauaauagucuuacuucucucacaggauguuuggaaagucaaaugaggaaacauacugcaaagcacuuuauggccuaaaaacugcaauacaaauauaucaaucgguauuuuguuguuguugcaugagcaauguucaacauacagguuaaguuacacacuaaacauagaauuuucauuucaaaguaaaccauuaccauuauuaaaaauugauauaaaaaacuugccuuggauugauuucucuuuccacuucucaugcuaaacuucuccuucauuucuucuaaaauuaucuucaguuucuuuucuucagguguuccuaaguauuuuugguucacaugaagauagcaaugccauuuagcugauucaaagccccaguggcaaguucuuuugucaggugaucugugagaaugcaucacaaacgucuggggugcaaacauuccacaacacuccagacauugaauacacggagcaucaggcugaacauaaaacuggggugcaaauaaacccugacauuugccuaggcauucaugcuccacuucaaaggcacugccaguuuccuuuaacugggccaaugagcuuuuagcaggaaguacgcuaccauuuugaggaaaaguucguggccgcaauaaagcauuacauaaucuuugugcaucaguuaauguaaucagcccacaggauggggcauugaauggaaguaugcccaguaccuuuaagauaugaagcuggucugaaguacaccuugaacaauauauguacaguucaucacacacuguauuuauuugcuggaguguaaauucucggagaacagaauuuaagacuuggggcaaacagagucucuuuucuccuccaacuugaaaacaagaaauagauuccccuuccaacacagucugagugaguucuguggagcuaucugaagggaugagcaaugggccaggaagaaccugaggugauggaagaggcagaaauacaguaggcgacaugcuuucuugggaaugccgagcagaaaaugcugcugguccacccagcgagcucugacuacuuaaauggaauugugccaauguguguuucaaacugggauuuaaaugcaaaguuucaggaacagaaguacagguucgcuuaacaugcucuccaucaguuuccacuggugcuucuccauagucauccaaguguuccuucuuaacuguuggcaccuuguuuaucguuuuuccauuugcaugaauguccguuaucauuuuuuucgcuggggggcugccaucaucucccaucccauucaguuuuuuaguugagcccugaaccaaggagaaauuugucuggagguuuuccaugguacacucuucuguuaaauaauuaagucugagauuagcauuucuauuuaguugcuuauuugaaaagaggaaaguaaugaauggauacaaaugccuaucguaacuuacucucaaacuuucaaagcgagagccccuuaaauuaauaaauuuugcgacuuaguuuugguucuccuuauaaucugguauaauuucacuacaaauccuauaaaauuguucguuuugccucuaauaauaaagaaaagaggcacaccucugaggaugccuuuguuuucuugaauucuucagauauacauauuaaaauaaaguuaccaauuucucaauuaaagauguccagggucaaugcaauggucugguuuguuuuaaccaaaacacaugaaaaguuuaugccauuccuugugccauaaaaucuagacucaaacacaagucaaaaugaugcaaccaaauuuaaucuuuaccaccaaggaaaccaaaaaggagggcagagggaguauuuccucuaaaaaugauggucugcuggucugugcugaaaaacugaagacguguguaaauccucacaccaguaagaacagccuccgacuuaaaaaauugcccaguuaucuucaaggauuauaguucauucuucuuuuaauuaaucuggaagaagagaagggggguuggggaagaguuacauuugaauuugcuccagaggccaaagggccaauuugaaaccaguuucuuuuauuuuuuuuuuuuucuuuuuuuuacggagucucgcucugucgcccaggcugaagugcagcgaucucggcauacugcaaccuccgccucccggguucaagcaauuuuccugucucagacuccggaguagcugggacuacaggcacaagccacgacacccggcuaauuuuuuuguauuuuuaguagaaacgggguuucaccauauuagucaggcuggucuugaacuccugaccucaggugauccgcccgcccgggccucccaaagugcuggaauuacaggcgugagccaccgcacccggccgaaaucaguuucuuaaucuuaaacugaguucaguuuaccaaggugaagcuugagugauuucuuuaaaucuaacaccaguuuacuagaagaacauucauuuaaauaggaaagcaauuuggaguugcguaaagcgagcaauaauauaacauaaaaggccuuucgaguucagaauaugaagacucuuaagcagaucaucucaauuaguaguaccggggcuuucucagcuaugccauuuuaagggagggaaaaaaauccauuacuucaucuccuauuuaaaaacaaaacaacaguuucauccaaaaaaaucagauaggaguuaacauaucuaccauauguaacuaaguuacaauuuuaaguggauuaauucagcuaguccguguacacuauuuuucuggaaugacugcaggcaaaaauuaacuuucucuuaaaaaaagguuagcgauuuuacuuaauggaagccaaaagcuauagacuccacgccugggaaucuccauccuucaacaagacuaauccgggacaaaaagcacaaggcagacaaaccucacaaagaaugcaaauggaggaagagggaaaaagaaaagacucuuuuuccacuuccuucuugagagaaaagccaaaagaaauccaauaaauagaaauuuuugcuucccaaacucucagcacuuuaccuuaaaacagacccaaaggauuaaggaccaaugccaccaaccaucguacagacuuucguccaccacaggaacacaccuuacucaacacaggccaaggaagagagcaagaggcaugaccuagaaugggggagccccuaaaacccugaaguccuccgcccacucaaagccacccaccuaucucuaacccggagagagggagaacaagggacacgggaagccugggggugggugugcaaggggguggagggaaguaaagggaggaguccccccacccccaccggcgagccugggauaaccccaagugcccucccaacaccgcccccccgcgggggccgcgggaaggacuguggaaauccacccccccgcgcacccucucccugggaaguucucgggugucaccucagcgccccuaaugcugcaccuccccgcgccagccccgggccagaacgaagaggacaccagggcaguuuaggcgccgggcgcggaucccugcgccgccgggggcugacggaccgggucgagaccagggcauccccgcggagcgcugcuggacugggggaggggggcggugacgggcguccgggucuccgggguccccgcggcucccgucaacuacagcgcccugcccugccggcgcccaccgccuggggccaacgaagcgugaucagccguggaacacccgccuagcgacccccucuggccccgaccccacccgggacccgcgcauccaaacccccuacucgggccucggugcccggguaagcucgacgagcuuugugaauuccccaccgccccugucgccgccgucgggcuccuaggagggugagcgccucuggccucccgccgccuccgccgcgucgccgccguaagccggagccgcaccugugcccgccgccgccgccgucgccgcucgcccgcucccuucggcugugccggcgcggcuccgaaccccacacacaucgcuacacacagcccucugacguca

SEQ ID NO: 13597 - RNA, 55156 nt, Homo sapiens
auuuucagacaagacucagaaaccguuuuauuaaacuggaacacaaaaugcguguuauaauaaugucaagccuuuaucagaaaucaguacauaagugaggauacacagccaaaaugagccaucaacaaaagcaguauaaauuuuaaauaaguuucagauuucuauacucaauaugcuaaagaaaauaaaaccgaaagaguaguuucaauuucacaauucacaguugauugguuuuaaucccaugacacguuugucauucugcagccccagaacacagacuuccaaagcagugacuggcacuccgacccaacagcauacacagaucuuaagccucuguaugacauuuagagaaaauuuuaauaaacaacccuaauuacacacaguuugggcugacauuuuuuagcuauauccuuuaucaaagauaguucuagugaaauagcaaaagcaguuuuaaaaguuugccaugccauucaauaaaggguucuaaagccucccuugguuuuacauuuuauucucuaauuuaaaacaauaacugcauuaaaaugcaaccuuaauggugaaagcaaaaucgguuuugcuucugaaucuagagcauauuuccaaggagaagcaacuuauugucccagcagauauauggaaugcuuuaaagcaggaucugacauacuccaguaaggcauuucaaagcagacacaucauacccaaacuaaaucauuauggucagucaaggauaccacaggugaacaccaaguaacgcagaguuaacgugaaauucuuacaaaugacacacgauuuacaaaaccccagaaagguacucagguaccaaaagagggcagaacaaugaccagccacuccaaaagaguuuuguuccuauacaugccauauuugcagaguagaaacaaacugcccuauuugcgcuuugcccuaggauaauaucacucauucugacauguggaguuacucuuccuuaaaaaaauauaucauguagagaauacacaaauaauaauaaaugauauagaacauuuauuauuuucacuagugagggggucacuuaagcacuuacaaagacuuauaaaugaaucaugaaggucaucaaaaugcaaaaacauccaauaaauguugcauuauuaguauucaacagugcagcaagauuuuuagcaacugcgucgggcuuaauuuggaacuauggccaugagaauauguuuaaguucaaagaacugccagaugucuaaaaaaaaaaguguaauuaguaaaaauauggauuuucccuccaagggcccaaaggaaguguucaguuacuuuggaagccaugaauuuuaucaaacacacacaagaauaugaaucuggaacauuucaauucugauucaauucuacccauugaaucuucaugaccuggagaaagucacuuaaaauucuuuagauuuuaucuaaagaaucuuauccacaaaaagugggcauaaaaauaaaggcauauguaaaaauaauuuuuucuaaacaugacuacaauaaagcuaaagaugguuacuaaggcuuacaauuucaacaacucauuguacaguacaaucauuuuuaauucugcuaauuauagcuggaggaaguguggauaauuacaauucucaaggaauucaaaucaaauucuuuagaaaaauuaauaguuucaacuuacuaagcuacuuaaucugcucuccuagaguuguuuaaaacagcuaauuauauagggguuugacccuuuacuccccucuaccuucugguagagcagcugaaaguagugaaaggagaagugacaagagggagaaaagcagcaacagauugaaaugagguauucgcugauuucauaaaccccaaucaguaauuuacaguuuuuugaagaagcugcauaguuuggcaaaaauacauuaucagaaguggggaaaagaaaaauuauauugaaacuuuaaaauuuaugacaagcacuuaaaaaugaccaauucuaaaauaaacuuguguuugaaaggaauuguccucccucacccuaaguacacacaaaaagagaaacuggaagacaaaaguccacaggaggaaaaaaaaaaaaguauguuaauuggcucagauuaucaacuucauacaccacuuucaaaauagauauuuaaacgaauacuaaaccuuaauuaaugacacccaugcuaagaauuuagggcaguguauugccuaaaauuuacuuuggaauguucuuuaaaaaaaaaaucugauggaucgauggaugaaaagagggauagagaauaugaacagauacauggcaauacaaguauagucaaauguugauggcagaaucuagcagugguuauacugcaaaguuuuuucaacuuugauauaugucugaaaauuuucuugagaaaauguugaggaacauguuaacauuucuauaauaaaaucagucuagcagggcguuucuaagauucuaaguagucaggcaauuuagaauuuuaaauuaauuaaacuagggaaaauuuugcuuuuaauggcuucaaaccugauuugugaagaugcuucauuuaauauagaaaugaacuaacacaauuaauaauuauugugccagucucuucgcuuuagcugcaaauacauaauuuuuccccucucuacagaagacaaguuugaaaaugaccacuagaauaaagaauuuuuccaaacaucagugucaagcucuuccaaucaaccacacugccauucacuaaguacaaacgcaacacagaucaaggugaaaaaugaucucugacuucugccagcuugggaaaacuggauucauuuucagaauguaugguuucugaucaauaaugacaauaguuuuacuugauaucaaauugacauuuauuuaaaaaagggaaaaaaaagacguagaacagaauucacacagaccuuuguuauuccaagcuccuauuuaugaauggugauuaauagcaauaauucugucucucuucucucugugaaaugcuaacacuugcuaaaggcacucagauucugggcuuaacggagacaaggucacaugggaccauaagccaguacguuuuuugguagcuacccagaaaggaaguuuacaaauguuccucccauucauaacgggaagaaaaagucaaacagcuaucaguagaagcguuuuaugagaagcuauuuacacagcuauuuguccauucagccagagugacaguaacugcucacaaugguagggguucuccccugccaagaaagcaaaaacaauaacaaaacacuuuuuaucauauaugaaacuccuguacaaugauuuggcuagaagaaaaaaauaguugguaaggucaaauuuguuuuaaaacaucuguucaaaagccugcauuaaacuuuuaucuguccugacaaaacaugucucaauuucuuucuaaagcagcucuauuguccuagcauaugccucaccaaguucuuuaaagggcauuuccaaccuuaguucugacaaugaagacacaaaguagguuagguuccaaaaccacccuuccuagcccucccuguagaaaauaccauguugcacaguuacauguguccccugacacaaacgacacucauuuuacguaggucacuggaccucaaacuguuguugcuugcugucccagccaauucaagagugaaggaagauguaaccagacauacauaucucccuuucucccuguucaaacuguagauagguagcuauaagcaagcauauaguucuguagaaaagcuuucuaaaaugagguggaagaucucgugcuucuuguuagcuuuuuaagucaggggaauguaaggaugaugucaaauagccacgauucuucuuuuaaacucagggcuucaaaaauccuaccugguuuucuaaguuuaccaacuaauuaaaaggucagugaagaagaguuggaggaggaacuuuuuccaaauaaaugguauaaaaaaauuauucaccuugcagaauuuagugcaauaagagacaggcagacaaacauaaacaacaugcacauauuuacaaguugcaggacaugaugcacaaugugaagaccaacaaaguauuuucaaagcaucuucagugcacucaaaaggauuacagggcacacucaguuuaguaacugaacuuuuuuuacaaaaccacuucaaagguauaugcaauccaaucuuuuaguugaaacacgaauuuucuuucuuuacaacuucuuacccucaauaccuaagaagaauucuaauugucaucuucuaacguugauuuuuuaugacaacuuacacaaagauauuauucacagagaaaagagacugaugcuaugaguuccuauggaugauuaccgaaaucuaaguauuuuuuuuucuaauuuuuguuguuguugugguuuaggccucuguccauccuugaagacagcauagaaaaggacacuaacauaauuccuggggagcacaaggugcaaauccuaaaguauguuacagagacagacugagcuucacaaaaugaaaccaacgaagaucacauaucacugacucagaagaaacaacagucugcuuaaacagagaaaaaacacuguuuauggaauacaugaauaugagaaauuguaccaugcagagauguaucuauuuaggcauuuccugccugauaaccucugucacccuuuguuuucaccuauggaacagagaagaauacugcaagguaacaagcucaaaacauaaccuacugucauagagauuugugauuuuuuuucagaugugcauguaacuuuuacaagugaucauggaaguuauuuaucaacuucccagaguuuggaauuuaaggagcaaacugaguuauuguaggcaauacgguacuaaaguguccuauaaaacaaacacauagcucuuuuuuagugcaaagaaauauagcaaguaagaaauaacacuauaaaucuaacuucuuucuuuaaaagaaaaugugcuuaugcauucauaacauccauuaagggcacugggaaacuggaaaccugaauccacaaggccugaaaaaacaucaagcccuuaagucggcugcuuuuucuacguauauaaugaaauuguuaaguggagagagcaaggggaacccuucuuauaaaacuauuuccaauggaaaacaaaguggaugaaugacauuuuuacaaaauauaaauucauguucguaucuucuacuguuauuugaaauaaggguugaaauaccucucuaugacaacauauauguacguguguguguggggguaugcauacacacacaucuaccuauggaggaaaaaaacuagauuuuuagguaaucauagaaccaagcggccagcacuauaauguuaaaauuaaccaaaaaauuauauuuagcagcaaaaugaauaaccuacuggccaauaagaaaagcccuaaauugcucaaaacuaagcaacucuacuuuauagauuacugaaaaaauaauaauaauaauaauaauaaaaggguuauuauacuaagagucacaggucuagauagaauccuaacagaauaguauuugauucuucuguuucugggagaagaaaaguuacaaaauaauucuacuucucaaagaaccaccacuucaagagaagacaguaacuggauacuauacaaggguuaaucacacaaaacucguuuuuaaacaugggucugaguuguuuaaaaauugucccaaaguauuacagaagaagaaugauuguaauuugccuuccccaauuuuuuuugccuacagaauuaucaagaaaaaauagaaguuuuaccucuaauuaguaauacaagcaaucaaaugugaacugaccauugugcaaacauacugcuuaaaauauaaacuuccugaucaagugggcuuucaaaagaaauacggaugaccacuggucuuacccauauaaaauauaguaaauagauaaaauguaguuaaugaauauucacagagcacuccauuaguuaaucuagauauauauuauagcuucuuuuuuuuuuuuuuuggagacggaguauugcucugucgcccagacuggagugcaguggcacgauucuuggcugacugcaaccuccaccuccuggguucauacaacuucuuauuuuaaacgcaaaaaaacaaaaauaauaauacugauauaauuaucagaugccaaagugaucuaucauauacuuguuaguaucuucaagaaagccgaauuacaaagaauaaaaccauaguucguguauauuucuacuggaaacgaagauagugaaacuuuauuugcuuuuuaaaaaauuccucuguguauaaaacagcagguggugauauuuuucaggauggccaccagacuggcaagacagaggaaaauguaaguaaaccguaagaaucagauuaucaaaaaagucuggcaaaacaaaauaucaagcaaucugaacuuaugguuuagaucaugauauaagcgcauguuacuaucaaugaaguaacucuaaauuggaaaaucaaacacaccuuuguuuccuaaaaacugcuggaaaauauaucuauauauauauauauuuuuuuuuuuuuuuuuuuuuuuuuuuugagacggagucucgcucugucacccaggcuggagugcaguggcgcgaucucggcucacugcaagcuccgccucccggguucacgccauucuccugccucagccuccagaguagcugggacuacaggcacccaccaccacgcccggcuaauguuuuguauuuuuaguagagaugggguuucacuguguuagccaggaugaucucgaccuccugaccucgugauccgccugcuucggccucccaaagugcugggauuacaggcgugagccaccgcgcccggcccuauuuuuugaaaucauauccaucuuaaacucauugaauauucaaauaugaggcuuggaaaacccacagcacagcuggggcaugaaaaugggcuuguuagacaagcugauucaacuaggggggaaaaaagaggagggaagaaggcggcaauuauaugugugaaauccacaacuggaaaucaaguuuagcuguuuggaaguauacaagcucauugggaguauuugaauucaagaaaauuugcgcuucaaugauggggagacaugauacagaaaaaaaaauguccugggaaagacccuaacaguuucuaauaauguauccuacugacaaugcauugagguggcgguucugguuaagcccugggaaacugaaaucucugcugaccuauuuuuacuuugaucuaaaaagaauucaauacaauucuuuaacaguacauaaaacuacaauugcaaaagaaaauggcagaaaaaaaugucccgggaaagaccuuaacaguuucuaauaauguauucuacugacaaugcauugagguggcgguucugguuaagcccugggaaacugaaaucucugccaaccuauuuuuacugugaucuaaaaagaauucaguacaauucuuuaacaguacauaaaacuaaaauugcaaaagaaaaugaaacuuuuaaauagucaaaguucuaagccgucaggcuacuaguugaccagaacuugagcaagauaaaaaguuauuucugaugggguagguaggucacaugcuaugagcggcucaacaccauugacccugcaaaagcguuaugaccuaagaagcacguucuucacacccaccuccccccgccccgcccccgggcccccagguuuugacaucucaugguaccacuguggguuacauguauuaacauuaagcagaggaauguacucauaucaaaaagaccacaaagcagggcaaguugacaaaaggcaaacaacaggcaggaaaagcugcucuaucuuaauaugauaaucacuauacauaucccagauucuccaucucauuccuguaccgcuguucagacaccuugcucuuauguugcuugcucucuaaaugcugccggaauuccaucucuucgccagcuccaacauuacacauugagcaguaaaacuggccacuuggaguaacacacauggccagaucacguggaauucucugccgagagcggggauugaaguaaggaccugcuaaagcaagagauaaaaauaauauauucaaaauauucauuaagugaaugacaaccugaccaauuaucacuguaauuuguaauucuaaguucaaauuauaaaauucacagauucuuagcuuuaagugaaugugaaguuaauggauuuuuaaaauuacaauuuuacacagguucgaucuaaaaagauaaaaugauuccuccaaccauugucagaaaaauugcuguagagccaaacccaaauuccaaauggcugugucucuaaaaaagugaauacgcuuuuaaaaauacuuuaauuuccaagcauuauaucagaagucuuaugcuuaugcuaacccuuuaauccaaaaauucuacuuguaagaauuauccuaagaaaauacuaagaauuuucacacugagauuuaauagcaauauguuuaucucagcagugauuauaaaagcaaaaauuuagggggaagaagagauucaaaaauaggauuaaagaaaguaugguaaugaaugcaauggaaaacuaugccauugcuaaauauaauaaugcuauagaaaacucuuacgcuauuaaguaaacuaugaauaucccaaacuaggaucccauuucuauuuuaaagaagucauacauaugaagagacuagaaugaaaucugcaaaaguguuggugacauuacugaucauuucauuuucuucuuuuuacauuacugaccucauaagcuggacgcuuaguucguuaacuuuaugcuuuucacuuccacuauaauaauauauagguaauacuuuucucaaaauacugcuuucacugcauccuacaaguguuaauauauuuucauuacuguuucacuguaggaauuuuuaauuuccaguauaauuguuucuuugaaccaugaguuauuuagaaguguuuuuaaauuggaaaacaaauggaaauuuuguuugcuuuucuauuuuuguuguugacaucucauuucauuguacucuggucagagaacauaaucuauccuaaaauuuauuuuucugauauuaauacagcuaucccagcuucuuucauuucagauggauuucuuucauccaauuuaacauuuuuuggacuuugguaauuuuacauuuauuacaauuauuaauauauguuuagacuuuucuuaaucauaaugaauugugcuuuuuuuuuuuuuuuuuuuuuuuuugagacagagucuugcucugucacccagacuggaaugcagugguguaaucucagcucacuguagccuccaccucccagguucaagcgauucuccugccucagccucccaaguagcugggauuacaggcguaugccaccaugcccagcuaauuuuguauuuucaguagacacgggguuucaccguguuggccaggcuggucucgaacuccugaccucaggugauccaccuaccucagccucccaaagugcugggauuacacgcacgagccacaggagccuggccugaauugugcuuucuauauguccuuuuuuuaguaggcuucucuggcuuuucaguuagcucuguuuucuauuuguuucacuguucaaguaaaugaccucugcuggcaugugcaugaaucagaggcugaaguagaggggagggugagggacuacucagcccacucucccuacugaagacaaucagaaaaugcagaauuuauuccuauaaaucaguguuugugaacuaaauguguauaucagaagcaucaagcaagcauuuucaaaacacacauaugucuggguccuacuccaaauuuauucauugaaaaucucuaagucaugguucaggcauuuuguaaaagcuccuuggguaauucuguuucacuagccugguuaaaaaacacugcuuuagaaucuuuucuuuaacaugguacaacuuuaaaccaaguagcccauuuuuaucaugucuuuuacauuucucagcuggaaauauaaacaaacauaaggggacaaagauaagagauccuaaaacacagacuauaguguaaaaccaaaauaaauaauauauuauuuacaacaauaaaguaaauaaaugagaccugaaauacacaccagccugaaaggccgccacuagacuaauucaauaaaacacugacuaacuccaaauucucagggcuaucuauuaucauuaaaagaaauaaaaacaaaggagacuagguacagaauguacccaagguauguggaaacagacaagauaccugaauuauucuguacuguauacauauuucuccuguuaggcaucaucuuaaacucauucccuucuuuccuggcccgccguugacccagcucugaggauucccuggagaaaagaaguuuaaaaaagagugagucuucuaaacaagaaucccuuucuacucuuuuucuuuaaagacagucaaucucacauaacacuuuggccucagagaaaauggcaauaccuacgagaaugaguuacucugagcuuccgccagccgcagccucuuggcaugauucuucccuugauagugagccugagccacagcuggggaacugaaggaggcaucacagagcuuacaguaaucauucuccguggccaggaucacucggccuccuggcuuaaaggagcccaucugacaucaaagacacaagaagaaacaaaguuaaaaaaaauacagaguuuccuccuucuccucaaaggucuuucuaagagcugaaaaacaaccaaaggauauggcaugaccacaagcauuaagcuucaucaagaaaauaauucaauccaggaaaacaaaaaggcugggagauacuuaaucaugguuuugcauuauaaucacuuagguaccaaauuagugaauggcuaguugcugucgccacugaagacauuuuuuaagaguuuaaaaaccuuagauuuaggacaguaagucauggguaaaauagguaaggccuaaaaucacauuacgggaaacaguaaagucugcagaauccaucgauaagcauuuagugacuguuaacucuuuaucaggguugcugucuaguccaggagggauacauagucauauauuuuuuuaaaaagagccccuguccacaaagagucuacaaacuagcuacagauauaauccggaaaaaaauuaaaaauaaguagcaaauccagacaacuguagucagguuguggaauaacauguuaaagagagccuaacagauugcccagaagauaguaggcauucaguaaguauuagguuaacaaaaaaaaugacacacuagguuuuggccagaagagaauaauauaguacaugauaaagauucuggaaaccacauauaucagcaacaguugcagaaaacagcaucauuucacuuggaagggaaguuuuuucugggguaugcucugaagaaaggcuuaggcugccugcccgggaggguggagcccacugaaaacagcccccacuggggguagcuauucaauucuagagcagccuucagaaaccagugacaggaaaacuaugcagcuugaagaucucucuggguaucuucuuguucucugauuugguuuuuuauauaucucauuuuccccacaaauccaugagaaggaagaacagccagaauugcuacccacacuuuuaaauacuaaaaacuaacacucagaaaaguaaaaugauacaaacugguuaaaagcaaaggucuaagaucaaaagaaauucuugggcuggacacgguggcucaugccuguagucccagcacuuugggaggccgaggcagguggaucaccugaggucaggaguucaagaccagccuggccaacaugacaaaacccugucucuacuaaaauaacaaaaauuagcugggcaugguggcaggcaccuguaaucccagcuacucaggaggcugaggcaagagaauugcuugaaacccaggaggcggagguugcagugagcccagcacaccauugcacuccagccugggcaacaagagcaaaacuccaucucaaaaaaaaaaaaaaagaaagaaauucuugcuccaccacuuuacaaaaccuguaacaccauggaaaguuacuuagcucaucuaagcuucuaauaaacuucagugaggcugaaacugcugaccuauggacaccaauuugaguaauauggccaauaccucuaagucgcugcaagcauuaaaugacgucagggccugggacuaaaaugaagcaagugagacacuugccuugggcucagaauuuaauggagcaucaaaaaaaacucagcaaucaagauuaauaauacuuucauggaauuuuuuuaauuacauuuucuuuuuauuuuuuugagauagucucgcucugucacccagacuggaaugcaguggcacaaucuuggcucacugcaaccuccaccucccggguucaagugauucuugugccucacccucccaaguaccugagacuacaggcacacaccaccacacccagcuuaaaaaauuaaauuuaaugcaaaaaauuaaggaugaauaaaauaccaaaauuuuacauucagaaucaguaacaacacugccacaccaagucauauugcagccuggggcaaaaggaaaaucaguaauacuuauuuuaaguuuuuaauguuuuguucaccacuauuuuaaaucaauuuuacauuucuaaaauauuguauuaaauaucuaucuuuauuacugaguuuuuuggcuccuucuuaaauuuuaugcccaaguuuagugcauccaucaccucaccauagucccagcccugacugaaacaacguaugaaacaugcucagcacagugccuggcacgauauguacucuauuauaacuauuauuauuuaugaccacuguauuguuuuuauggacauauaacacuucaaagacagauuaagaguagacuccauguuucagaggcuacuaagguacaggaauaucuugccuaaagcaccuguucuaucuuccaaagagcagaagaacuugguuuucaagucuguuucaugauagcaagguucaaaacauguuuacacaggcucucugaauagagguaaguaauaagcaaucucaaacaccuaauuuugcaacuggaaggcaaaaucugaaauaaaugggaugaacugcaauaaaggaacacauguuugaaaaucucucuuuucauuuugggguuagccuagacauucaggaucauuuagcccagaauuucuuuuuuuuuuuuuuuuuugagauggagucucgcacuguugcccaggcuggagugcaguggugcaaucucagcucacugcaagcuccgccucccggguucgcaccuuucuccugccucagccucccgagcagcugggacuacaggugcccgccaccacgccuggcuaauuuucuguauuuuuaauugggacaggguuucaccguguuagccaugauggucucgaucucuugaccucgugauucgcccgucucggccucccaaagugcugggauuacaggcaugagugaccgcaccuggccuauuuagcccagaauuuuaagaaauguauaaagacucacguaacaauagccugcauuaaauccagcacuguaguucaaggaguuaaaaguaccaagcagcaucuuucaggauuauuuucccaacuguacccuaauggacacauggacgacaaaugucaucuauaaccauuugugcauauuacagcuuccacccuaaugcugcuucacccugacacacaugucucaccugcggagggacuggaacaacuggaguagcugcaggcucgaccacauugcucauucuagcaggaggaggacagcuauuugcugcauaguaauuucggaguuucuuaccaugauuuuuacccuagaaauaaaaauaaaaugaguacagcaguccacccuuaucugcaguuucagcaauuucaguuagcuauggucaacugugguccaaaaauauuaagauauuuugagagagagaccacauucacauaauuuccaugacaguauauuuuuauaauuguucuuuuuucuaauuaauuauuguuguuauucucuuacuagcccaauuuauaaauuaaacuuucuccuggguuauguauguacaggaaaaaaaaaaaacgcauauagaagaguucagaaauaucacgguuuuaggcuucuacuagaggucuugauaucuccuauggauaaaaaaaaaugaaaacuguaaucaccaugagaaagugugucaaacugaguuaaucaauguauuuacuuaaucacuuaaaaaaaaaaagaaaaaaacacaauacuaacuacauuuuauuccuucacacauacacaacccuggggguaaacagacuacuauagugcuagauuugauugcuagaucuugaaguaaaagagccuacucuuuggcucuaacagaacaauuaaauuuuucugggaaagacaagagaacacagccaaaggaaauuaauuuccuguauguuucuuaaaaaguaucacauuggcugggugcgguggcucaugccuguaucucagcacuuugggaggccaaggaggguggaugaccugaggucaggaguucgagaccagccugaccaacauggugaaaccccaucucuacuaaaaauacaaaaauuagcugagcaugguggcacaugccuguaaucccagcuacucgggaggcugaggcaggagaaccacuuuaaccugggaggcggagguugcagugagcggaaaucacaccacugcacuccagccugggugacaaaguuagauucugucucaaauaaaaaaaaaaaaaacucucccucucccucccccucccccucccccucccccuccuccucccccucccccuccuccucccccuccuccucccccucccccuccuccucccccucccccuccacacagccucccucugaugcugauccgaggcuggacugcuugccgccaucucggcucacugcaaccucccugccugauucuccugccucagccugccgagugccugcgauugcaggugugcgccgccacgccugacugguuuucguauuuucugguggagacgggguuucgccguguuggccgggcuggucuccagcuccugaccgcgagugaucugccagccucggccucccgaggugccgggauugcagacagagucucgcucacucagugcucaauguugcccaggcuggacugcaguggcgugaucucggcuugcuacaaccuccaccucccagccgccugccuuggucucccaaagugccaacagugcagccucugcccggccgccaccccgucuaggaagugaggagcgucucugccuggccgcccaucgucugggaugugaggagccccucugcccggccgcccagucugggaagugaggagcgccucuucccggccaucaucccgucugggaagugaggugcgucucugcccggccacccaucgucugggauguggggagcaccucugccccgccgccccgucugagaugugaagagcaccucugcccggccgcgaccccgucugggaacugaggagugugucugccccaccaccaccccaucugggaggugaggagcgucucugaccagccacccugucugagaagugaggagccccucugccccgcagccgccccgucugggaagugaggagccccuccacccagcagccaccccaucugggaagugaggagcgucuccgcccggcagccaccccauccaggagguggggggcagcccccgcccggccgcuacaccgucugggaggugggggggcgucucugcccggccgccccgucugggaauugaggagccucucugcccggccgccaccccaucugggagguguacccaacagcucauugagaacgggccacgaugacgauggcgguuuugucgaauagaaaagggggaaguguggggaaaggaaagagagaucagauuguuacugugucuguguagaaagaaguagacauaggagacuccauuuuguucuguacuaagaaaaauucuucugccuugggcugcuguuaaucuauaaccuuacccccaaccccgugcucucugaaacaugugcuguguccacuaaggguuaaauggauuaagggcggugcaagaugugcuuuguuaaacagaugcuugaaggcagcauacucguuaagagucaucaccacucccuaaucucaaguacccagagacacaaacacugcggaaggcggaaggcggcagggcccucugccuaggaaaaccagagaccucuguucacguguuuaucugcugaccuucccuccacuauuguccuaugacccugccaaaucccccucuccgagaaacacccaagaaugaucaauaaauacuaaaaaaauuuuaaaaaaaaggaaagaaagaaaagaaaagaaaagaauaugggauuuuaggaaaaaaaaaaaagaaguaucacauuuuccagugacuuauguccucacccaacuucuugccauuuauaugccacagauaaauaugaauuucaugacacucugaucuaauguacuuuauaaguuaguaaugaaauggauaauccaauuauucuuuuaaaauugcccuuacagaguaucuuuuuacuuacaaaggauguucauugcauuuauucauuugcugcucacaaaaaucuuguaagaggaauuuguuaauauuguccauuuaugacagccaaggaacugcaauccagagacuguaaggagcuugcccccagcucccuucucaagggcuaaauagcacagccaaagccugagacaggccuuccaaaucaaagaauggcccuuuuccacuacagcaugauggcuucaagaugcacuaggaaccucuacuaacaucaacuugccuuucucaucacguuuuauuagucacaugauuauauuccuugaacugacacaaacuaguggcaagggucaauaguacaaaagcauucuaaauaaggguaaaacaguauauuauucuuuaaacugcauuguaaaacucaaaccugcaggcaaacauuuauucaccaucuauuuauaugcuaagcccuagaaauaaacuaaggacuagcacauagaggaggagacagauaccuaagcagcuaaauagaguaaugaacuaagauccaucuucuccucacuucaauacccuaaaggugcuuuuaccauggucacagugaacuccagagucaaauccaguggucacauaugugccuucaucuuacuggaacucaaaguagcaugacacaguucauuuccuucuugaaacauuccuccuacuaucaucuauacuccuucuucccuccccaccucuccuccucuaucagaccucuaaacucuacaauguccaaggacgcacccuuagcccucuuuuauucucugacucuagguuauucuacccagaccuauagcuuucaaauaccaugaguaaguuggugacuccccaaaucaucaaucuccaucuuugaccuucagaaccacauauccagcuuccuccuggucauccauacuuucacgucuuaagaggcauauccaacuuaaaacaacuuuugauuccuccuccauagaacuuucucaucaccaccaucaccaccaccacuagucauccacaguagguaaauggcaccaccauccacaaaauuacccaagaaaagccaagggguccuuuuccugauuccauccuucccuaagcccaacacauucaacccaucagcaagucuugucauucaaaauacaucccacaucacuccacuucucuccauggauacuacaaauaccacaguaauccaagguaccaacauuuuucauuugcaguagguaacaguggucauuugcaguagguaacaacuccuaauuggucucugcuguuaaucuuguccuccuagaauucuccucauuauaaacccaaguaauaauucuugacaugaaucaguuccaugucacucccucacauaaaacucuuccaauggcuuucugcuauacuuaaaauugacaaaucuuaccuauaaggcccuacacgaucuggcccugucuaacugacaaaucucaccuauaaggcccuacauguucuggccccaucuaauugacaaaucuuaccuauaaggcccuacaugaucuggccccgucuaucucuugggccuuaugucagacagcacuccuuccuuuccccugcucauuaugcuccuggcucacuaggcugcaugugcuccuuaaacaugccaagcucaggcuagcuccaaggccuuuguacuuaacuguuccuuuugccuagaauguaccucuugcagaucucuguauggauugcuccuucuaaucuuucaagucucaacucaaacuggaccucacucacucucaagugucacaaccacucccccucuccacaccacacacacuccaucauauuaccacacuggccgguuuuauuuuaucuuaguaucacuaaucacuaucuaaaauaauauaguuuguugacuuguuuuuuuuucucuuuccuccgcucuguaauguagacuucuugaaaaugaggaccucaucugucuuguuuacuguucuaaucccaaugccuagaauaguuuccagaauauagcaagcaagcaauaaauaacuguuggauaaaugaaccaaguauuauaaugaagauaauaaacugcuaggagaacacagagaaggaauuucuuacuccugccugaauguaucacggaagacuucccugaaaagggggcaacugacucaucuuuuuaaaugagcaaauguuuacaggggagguaagcaauacggaaaaagaaaacugugcaccaagaaaauagcaugagcaaaagcccagccuucuguguugaggggcuacaaggagagauaacggucuucuagauccuuuggaggagaggcaaaaauugaaauacacagggggcucauucuuaaugccuuugcccaugauaaagaacuuggacuucagaggcagcagggagccucugaggaacuuuaagcaaagcagugcaugacuugauuguauuugauaaagaugagcaucaggguagcagaccaaagcuggaagcugggaagauacacagaggagagucaaggacaaaauccuagacacuacaacauagagucuaguagagaaugaagauccagaaaaugagauugacaaggucuagccaaaaaguaagauaaaaaucagauaguauguuaucauagaagcccacaaccaaacuggaguucaagaguguggucaggaugaagacagacucucaggaaugaucugaauguggaugguauuuaaagcuauggagccaaaaacuaucaccuagacagaguggagacagauaacagcuugcaaaaugggccucaagcaagauaauggcuagauaaaggagaaagacgcaggaacuaugaagaagguaagaacaaguaauagcauauuggauaagaggguagaagggaggugaaccgcaggguagauggaaauauuuaugaaaaauuuuuaaagguguggggaggaaaaaaggcuuuggggaagaagauagagucaacaaucucaaucucaauaugagauugagacaaccgaaagacaucuuaaugaauccaagagacagugcaauguguggcuuagugacagcaacuggagacagacaaauuccuaggcagacagggaugggucccugugaaacccaaccucaugccaaagacaguuuaaagacugaaaacugagcugccaguugcagguggaguccacaacgagagugagaacuuccucgaugccuuuuaggcaaucaaauggugcuuuuuccaagccgacccgugaaccaaucagcacgcacucccccauucugagcccauaaaaaucccagacucaaccccacagauggcaaaccucuuuuggguccccucucacacacagggcuaaucacucuugggcccccucucugcugagagcuuuccuucuauugcucaaugaaauucuucuccacccuauucacucuccaguguccauguaccuuauuccucuuauuccucuuggucgcaggagaagaacccagaauaggccaaccuguaacacacacccauucacugagcugcggguggugggaccgacugagcuguaacaugccccuguucgccaagcugcagguggcaggaacaauacaaagcugcaacauuucuugggaggucaaaucuugggacuccccggaugagagcuguaacaccccuugggacucugccauuacugacaucucugaguuuucgggcaccacccacauuccccucaucuagacaacgacacccaaugcagaagcugcuggcaacacacccaguggagccaugggcugagugcagaucccucagcgggcgcaggauccaggccaaggcacaagccgagcacagccugccaggcugagugggcggagugagcucgguggaaugaggccccaggcagaggacacagcacccacagagauuuccggcuggugaagcagcaccaaaggaauccuuacacugcaacccucccuccugcucacugagcaacggggaaaaaaagccagugugccauuuccucccgcuugcugaacuacaaaagcugcaacauuagcacuaaggaagucaaggcuaagaagguuuagaagucuucuaaaaacaggugagaauuugaaucuacaacucuggcggaagauaacaggguuaaauaguuacugacuacccucuauguucuggcaaccauucuaagaaaaggagauaaaacagugaacaaaggcaaagucucugcccucaagaagcuuuucuaggggacauaaacagaauauauacauguacauauauauauguacacacacacaaccaaagaaaaaagaguuacugacaacugcucugcaaaaaauaaaacaggaugauauaauagauaauggacagggagagaguggggugggccgacaaggcuuuucuggggagauacaugucagcuaaaagcugaagcaugagauggcuccagccaugcaauguagagaaagggggaagagcugggcaucaagagacccacuugcuguguuaagucugagaucccuuucagauguccaaagagagaccaaccuggaguuuacgaacgaggucagguuagagauagaaucugaggaguuaucaguauguagguggaauuuaaaaccauggaacuagggccaggcacaguggcucaugccuauaaucccagcacuuugggaggcugaggcagaaggaucacuugagucuaagacuuugagaccaaacugggcaaaaugacaaaaccccaucucuaaaaaaagaaaaaugaggcaggcaugguggugcaaaccuauggucccagcugcugggagcacugagauggaaggaucaguuaaacccagaagguugagguugcagugagccaugacugcaaugcuacacuccagcugggugacagagcgagacccugucucaaaaaauaaaauaaaauacaagauggccaaauaggaacagcucuggucugcagcucccagcgugaucaaugcagcagacgggugauauccgcauuuugaacugagguaccugguucaccucacugggacugguuguacagugggugcagcccacagaggacgaacugaagcagggugggguguuaccucaaccgggaagccaagaggucaggggauuucccuuuccuagccaagagaagccgugacggacugcaccuggaaaaacaggacacuucugcccaaauacugcgcuuuucccaaggucuuagcaaccggaaaacaaggagauacucucccgugccuggcuuggcaggucccacguccacagagccucacucacugcuagcgcagcagucugagaucaaacugcaaggcagcagccuggcugggggaggggccucagccauugcugaggcuugaguagguaaacaaaguggcugggaagcucgaacugggcagagcccaccacagcucaacaaggccuacugccuccagacuccaccucagugggcagggcuuagcugaacaaaaggcagcagacaacuucugcaaaguucaaugucccuuucugacagcucugaagagagcagugguucucccaacaugguguuugagcucugagaauggacagacugccucuucaaguggcuccuugaccuccauguagccuaacugggagacacgucccaguaagggccaacagucaccucauauagaugggugccccucugggaugcagauuccggaggaaggaucaggcagcaauauuugcuguucugcaauauuugcuguucugcagccuccgcuggugauacccaggcaaaccgggucuggaguggaccuccagcaaacuccaacagaccugcagcugagggaccuauuagaaggaaaacuaacaaacagaaaggaauagcaucaacaucaacaaaaagaacgucuacaccaaaaccccaucuguaggucaccaacaucaaagaccaaagguagauaaaaccaaaaagauggggagaaaccagagcagaaaagcugaaaauucuaaaaaucagagugccuccucuccaaaggaucauaguuccucaccagcaauggaacaaagcuggacaaagaaugacucugacgaggugacagaaguagacuucagaaggucaguaauaacaaacuucuccaagcuaaaggagcauguucgaacccaucgcaaggaagcuaaaaaccuugaaaaaagguuagacgaauggcuaacuagaauaaacacuguagagaagaccuuaaaugacugauggagcugaaaaccauggcaugggaacuucgugacacaugcacaagcuucaauagccaauucgaucuaguggaagaaaggguaucagugauugaagaucaaauuaauuaaugaaauaaagcaagaagacaugguuagaaaaaaagaguaaaaagaaaugaacaaagccuccaagaaauaugggacuaugugaaaagaccaaaucuacguuugauugguguaccugaaagugauagggagaauggaaccaaguuggaaaacacucuucaggauauuauccaggagaacuuccccaaccuagcaaggcaggccaacauucaaauucaggaaauacagggaaugccacaaagauacuccuugggaagagcaaccccaagacauguaauugucacauucaccacgguugaaaugaaggaaaaaauguuaagggcagccagagagaaaggucgaguuacccacaaagggaaacccaucagacuaacagcggaucucucggcagaaacccuacaagccagaaaagagugggggccgauauucaacuuccuuaaagaaaagaauuuucaacccagaauuucauauccagccaaacuaagcuucauaagugaaggagaaaugaaauccuuuacagacaagcaaaugcugagagauuuugucaccaccaggccugccuuacaagaguuccugaaggaagcacuaaacauagaaacaaccgguaacaaccacugcaaaaacugccaaauuauaaagaccaucgaugcuaugaaaaaacugcaucaauuaaugggcaaaacaaccagcaaacaucaugacaggaucaaauucacacauaacaauacuaaccuuaaauguaaaugagcuaaaugccccaauuaaaagacacagacuggcaaauuggauaaagagucacaacccaucagugugcuguauucaggagacccaucucaugugcaaagacacacagaggcucaaaauaaagggauggaggaagaucuaccaagcaaauggaaagcaaaaaaaaaaaaaaagcagggguaacaauccuacucuccgauaaaacagacuuuaaaucaacaaagaucaaaagagacaaagaagggcauuacauaaugguaaagggaucaauucaaugagaagagcuaacuauccuaaauauauaugcacccaauacaggagcacccagauucauaaagcaaguccucagagacccacaaagagacuuagacucccacacaauaauaauaggagacuuuaacaucccacugucaauauuagacagauuaaugagacacaagguuaacaagcauauacaggacuugaacucagcucugcaccaagcagaccuaauagguaucuacagaacucuccaccccaaaucaacauaauauacauucuucucagcaccacaucacacuuauucuaaaauugaccacauaauuggaaguaaaguauuccucagcaaauguaaaagaacagaaaucacaacaaacugcaucucagaccacagugcaaucaaauuagaacucaggauuaagaaacucacucaaaacugcacaacuacauggaaacugaacaacuugcuccugaaugacuacuggguaaauaacgaaaugaaggcagaaauaaagauguucuuugaaacaaaugagaacaaaaacucaacguaccagagucucugggacacauuuaaagcagugugguagagggaaauuuauagcacuaaaugcccacaagagaaagcaggaaagaucuaaaauugacacccuaacauuacaauuaaaagaacuagagaaguaagagcaaacaaauucaaaggcuagcagaaggcaagaaauaacuaagaucagagcagaacugaaagagacagacacacaaaaaucccuucaaaaaaucacugaauccaggagcuguuuuuuuuaaaagaucaacaaaauugagagaccacuagcaagacuaauaaagaagaaaagagagaagaaucaaauagaugcaauaaaaaaaugauaaaggggaugucaccaccgaucccacagaaauacaaacuaccaucagugaauacuauaaacaccucuacgcaaacgaacuagaaaaucuagaagaaauggauaaacuccugggcacauacacccucccaagacuaauccaggaagaaguugaaucucugaauagaccaguaacaggcucugaaauugaggcaauaauuaauagccuaccaaucaaaaaaaguccagggccagacagauucacagccgaauucuaccagagguacaaagaggagcugguaccauuccuucugaaacuauuccaaucaauaaaaagagggaacucauuuuaugaggccaacaucaucccgacaccaaagccuggaagagauacaacaaaaaccagagaacuuuagaccaauaucccugauaaacauggaugcgaaaauccucaauaaaauacuggcaaaccgaauccagcagcguaucaaaaagcuuauccaccaugaucaggucagcuucaucccugggaugcaaggcugguucaacauacacaaaucaaaaaacauaauccaucacauaaacagaaccaaugacaaaaaccacaugauuaucucaauagaggcagaaaaggccuuugacaaaacucaacagccuucaugccaaaaacucucaauaaauuagguauugauggaacguaucucaaaauaauaagagcuauuuaugacaaacccacagccaauaucacacugaaugggcaaaaacuggaagcauucucuuugaaaacuggcacaagacaaggaugcccucucucaccacuccuauucaacauaguguuggaaguucuggccagggcaaucaggcaagagaaagaaauaaaggguauucaauuaggagaagaggaagucaaauugucccugcuugcagaugacaugauuguauauuuagaaaaccccauugucucagcccaaaaucuccuuaagcugauaagcaacaucagcaaagucucagauacaaaaucaaugugcaaaaaucacaagcacuccuauacaccaauaacagacaaacagagagccaaaucaucagugaacucccauucacaauugcuacgaaaacaauaaaauaccuaggaauccaacuuacaagggaugugaaggaccucuucaaagagagcuacaaaccacugcuuaaggaaauaaaagaggacacaaacaaauggaagaacauuccaugcucaugaacaggaagaaucaauaucgugaaaauagccauacugcccaagguaauuuauagauuaaaugccauccccaucaagcuaccaaugacuuucuucacagaauuggaaaaaacuacuuuaaaguucauauggaaccaaaaaaagagcccgcauugccaagacaauccuaagccaaaagaacaaagcuggaggcaucaugcuaccugacuucaaacuauacuacaagccuacaguaaccaaaacagcaugguacugguaccaaaacagacauauagaccaauggaaaagaacaggccucagaaauaacaccacacaucuacaaccaucugaucuuugacaaaccugacaaaaacaagaaauggggaaaggauucccuauuuaauaaauggugcugggaaaacuggcuagccauauguagaaagcugaaacuggaucccuuccuuacuccuuauacaaaaauuaauucaagauggauuaaagacuuaaauguuagaccuaaaaccauaaaaauccuagaagaaaaccuaggcaauaccauucagcacauaggcaugggcacagacuucacaacuaaaacaccaaaagcaauggcaacaaaagccaaaauagacaaaugggaccuaauuaaacuaaagagcuucugcacagcaaaagaaacuaccaucagagugaacaggcaaccuacagaaugggagaaaauuuuugcgaucuccccaucugacaaagggcuaauauccagaaucuacaaagaacucaaauuuacaagaaaaaaacaaagaaccccaucaaaaagugggcaaaggauaugaggauaugaacagacacuucucaaaagaugacaucuaugcagccaacagauacauggaaaaaugcucaucaucauucgucgucagagaaaugaaaaucaaaaccacaaugaagauucacaccaguuagaauggcaaucauuaaaaagucaggaaacaacaaaugcuggagaggauguggagaaauaggaacgcuuuacacuguuggugggaguguaaauuaguucaaccacuguggaagacaguguggcaaucccuuaaggaucuagaacuagaaauaccauuugacccagcaaucccauuacuagguauauacccaaaggauuauaaaucauacuacuauaaagacacaugcacacguauguuuauugcggcacuauucacaauagcaaagacuuggaaccaacccgaauguccaucaaugauagacuggaugaagaaaaugugguggccgggcacgguggcucacgccuguaaucccagcacuuugggaggucaaggcaggaggaucacaaggucaggagauugagaacauccuggcuaacaugaugaaacccugucucuacuaaaacuacaaaaaauuagccaggcaugguugcaggugcuuguagucccagcuacuugggaggcugaggcaggagaauggcaugaacccaggaggcggagcuugcagugagccaagauugcaccaccacacucccgccuggacgacagagcaagacucugucucaaaagaaaaaaagaaagaaaaugugacacauauacaccauggaauacuaugcagccauaaaaaaggaugaguucauguccuuugcagggacauggauggagcuggaaaccaucauucucagcaaacuaucacaaggacagaaaaccaaauaccuuauguucucacucauacgugggaauugaacaaggauaucacuuggacacagggcggggaacaucacacacuagggccugucagggggcgggggacuaggggagggauagcauuaggagauauaccuaauguaaaugacgaguugaugggugcagcaaaccaacaugguacauguauaccuauguaucaaaccugcgcauugugcacauguaccccagaacuuaaaguauaauaaaaaauaauaauaauaauaaauaaaauuaaauaaaaccaugaaacuagguaaguuaccuagacgagucggugauagagagcaaaggacaaaccucuaagacacuacaauaucaaguguggcaaagaauccaaaaauaagauugagaaugcccaugaaauaagauaaaaaccagacaagugcagugucauagaagucuggaacaaaguggcucaaaagaagagucuaguuaaauacauuaugacccaggaacuauaguucuagguauuacgaaacagaaacauacauaggagauaaccauaaggaugcuccuagaaguauuguuuguaacagcaaaaaagguggaaacaauguaagugaccaccuacaggacaacagauaaauuguagauuauucauacagaggaacacuacacaguagugaaaguaaacacucuagggccaugcauggaaacaugaaucggucucauaacaaaauacugaauaaaaagagcaaauugcaaaagaagauauguaagaauaauuuuuaauauagggucuaaaaauauaaaaaacaacacuauauacuuauauaagggaacauauauguagcaaauauacaaaaacaaugugugguaacaauaaauaucaauccaguauaguggcuacaucuaggggcauaggauagggauacaauugggaagagauacauggggacuucagcugaauuaauaauuuuuacuccuuaagcuagauggcaaauacaaauguuuauuauauuuuugguaccuuauaucugaaggacuucauaaucauucagcacaacaauaaccaaaaaagggaguaguucaucaggucaaaagcugcugugaauaaagucaggagagagaagugauacuuggauuugcaaagacagaggucacaacuggccuagguaagaaucacuucagcagaacagugagagauaaaggucaugugaagugguuuaacuaggaaaacacccaguacaggcaacuaugcagaagagcucuaugacagggagcagagaaauccggcaugcagcuagacagagaaaugggaucauuucccuuugaaauauggauuuuagaggcuugucuguaugacaacaggaagaagucacuaaaagcagaagaacagcugauacaggagcugaagagcaugacuacaggaacacaguccaugaaaaggcagaagagguacccaguacuaguggaggggucaagguuagauaguaucagguauuuuauuuccaaagcagcauccccaguaguauucaagcagauauugcauccacaacauaaugauacuaauggcaacuaagaaaaguaugcaaauuugcagggaaaauagcagacaggaggcaggacuaacuagcagcucccacucagauggacagagcaguguguggagacccauaucaugaaauuuugcuccaagaacuacagcaggaacauaccaggaaagcggaggguauucacaggcccuuugaaggaggcggauugccacugcagacuccgugggacagcugaggaacugagucggccugcuuucucagcugggaggcuuguggucuggggcaaguucucagcccugaccaccagcugccuggaaaugaacucagugcuacagaugaggcacagugggaggaagaccagccuuuagggcugggggaugcaugggagcugggugaggccuguaacagccagcuuucccccaauucccuggugaccugugugacacagcagaggcagccauaaucccccugggaacauaacuccauuggcccguucacaccccuauuccccauagcagcugcagcaagccccacccaaggagagacugaccucagacaugccuaacccugccccaacccgauggucuucucuacccacacugguggccgaagacaaaggacauaagcucuugggagcucuggggccccacccaccgcaugaucaucucuauacuaccauagcugaugcacucuugaaagcaccaccuccuggcuggagaccaaccaacacaaaaccagcacacuuaacaaaaauacaaccaaggacccucacugaguccacuucacuccccggcuaccuccaccagagcaggugcugguauccacagcugacagacaugaagaugaaucauaucacaggacucccugcagacacugcccaguaccaacccagagcccaguagcuccacuagguggcuagauccagaagaaaaauaacaauuauugcaguucagcucucaguaagccccauccuagaggaaaggugagagcaccacaucaggggagcacccugugggacaaaagaaucugaagagcagccucugagucccagaucuucccucugacauagucuacccaaaugaggaagaaccacaaaaauaauucuugugacaugacaaaacaagguucuuuaacacccccaaaagaucaccuuagcucaccagcaguggauccaaaccaaggugaaauaucugaauugccagaaaaagaauucagaaggucaacuacuaauccaaucaaggaggcaccaggccgagcgugguggcucacgccuguaaucccagcacuuugggaggcugaggcaggcagaucaccugaggucaggaguucaagaccagccugaccaacauggugaaacccaaucucuacuaaaaauacaaaaaaaaaaaauagccggaugugguggugcucgccuauagucucagcuacucaggaggcugaagcaggagaaucacuucaguccgggaggcaaagguugcagugagcugagaucaugugacugcacuccagccugggugacagaguaagacucagucucaaaaaaaaaaggaggcaccagagaaaggugaaguccaacuuaaauaaaucaaaaaauaauacagguaugaauggaaaauguucagugaaauagauagcauaaauaaaaaacaaucacaacuucuggaaaugaaggacacgcucagagaaaugcaaaaugcacugaaaagucucagcaauagagucggacaaguagaagaacuucagagcucaaauauaaggcuuuugaauuaacccaaauugauaaagacaaagaaaaaagaauuuuuaaaaaaugaacaaagccucgaagaaguuugagauuacgauaaacgaccaaaccuaagaauaauugcuguuccugaggaagaagagaaaucuaaaaguuugcaaaacauauuugagggaauaauugaggaaaacuuccucagccuugcuagagaucuagacauccgaauacaagaagcucaaagaacaccuaggaaauucauugcaaaaagaucaucgccuaggcauacagucaucagguuaccuaaagucaagaugaaagaaagaaucuuaagagcugugaggcaaaagcaucagguaaccuauaaaggaaaaccuaucagauuaacagcagaugucucagccgaaacccuacaagcuagaagggacugggguccuaucuuuagccuucuuaaacaaaacaauuaucagccaagaacuuuguauccagugaaacuaagcugcauaaaugaaggaaagauacugucuuugucagacaaaaaacuucugagagaauuugccacuaccaagccagcauuacaagaacuacuaaaaggaguucuaaaucuugaaacaaauccuccaaauacacaaaaauaggaaauccuuaaagcauaaaucucacaggaccuauaaaauaacacaauggaaaaaaacccaagguauucaggcaaaaaaaaaaaaaaaacagcacaaugaacaaaauaguacuucacaugucaauauuaacauugaaugcaaauugccuaaauucuccacuuaaaauauuccaaauggcaaaacggauaagaauucaccaaccaaguaucugcuaucuucaagagacucgugauacauaaggacucacauaaacuuaagguaacagggugaaaaaagauauucuaugcaaauggacaacaaaagugagcaggaguagcuauucuuauuugagacaaaauaaacuucaaagcaacagcaguuaaaaaagacaaagagggacauaauacaauaauaaaaggacuaguccaaaaggaaaacaucacaauccuaaauauauaugcaccuaauacuggagcuuccaaacuuauaaaacaauuacuacuagaccuaacaaaugagauagacagcaauacaauaauugugggggacuucaauacuccacugacagcacuagacaggucuuuaagacagaaagucaacaaagaaacaauaaacuauacguuacaauaaaugcacuucacagauauuuacagaggauccuacccaacaacugcagaauauacauucuauucaucagcacauggaacauucuucaagguagaccauaugauagccacaaaacaagucucaacaaauuuaagaaaaucgaacuuauagcaaguacuuucucagaccacaguggaauaaaauuggaaaucaacuccaaaagaaacccucaaaaccaugcgaauacauggaaauuaaauaaccugcuccugaaugauuguugggucaacaauaaaaucaagauggaaauuaaaaaauuauuugaacugaacgauaauagugauacaaccuaugaaaaccucugugauacagcaaaggcagugcuaauagcauuaacugccuacaucaaaaaguuugaaaggggcugggcaugguugcucaugccuguaaucccagcacuuugggaggccaaggcaggcggaucacgaggucaagagaucaagaccauccuggcuaacauggugaaaccacgucucuacuaaaaauacaaaaaauuagcugggcgugguggugggcgccuguagucucagcuacucgggaggcugaggcaggagaauggcaugaaccugggaggcagagcuggcaguaagacaagaucgcgccacugcacucuagucugggugacagagcaagacuccgucucaaaaaaaaaaaaaaaaaaaaaaaaaagccaagccuaaaagaacacaaauagacaauguaaggucacaccucacagaacuggagaaacaaaacaauccaaacccaaacccagcagaagaaaagaaauagucaagaucagaacagaacuaaaugaaauugaaacaaaaaaaauacaaaagauuaagugaaacaaaagguugguuuuuugacaagauaaauaaaacuaauaaacaauuauugagguuagccaagaaaauaagagagaaaauccaaauaagcucaauuagaaaugaaaugggagauauuacaacaaauaccacagaaauacaaaaaaucauucaaggcuauuaugaacaccuuuaugugcauaaacuagaaaaccuaaaggagauggguagaaauauacaacccuccuagauuaaaccaagaauacauagaaacugaacagaccaauaacaagcagcaagauugcaaugguaauuaaaaaguuaccaacaaaaaaaaaaguccaagaccagaaagaugcacagcugaauucuaucagacauucaaagaagaacugguaccaauccuacugacacuacuccaaaagacaaagaaauagggaauccucccgaaaucauucuaugaaguccauaucacccuaacaccaaaaccaggaaaggauauuccaaauaaaagaaaacuacagaccaauaucccugaugaacacagaugcaaaaauccucaacaaaauacuagcuaagcaaauccaacagcauaucaaaaagauaauccaccaugaucaaguggguuucacaccagggauuuagggaugguuuuacaucuagggaugguuuaacauccucaagucaauaaaugugauacacuacauaaaagaauuaaaaacaaaaaucauaugaucaccucaauagacacagaaaaagcauuugacaaaaucuagcaucccuuuaugguuaaaacccucagcaaaaucagcauagaagaaacacaccuuaagguaauaaaagccaucuaugacaaacccacagccaacauuauacugaaugcggaaaaguugaaagcauucccccugagaacuggagcaagacaaggaugcccacuuucaccacuucuauucacccuaguacuggaaguccuagccagagcaaucagacaagagaaagaaauaaagggcauccaaaucaauaaagaggaagucaaacugucacuguuugcuaaugaaaaugauuguguaucuagaaaacccuaaagacuuauccaaaaagcuucugguacugguaaaugaauucagcaaaguuuuaggauacaaaauuaauauauacaaaucaguagcucugcuauacaccacuauacaccaacagcuaccaagcagagaaucaaaucaagaacucagccccuuuuacaauaccuacaaaaaaaauaaaauaaaauacauaggaauauacuuaaccaaagagcugaaagaccucuacaaagaaaaguacaaaacacugcugaaagaaauaacagaugacacaaacaaauggaaacacaaaccaugcucaugauggguagaaucaguguugugaaaaugaccacacugcaaaaagcaauccacaaauucaaugcaauucccaucaaaauaccaucaucaaauucaaugcaauucucaucaaaauaccaucaucauucuucacagaacuagaaaaaaauuuauauggaaccaaaaaagagccugcauagccaaagcaagacuaagcaaaaagaacaaaucuagaggucuuacauuaccugacuucaaacuauagcauacggcuacagucaccaaaacagcaugguacugguauaaaaacaggcauuuagaccaauaaaacagaauagagaacccagaaauaaagccaaauacuuacggucaacugaucuucaacaaaacaaacaaaaacauaaaguggggaaaggacacucuauugaacaaauggugcugagauaauuggcaagucgcacguagaauaacgaaacuggauccucaucucucaccuuauacaaaaaucaacuagagauggaucaaagacuuaaaucuaaaaccugaaaccauaaaaauucuagaacauuggaaaaacucuucuagacauugacuuaagcaaagacuucaacaagauaaagauaaauagaugagauuuaauuaaacuaaaaagcuucugcacagcaaaagaaauaaucagcagaguaaacagacaacccauagaguaggagaaaauuuuugcaaucuacacauccaacaaagaacuaauauccagucuacaaggaauucaaacaaaucagcaacaaaaaacaaacaauaccaucaaaaaguggccuaaggccaugaauagacaauucucaaaagaagauauacaaaugggcaauaaacauaugaaaaaaaugcucaacaucacuaauuaucagagaaauguaaaucgaaacuacaacaugauaccaccuuacuccugcaagaauggccauaaucaaaaacucaaaaaauaauagauguuggcauggauguggucaaaagggaacacuuuuacacuauuguuaggaauguaaaauaguacaaccaccauggaaaacaguguggagauuccuuccuuaaagaacuaaaaguagaucuaccauuugauccagcaaucccucuccaggguaucuacccacaggaaaagaagucauuacacgaaaaagauacuugugcacacauuuauaccagcacaauuugcaacugaaaaaauaugcccaucaaucaacguguggauaaagaaaauguggcacauauuaauauauacuauggaauacuacucagccauaaaaaggaacgaaauaauggcauuugcagcaacuuaggccaggcgcgguggcucacaccugucaucccagcacuuugaaaggcagaggcaggcggaucacaugaggucaggaguucaagaucagccuggccaacauggugaaaccccgucucuacuaaaaauacaaaaauuagccaggcacaguggcgggcaucuguaaucccagcuacucaggaggcuaaggcaggagaaucgcuugagcccaggaggcggagguugcagugagcggagauugugccacugcauuccagccucggugacagagcaagacucugucucaaaaaaauaaaauaaaauaaaucaaaauaaauaaaauuagaauauagguauagauauagaauaucuauagauauaaaauauaucuagauauaaaauucuauagauauaaaauauaucuacaaaauaucuauauucuauauagagauaauuuauaucuauagauauagauauagaauaucuauaaaauuagaauccauaaauccccaguaauauaaauaacugaauaaauaaaugcaaaaaugggaaagcucuuucuuaaaguaaaauuccaaguaacaagcuuagaagaaaugauuaaaacagaaaaaucaccauuuggcaaaugccacaguaauaauuauugcagacaagaaucaucacugaccaaaacuaugaugagaaauaaaauauucgcagucuuaaagcaccuccccauauaacauuuguugaacacaaaaagaaaaagaguaacuuugcaaaggagaaccauggcaggcaguagcuuaaacaagugaucagaguuaacagcaccaguaauacaagacauucacaucacauccuucuugacaugacacacuaggaagaacacaguaucauuucugugguauucuugcuaaaaaacacauaaccugaauuuaaucaaacaucaaacaagcccaaauuugggacauucuacaaaacaacccuucaaaaauggcaagaugauaaaaagcaaagaaaaaccaaggaccuauccaaauuaaaggagacaugaaaacuaccugcaaaauuucauccuggauuaaauaacuagaaccagggaaaggccauuaguacacaauuaaugaaauguaaacaguauauagauuaaacaauaucauuugaaucuguguuaaauuccugauuuugacaacuauacuguaguuauguaaaauguuaauguuuggggagucugaauaaggugcauacaggaauuauuuguacuacuuuuggaacuguuuuguaagucuaaaauaauucaaacuaaaauguugauaaaauaaaaauaaaacucggccaaugccacaauuguccaaugcagagcugggacaaucugguuccacugcaccuugggaccacucaacacugucaaggacuaucucagguaccaggaacuauucuaaaugccccacacauacuaacaugcagauauuauuaguaucauccuccucaucaucaucuccuucuucaugaggcagagaaggguuaggaaauguuuucgauaucauacaucuagcgaguaguaagaccacaacaucaaauacuagucugaccucaaaguccgcgauuucagguucuuaauauccuauaaaacagaugcuaugaauugagaauaaaaaaucuggaagucuuauuuauuuaaaucuguguuaauuuccugauuuugacaauuguacuguaauuauguaaaauguuaauguuugaaauguaacauuaaaauuuaaaaauuaaaaaauucaauaugaggcuacccucuuuggguccccucccuuuguaugggagcucuguucucacucuauuucacucuauuaaaucuugcaacugcauucuucugguccguguuugcuaaggcuggagcagagcuuucgcucaccauccaacacugcugcuugccgccaucgcagacccgccggcgacuuccaugccuccggauccagcaggguguccacugugcuccugauccagcgaggcgcccauugcugcucccaauugggcuaaaggcuugccauuguucccacacggcuaagugcccggguucauccuaauugagcugaacacuagucacuggguuccaugguucucuuccaugacccacggcuucuaauagagcuauaauacucaccacauggcccaagauuccauuccuuggaauccgugaggccaagaaccccaggucagagaacacgaggcuugccaccaucuuggaaguggcccgccgccaucuugggagcucugggagcaaggaccccccaguaacauuuuggcaaccacaaagggaccuccaaagcgaugggaaacauuccccccaaggcaaaaacgccccuaagauguauucuggagaauugggaccaaugugacacucagacgcuaagaaagaaacgauuuauauucuucugcaguaccgccuggccacaauauccucuucaagggagagaaaccuggcuuccugagggaaguauaaauuauaacaucaucuuacagcuagaccucuucuguagaaaggagggcaaauggagugaagugccauaugugcaaacuuucuuuucauuaagagacaacucacaauuauguaaaaagugugguuuaugcccuacaggaagcccucagaguccaccucccuaccccagcguccccuccccgacuccuuccucaacuaauaaggaccccccuuuaacccaaacgguccaaaaggagauagacaaagggguaaacaaugaaccaaagagugccaauauuccccgauuaugcccccuccaagcagugagaggaggagaauucggcccagccagagugccuguaccuuuuucucucucagacuuaaagcaaauuaaaauagaccuagguaaauucucagauaacccugacggcuauauugauguuuuacaaggguuaggacaauccuuugaucugacauggagagauauaauguuacuacuaaaucagacacuaaccccaaaugagagaagugccgcuguaacugcagcccgagaguuuggcgaucuuugguaucucagucaggucaacaauaggaugacaacagaggaaagaacaacucccacaggccagcaggcaguucccaguguagacccucauugggacacagaaucagaacauggagauuggugccacaaacauuugcuaacuugcgugcuagaaggacugaggaaaacuaggaagaagccuaugaauuacucaaugauguccacuauaacacagggaaaggaagaaaauccuacugcuuuucuggacagacuaagggaggcauugaggaagcauaccucccugucaccugacucuauugaaggccaacuaaucuuaaaggauaaguuuaucacucagucagcugcagacauuagaaaaaacuucaaaagucugccuuaggcccggagcagaacuuagaaacccuauuuaacuuggcauccucaguuuuuuauaauagagaucaggaggagcaggcgaaacgggacaaacgggauaaaaaaaaaaggggggguccacuacuuuagucauggcccucaggcaagcagacuuuggaggcucugcaaaagggaaaagcugggcaaaucaaaugccuaauagggcuggcuuccagugcggucuacaaggacacuuuaaaaaagauuauccaaguagaaauaagccgcccccuuguccaugccccuuacgucaagggaaucacuggaaggcccacugccccaggggaugaagauacucugagucagaagccauuaaccagaugauccagcagcaggacugagggugcccggggcgagcgccagcccaugccaucacccucacagagccccggguaugcuugaccauugagagccaggagguuaacugucuccuggacacuggcgcagccuucucagucuuacucuccugucccagacaacuguccuccagaucugucacuauccaagggguccuaggacagccagucacuagauacuucucccagccacuaaguugugauggggaacuuuacucuuuucacaugcuuuucuaauuaugccugaaagccccacuccuuuguuagggagagacauucuagcaaaagcaggggccauuauacaccugaacauaggagaaggaacacccauuuguuguccccagcuugaggaaggaauuaauccugaagucugggcaacaaaaggacaauauggaugagcaaagaaugccuguccaguucaaguuaaacuaaaggauuccgcguccuuucccuaccaaaagcaguacccccuuagacccgaggcccaacaaggacuccaaaagauuguuaaggaccuaaaagcccaaggccuaguaaaaccaugcaauagccccugcaauacuccaauuuuaggaguacagaaacccaacagacaguggaaguuagugcaagaucucaggauuaucaaugaggcugcugucccucuauacccagcuguaccuaacccuuauacucugcuuucccaaauaccagaggaagcagagugguuuacaguccuggaccuuaaggaugccuuuuuugcaucccuguacauccugacugucaauucuuguuugcuuuugaagauccuuggaacccagugucucaacucaccuggacuguuuuacccuaaggguugagggauagcccccaucuaucuggccaggcauuagcccaagacuugagccaauucucauaauaccuggacacuccuguccuucgguacguggaugauuuacuuuuagcugcccauucagaaaccuugugccaucaagccacccaagcacucuuaaauuuccucacuaccuguggcuacaagguuuccaaaccaaaggcucagcucugcucacagcagguuaaauacuuacggcuaaaauuauccaaaggcaccagggcccucagugaggaacguauccagccuauacuggcuuauccucaucccaaaacccuaaagcaacuaauaggguuccuuaacggguuucugccgaauauggauucccagguacggugaaauacccagaacauucuauacacuaauuaaggaaacucagaaagccaauacccauuuaguaagauggacaccugaagcggaaguagcuuucuaggaccuaacgaaggcccuaacccaagucccaguguuaagcuugccaacaggacaagauuuuucuuuauaugucacagaaaaaacaggaauagcucuaggaguccuuacacagguccgagggaugagcuugcaacccgugguauaccugaguaaggaaauugauguagugguaaaggguuagccucauuguuuacagguagugguggcaguagcagucuuaguaucugaagcaguuaaaauaacacagggaagagaucuuacuguguggacaugacgugaacggcauacucacugcuaaagaagacuugcugucagacaaccguuuacuuaaauaucaggcucuauuacuugaagggccagugcugcgacugugcacuugugcaacucaacccagccacauuucuuccagacaaugaagaaaagauagaacauaacugucaacaaguaauugcucaaaccuaugccacucgaggggaccuuuuagagguucccuugacugaucccaacaucaacuuguauacugauggaaguuccuuuguagaaaaaggacuucgggacgggcgcgguggcucacgccuguaaucccagcacuuugggaggccgaggcgggcggaucacgaggucaggagaucgagaccauccuagcuaaaacggugaaaccccgucucuacuaaaaauacaaaaaauuagccggggguaguggcgggcgccuguagucccagcuacuugggaggcugaggcaggagaauggcaugaacccgggaggcggagcuugcagugagccgagaucccgccacugcacuccagccugggcgacagagcgagacuccgucucaaaaaaaaaaaaaaaaaagaaaaaagaaaaaggacuucgaagaguaggguaugcaguggucagugauaauggaauacuugaaaguaauucccucacuccaggaacuagugcucagcuggcagaacuaauagcccucacuugggcacuagaauuaggagaaggaaaaaggguaaauauauauacagacucuuaaguauaccuaccuaguccuccaugccuauguagcaauaugcagagaaagggaauuccuaacuuccaagggaacaccuaucaaacaucaggaagccauuaggagauuguuauuggcuguacagaaaccuaaagagauggcagucuuacacugcuggggucgucagaaaggaaaggaaagggaaauagaagggaaaugccaaguggauauugaagccaaaagagcuucaaugcaggacccuccauuagaaaugcuuauagaaggaccccuaguaugggguaauccccuccaggaaaccaagccccaguacucagaagaagaaauagaauggggaaccucacagggacaucauuuccuccccucaggauggcuagccaccgaagaaggaaaaauacuuuugccugcagcuaaccaauggaaauuacuuaaaacgcuucaccaaaccuuucacuuaggcauugacagcacccaucagauggccaaagcauuauuuacuggaccaggccuuuucaaaacuaucaagcagauagucagggccugugaagugugccaaagaaauaaaccccugcacugcaggccauacauuucaaucccuguaucuuuaaccuccuuguuaaguuugucucuuccagaaucaaggcuguaaaacuacaaaucguucuucaaauggagccccagaugcaguccaugacuaaaaucuaccauggaccccuggaccagccugcuagcccauucuccgauguuaaugacaucgaagacaccccuccagaggaaaucucaacugcacaaccccuacuaugcccugauucagcaggaaguaguuagagugguugucggccaaccuccccaacagcacuugaguuuuccuguugagaggggggacugagagacaggacuagcuggauuuccuaggucgacuaagaaucccuaagccuagcugggaaggugaccguguccaccuuuaaacacagggcuugcaacuuagcucacacccgaccaguaagagagcucacuaaaaugcuaauuaggcaaaacaggaggugaagaaauagccaaucaucuauugccugagagcacagugggagggacaaugaucgggauauaaacccaggcauucgagccagcaacagcuacccucuuuggguccccucccuuuguaugggagcucuuguuuucacucuauuucacucuauuaaaucuugcaacugcaaaaaaaaaauucaauaugagauuagaagucaagaacaugucucaaauuaaaacaaaaaaagaaugauaaaagauagcagagacaaacaauauaaaguaucuauccaucaauuauacuucaauaaagcuagaaaaauaaaaaagaaucaaucaagcagaaccaugacaauagcuaacaggauuccuagaaggaaagacaaaaaaaucuggagaauagugacuaagaaagaauauuuuuuuuuuuugggagaccaaggcagguggaccaucugaggucaggaguucgacaccagccugggcaacguggugaaacccugccucuacuaaaaauacaaaaaaauuagcugggcgugguggcaggcaccuguaaucccagcuacucagguggcugagacaggagaaucgcuuaaacacaggaggcagaaguugcagugaguugagacuacaccacugcccucuaaccugggugacagagugagacucugucucaaaaauauauauauuuuuuaaauucuccagagcaagagaaacagaaguacacaaacugaaaggaucuacuagugcugaccaggacaaaugaaaaaguauccuggggaaaacuagacacaaccaucauugucagaucucagacuacaaggauaaaagggagagccuaaaagcuuccaggggaaaaaaaagaaagacacaaaauuaaaacaggucaccaaaaaaagaauaagaaucagaagauuucucuucagcaacauuagauaaaaacagaaaauagagggcagcuguuaacauuccaaagaaaaauaauuuucaaccuggaacugaacugucaaacaugaaggcacaaugcaaacauuuuuuagaaacgcaagggcucaaaaaaauuauuucccauuacucccccauuuuauuucaagaaaaaaaaaaaguguuguacauuuauauucauucuuucuuccuuaaugugacaauauacuccaacaaaacaagauuuaaaaaagaaaacauauauuuagaaaauagugaucccaccuaaagagugguaaguccaaagcugacaaagcugugcagcaaacccaacagacuccagcugaaaauggagcaaggagauagagggaucuaggauaaaaggaaaauuccauacaauaaauagugggguugagauuuagggauggaggggagaacgauaauaugaaaaauauaaugcaagaaaaagaggggagaagaaaagcaacuaaaaucuccgggaaauacaaaaccuacacaaugaaguagugauucaaauauggaacaacuaauccaaauuagaacaacuagucaaaaucagaaucagaaaacaguggguuucaugaagauaaaugaaauggguuguaagcaauauaaagaaagauugagaugcuaauaccuuuuuugaaaggcuuaagauucuucucucuaguuuuuuuuuuaaguaccagaaacucaaggaaaaacaaaaaguuauuucaaaguuauaauccacauaugaagcaaacuaaaauagacacaauuuugagcaacugguggcauucaggaaaggguuaccuauuugaacaucucuugugaguagcaugggaucaugacacuggaaauacagggaaggaaacagcucugcagugaacaauauuuccccacucauaauagugcaaaauucccuauucacaauaaugcaaaaacucaauguuaauuuucaacaauuggcaucaaccugcaaauagagcauggaaaacuuaauuugaugacagaauggauaaaaaugugaucaaucuugacagugucaaaguaaaacuauagccagcucaaguugggagucagaaaggagaagagaauggagaggaaaaaaaagguagggaauggguggagaacaggugauuacuacuuuucauuauaaauccuuugguuccucaggcauuauuuuaaauaaaaauauuuuuaaauuuuuuuaggagaaaguuguuaccauuggcuaaugcuacaaaggggucaagugagaaggaguuagauuuggccuguaagaucauggugacaauggaaaggaccauuucagcggccuauaggaauggaaaucagaguacagugggcugaggaaugaaugggaaauaaagaccugaagagaacaauucuaccugcagaaugcuaaggacaggagaggagaggagaaagguugcuaauagaagggauuaaaaguaaacagaagguugcugcugcuauuuuuauuuauauagaaaagacuugggcauaguuuuugauugaggugaaaaggugaugaaauccagaaaacaggaugaggaaucaaacuuggacaaaagaaaggguaucuaucauuucgaaauaagaagaaaugagguagggguagacuagaggaggaggcaaaaaacuggcaggaucacagagagcuucuguccucuaaagugaucaaagcaagagcuagaaaagccuacagagcuggcgauuucagagagcagaacaagaaaaccaacaaggauugauuauuggguaaauggacuaagcugacagacgaguaguaugguugaaagcauauuuacauuugaaaaucauuuuauuuugccucauuuguugguugaauuauucuucaugagaaucuuuuaagguaaccugguaucuggaucuaaaagacuaucucgggagaacaaucaaggaaaacaaaguuuugcuuauuuacacaagguccuacagcaaguuacuaucaagguaguaacaacaguaagacagcugugugccaucucauucugcucauuugagacccaaacacuucuaaacaauagcaaccuauuucaaucaaccagcauuuauuaagauaacauaugcaagucucacaauccugcagaggaaguacaaugaccccuacuuuacagauauugaauaaagagagauucagugucuugccuaaaguaacugagccaagauccuagcccaaaguuguuagauuccaaagcauauaugccacguguaaagcacaugcauuaaaaccaaaucugaaguguguuuuggccauucucaguccacugcaaguccauuuggaaaaaaaucagauaggagaauuuugaauacaugaaaauuagcugagauuuaauucagugauccaaaccugggugaucaauauuaaaauguaagugccaaaaucagugcuuuaaauuuugggaaaaaucuaauagcauucucuucauuaugaauuaugaauuaagaccacuacacucagcauccuaauucuaaaacuauucuuucaccuguguucucuuucucuaaucaaucuaauucaugguagguugcuaucuggccacuaacuauuacaaauagaaagccauguuuaugacaaauuuuauaaauguacuuugaguaaguagaucuuuuuaaauauauacaugcaaauuagcaaauaaacuggugacuuuaaacuguggaugccuuagcaaaauucauccgugcuuuuugcuuuucuuuauuucuguuaauaaccuucccugcuaaagcaauucuuccucugggcauuuaugcugaugaaacagugguauguuaccccaugccagccuugcccuaaguaaccugaagccugcagauagacuuuaauaaaaugaaaauauguuucuccuccaaagauuggauuuuaaauuaaguuauauccaaagcccuaauuuuaagaauauaauauuugauggcuucauuaaaaauaaaacaauagcuaaugauguuuugaagccaacugaccaguuuuuaaaaguccuuggaauaaaacuaaaucugugaugacuacagauacacaugggucacugcuaagguagccccagcuugggaacacugggaugucaggaaaaaaugcuagugagcuuaaagggaaguauuuauugggcaguuuccacugcguguccuggauuacuggcacaugauacaguccggcucuaguguaaccaccauuguuuacaauacccgaggcaauuugaaacuccacgauuucaacaauggcaucaacugacuaaaaaguuuugaguaauguaaucacagugauuuaucacuucacacaaauguguuucuagcucauaaacaggcuacccgugacccauuuuaucucacacauaacugaaauaaugaagguacagcuugguaaugcucuguauuaaaaauuaguaaguuuuuagucuugaaauaaaauuuuacauccaucaucucauuuaauccuaaaccacuuuauuagucuacaaucauuggcauucuacuuauuccugugcuugguaagccuuacucauuggucuuauccuucucuuuuuuguguguuuuuuguuguugucuuuguuugcuggagugcaguggcaugauuauagcucacugcugccucaaucucccaggcucaagugagccuccugucucagccucacgaguagcugggacuacaagugucugccacuaugcccagcuaauuuccuuguauuuuuguagagacagggucuuguuaugcuguccaugcuggucuugaacuccugaacgcaaacuaucuucccgccucagccucccaaagugcuagaauuacaggugugaggcaccacaccuggccuggucuuagccuugucuucaguaaucuuucuuuuauuacugcuuauucauguacacccucugaugcaucuuuuuggcuaacauuucuacgcuuuccuucuuugguagcucacccacuucuagaguuauguucacacucuguuuauuauucugaucuacacuuugcacuauccacucucaucuugaccauuucuaucuuauugaaauccagauuucacuucuaagauuaccuuucuucuauguuacccuaacauaauugcucuguauuuuuacacaugaacugcuuugccuuaguugucuguuaaaaccuucucucuuuaagaguuaccaauaacaucagucucauucgaaucuuugcuucugaagucuuagcaauauacuuuauuauacccaaacuuuucauuuucuguaagcuccuacuuucugauuacuugcuugccucuuuucuuucccaucuuuacccugguuuuuagcugcuuaaauugucccauuacauccuguucuccuucaaccuuuccacuuaaaaauucugauuuuugagaaauuuaccuaaauuguauuucccuuuucuuauauuuucuaauuuauuuauucacuguaucacugaggaaacugaaauuaaguauaauuacuaaucuugucaacuacauaguuuagaacauacgcaaaaauguaaaauaaaagaaaaaaacaaauguugauucugcuuaucuaguuuuagccuuauaauccaaagaccuugcaucaaacugaaucuucucuauguaucaucaguagcaccuuucaaaguccaugaagucaaaaaguuuuauuaggagaaaaaaagaaauaagguauauguauaauccauggacauguuaaaauuacacacugcccgagaguuuucccucauaaaaguaaacaacucuuccuuaaaagggaauuauaggcugggugcgguaggucacucacgccuguaaucccagcgcuuugggaggcugaaucuagccaacauggcaaaccuccaucucuaccaaaaauacaaaaauuagcugggugugcuggugugugccuguaaucccagcuacucgagagggugaggcaugagaaucgcuugaaccccggagacaggggcugcagugagccaagaucgcgccacugcacuccagccugggcaacagagcgagacucugucucaaaaaaaaauaaauaaauaaagauaauuauauauguguauagcauacaaguggguuugcccccaaguuaaugauuuguuaggggcuuuauauggcuaauaauuaaaccuuuagaacccuggcuucuuuuuucaaagugagucuuaggcuauaaaacugaacauuccguaggaauaaaugaagaaagcuaauacagucuuggaguugagauuaaucaugcuaacagacucugcuugaaugguaaagacaggcaaaggaagacccuguaucaaacaacuguacuggacagcaaggugaugagaguacguacuggggaaagggggaaaacguaaaaauaaaaccagaagaggccuuuaggaaccaaugaugacacaugucaagagcugcgagauauaauuaacucaacucucugcaccugagggcaaaacaaaaccacauaaugggaacuuaaaggaggcaacauauuaugucuuccccuaaauaccagagaaaacaauugaccaucaaaauacuuccgacauacaaucaaaaagcaacacaauaaucagucuuugggaucaaaacaaaacagaaaagacuuaacacccacaguaaacaaaguggagaaaguuauagugcacaacagaagaaacaccuguguaacagucuucuaccauacucucuuauuacuagagauuuucaagcagauaauaaauaaucaaaucagugaugacccgggaagacaucauucacuggguuuuguccuugauuaucucccaggucucuuuucuccaaaaaaggaaauuauuuaacuuuauacagacaaaugucuagaauaaaaagaaauauuguaccgucucuugcuaaccaaaguuuaauuuuccauuuguucuuagguaauauuacccuuuaaaaugguccuuuccacuagcuauucaacauggaggugaaagcuuuaaaucuuaaaaaccaguauuaguuuacgcuaaugggcuaaaauaaaucagaguauguuuauuaugaaugaaggauagggcucaauauugcaaugucauuuuauucucaccacaaaaagauaccuguguuuuccuuaccagugauaggauauauaagaguuagaagucaaaaauggaaagcauaagagucaugcacagaggucaccucgaaaugaugcaaauuauauuagcuucuaaacaauuuuacacugaauugaguucgguacaucauggguuuuuuuguuugucugagacaaagucucgcucugucacccaggcugguaaauagugguuuaaauacuuguucuucuuaagacuacagguucagaugccagcauagaucauuuacauuugccuacaaagacugguaagcuaucgcaugccacacagcuuaguguaacagguugagauccagucuacaaaaagugauacuuauuuuuaaaguaaaaacauaaggcuuuuaaucaaacaaauucauaguuaguuguucucuaagccaucuugguauuccaggcacagucauaucuggagagacaacugcuaaauagccagagcccugaaauguucacccuacucaaugccugguuuucuuuucucccuuuaccugauaaugagccugggcuugcugugcagaguucaaggugacauugcagaguuugcaguacaggggcuuacauagcuccuccagggcacagucuugcuccccucccuucgauaacucuucuuccccugcaagaggcaaggaagccuccugcccaaaaggcuucugugguggaagcugcaagguuccuguagaccugguggccacugacauaggaggcgagggugagggcugcuuagguggaggaagcacggcguguugcaagaggaucauuggguagggaagccuggggcauaauccagugggugaugagaagcaaggucuucaaaucugaaucaacagcaaaaaaacagaaaaaaaaacucacuugaaaaucagacuucagcaagauaacauguaaaugacaacauaaucugacccuuucuucuacuucuccaaacccaucuuugggacuucuuuccuuuggccucauuuagcagacuuccccugccuguuaauucauguuaacacggugcucuuccacugagaauggcuuuauagauuuggcuuuauuuugcuuggcacaguuccaacugcuaucccuuuggcccgugaacauuaacagcauugcauccacggcuaaaucuaaaagucacauggcugaaauggacaucaaaugucaccuaguccagaccccuucccucaggcacacuuacacuuaaacacucuuaaugauaaucaugcacagacaaaaacaccacgagcuguccaggugugguggcucacgccuguaaucccagcauuuugggaggccaaggugggcagaucaccugaggucaggaguucgagaccagccuguucaagacaacauggugaaaccccgucucuacuaaaaauacaaaaauuagccaggugugguggcgagugccuguaaucccagcuacucaggaggcugaggcaggagaaucgcuugaaccggggaggcagagguggucgugagccgagaucgugccauugcacuccagccugggugacagagcaagacugugacucaaaaaaaaaaaagaccaccagcuaaaaaucuuagcaaacauaucuuccaaccaaccaauaucaaaaagaguguauaaaagaauaucaucuugcagaauucuuaaagcacuuauagaacuagcuaaaauuucagggaacucuaggaguagccuaaaguaugacagaaauaaauaaaauauguuccuucugaucaacuagcaauauuuaaguaguugagcaaauguauagcagagguggcaaacagccugugggccacauacagccacagaugugcuguuuggaauauacaguuuuguuuucauuuuuuuaagucgaauuaguuguuagcauuuaaaaaucaagagauucauggcuucucuugaaaaaggaugaucuggcaucacuuggcccacauuccuauaugggacgcaauuagcuaguuagugcucagaggcacugugcccucuagcgaggccugccuucucugggacaccucaguccccacucagcugcugccuguacuuguuacuugccuguucucugugagcucuugaguuuacagcccugccucauacagccuuagauuauauucaucagccccuguaaaacccaaauuuuuccuccuucucuagguaaauuaccuacacaaaauaagguaucaaggaaauguccaauggaguaauggaucacaccaccauaagccacaguauaauuccaguuccucaaucuugaggcuauuucccuccuccuucuuaacaaauaacugauagucucuauuauaauucccucagaaaagacccaaaauguuccucucccucuucaaucuuuauccauaaugucuccugccucccccccagauggcgccgucuaacccugagugucucaaaaugaaccacaguacacccuuugaguucccaagauucuaauuaacccaaauuagaauccuuauuucaaaauccacaauucccuccacucucucaauacaguauuauuaaaaccucuucucuuggucaauagaauauggcuauuuuaagcugcugaaauuuuccaucugcaauggaaauguguacauuauggcaauaauagaauuacuaaaaugaaucaaguaaauuuugaaaaguuaaagucuauuuuaccauauuugauaacuacacagcaccugaaaaucaaguaacaacuuucagacgaaauuugggguggggaggcaacaaaggaaaucagcgugaugggaaaauaauguaguuaaggacaaagugcauaaguauuagucauagaauuuaacaauacuucucauuaaucacaaaauuuagaaaaaugauaauauuauuuaauuuuuaagcagaaguguacugcccauaucucugggaacauaaaagaaaagcaauauagaguuuuaacauuuaaaaagucagguucucuguaaugguauuauuucucuuaauugaaucaagcaaagauaguccagaaagcaaagacagauauggucauuuuagaaaacggaacuaaguagacaaagaacagcuuuuaaaaaguuuaacuaccuaauaauaauaauucauaauguugaaaagcuacugaugucaaauugccacaaacauucugcuaguucauuagugaaaaggugggggggggugucaaaaccucuggauaaaggaaaucagcaauauaaacagaaaaucaaaugcuaccaauugccuaggcaugucuggacuuguuuuaugaaagcucacuuucacuugaggaaauucuagcaugugucucccccaguguuaucuacagguuucccucaaaauaaagauccuucucaaagaacagaggcacaaaaggccuccuaccagaggugacaguuaccugauuuaaagaaaaaauucuugccaaacacagauuuacccauuaucacauuugaucuuuacaauuuuuaaagaguagcuugauaucccaaauuuauuucuuguuauauuuaacaaucaacacaaugucgacuccucaaaaaaaucuauguaugacaauugcaucaaauauuaguacauuugcaaacaaaaauuaguauaaaauauaaaucuuaaaaugaauaaaaccaagucuucagugaaugcaugaaugauggaauacagagacccaaaacaugcaacucagaucuguucaacuguugcauugguuuaaaagggacuaauuugaagacuggcauaaauauucuucaaaucuuaaaaaccagucacuuugaugcuugcgauggcauaaaugaaggauuuaugcugguuaauguccugguuuggaaaggagcuaagacgacauuaaagaaaaucaaagcuucacaagguacccuguuuaaagaaaauuaauugucauagcauacuuaguuuuaaugauuggacuggggccuacucuucacauacuguguuaaagacaaucucuugucucauuuggagaaaucuacagaggaaagagaauagaauaaaggaacagguuaggagcaccucagcaaacuagguaagucuguaauugggaauucuggaaaugagggaaaggcagcgagcauuacucagaggucaucagaacgcagcaagaaggaaugagagggagaaaaguuaaaaaaaauaauaauaauaaucacuugaggcaagguguauccuauaaagaaggcucaaaagaacgcagaaaacuggggaagaggccuuggugaauuggcgaauguuuuucagucuccgcugugacgguuccuaauccuagagaacuguuuacagauuugaaucaaagcuacagacaguucagcgucgcccacauccaccuuacauuccuaagaugugcaugcauacacacgaacccacacacgcaccucaacccgguauggaugccaucacgaaggauggaaucccccgacucccacggggcgggggcaacugagagggccaaggcagcugcacgcacagaugauccaccugguccacgugaaaugccugaaacaagcaaacugauaaauagaagcagcgcaagcccugucacguggagggcagauggaaagagcaucggaaaggaaccgcuaguccccggcgcuccaggggcucguccugaaagcuccgcggcucccaaucgcccgcacuuaccggaacccccgggacgcgccggcagucuccgcgccgcguccgcccgggacgcccgcgacgcccgcccugcgcgcccggcucggcccagcucgacccagccucuucucggagcaacuuucuccgccggccgccgccgagcccccuccgcagccgaaggcugacugucaaaagucaguccaacccgacccacagggaaacagcugcaggaagugacugcggaaccgggaggcgguggaggaggagacugagggcgccggcucggcgucgccacugcgcaugugcuuggcggagcaggcccggcagcgguggcagcgguagcaguggcggcucccgcauccccggcgggcggcgcgugggucaggugcccuggccgcgagcgcaggggcgcgggguuaggccggcguggggaacaaaggcacgagugagaggcgggagggucccgccgccaaucucagcagacagccccgaagagcaguucagcagaugcccuggaaaguuaauccuugguagaagccugggcagagcuuuugcaacuuucaucuccagucauugggauccaaacauuguucauucuguuccucccuuagccugcugguuggcgguuaaggcggcugaguggauccuuuaaacugcugcaacagaaccuuuaaacugcugcucuccccacuuccgccccaggauggaggaagaagagcguggcugccugcccaguaucggccucccucacacaaaacgcccccacccacccacacacacaccuucccuccccuacacgaaagugag

SEQ ID NO: 13598 - RNA, 3132 nt, Homo sapiens
aauugucauagcauacuuaguuuuaaugauuggacuggggccuacucuucacauacuguguuaaagacaaucucuugucucauuuggagaaaucuacagaggaaagagaauagaauaaaggaacagguuaggagcaccucagcaaacuagguaagucuguaauugggaauucuggaaaugagggaaaggcagcgagcauuacucagaggucaucagaacgcagcaagaaggaaugagagggagaaaaguuaaaaaaaauaauaauaauaaucacuugaggcaagguguauccuauaaagaaggcucaaaagaacgcagaaaacuggggaagaggccuuggugaauuggcgaauguuuuucagucuccgcugugacgguuccuaauccuagagaacuguuuacagauuugaaucaaagcuacagacaguucagcgucgcccacauccaccuuacauuccuaagaugugcaugcauacacacgaacccacacacgcaccucaacccgguauggaugccaucacgaaggauggaaucccccgacucccacggggcgggggcaacugagagggccaaggcagcugcacgcacagaugauccaccugguccacgugaaaugccugaaacaagcaaacugauaaauagaagcagcgcaagcccugucacguggagggcagauggaaagagcaucggaaaggaaccgcuaguccccggcgcuccaggggcucguccugaaagcuccgcggcucccaaucgcccgcacuuaccggaacccccgggacgcgccggcagucuccgcgccgcguccgcccgggacgcccgcgacgcccgcccugcgcgcccggcucggcccagcucgacccagccucuucucggagcaacuuucuccgccggccgccgccgagcccccuccgcagccgaaggcugacugucaaaagucaguccaacccgacccacagggaaacagcugcaggaagugacugcggaaccgggaggcgguggaggaggagacugagggcgccggcucggcgucgccacugcgcaugugcuuggcggagcaggcccggcagcgguggcagcgguagcaguggcggcucccgcauccccggcgggcggcgcgugggucaggugcccuggccgcgagcgcaggggcgcgggguuaggccggcguggggaacaaaggcacgagugagaggcgggagggucccgccgccaaucucagcagacagccccgaagagcaguucagcagaugcccuggaaaguuaauccuugguagaagccugggcagagcuuuugcaacuuucaucuccagucauugggauccaaacauuguucauucuguuccucccuuagccugcugguuggcgguuaaggcggcugaguggauccuuuaaacugcugcaacagaaccuuuaaacugcugcucuccccacuuccgccccaggauggaggaagaagagcguggcugccugcccaguaucggccucccucacacaaaacgcccccacccacccacacacacaccuucccuccccuacacgaaagugagcaggagauagaggagacuuucuccugacccccagaggcucaccugcaagacaggaaggaccaggaaaagaguggccaacgcuaggaugucacauccuucauaaccaaccuggacaucuucaauguuaacacugagugaugagcugaggaaauuccggcucuaaacuuauagcguaaauuaacucguaugaagaucugcugggguauuauuuuuguguguggcaaacgauaacaaauauacuacuuuaagaguacaggccgggcgcgguggcucacgccuguaaucccaacacuuugggaggccgaggcggguggaucacggggucaggagaucgagaccauccuggcuaacacggugaaacccaaucucuacuaaaaauacaaaaauauuagccaggcgugguggugggcgccuguagucccagcuacucgggaggcugaggcaggagaauggcgugaacccgggaggcggagcuugcagugagccgagaucgcgccgcugcacuccagccugggugacagagcgagacuccgucucaaaaaaaaaaaaaaaaaaaguacaguucaguggcauuaaguacauuugcauuauugugugguuauuuuuuaaaacacgaauuaaaaugccaaggagaucuaaguauaguaagaugugcccuauuaguagggaaacaacugcaggaaaucaaggcuguuucuuuggcugaaaaaugcaccaauccaauaccaacaacaacaaaccauaaaagacuucauaaguacaaugaauaugaaguacaaacauauacacacaguguacaccagccauuuggggagaguaauccaucaccugaauuguuuuuccagcuguauagguacauuuacuuuaugugucacuauuuuaaagggcuauauuguuucuaaaauaauaaaugcugcuaaaauccacucuccagccccuuuucuauauggucuuuagccagucuuagaacuucacaguccacacuccuuaucuaggaccacaaguaggccuugcggagccuuuccgaucugaccuuccaccagucuccccucaucauuucacucacacccccauccaugccccuucauuuccugccucuguaauuuagcucugucugcaucuugaauacaaaaugcuuucucuccccuccccuugaauugucaaauccuaccuguccuuccaggccucuucuuucaugaggucccacagcacuuuucuccgcacaccuugaugacacacuauuuguugucccacauuauaauuacuuaagagauauuuccucugcccuguaaauaccuugaguccaggaaggauaaaugucuuggaguuuucaaguuuuauguuugauaguuugauguguucuuguccaucaggaugaaaaucugaacaauuccauguucucugcucacauacucuucucagacagcuagggcauuuccuucccugccucggggagaaagaaaaggcaaaucugaugcuuguguaauagauauuugaagcucauggcagugacaguagucucauaagucagaguuuguaguuuagaauuggcuggacuucaugaguuucagcacaugaggugaaa

SEQ ID NO: 13599 - RNA, 9015 nt, Homo sapiens
auucagugugaaggaucugauauuuacccuacuugaaagcugacaaguuagccugccacaguuucauugugucuuuugcuggcagaagacacaaucccuguuucagagacaacggacuuuauuucucaugacacagcaagaagcauaagauuccuguuugacuggcuccccuugcucccuacaucccaugggagcaagaaggggcucaaguggaugcugcaaacaguagauuugcaucacagcugaggaaucucaagccuagguaacccaaauauuuuauagugggaaauaagcaaacaugccuaacuuuugcuccagaaggagauacuaccucuaguuucugaggcuguuugcuauucaaacgucuuuaaaaagauaguccaaacagggcgguugagaauugucuuccagaauucagauucuuaaaucuguugguuacuuucuccuuuuauuucaguaaauuuauauuuuaugagcuauuuuuuagaacuuaauacuaguaaucuuaauauaugccuggcaauauggagagugccucaacugccugcuacaaacucaugcaaguaagcucucuaaccauggugaaaaagaaauccucaaccuaccaguuuuucuacugcuagagaaaacucaugguaagauauauuuagugucauaaguuacaguuuuucuuauuuuuaauuaucacucauuuccucagaaaauauuuacucauccuuuaugugaucauaaaaacuugcuggacuucaagauuguggaccaagcacaguauauuacucuuccuuucuaaaauaaaaaaagauuaaaaaaaacagcaacauagcaguucugagaaucagaaagguacaauaauuuuucaugaauucauggaaaacagaugggguaagauuaacggaaaaaaaauagacacacacggaagaccacugcagaagcaggagccauuuuccaccaaagaagucugaaaaaaauccaaacucagaaacaagaaaaagaacaagagugaucugugaggcuauaaucaacaacucugggccauuccccucaaccccucaaaacauacagaaaugucaggaaugcuuucugcuccaaugauaaccaaaaaauuaccacaguuccuagcauguauguugaagcuagagaaagagguaaaaacaugacaguggaaguaaaugaaaaagaaaggcaguucuacuuaggaaugagauaaagucuucaucacucaaaauaaacaccuccuaacuuuuuguaaccaugaaauccuaacccugcuuaauagcuauuacgcucuuuacaggacaaacuagcacgagccuacaaucagcccucccauuuagaggagcgaucuguuggagaaaaccagagauccacuuaauugcagaggaaacccuuaccaguuagcuaccaauauccaccgauuaauaagcauucauuaauaaauauuaacaaaggaccauuaaacauuuauggaaagcaaauggcaaaaaugaacaaagaacagaccugacacauaaugcauagaagacaauguucagucuucuaauuaguaccaucuaaaagagaagaggauauugauuccaaaaacacccauaaaacaagaugggcugcuaugaaaauaaaggacuaaugaaagaauaacagugcuugcaaauaaguuuucuucuucaauguaagagcagugaagaauaaagauuuaaugagcaaucuggagagagagacaaggggggagauuaggcagaggagaggggaauagggagagagagauaaagaauaucugagaaaguaaaauacaaguagaaaaaagaaaccuggaggacagaccuaaaagggccaacaucuaguaaaaaugagcaacaaauggagaaaacaggagaguaugaugguaagaaaaaaauuaaauagaaaaauauucuccugacccaaaggaagacuugaaugaaauaacuaaaauagaccauacagaaaggaguucagccccucuucccugggaaccccuauccccugacucuucaccaggcaggggccccagcccgugaccacagaacaguugcuccacccauggcugagcauacccacugguaguggccuggaguguccugcagaggcucccagaggcacaugauagccccucugccacgaccacagcagcaguucuaucccugcugcccuugauuuggggaaaaaacagccugaggacuaugccugagcuuacagcacacuacagucaccaugcagagaagacaaccacucucuucuccugacucccuuaacuccuugcuccccagcaagccacaagcucacaccagcaguacagccaccccaccccaccccaccccaccagcugaacacuaccaguaacagcagcuaaauguuucucagagguagagccgucagaggcaaccaaaagcuucugccacuggcucugcagugguacuaccccagcuauccucagauuaaccaaggagcagagacccuaagugccucauccguauuugcaacaagcugcaauccacccaaggagaggaagccaguccaucucccauggaucacauaaacacccacugcucaucaccagguaggguguccccagauugggcccauagcacagacuaccucauccuggguuuauugcauucagugauugcugaccugcaccucucugggaugaagccaucaggagacaaaagacccucagccacaaccacuacuaagguaccuuauucagcugccuccaaguugggaaagaaacauaaacccugagaucaccccagagcuguggugggcagcccaguagcaccaagccgugaucuacagccagcacucaggugagagagcagcccccacuuacagagcacugagagagagcaugacugugaggaaauauagagcagccacacagccaagcaagagccuaccuacugaccacuacaccuaagcaccaccuacuggaucacaccccaaagcuucaacaccaaaaauaacuuccuaacauauaccccugugaaaccaaagauaagaagucagcuacaaauaaagaccccacacaaagccuuggcccuaugaaaacauccagaaaagaaaucuguugacuguacucagucuacaccacaguuaaaggaauaaccauuuaauuaguccauuuucaaacugcuauaaagauacuaccugagacuggauaauuugcaauaaaagagauuuaauugacucacaguuccacaugucuggggaggccucuggaaacauauaaucaugaaucaugauggaaggcaagggggaagcagcaucuuuacaaggcagcaggagaaagcaagagacauuuuuaaaccaucagaucucaugagaacucacucacucacaagaacagcauuggggaaaccaccaccaacauccauuacuucccaccaggucccucccucgacaugagauuacaauuguagaugagacuuggguggggacacagagccaaaccauauucugccccuagugccucccaaaucucauguccucacauuucaaaaccaaucauacuuucccaauaauccccccaaagucuuagcucacuccagcauuaacucaaaaguccaaguccaaagucucaucugagacaaagcaagucccuuccgccuaugagccuguaaaauaaaaaacgaguugcuuccaagauacaauggggguacaggcauuggguaaauguuccuguuccaaauuggagaaguuggccaaaacagaggggccacaggcucuaugcaaguccaaaaccuggcagggcacuccuuaaagcuccagaauaaucuccuuuuacuccaugucucacauccagggcacacugauacauggggugggcucccaaggcuuuggguagcucugccccuguggcuuuuuaggguauagccccuguggcugccuucacaggcugauauugaguaccugcggcuuuucaaggugcauggugcaagcugucguggcucaacauacacaaaucaauaaaucugauucaucacauaaacagaacuaaagacaaaaauaacaugauuaucuuaauagaucuauaaaaggcuuuugauaaaagucaacuccucuucauguuaaaaauucucaguaaauuaggcguugaaggaacauaccucaaaauaauaaaagccaucuaugacaaacccacagccaacaugauaguaaauggggaaaagcuggaagcauuccucuugaaaaccagcauaagacaaggaugcccucucucgucacucuuagucaacauaguauuggaaguccuggacagagcaguaggcaagagaaugaaauaaagagcaucuaaauaggaagagaggaagucaaacuauccuuguuugcagaugauaugauucuauaucuagaaaaccccauagucucagcccaaaagcugcuucagcugauagacaacuucagcaaaguuucaggauacaaaaucaacguauaaaaauuacuagcauuccuauacaccaauaacagccaagccaauagccaaaucaggaacgcaaucccauuacacaauuaacacaaaaagaauaaaauaccuaggaauacagcuaaccagggaggugaaagaucucuacaaugagaauuacaaaacacuguucaaggaaaucagcagaaaacugauuucucauggauaggaagaaucaauguuaaaauggccauacugcccaaagcaauuuacagauucaauguuauuucugucaaacuaccaaugacauuuuuauagaacuagaaaaaaacuauuuuaaaauucauauggaaccaaaaaagagucugaauagccaaggcaguccuaaacaaaaauaacaaagcuugaggcaucacguuacccaacuucgaaguacacuacagggcuacaguaaucaaaacaacaugguacugguacaaaaacagacauacagaccaaugcaacaggagagcccagaaaucaggcugcaucccuaccaccaucucaucuuuaacaaaacugagaaaaacuaucaguggggaauggacucgcuauucaauacauggugcugggauaacuugcuagccauaugcagaagauugaaacuggaccccuuucuuauaccacauauaaaaaucaacucaagauggauuaaauauuuaaauguaauacucaaaacuauaaaaacccagaagacaaccuaggcaauauuauucuggacagaggaaagggcaaagauuucaugaugaagaugccaaaagcaaucacagcaaaaacaaaaagugauaaaugggaucuaauuaaaacugaagagcuucugcacggcaaaguaaacuaucaacagagaaaacagacaaccuacaaaaugggagaaaauuuuugcaaacucugcaucugauaaaggucuaauauccaacaucuauaaggaacuuaaacaaauuuauaagaaaaaauacaaccauauuaaaaagugagcaaaggacaugaaaacuuuucaaaaggagacaugcaugugccaaaaagcauaugaaaaaaagcucaauagaucuuuagaaaaaugcaaaucaaaaccacaacgagauaccaucucacaccagucagaauggcugccauuaaagucaaauaaaauaaaauaaaauaacagaugcuggugagguugcagagaaaaaggaauucuuauacaauauuggugggaauguaaauuaguucagccauuguggaaagcuauguggugauuccucaagaaaguaaaaacagaaguaucauucaacccagaaaucccauuaccggguauauacccaaaggaauauaagucacucuaccauaaagacacaugugcacaaauguucauuguagcacuauucacaguagcaaagacauggaaucaaccuaaacacccaucaaugacagauuagauuuaaaaaaugugccauauauacaccauggaauacaaugcagccauaaaaaagaauaagaucuuguguuucaugggaacguggauggagcuggaggccauuauccuuagcaaacuaaugcaggaacagaaaaccaaacacugcauguucucacuuauaagugggagcuaaaugauaacucauggacacaaagaggaaaacaauggacauugggaccuguugguggguggagggugaaaggagggauaaaaacagaaaaaauaacuauuggguacuaggauuaguagcuggguaaugaaauaaucuguauaacaaacccccaugacacaaguuuaccuguauaacaaaccugcacauguaccccugaaccaaagauaaaaaaauuuuuaaaacugaaagagcuccaggaagggucaagcaagagaaacuuuaaaaugacaaaaugcccagacacauacaagaaaauuauaaaacaccaaggauaaagagagugucccaaagcuuccagaaagaaaacaaacaaagcccaguuucccuacaaaauaaauuucauuaaucuguaaucagacuucucauaaacaacacuguaaucuagcagaauaugaaacaauguuuuacaauguucugucauucaaguuuaagggagaauaaauauauguauuaaacaugcaaggacugcaaaguuucagaaaacaucaguucgacaaaacaaauucaaaaucauacuccaaaaaaugaaaugaaauccaagaaaauagaaugaugacaagggauacaugaaaaaaccauuaaaucaagaaacaaaacacauacguaauuuuaaauuauugcugacauuuggauccacagcuuaaugcacaugaagaaguuuuuaaaaaaguaaagacauaauauuaaaaacaauagcaagagacuauaaucaguauuucaacaauaugugaaagaugggaaaaggaaaagaagagguaagagaugcuaaaagucuuacucuuuaggaaggggaaaauaauagaaacuaauuuucaauauucauagagaaaugauuaaaguuucuuuuaaaucuaagaauaaccaacaaaauaauuaaaauuagaauguauaccuuccaaauaaagaaaaggcuaaacaaaauucaguaaaaacaaugaaaagcaggaaagacagaaauaaugaauacauggcaauuucuuaauguuuccugaaaaguuaaauauauaccuaccacaugauccagcaauuuuacuccuaaguauuuauccaagagaaaagaaagcauauguccauaccaagaacacauauguucauaguaccuuuguuuauaauagcuaagaacuggaaacaacucaaauguccaucagcagguaaauguauaaaucaacuggaguaaacacaugcaauggaauacugcuauuuaacaagagaaagccagggucaguaaaccauccugccugccaccuguuuuuagauagcccacaagcuaagaaugacuuuuaaauuuuuaagugauuagaaaaauaaaagaauuauauuucaugaaaauuuaaaacuucaguauucauaaaguuuuaauggaaaauagccaugcucaucuuugacagugucuguggcugcuuucagucuacaaugacagaguugagugaguugaguuauucaaacuaugacuggaagcagccuaaaugccaaucaaccaacaaguggauaaagaaaaugugguauauauacaccauggaauacuacucagccacaaaaaggaacaaaaucauggcauuugcagcaacuuggauggaguuggagaccauuauucuaagugaaguaccucaggaauggaaaaccaaauauuguuauguucucgcuuauaagcaggagcuaagcuaugaggauggaagagaauaaaaaugauauaauggacuuuggggacuugugggggguggagugugagagggaccugagggauaaaggacuauacuuugaguacaguguacacugcuuggguucagauacaccaaaaucucagaaauuacugcuaaagaacuuaucuguguagcuaaaaaccaccuguuucucaaaaauuauugaaauaaaauuuuagaaaaaaauugaaaaauaaaacaaagacaauauggccugcaaggaacuguaaguuaguuaucuagcucuuagagaaaaagugugucaaccccugacaaaaaggaauguauauugauauacacaacauggaugaauuucaaaauaauuaugcugaaugaaaaaagccagacaaaaggcagaccuacuauuggauuccauuuauguuaaacucuugaaaaugcaauccgaacuauauggaugaaaaggagaucaguuguccggagagagaaacaugggggaaggaccgaagggaggaauuacaaugggguacaaagaaacuugugggggugauggauacauuaucuugaugguggugauggucucuccgguacauuacguaugucaaaaccuaucaaauguacacuuuaaauaugugcaacuuauguaucucaaauauaccucaauaaaguuuaaaaaguaaagucuaugacaauugaaagacaggaaagguaaaaaagaaaaaauggcaauauuaauuucuugugggaugcagcuaauauaauacuuagaggguuuuuuuuacuucaaaacugaaaauuaaugagcuaagcaucugaagaauuuaggaaaauaacauuuaaaaacccuguauaaaagaaggaaaaaauaguaaaggcaagaucagaaacuaaugaaauaaugaauggacaauagaagauagcaauaagagcagauccuuuccaaauaauguuaauacugauuaacuuguggugagaauuauccuaccccaaaagaaugcacaaauaaccaaugucaggaauauaaaaggaaucaucucuaaaaauacuacaacuauuaacuaauaaaauuauaaacaacuguauggcaauaaauuugaaauuuggauaaauauagaaaauuuuuccuagagaaaaauagaauuuaccaaaacagaaucaauaauaaauacaaaaucugcauuguccuauaaacaguauauaaaccaauaguugaaaauguucccccauagaaaacuucaggcucccaauggcuuuuuuuuccaguggggucuuugaa

SEQ ID NO: 13600 - RNA, 28681 nt, Homo sapiens
uaaagcuauaccuacuaaggugauguaucuaucuagucuguaaguuuauagacaguuugaaggaaaaucguuguuuuuuguuucuggagacagauucuugcucucuuguccaggcuggagggcaguggcacagucuuggcucacugcaaucucugccucccaggcucaagcuaucuuccuaccucagccucccaaguagcugggacuacaggcaugugcuacccugccagcuaauuuuuguauauuuuguagagaugggcuuucuccaugcugcccaggcuggucucgaacucaugaacucaagugauccaccugccucagccucccaaagugcuaggauuacaggugugagucaccaugaccugccagaaaaucauuuuaacuuuaaaaguugauuuauauacuuggaaaauuaaauuaauuauaaaucagaaaacuugauauaaacugauuuuuuaaaauuauuuuuaaaguguuuagcacacagaagacaauuuacaacaguaaauuggggugcaaauaugacaaguuauugaaaaucugaguauuucaacuuacauggauuuuagcauuuuuuucuccuuaaaucuugaaguuuaguacauguaaauugcugcguguuucagaagaguuuuccuaauuauauauuggggcuggguacaguggcucacgccuguaaccucuuuacgaagucaauaaucccagcgcuuugggaagccaaggcaggaggauugcuugaggcaaggaguugggcaacagagcaagacccugucucuacaaaaaauaaaaaguaauagcugguuguggugacacgcaucuauagucccagcuacucuggaggcugagacaggagaaucacuugagcccaggaguuugaugcugcagugagcugugauuguaacacugcacuguagccugggcaacagagcaagacgucaucucaaaaaaaaaaaaaaaaaaaaaaaaaaaaggugugugugugugugccugccugucaguuucaugucacuuuuaggcuagaacuuuguuaaaauauuaaacacugaauacuuuuuuuuuuuuuuaaacaggguaugguuccauuuguauuuguuggcacuaaagaaagcauuggaaaugugcagguucuucuagaguaucauauugccuaucuaaagguuuguauacgguucauacuauauucugauauuguugcugcauuuacuacauaaauguuguacauuugcuacaaauuuaaaauguccucacauuaaacauuuuauauuugaaguaaacuucaaaucuuuaaauauuuuuuguuaauucagcuucagauuugccauuguucuacaugagaauuuaaaaaguccuuugucaucauaaaaugauuggccuugugugcauaauuucucuucuuucugagcuuuuauauuucuuucuuucuuaagaaaugauuccuuugucuucaugcaauuugacucucagaucacuuauguaucugcauguucauacuggagccauuuuguuuuuacuuuuguacuuuacauacaaauaggguacagaaccaggagugacauugggcuuccuugguaacuuuggcauuaugcaaaucaucugcaucaucuccacugacauuacucgauaauuuguaaccauuguuaacaaaauagucuauuugaguugauacauaaagagcaaggguuuuuagaaaaauaugacccauaaauuauuaaacauuuuaauuuuauuuucuacucuuucccuuuuauuccugcuguguuucuuuuuaaaguauaauaauauccucaccuguucucugccucuaguauguuuuccucccagucugucguaucauuguugcuguuacuauuuugagaucacucugauaaugucauuucuuuucuuuugaaauucaucuuuauaugaaaagucgcaauuaaagcuggcauuuugaagccagugcuuuaucuuucaguacucaucuuuuaaccaagagcuuucucuagacaucuaaccuuugcauccuguaaugaccucaauuucugaaugacaaagucuagcacuccuucuaggucacaacucgugucacugcuuugauaggaaaguagcuuguuaauaguaccuuucauagaugcuaccuguaucucauucagcaauucuaacuccuugagggcaaaaucugguaauauuguauaauuguuagcuauuuaauaaauaacuuauuuuaaagcugucuguuaaacauccccuugauuggggagaguccaugucuucuuuuauauuguaugccuauaguagcauguuuggcacacucuagaccauucaguaaauguugaacagaaacagcaaaugaccucaucaauucuguugacuaggaacacaaugcucuuuaccaucuaauugccuaaggucacagcuuugauagggaguacagcuuuagcuuuaggcuuuaggaaaacaaaaaguuauauauaagaagacuuacucuuuuuuguuuugauuguaggaaguagaacagcuaagaauggaacgccuacagauugaugaacagcugcgacagauugguauggguuucagaccuucuuccaccagagggccugaaaaagagaaaggauaugccacugaugaaaguaccgucucuucuguacaagguucuaggucuuauagcggaagaggcagaggucgucggggaccuaauuacaccuccgguuaugguaaaaaaaaauuuuuuuuuuuuuuuuuugguaauaguaauaauaguaguuauaguuuaggugcucuaacacauuuucuuauaauuaguucauuacucugucuuggcuuugaggguagaagguaguucugaagguuuaguacacgucuuaauaguagugauaguauacauuaaaaugacaguaaaauauauaaaauuuccaagcaguuauguaaugaagcaaagcauguuuuuaaguugguaguucauugucauguuuauuauauuuacaaagaauacauauguaacuuguuuuucaaauacuuuacuaguacaguuuuauacauuucccaguaaauaccuaguaauggugguggugauacuucuaggaaucaucuuuugucuacccucuuuaaguaaaaaaugaaaagugugcgaaucacugccaagauugcauauagcaagucuuuuuacuagcuuuuaaaaaauauuuuacuuacucauuuggcguauuugaauauauuaacaucucacaucuggaauuauuuuauuuaacaacauuucacuaaaaugaagacucugaaagccagaaucuaauuuaacacuuuauaaaugaacauuuucuaaaauguauuucacugugaggauugggucuaacccagauaggaagggggacaguggaguggugauagucaacaauucucuaauccuaaauucucccuuauucuucuucagcuuuggaguuguuccauuuuucuacauuuggacuuggaucuuagcagugaccugauuuguuuuuuuccuucgccccuucucuuuauuuucucuuuuccuuuucuuuucuucacuccuauacuuacucccuuuugaggaaauauaaaaccuuuuccaaaauguaaggcauuuaaggaaaauagaaauaaaugcaaauuucaugcuuuaauugaaggaucaucuaaugcugacaaaguuauauuaaaccugaacuaucuucaauuuguuguagaguuguaaguuugugucccugcccuuuaauaucauaucuuuauguucucauuuucuuauauauguuuuuauuuaaugcaguauugaaaccuaaacagcaaaauucuaauaaagaaguguucagcauauaaagggaugaaaauugcagacuauuauuauauuucugaaaauguuuaaugcaaaagacaguuaaccaguaaucacauagaaaucaaauauauucucauugauuuuugaaccauacauuauuagcauagauaaucagacuuggcuuauuggaugaugcguaugaugaauucauugaauaauuuuauuagcuuuugugggaagucggcuuauugaugagagcuuacucuggcaaaaugcuuuuguugagaguagauaauuaugugagagguagagaaacaucuggauucaagaaagcugugcaaauuguucaguagauggcacucuuagcucugaaucuuaguggaauugauaacauuuuauuucuugaaauaguuacugaaccugagugggcuuggaaaagcaagaaaaaccauuugaauuugguuguagacguucauguauacauuauaucagagggacuuguaguugauuuauauauauauauauauauauauauauaaugaguacuguaguuuuaucaguuuaauaggaacuauaagaaacauuucccaguauaacaucucugaaguugguauguguguuaaauuggacaucuuacaacuuuagcagcauuuucuuuuuuaauggcacauaaaauaaugucuuaaaauugauggccucuuggagucgauaaaacgugauuauuuuuagcuguuaagcuuagcacaaccaaccauugaaaaaugauauaaaccaucuucauaaggugauuuuagaaguuugaggggaaaauaugauuuuaaaauugguuaaaaacacgaugucauuauguuuuguuacuuuuuuuuuuuugagacggaguuucgcucuuguugcccaggcuggagugcaguggcacaaucucggcucaccgcaaccucucccuccuggguucaagugauucuccugccucagcuuccugaguagcugggauuacaggcaugcaccaccaugccugacuaauuuuguauuuuuaguagagacaggguuucuccauguuggucaggcucgucucaaacuccagaccucaggugaucugucuaccucgccucccaaagugcugggauuacaggcgugagccaccagccuggccuagugucauuacuuuuaaagcuuguuuaaaaaaacgacuuugaaucaccaaccuguguuuuacaaaauugagaggcuggaauaaaugguuucccugauuuuauuagaguauuuguuuucuauugcaguaauaaauuaucacaaacuuagaggcuugaccacagaaauuuauuaucuuauaguucuguuggucagaaggcugacaugggucucacuaggcuaaaaucuugucagcugggcuacguuucuuucuggaaagucuagcggggauuccccuuucaguaguuuagaaaauuucucuacuuuuaaagacccagugagauuaguuuggacccaccuggauaauccaggauaaucucucuaucucaagguccuuaaccuuagucacauuugcagaguccuuuuugcuaucacagaaacauuuaauauguguuauuaacaguuauuuaauaugaguaauguugagcacuagccaauacauuaaaauuuugggggguacggccucaauaucuguuuuaccugcugaaaucuaugauuuagacauucccucuaagucucuugaauacuauauguagguuaaauuuaaggaagacuuuacuugcugugacacgggguuagauaaauacuacacuggauuucuaaggauacuucaauaugaacuuuugagagagucuucagaaugaaguauucuucauuugcccugaauuuugguaauguuuucagguaggguauagguuuguaaauaaauucagaaguucuuaaacauucugaaaggcuuuuuuuuucacuauucaaggaaagauaaauugccuucauuacaacuuuuaugacauccuguuaauaaaguacuuuuugucauuuggugaaauaaauguuaggggaaauuaauucccuucccugagauucuaaucccaacaaagaauugaaagugaguaauagaaauuugauguauucuuugaaaaauacacauccaacuaauuaccuaauuguuuuuauaauugacuaguuacaucuauuaacaccauguagagaaaagguaggcauccuagaguuaucguuaaaggagaaaggaagugaggcaccuucauguauaaaacuuuacauuuuauucccugcaccuuaauacuuaaaacuucuuaugucugaagagcucuuguuugcauuuuuccucaaaugauugcagaguuuaaauauagggaacuucaagguauuucaugaaaucacucuuaucugagaguuuagcaaaugaacuucaaaauaaugcagcaaauuauuugguugagaaaauuguuauacacucugccaggcauuugaggacauauaagauggaguuccacccuuuaucauagaccaauuuugaaguaauuccacagggggaaaaaauaacaacauggcacagucugugauagauguggggcgauuuuaggauaacaaaaaauggggagagaucugucuuaguugcaguggucugaaguuagaauuugaacuaggcccugaaggagauauauuuggucauauaagagggaaagaagaaguggcaucccagaacuaacaaguggaaaugaauaugauagugauugagucauauguaucugacauuugaguuacaguaauuauuaaauaaugauaauguaggccucugauuauaucuuugugguguuuaaauaaauuuuugaaaggucaccauuacaauaguugcaguguuagaaauggucuguaaacuuuuaaaggcaaugcugaauauuugucucacuggucauggcuucaguucuguugucaggugagagaccuucuguuucagagaaaccuuaaauucuguuuaguaauugcaaauauuagguuggugcaaaaguaauugcaguuuuugccauuaaaaguaagaaaagcaaaaaguaaaaguaguuacuuuuaauggcaaaaaccgcaauuuaagaugcuaguaaaacaugccaucauuuuauauacaaccuacuggaaaaauuacuucuagcuuauaauaaagaugccaucaauuauaagaaauaucuugauuucagagauguuaacaugugaaaaguauacccuagaaucaaugaaauuauggugaaauacacuauacaguuaaacuauucaguuuucuaaauaugauuaauuuacucaaauauugaaguuauuuuuauuguacuaauaauuuagguuacuaaaacccaaaucagcagaaacauuugacuauccauacuaaguacauucuaauauugauaaaugauguucuguaugguuuuuuuuuuuuggugccaaaaccuaggaauuaauguucuguauauuuucuguaauuuuucuguugacugcauuucugcacaucaguuuuuuuuuuaacuuccaugacuuuguauuuccuggauauuauccccuuuugcugaugagauggucacaccuuugacuauauuacaugacauagcacaucuuagcagacugcagugagggauucuucugcugguuuugaagaagugagcggccuucugcacaucaguuuauuuuuuaaucuguauuaacuaguagauacuauacuaguauauuaauaguauaauaauugauuauuccuuaguacguuucagauugauuuuaacuuucauggaucuuucuuugaagcagccaaacaguauugcuuauuuaaacaauaauuuguaggacauaauuuugaacauuuuaaaaggcuuuuuauagaaaucuaagugguuuauguucuuuucuuuuccaagguacaaauucugagcugucuaaccccucugaaacggaaucugagcguaaagacgagcugagugauuggucauuggcaggagaagaugaucgagacagccgacaucagcgugacagcaggagacgcccaggaggaagaggcagaaguguuucagggggucgaggucgugguggaccacgugguggcaaauccuccaucaguucugguagucuuuucuauacucugucagcauccauuauuuguaaacaguuuaauuuuacaaaaguuaauucaucucccagggccacccauuuuuggaaguuucucuugcuacucauugucuuagagaaaguaguggaccauauagcaguaucaggaaaagcccucguagaguguuucucagugaagguuuacuuagaauauacuggucagaacuuuaguuggcagcuuuucuuuauaugaugagggucagauguuucucucuucagguuuuggaggcuuauuuaauuagaauuuuuuuuguuuucccuagaauuuugggguuauguuuuuuuguuugccagacagacccagagauuucuaaugcacagagagaugucaguacuuuucuauacuuaauauugaaaacgaagugaagagcauucuuagcuacacuauguaguacuuugggaacagggaaaaauuguggaauuaacuaaguuuuuuaauuguuggaggaacugugcuguaaagaggaguguuuggaugacuaaagauuugaggguguaggaaacguuuuacuuaauuacuucugucuucuaaaauuuuuuuaugcuuuacauuaaguuguaggaguuuccagaauauccuugguuaccauaacgggcuagggaguuaauugccagggauagauacauagacuauauuaaggauauaacuuuaacauaucauuaugguauaccacguuaagaaacccgcaccuuccuuaauguuauacccaugaaaacuuauguaguauuuuaauauuauagaaaguguguguagauacauuaaauauagaugccaacugugcuuacaaauuacaaaaacuggaacaaaucagggcaaaaauuaggaacuuguucuuuguuuguuuagauuuucucccuuuccacaguaauacucuuugagccuuaaguuuaguuuacaggcuuucaggguaauaguuuuuauauuuuaguacacuuuguacaguuaccaagguguuuaaaauuacaguauacugaauugcaaaauaaauguacuugaccuaguguuuuaugauuaauggauacgcuuagugucuuuugcaaagaugcuuagcuugcuagcuguuaccaaaggaaucuuaggaaaaaucggaauuaggugaauuucuucuauaaauuugauuguuggagguaauaaaugcacauagguaagauggguauuuuucuuaugaauuguaccuuacaguuuuuccuuuuccaccuucacaucaccuuccauaauguuucuaaagauggaguacuagucagcauucguuucaacauuuuccuuucauaaccaguuagaaguucaaccuuauuuaauuggcugcuuuguuucaacuugucuugauugcuucaguucaguuacggauuucuauuaugucauggaaugcagguauugaauauuauuugggaaacaguccaucaacaucaacacaacaaagcugcagucauuuugaacucaguuaaggggaugaaagcucgcucuuauaauuauuucuuaacagcugaauauuuguuucuuuucauuuuuguuuuucuagucucugggcaggauuaccuugaaaugugaaugcaagaauuagcauuuaauacacuauuuucuaauguauauuuuaaaaacaaggcacaggaaauguuaggaagccaagaugucugcuuacuuucugcuuuaauuuuucaucaccacuuaaaguuuuaucauauuuaauuaucuuuguuauuuuccagguaaauaauauugaaaacauuuuauuugaagacagugcauuuuuauugggggagacugaaguuuauuugucauugauauaguucaauauagaucaaacauucauaauugcaguacucuuaaacgaauauuucuugccucugacaugaauauagugcucaaagauccagacagcaauccauacagcuuacuugauaauacagaaucagaucagacugcagacacugaugccagcgaaucucaucacaguacuaaccgucguaggcggucucguagacgaaggacugaugaagaugcuguucugauggauggaaugacugaaucugauacagcuucaguuaaugaaaaugggcuagguauguaagcacuuagggaagagaaauauauauauauauauauauauauauauauauauauauaauuguaaacuauuguuaguauaugaagcuuuuuucaaagaaauaugcaauucacaaauugacuuuuucuuaguguuuacuuugaacaagguagauagcuuuuugucuaucuuaaauguuuaguucucagauuuguuauagccaaauuauuugaaacuuggaggguuaaagugcccuuugaugccauuaaaucaguacaaauauucagcuggcaagguacuuagugcuuuuauuguccccaagcuaaaaucaggcuuucaucuugccucuuuuaaaauaauuauaaaugacacugguaaagguacauauaucaagaguaggcauuaauuuucaagggcuaaaaugucauuaacuucgguauaaaccaaacuguacuagagaggaagacugugucccugaaugauggcaguuuaagucugaguuuuacugugaguuaaaacccucugaauuuccagaugauaauuccauuuuuaauccauuuggaaugcugaaagcuacaaaaauguauuuccugucaguaaacauuuguuguuuuauuuuuguguuuaauuaaaaguuuauuuuuccccuuuaaaucuuugaaggaaagaagguuuuuuuguuuuuuuguuuguuuuugucagaauaguucaugguaaacuuugcaauuacagaugauagugaaaaaaaaccccagcgacgcaaucguagccgcaggcgucgcuucaggggucaggcagaagauagacagccagguaacuugaguggaccuguggacaccaucaggucacaagcaugaaaaaaaugucuaugucugcuuucuaaauauauuauacuuacauguacacaugugugcauauacauucaaaauuugcauugcauaaauuguuuauucaacuaauaagacuacuacuauuaagaaaaugcauucuuccuucacaguguguuaguaacuugucuaauugaacuaauguuguguccuaauuguuuacauggaaauacuguugagaagaccauuuuguucacuuggcaguuucuucacacuugagauggggccugccauccgagggacuguguuguagauugugaucaagguugauuggcaaaacugggcagcuuuugcauggugccugcuuacuauaucugaauucagcaccucauuuuugugggaguuguaauacccacaauuaaaaaaaaaguauaaaagagaaaaauauuugaaggugucuuuaaccuaaugcgaggaaugcauguuguuuuuguuuguuuauuguagugugaugccuuuucccuuacaccuacuaacuauucaaauuaauaauacuuacuuaguuuuagaauguuuauuuuauguagucauuaauuuuuaguaacuucaaagaaacuuguuugcugugucuauuauuuugaacauaauuccauuuccuguguacagagaaucacauguauauucacaaugaagcaauugugugcaccagaaauaaaccccuuucaaacuaaucaauuuuugcauucuuuccaaaaccaguucuuucauguguuuuccccaaauaaagaauguaaauucuggcaucuuuacuauuuuaaauuuagugguuguagagacauuugggaaaacugguuaagagaauuaguucccaucccuaaaaguucauguuuuaaagauaguuggaaauuuuuagagcaauuaaauauugucaaaaaauagaaaguguccagaaaauauuuguuuuccuuccccuucuuuccuccccuccuuuaauguuggaaauauauuuuagggcugggugcaguggcucauaccuguaaucccagcacuuugggaggccagguagcaggauugcuugagcccaggaguuugagaccagcuugggcagugggauccugucuagagaaaauacagaaauuagcugggugugguagugcgcaccuguagucccagcuacucuugagacugaggcaggagaaucacuuuagccugggaggucgaggccgcagugaagggugaucgugccacugcacgcuagccugggugacagugagacccugucucaaaaaaaaauguuuuagaugaagagauuauuucauuuuuugaaggugguacagcagugaauacauuucuggcccuacuguaaacaagaaaauucaggcuaucaguaugaacuuaacagaauauauuacaacauuuauuaacuagauguauggugguuuauuaccaagucaacagguauaaaaggaguaacagugggguuuguuggagaagaggcaaaaauuucuguaugguauuaauugcaacuugaguaguuuggaggcuucaacaguuugacaaugauuucuguuccauacuacaucuauuccuguuuuacuucuuugggauuacuacuucccucuuuuaaaacuccucacauucccuagcuugccccuucucccaaaagauaggguggguaaaacaagcacaaaacuguuaacccuugauccuaguagcaguucuaggaggcagccucccucuaaagcuaauaucaauauucuguuuaaaacacucauuuaauuugaucucaucugcucaaaauuucuuguugcucuuaguguaaauuaagcagugaauauucuuuaccacacuuagaaugugacaauacacacugguguccaguugauuaacuuggauccauucgaggaaauucuagaguccaugucauuacagaaauugccuguauuuuuuucuagauauuguuaauuauuaaucuguauuggacuuuuaaggggcuuguauuauaaggacuggcuauaaacagguuuuuauuugaauuaacagagguuucuuuuggcuuccuuuuauuuagguagcggauaccccagcuaagugcuuguuaauuuaguugauaacuauaucaaaauauuauucugucucuguacacaguggaugaaagguucuagaauuguuucaacaauguguuagguuggugcaguuuuugcacccaccucaaaauggcaaaaaccacaauuacuuuugcaccaacuuaauuuagcagcaggcuuuccaauuagauguuuuccuaggugucacugagggccgaacuuggaaacagugcauucacuaugcuguuccccacacuggcuagaauuguucuuguaauagguuugcuaccauguauguagacauaauaaaguggauuaugacaauagcccuuuuuccaauauuguaaacucuuuuuaauguaguuauaaauauauuagcaaugaauuuaaauaauuuaaaaagcuucaagaugagcguacuguuucuuacaguuuggaaggaaggaggcaguuucagauuugaaacaucuuuagugguuuucuaguaaaugauguauguaaguucugaaauagguuguuccuuugugguuuuaaaagauuuacauaauaguucuagaaaguucuuggaucuuaugaaaguguuagcauguuauuucauaauuaagaaacgugaauuguaaauaccauccagcuuuuuauuauaccagaaugauuuaguuguuuucauagaauuuauacuuuauggaccaauucuccccauaccuagugacuuuaaauaaauaauuuaaaauuuacuggagauuucauucuuuacauaauuaacuugcucccauaauuuaaaguauauauuguacuuuuacauaucagggauuuucugaaacaguuugcaauagaaaauacuugaaagaaaaaagggugguucuuuugguauuucuuaaaaucagugaauucuaaguuucaauucuuuuuuuuuuuuuuugaaacagaguuucacuauuauugcccaggcuggagugcaguggcacagucuuggcucauugcacccuccaccucccggguucaagcaaugcucuugccucagccucccagguagcuggaauuacaggcugugucaccacgccuggcuaauucugacgggguuucaccauguuggucaggcuggucucgaacuccugaccucaggugaucugcccaccuuggccucccaaagugcuggguuuacaggugugagccaccaugcccggcccuaaguuucaguucuugaagagagaguguugauguauaaagugagucaguccacauacuguagaacauaggucauuuguugaaguuggguugacgugacaguaggguguuagguuggguuuagucuuuuuccuaauccacuacugccacuucuuugcaaauacacauuucagaucgucccuaccaagauuggcaaagggggugugggaggggugucauugaauacacucuggaccuuuucccacucugaucaauguccacauuuuuagggugguggucugucaucuuuaguuugcuuguaguuucuuauuuuaaucacucagaaucguuucuagugugaaacguuaaaacaaaaccauagaauaaaccacacuuggauaucuuaauugugcuuuaaaaaaaaacacacacacacauuugaguaaauauuuuuguaucugaaauuuucaaauuuaaguauaucauacugugauuuggaccaaauuugccccauuccccccuccccccgacuccccgauaauugcaaacacugggcuuagaacacugcguuuguauuuccuuuuacugguuguggguuucucuaacaacuuuguuccacaacauuagggucaaccagaagcaaauagcuggauucuugggaaagaggaauuuaaucuagauuuccucaaucucaagcuugaaauuuucuucagcaccaaaagcccagguagauuuuuaaagcuuuguuuuugguuggaggugauacccagcuuaagaaaauuuugacacugggugacccaccacuaguuuaauagugaaauuacccuuuauccauaaauaaacuuuagaaauauuuuuucaacaccuguaauuuuuuucucaucuuuaacagucacaguugcagauuauauuucuagagcugagucucagagcagacaaagaaaccucccaagggaaacuuuggcuaaaaacaagaaagaaaugguaaggagaauuuaaccuguagguuuuuuuuuuuuuuaauuuuugguaugguuuagcuuuauuuuuuuacuacuuuuacugugugaucacuuguuuccacaaauagacaauacuauuuuaguuaaagacucuugaauauguucuuggccccagguaacuaaagauaugcaugcuugagccugaaauacuuuuuaguuagagcuucaaauagcauuuauaaaauucauucugcccaaagauacugggcauagagacuauugccuaauucaggagcaauaggcuauauaccucuucucauugauggauauagaccuuuuaaauuuuaguucuuuuaaaugcuuuacaguauuugauauguaaaugugauuucucaaaauaaggugaguaaaguaggugauuauuuguuuaauauuaacuguuuaugucauuuucauggugagcuuuccaguguuuuaaaauuagguacaguuuucauuaguuuagauguuuucugugguuugggcacugcuagguacuagagauacaaaguugaaagacccauagaguggaauacuuuguuauuuguuuugaauuuuaaagauguuuuaauacuuugauccauugugguauauaaaacugaaauuuuuaauuagcuaauuaguguuuauguagcuguuuuccuccucagcuauagauuucauuuauaaagaaguugaaaaaguugucucccuuuggcaggcaaaagaugugauugaagagcaugguccuucagaaaaggcaauaaacggcccaacuagugcuucuggcgaugacauuucuaagcuacagcguacuccaggagaagaaaagauuaauaccuuaaaagaagaaaacacucaagaagcagcaguccugaaugguguuucauaaacugaagaaguuccuaguuuacaguucuuuuacauuacauuuacaauagugcuuguacaagcuugccaaagauagaauauggaucgccagucuuuacaucgcacuuucaguuccuccauuuggaauucaaaaaggggagggauccugaagaaaucauauguuaaacauacuuugacaccuacuguguuauaaaauauaucaucagaugugccuugagaauaguauauguaacauuaaaaaaaaguugcuggcuauaggaaauguuauuuuguuuucaaaauauggcagagauggggggugguggguggggugggaucccuaacguaauauucuuuaugaaagcauuagcugcuuuuguuacauuuuuaauaugcaaccacuucuucaccugaggaaaacuagaaugaaaugcagucuaaaauauuuugcacugaauuguaauuucuucauuaguuuagucuggaaacuggucuguuuuaauguguuuuuuaaaugcuguauguagaggaaaaucugcagaccacuggaauacauuuguuaaacucucaucugcagggacacugggcgauacuuggcagugacuguucuaccuugaggcuuuguuugguuuauuuauuaaaguguacaguauuuaaaaaucaaacauagcuuuaguuaaaacacuaagcugaauuagucauguccauucagacauaaccugaacuacugaaaagaucaauuuccagaagguuuauucuguauaaacuacauguuagucuucaguagaguaucuuuuuuuuuuccuuuuuuuuuuuuuuauuucgguuguuugaugugcaauauguuuuuguaugcagguaguaaauaaacuuugaucuuccauuugcugaauuuuuuuaacuuucuacuuuuuacaccaauuguugcaaaauaguuggagcuauuaauaggcuuaggauaguauacuuugcuuuuuaaaaagcauuuauacuugcucauaaauagcauuaaaaugucaguuggccauuuaaucauuuuguaaugaaucaucugaaaucuuuacacaaguuuaggcuguuagaugcauagguaauuaauaauacaugugauaauuagcaaaaaaaccuaacaaaauucuaaucaaaggcaacuuuggaagacaaugggggauagaagggaugacaagcaauuuuuaaauaauaggccaaugauuugcuuuauucauucucaacuuauuuugaaggcucucauaucagugaccaaaaaucaguuauuaaacuuuauguauauauuuuagccagagcuuaauuuuuaugaagauaaagacaugaaguuuaacaauggacaacaguuaguacagcuaauugugaggucaaguaauuguuagacauaggggaaggcuuuguuccacaauauuauauggaccacugaacaagaaugacagcccuuuguuaucacuuggcauaugaaaaguguugugugcauaguuuguguuaauuuuuuaugugcauaaaaaugugauuuuaauuuauaugcucugaaggauaauucaggguauaguuaaaaauguacaaugugccaguucaguauauauaacccuagcccucaaauuauucugauuaagguuaaaaugugcugguauuacgugcuuuuuccugaggccuucugauugguucuugguaacagaauuuuaaaguaaggugugaguagugcaacuccuguccuuuauauauaaagauaucaaguaauuucauguccugauauuuaaaaaaauuacccacaaauguguuuuuuuaaaucgaucaaagcuagcaacagguuaaauugucucaguucucuuacauaauuggguuaaaaauuauaagguauuagaagaauuuuaauuaaugccaaauugguaaauaugguguaaaaaaaaaaaaaaagacuuuucauuuucucccacauagaauagucagauauauuaaacaucccuuuuccauaaagaugguuucaaugggaauggaagaaacaaaaucuuaaaagagugaguauagcugaaccaauucuucauucuagcaauaaccacacuaaguucauuacuuuacaaaugacuaaacccaaugucuuguccuuuaaaaaauauagguagugcagaauugugauaaauacgcauuuguuuuuuuagagagccccacuccccaaaggguagccauuaauucagguagccuuuuaaauguauuugagaggguuccgucuuuuuggcugcuauccuaguuaggugagauguugcuaugggaagaacuugccacuauacacuaaacagacacuuaagcaaaagauguauucuggagccuggcacaguagcuuaugucuuugguucuagcuacucaggagccugaggugggagcaucauuugaacucaguucugggccacugagacccucuuuaaagagaaggaaaaaaagguauucuggaagaucuugugcaguugcaacaauguuucagcauauauaugugaauucauauaugacaccugaacggaaucaugaaguaacagcugagauuauaugguggcaaaaaugaccugcuuuuccugaagcuuugggaggccuaggauucuugcuuuaggcaucaccuuuguuaagccuuaaagggggcuacaacuugugcaaaauggugucucugguaacacuucagaaauaauuggcaaaaguguaauaggaauacacaaaucuuuauuuugaaauaaucuuguauuuuaauguggaauuagaagcagcacaucaaacuggugaguucacagaaacuuaccugagaugaugcuggguuccauugcuguugugcuaagucacguauuuuuguagcugcuguuagcugugucuagcguuuuguaaccuaaggagggucuuauagaaguugguauguuaacuaaaucuuggacugggaaacagcaccauuuguauccucugcaaacagauuuacgcuuuugaggcucaaaccaacuaguguucucaugggcuguugccuaaggacagauaaacauggaaaacaggcuauguccagggacagaugauuggugguuaagaauuacaguaaaggaaaauuacaccuggauuuucuucuguaaaguuucaaggaacuuggauuugaacugugaaucuacuguuuuggcaaaaaaucucaaagaaaaggauguuuguuacugucucagucuuccugucuuugcuacacgauuuggaucccuuacgcuuuuucguuaagaauaucugucugcuauagugaauuugcuagccccuuauuuuuuuuuuuaauuuuaguucuuuauuagaacguguacuugaauggacuguaguugcucauaacccauguuaaucucugauaguauuuggguuuuauuucaggagcuuuugcaauaaagcaguaacugcaaucugcuaaagucagacuguuagcaagugguguuaaaacugauuuaaguccauuacacugaacaguaggaaauuaccacuuuuguaaggcucaaaaaugaucaacuauuaacaguuucuuaugguucagucuaauuacaaauuuuuaaaaaguuuaucaguguaucauuucagauucaucuguaucuucuguaauauuauuuccaguacugagguaagguacacaaaaauuccccuggaaaaacuauauucuaguuuuguaagaugauuucccacaguccauuugcuuauuucuuccuuugauaauucaaaaagaugcuuuagguaaugguacagaauuagaagcugcuauuuuagcucuauuaacuuuuucucuaugguuucaauuuuauccaaccagagagggcuggccuaguugguaucuuuaaggcccuuccaguaguaauuugagucuagucacaugucagacccugagcaacaccuaaccaaaugcccaaguauucucauaaggaguaugcugaauuuaagugguguuuguuuuacauauguauccaucccagacauuuucaacuaugcugaaugcaaucuauaagauauuccaaacaaggacaaaguaauuuuucacaagucuuacagccccacuauuaaguaugcuacuaauuagcuucuugaauuucuuuguauuucagugauugggauguucuuuuuuuuugggaaaguuuuuuuaccccuuuguacccucuuaauuggauuaacuguaaaauguacauauuaauuuucuaguuuuagagaccauuuucauuaaaaauauuuuccaauaguuuuucuagauaaacaauuuauacuuaauuguugcuugguugcuuacauuucaaccucuaggcuuccuuuuucagcuaacuuggcugucuucagguuguaaagaaaaauguaaacauauauuugaaauuucauuaacugaaacugcuguaagguguuagcaaauguuaaccauaacagauuaucccauaucauuggacuguucuauuauugggucaggaauaauaggugacacaggauagaagcucuuccuauauauaucuuguugcuaaggcaguaguuggcucuaagcugauaaacagcacacuguacagcaguccaaaaacuaaaaccagagcuuaggucauucaaguuaacugguacucaagguuacucauuccaggauacuuuacauaaccaaaaaccuaggagagcauucuacauuguaauuuuuuuuuuacuuuguuuacauaaaauuuacaggguuuuguuuuuuuaagcuuagucuguucuuugacauuguugauucauguucuaaauuuucaucagauuuaacauguuuggagguucuugugcacucaaugugaaccuacuacaagcuucugaacugcaaaaccuuuuuuuuaggucacugucaacagaaagaugccuuauagaauuucucaugauugaaacagaacucugcauucuaaccuaaaaccccucuaacccuuuaaaugaagcauuaugccugcgugaaauuuuauuuuuagacauuucugauacuagguuuucuuuacgggggggcauacauauucaguauacugaauuuauacagcuuucaguguggcaauauauuaagaagcuaguucccuaauuuuucucaguucucauugguuuuccauuuaaauguuuccguaaguacucucaucauuuggaaaauacuugauggcaggagaacuugcuuaaaacuaaagguggagaaagaguuaacuuccaggacaacccauuauagcucacuucuuaccaacaaagcaguuuuuauacagcaccuuaggacucauuucuaaugucaacccagauggccaguaaaggcaagggaagaggcuaagugacucacaaaaaucucugauauugaggucuaaugugaaggcuauagauaggaauuccccacaaacuucuaaugaggacuaauaugaacagcaaauuggagaagacaccaaggaccuaauuuuaguuucacuagccgugggaccuuagaaaaaagaccauuugcucuggacuuuuguuucccaagccauaaaauguggaagaaucuucacaauuucaaguuggucauguauauuucccuuuuacagagaaagcugaagccucgaggcucagauuuaccuggcuucuguuuaccuggcuucugcagaaguuuaacuuguaaccuaccucucauucccaaaguguguuuaaucaugccgccuucuuuaaaauauaucuggaagcaccaaugaguaaagacaaaggccccaagcuagaucuguagagauaaguacuagacucacaucucaguacuaucaaggaaaacaugcuuagguuaucagaauugugaaggccauaguacaaaaaguuaagagaacggaacucaggaucugagaaagaucagccauucucagcauguugccuuggcugcuuaaccuuacuaaacuuccauuuccucacauguaaaauguacaucauaauaacuagucuacugagauaagggaagaauacuuagcacagugcuaguacacuguaaguacucaaauguuacagauccaaguauuuuguaagaaaauaccagcaaaagauaaaaguuuuuuuauggaucguauuuguaucaaucaccuacaugaucuagagcccucacauggauaacauuuaaauguucaguuugccuaauagccuucaaugaaacacggauucuucuacuuaaaaaagguaagccuggagaaaauaaaacugauuacuaugcaagaaaaaaaugugcucugcugugcuccuugguauuuuuaagugguuuccauugucuuaacaccugucuuaaaacggguauguuguuugcacugaacccucaaaaguauuuauaccuauuaaguuaaauuucccuuuuuagaguuaaugcuucauugccugucggcauauuaucacuaucugucuuugaaaaauuuucuuuuaagucucaacuauuucuucauaaagcucuuguucagagaaacauuuuuugauuuguccaauggacugaaauaaaagguuaguaaaccaaaauacaguugauccucauuauuaguagaauuccuuaucugugaauuugccuacucacuaaaauuuguaacuccaaaaucaacauccuuuucuggucauuugugaguauuugcagagugacaaaaaauuuaaaccacuuuaugugcacaaggcaaugcucuaccuuguuuaagcucucacaccauaaacagauauccuuuuuguggucuauuuagugccaaguuucauguuugugcuuuuuguuggugauuuugcuguuuuaagaugguuccuaagaguaguagugaagcaugcuaccuaguguucccaaaugcaaagaaggccgugaugucccaagcaugaguuaguuauagugcuguuggcuguuaauugaaaguuaaugaaauacuaaagaauguuuucaagcagaaacaggucgaucaagguuauauacugacuggcagacaauauugugaccaaagggucacagaaucuguauuucucuuaggaacuuguuccuuauuugcuaauucaguguucauagccaccuuaaagaacagaauuaccacaaacaagaaccagcuguacuuucaugucuccuugucccuggaaauaauuuauccugcauaaaagccuuagaagcuaguguuucaucauacacuaaaucauaacagacuccaucagauuuuaaacgaggguauuggauagaaaacacaaagagcagauauaccuuuacuuuauaaggcagauaaauauuaccuccacuauuuuuuuaaccucaaaaguccuuguauccuccaauaauuaagaaacuuaugaugacuuaaggaaguuuagacgguagguaguauaauuuaucaucuuagagcuacacauaagaaauacuccuguugagaaauacauacuaguuuauaccagauguuuuauacagguccucuuaagauccuuauauauuuuauguuagacaaacaguaaguaauuugccuuuaaacaucauuuaaauuuauuaguguauaaauucuaaagaguccaaauuaaauauguugauauugagaacauuucaguuuucaguuuugcuaacaggguuuaagcuuaaucauaacaauugcagaaguuugauuaugucaagaaauagccaacugaaggaauaauuuauaaauggucauuaccuuuaaggggcuagcugaauacaauguaaauacucaugccuguaaucccaguacuuugggaggcugaggcgggaggacugcuuaaacccaggagguugaggcugcaaugaacugugauuguaccagaccuguacucugaaaucuuuaucauacuauuuuuaaugcaugaaauaaaaaugguuuauauguacauagaauacacacacacacacaccccuaggucaauuucuuaggucucaguugugguuaaauucacuuuuaaauacaagguuccaaguauccaaguugccaggccaguugccuguaccuggaacagccuuuccaccgaauaagaagagucccuacuuaaacagcuuaagcuaauuuccaucauacuauuuaucacagucuaauuaccaguuuaucagucucccauuaaagugggggcucccugagagcaaggacugucaucuucacuuugccuugaaaaguagacauaggucccaaauuaucugcuaaaugaguaaugaacaauauuucuauucagaaggugugugcuugcccauaauuaauacgcaaauauucuaaacuauaaucugauuuaaaauccccaaauuuaaacaagaaaauuauaccaaggcuuugagauuuagcuugugcuaaaucauuuuuuaaaauuguagcucugaggcauuuuauuauaaaaacuuaguacucauauacauaaacuaauacgaacuuaaaauucaucauacauuuacuucauuuuuuagcuugaccuucuaguaaaucuuuagcuucauugauuuuggcugcuauauaaggagauccuccuauaggaagaaagaaaaaagaacaguuacaauauggauucucaauuucugcuugguaaaaagcuacucuuguuucaaggacuccaaugcuuaucugagggagauuuagcagaaacaguguuuuaauuuuuaaaaaauaacccugacacugcaacuggaugaccaaauauaugguaauauaugugaccaaugagaaaugaaguaauuuacgugggagauauuucuacaaaaauaacaccuuuuuagaaagcuuaaacugauagaaauaggauuucuaucauauauauuagauauauauguauaugccuuugaacugguguuagccuauucaugauuacaggucauaaaugaacaucaauuauaccauguuauuuuaauaccaugauauucucagaggcuucugagcuguuuacuggaaagaucccaguuugcuuuacauccuuuuucuguccaguuuuucuuuuccuguuaucuacugucccuucacaaugucaucuacagcugcuuuccuacgaaucugcuggaggagugauucucaaaguaugguccuaagaccagcaagaaauaacaggaaauuuaguauaaaugcauauuuauggggcuccacugccgaccuacugagucagaagcccuccauauaaaacaagcuaaauuucauaaaagauacugugaaguagauaucaaacaauuauaacccuguuuaaaaugucaaaacccuuuuuauuaaugaaagcccucuccuguauaaguaaaaggauacaaacacuagaacaugaauucuguggucuauuuuuugguauucaaagaaauucuugcuuuccuucaacacagccaaggcugcauagaagucuaucacaaacgaauaaauaaaucccauaaguuucuaucuagguaaucuccguuucaagguaucuaaaauggauaaggaaaaauuacauuuuaguuuuacgaaauuuaacguuuuaauuauaauaaauguaggccagaaaaacccacaaaacauaguaauaguagcacuuacaucugcucauucuguaaguaaaguuuucacuuaauuucuuuuaagacaccaaaaauauauggcuccagccuaggagacaggacuuacagauuuaaguguuaccuuucuaauagccaggaauuugagauaaaauuaucccauuaauaacuauuggucacaccaacaacaucaacgagaauuuaaugacuacuuaccuuugucaggaugauuuaaaagcauaauucgucgaugagcaucucuuauuuucccuuuauuggcaguagggcuaauuaaaaaaagaaaugguauuuacuucauccuacuucugcaucacaucaaaaaacuguacauaaaggccaauuaaagacacugugaaacuguaguaaauuaacacaacaguaugaaaagcuguuuagaaaccucaacacacccaaugcguauccuaaauugggaaacuacuuagaaaaguaaggcacucucaaaaauguguugaacuugcaguacccauuacaacaguccuuuuauugauaagaaacgcauguuuaaggauuugaaaaugaagaaggaagaguuuuguuuuuuuuuuuuuuugagauagucucacucuguccccuaggcuggagugcaguggcuugaucuugguucacugcaaccucggccucccggguucaagcgauucuccugccucagccuuccgaguagcugggauuacaggugugugccauuacgccuggcuaauuuuuguauuuuaaguagagacgggguuucaccauguuugccaggcuggucuugaacuccugaccucaaguaauccacuggccuuggccucccaaagugcugggauuacagacgugagucaccgcgcccgguugaaggcagaauuucaccacaaaaaaaaugucaguuacagagaacaacacugaacacugugauaaucugcugaggagucuaucuuuaaauaaaugaaaaagugccuguguuuuaguaaacacucuaggaaaaaagaaaaagugcuuaagugcuagugugccuucucauuugaaggauuguuuacaucuuaaaaauaacaugaaggaacaguacaguuucauugauuagaauugguaauaucaaucuuccuaggacaaaaucccccaugacccucuccuauuaaaggagagaaggucuuucuuauauuuccucauggcucuacagugguagaaaaaugcuaaaaauauuagagauuauuuuaccuuacaccuaguauuaaugcugcuucccguuuugucauuuuggguucaaacccaccucuauaauagccaccacugaaggccugaaagaagaaaugcauuuguaaagaaagguuaauaaaauaaaguugcuuuaaaaaagacgucuggaaauauucacagaacuaagaaaaacuaagacauuucagaggacuuuuagugcaauucccgagguauuuuagcuaaagcugaauaaaguuuauaaauaaguagcaacaaguaguauuuuaaugaucauuaaacagauucauuuuuuuccagucaauaugaacuaucuuagaaauauaagacaaaauaacagugucugaaagccaggucuuccgggaguaaaggaaagaucauuccaaauuagccauauucuagauaaaaaucugcaagaaguggcucaagaacagaagucuuuugagacaagagguucaaguguauuugaaacaagacuuuaagauauauauacagaaaauaccacuauuagguccucugaccuugccaugucagaaaucauauugguaaagccuacaaucacucuauucuguuacacuuaaucacaacauauucaacaggugaucacagccaaaucuauucuuaacugugaccacagagaguaugaccauaacaucaagccaaacccuauagccuaauuaacuagagugcuaccuauguaugauguuugggagugccagggccacauggucagaucggaucacuuuagaaucauauaccucugugugugcgaugcagagcagaugaaggaaaacaagaauauguacagaugaugcugaaggugaugguaugugaaaaagugaaacuugggucuagugggguacuagaauugucaaaaccccauccaacucugucacauauaacaucugauguuucaggguagcaccaucacaaaguucagaacuucuauacucuccuugcaggaagcaggagaauggguccaaagcaaucacuuagaacuucauggauauuuggaaauuuacccuucccuaaguguggcucuagguuucaaauagaagcagcaaagaauuaacaaagucuuacagauuuugguaggcuuugaaaaacuuguuuuacuugaggcuccauaugcuucauggcuugcaaaacguaacggccuaaaaccaaaagcaacagaauaaguaaacuaaaucuccaaucuccccgacuucacuuccauccccaaaccauaaacaaaccugcaaauccugcagcagcaauggucaguccaacugcuaccacuguacuggccugguaagggggagaagaguaaauauuuacuucucuaauucccacccuuucucauuuugcccauucuuccauccccaacucauuacaaacugcauuuuaauaggagaaacaacuuuuuuuuuucuuuuuuuuuuuuuuuuuuuaagagacggagucuugcuauguugcuuaggcuggucuugaacuccuggccucaagcaauccucccaccuuggccucccaaagugcuaagauuauaggcauaagccaccaugccuggcagagaaacaacuuuuaaggcggaaauauucuguccaguaaucuuuaaaacuacugcaucuguuaugcugaaugcauuaaaguuacaggauucaucauaugggaaagagggcaaguucgacuugcuuauuuaucuuuacaauagugaaaaagaugauucccucccuuugaaaacuucuuucaucaccagacaaauuaagucacauuaaaguucaaucaaaaguaguggaaauaggccaggcgcgguggcucacgccuguaauuccagcauuuugggaggcgaggcgggcguaucacuaggucgggagaucgagaccauccuggcuaccauggugaaaccccgucucuacuaaaaauacaaaaaaaaaaaaaauuagcugggcgugguggugggcgccuguaaucccagcuacuugggaggcugaggcaggagaauggcgaacccgggaggcggagcuuguagugagccaagauugugccacugcacuccagccuaggcgaccgagcaagacucugucucaaaaaaaaaaaaaaaaauguggaaauaagguuucugcuacagaaggaaaaacuguuuacagacggcuccug

SEQ ID NO: 13601 - RNA, 635 nt, Homo sapiens
aaagcagaagcugacuacgcagucccagaucaaacacgcuccagauaauucgcuucacucagcgcugcggccagaucugcagcucagcgcuggccccugacgcccgccgguguuucagcgcccccuccacgccagccccggcugccgcagcucugaaaggcagggcccgcggcggcguuucgaaggcacagcacguggcccugacgccccguuugguauacguuuuaaaacaucagacaaacgcuuccaccaauauggugaccgucugaggccuucugcugaucucagagguccucuccuaaaugcugccugaagaggaugaggguggugguggucucugggagaaaaacaaaaaacaaaacaaacuagaaaguaaugucccagagucccuggccaagaggcuuuucccggggcgccgcacuccgcgagagguaucaguaguggagggcuccgagaauacggaggcuggggccuggagggggucugagcguugaagucccgaguugcgauauuauuaaccaaagaccagguuaccaagauugagggcgaggaggcuggagaaucugcagugcauaauuaugugccgaaauaaaauguuucaguggggggaaaggggguaaaaagaacacgcaaaa

SEQ ID NO: 13602 - RNA, 210476 nt, Homo sapiens
gacgcuggcgugugacguugcugccugacgcaggcgcagugccgcccggccucgguugggaccccuccccuccuccuccgcccccuugggugucgguggcugcggccagggucuggaccugggcggcggccccgggcggcggggcuaaagggugugggcaccggcagagcuucgcaggcugcauccggcucggugcugcugccgucgccgccccugccgccgcccaaggcccucggcguuccccggagagaggccagagggauuucgggcugccucggcacucgcccaggugaggggaugggccgggccagacgggguugaggucgucagccccuuuuuccagugucucuggaacucaaccuggucggagucugagagcuuuggcuuaguaguggcugccugcggcggcgacuccuucauauuccuuugccauccuuaccuacagcccuggcaccuauaaaccgaggguuggaggucaguggcaaagucuggaagggccauggcagucggauggcuggggacuuugauacaggagcaguuccugcgggugaugguaaggcgcuccacuugcugguguguggacucggcaggaaggaccgugcacccgcaggcucggacugcagccuugccagcugcacuggguuguaguagaccccaugcugcuuaauauagggucgguugaccgagggcggggaagccuuggaacaacccccgcuuucuucucugggauugauguguuuuguauucugaauuggugcuugcugcacugcacucuagaagacuacguuucagcagaauuuccuauuggucaaaggaaggugaagagaaguugauuuuucuuccggagaguauuaguuguugucguuuuuuuuuuuuuuuuuuuuaccuuccuguuggccuuaguguugacguuuguuaaagguaaaaguucaugugaauuuccuuuuuaaggaaaucaugggcuuuauaacugucuaagcgccuguaaguuucaaccgguuuagugguuucugcuuucacccugugcauagcaaugaaguuguuuuauuccaaguuaaauauacaaaguauaaaaauagaugaauaaccagaauacuuuguaacuauugagugguacauauaauuaugugcauauauuaucacauuuaaucaucaaaacaauccuauaauguaaagucuacuauucccauuuucuagaugaaagaacagaauagaccuacaaaguaacauguucaaagucagagcugugacugaaaccagguaaucugacucguuugcagucccuuagucaguaugccauaccaacucccaagcacccugugauuuugcaagauuuucauuugauaaaaaguaugccaggaaggacauuauggcacuguucuugccggcaaggacccaacaguuugagagaaacuuucucaaugugcauuuugaguuauguuuuaaacauaggauuugaucucuaggaccuuugauuaccaaacucaugcucuuaaguacagugguuuuggagucuuuggaaggcuucaguuuggaaguuguaguuuuauuuuauacuuaggaguauuuguuguuuggaaacuuuaaacaaggaaacguaauauuggacuaaaagaguuucguccuguuugugcaugauuaaguaacgaaaucauauaaucagaaaugguuaugcugcucguaaagccagaauaccuuguauaauuaguuaaaaugccauacuuuucagguuuguuaagaugaaacacugcagaaaggcuaucugaagaaaaguagaaggaaaaacagaacguugcaaacucuggaaaaaaacuuggguaaguauuuuuggcuaaguuuuaaaaaggucaaauuuucgguuaaagacuuuuuuuuuuuuuuuuuuuuuuuuuuuuuuugagacggagucucgcucuguugcccaggcuggagugcaguggugcgaucuuggcucacugcaagcuccaccucccggguucacgccauucuccugccucagccucccaaguagcugggucuucugacuuucugcuucaguugugguuuaaucugccuauauugcuagggaauggggguggggugguggugauauguaauguaaccuguuagucauuuuacuugacuuuugagcuauugauaccugauugacaaauuaagucaugugcuuagccugugcauuggcaggagaaagcagggaaauccuuugcuuaacaggugucaaaauucuguucucucuuuugcuugcucuuuaaucuaccuauguuuguaaaguguuuuaagaagaaauugagaaaauggccgggcgcgguggcucacgccuguaaucccagcacuuugggaggccgaggcgggcggaucacaaggucaggagaucgagaccauccuggcuaacauggugaaaccccgugucuacuaaaaauacaaaaauuuagcggacgugguggcgggugccuguagucccagcuacucgggaggcugaggcaggagaauggcaugaacccaggaggcagagcuugcagugagcugagaucgcaccacugcacuccagccugggcgacagagcgagacuccaucucaaaaaacaaaaauugagaaaaugaagaaaaguaguugacuuuugguuuguuuuucauagaauauuguguauggcugaacucaaguauauuuuuuaugaauucuacagagaauaauggaagacaugaucaaaggugauuaagaagcaguguaauucauuucauaacuagcuauugaguaucaugugucagacauccaggcuucugguaauagagcaauggucuucauggcccuggagaacacuacaguagugcauuuucucuuagaagguaacauuuuuugugaauuaauauguuuucuuuauuugauaagcaaguauguuuuugguuuauguaagagacuagaaagugagcauuacucauauaguaagaauuuauaauaaauuuuauauuauuuuaguugguaaagcaggauucucuaugaaugcugcauuaauguacagugggaagcuaggauuuuuuuuuuuuuuuuggagacacaauuucacucugccucccaggcuggagugcaguggcgcaaucucuucucacugcaaccucugccuccuggguucaaguaauucucaugccucaagcucccgaguagcugggauuacaggcaugugccaccacgccuggccaauuuuuguauuuuugguagagacagaguuucaccauguuggccaggcuggucucgaacuccuaaccucaagugauccacccgccucggcuucccuaaguggugggauuacaggugugagccaccgcgccuggugaaaugaggauuuuuguagacuuaauuuuagcauacuguauuucauauuaaagauaauaugggagcuuagcaaaauuaauuuuuuaauuugagaaaauuuugaggaacuuguauagaagauacauggucagauagggaacuguuuaggugaugaauuggagggaggugagcuuugaagacuggugauuaguuagaggcuauuauaguuauccaggugggaaaugagaacugcagugcauauuggaauuaagaaauggagauggauuuaauagauguaaagaggguagauggauaggauuuagugggcuugagggaaaaugaagucaggguaguuucuagccaccaucaucuuuaugcauauguuaauguuuaauaaauacuuuugagaugcuuagaaugaauucucuggcuugggaaacugaguagauucuggggccauuuacugagguaggaaguguaggaagaacaguagauuggggaacaugauuggaggagaugaguucaguuugguccauuaaaucugaggcauccgugacuucuaagaaaugucauuagugaguuguauauauggaucugaauuaagcagaauacccagcuugagauguaaauuuuggagucacaauuuaaagaugauaguuaaaagcaacggcaauggaugagaucacucaggaaaauguagagugaaaauagaagagaaaugagguuggagaacaacagcauuuaagggugagguuaaagaaaaauacaccucaaaggagugggcagggaaguaagauuggguaagagagucacaaaagucaguggaagaaccgaguuuagagaaaaggaaugaguauuagacaucuauagacaucaaauaggaugaggacaacuaaaguauccauuggacauaucacuuaagaaaucguugaugaccugagcaagagcaguuuuauaagugaagcuaauucacacugggcaagagacauggauguugaaauagcuaaugucauuuacuauuucagaaaguuuaguuguaaaugaauagagaaggauauagcuaaagcuaugaguuugagagaagguuuuuguuuuuuaagguauaagggauauaagcacauguuuauuugcugaagauaaagagucaucaguaagaaaaucugaagauaaaggaaugaggcaaaauaauuggugaagcaaagucacugaacaaacuggaaaggauauaauacaagggcucaggucaaggguacuuuagguagacuucuacugagacaggaaggaaggagaugaugaugaugauauauuacagauaaauuuguaggaggcaggauaaagggcuacucuacaaaguuuaugcaggagacucugacuuaugguagaaagaggaaaugguucacucuuguaaucaguagccuucuugauguggcauugcugacuccugaucuuuuaguagggaggaggaggagagugaggugguuuagcuuaagaugacguauaugaaucaucaaguuagagauaccuugaagaucucuugcaaaauuacccuucucauacuuuguauuaguaucuauggcuaaauaacaaauuaucccagaacuuagggguuuaaaccgauaaauguuuuuuauuucaauuucuguggaucaaaaauuugggaaugacuaaacugggugcuucuggcucagggucuuugaggaggaugcagcaaagauguagguugggacuuuaguuaucuaggguagugguccucaaccuuuuuggcacuagggaccaguuuuguagaacaauuuuuccgugcaccugacaggggugggguugguggggggaugguuucaggaugaaacuguuccaccucagaucaucaggcauuagauucucuuaaggagugcacaaccuaaaucccucgcaggugcaguucauaauuggguuugugcuccuaugagaauaaugccaccugcugaucugacaggaggcagagcucaggugguaauccucacucaccuccugcuguguggccuaguuccuaacaggccacagaccaguaccagucugcggccuggggguuggggaccccugaucuaggggcucaacuggggcuggaaggguuuaauuccaugauggcucacuaguuuagcugcuggauggagaccaacagcuuuuuuugucauagucacguaaaaauucaauuucaguuauaguaauauucuugguucacaggaauuggcuauuauguggauccauuuggcucucugccuagcaacacuccaauuaaaaaaauauuuucuuugaacuugauaugaugagaguguugguaaacacaugugaccauuuuccccucccugucucccaagucccuguuuuuuuggguggguaguuugcuguguaucaggugaggguuccugauccaaguggcuuaagacuggaagauaugagaaaagccuaaaugcuacauaggaaaaaagaaauaguuuuacuucaaaaaaaccuuuagaauuuuacuuuguugaugcuagcauuuuaguguuauuuaguguuuuagaguauuuuaaauaaaaauggaagugagaaauugaauuguugauuaaaagaaacuuacagaauguguuuguuagccaauaugaaaaaagcauaaaugaagcccuauaacuaauuaauuuaugguaugaggacuaacccuuucauucgugguaguuucuauuuaucucuuuguauugcucaccauuuuaaggaguaugcugaagguaguaauuaccacuaaaguauuaccauuaaaaguagauaacauuuaaaagucaugauuucuucuagauuuagagagauuguaguuagcucucucuguccucuuaguugauauguuuucuacagcuuuuuaaguuuuugaggcugggcacaguggcucacuccuguaauccuagcacuuugggaggcugagguggguggauuacaaggucaggagauugagaccauccuggcuaacacggugaaaccccaccucuacuaaaaauauaaaaacaaaauuagccgggcgugguggcgggcaccuguagucucagcuacucggaaggcugaggcaggagaauggcgugaacccaggaggaggggcuugcagugagcugagauugcgccacugcacuccagccugggcaacacagcgagacuccgucucaaaaaaaaaauaguuuuugaaaaaauuauuuugauaaguauuuaggugaaccagcauaaauuucuggcuauggaggugagguuugguaaaauacagcauuuuugguugggugauaugacuucuuagauauucagaguucuucgauauauaagcaugaagaaccauuuuuguagcauagauuaugauauuaaaaauuauguuuguuucauuugcugauuuauaguguuuggaucaucagucgccauaccugaauauuucuuuugccuaguauuugauuuucuucuaagaaucaugcucacuaguacuuguggaacuauguuauucauguugguacuuucuugauuguuauuuguggcaacuaauuucuuuugguuauaaguacaauucuguuauuaaauaugguuuuuggcugggcgcgguggguggcucaugccuguaaucccagcacuuugggaggccgaggcagguggaucaugaggucaggagaucgagaccauccuggcuaacauggugaaaccccgucucuauuaaaaauacaaaaaauuagccgggcgugguggcaggcgccuguggucccagcuacucgggaggcugaggcaggagaaucgcuuggacccgggaggcggagguugcagugagccagaucgugccacugcacuccagccugggcaacagagugagacucugucccaaaaaaaaaaaaaaguuuuuauuuuacuuauuguaaggaaugaaauacauuuuaaucguuguuuacugccauggacuuuauuguuuuuuagcuuucacuuuguuguugaauugauuuuuucuuuaagaauauuaauaaaaguagcuuagcuacuacuguuauaauguuuuuugucaagugcugugcugugaguuuuauguuugcuuuauguuuuuaaugccuucagcaucucuucaaggaagagauggccauccuacuauuuggaaacaggcgcaaagagauucagaggcuugcucacagcuaacagaaguauaaaagggaugaagccagcuuuccauuucaaaucugguuuuaaagccuacucuauuucuaagauaccagacaauuucuauuauuucugauugaauguuauuuuaccacauaauucuguugggcuuuagaacuaguuaacaggugaaauuguguuuguuguguauagaauccugggacugaaaaggaccuggagugacccuuccuagguagcaaggauuauaccuaaucuauuuuaccuaagaggauaauuguuuauuuugucugcuugaauaaacagaauaggacauuauauaauuuugauuuaugugcacaaagaugcuggcccuguccagaauuguuaaggagccuaaguuuguauuugucgcccaucucuuuugaagauuuuccacaucuucgggaaucuuaggcuuuuuguaauauucauagguccugcuugugaaugagaaaagcacucuaaugaaucaauuuacacuaauaccacaugguaaucaugaaugguagguauuauugaaaucccauuaagauaucuuuccauucuuaagaauauugguuagcguucuauuuaaauaaaugggugguguaauuuuaggccuuguugugucaugaugggagcaauuuuuaagcagagaggguccuacaaaucacuguacauguaaugaguaaugucaaccuuuuuauacauuccaguacuaucuuaaauguauaaaguuuacauaguuauuuuaagugagguauucaauugcaguagacacauauuuuguauacuuuaucuguauagcaucauagaauuggaaggaacuucacaaagucauuuguuccaggccaucugccugaggcuugguuagugcuuagaccauuuuugucacuuuacaaacaguuuacaugaauuaaacacuccuugaaacuuuauuuugaauaaaaauguuguaugaucugauuuguauuuuacuuuuguuuugggaucuccuuaggccauggcaaagauaaacaaucuguucaggcagaucuuuuguuuugguauuuacugagauauuuggaucaauuacuugguguuuuaauuguuaaggaggagauaaaugucuuuagaauugguaacccuacacaaauuaucugaagauaauuuguuacauaugcgcagagaccaguuaaagguuuucaaguuaagcguuuggucugcaacauuuaauauugaucacuaaauguagaaagcaauguagaaaugugauugugcagaguacauaauucacagaauuucuaguauacaguaauggugcuaugugcuaacagguacuuaaccuuacuuggugaugaagagaguguauguugguggaguucaaaggagagcucuaaaguugguuuauuuuccagcccuuaaagaacugugaugaaauccagaagacuuuaauauaauggugugaagauuuguggauggcuuagguccaaagauugugauuucauuguugcaugagggauuuggguacgauuaaauuuuuuuuuucauuuuuguucuauuuggaauuggguuguuaaaauauugaauguucuguuucuuuacuuuuuuuuggcaggccgguuguagggggugggugagaaauacuguaaugagaucucuucuuagcucuagaaaaugagagccauuuuuuucuuuuuucuuuuguuuucuuuuuuuuuuuuugagacagggucuugcucugucacccaggcugguaugcaguggugcagucacagcucacuguagccuugacuucccaggcuuaaguguccuucccauuucagucucuccaguagauggaacuacaggugcuugccaccacacccagcuaauuuuuguauuuuuuuguagagacggcguuuccucauguuacccaggcuggucuccugggcucaagugaucgcccacuucagccucccaaagugcugggauuacaggcgugagccacaacacucaaccagagaaucaaauuuucuuaaggguaaaaaagaucauuuaggagugucuuuggcccugaauacauuagaaauacuugccuaucuuugacaauagcucauaaugauguauuuuuuauaaugaugcauuuauuucauucauuuaugaagcaaauauuuauugagagacugcucaaugccaggaacuuuguuggauauuggauacccaaaugaguacagcaagcacauccuuaaggagcagucauuagugggggagauacauuucuaaaccgauaauuacaauacagugugauaaguacuaagagacagguugucauucaagcagcauuuauuuagcauuuucuauauuguuagacauucuaguaaagauuaugaauauucuaacucuuaaacuuaauacucagaauuucugagcuguaugguagaauuuuuaagcccaauaaauauuuauugaauggauaagcaaaaacacauagaaaagguuauauuguacuuucuauguugcuccaaauaaucaaaaucaaauauacuuucccaugacagugccaggguaagcuguggcucuucacaguuaggucuucucaagugauaaguaauguuauauggauauauuccagcuuaagccugauaaaggaaaaccuuauuucacacaguucuguucaacuuaugggauauuuguuucagaggagccaugaagcccuggaaggggauuaaccagugcacugagcuuucuugaggaccugugggcagguucacagaugggaauugggaaaauuguaaucaaccaguucuuuccaacucuucuucuuugaguuaaucaaaucuugcugagaugggguggaguugggggauuugggucaagcuguggugacgaaaguccucucauccauaauuccuuucagcuaucacccuagggucauccuucugcuagcuguuauuaacacaaauuaaauguuaagaaaaauagaagaggaaaagggacaguagaagguaaugggguuauaacaacaacaacaaaaaaaaaacugggaguaauaagaagaaaaaggaugaaguaaaaauguuuuaaaauaaauaugaacuugacucauacuuuaaaaauauauggaagcaaucagagucugucauucuuuucucuacagaaucuccuugcauuuggguucauucuuucucuguuguuccuguucugauaaaagaaauguuccucuuucuaucaaaagcuaguuccugcacauauguaugcucuggauugagauuuuaaaagucuuauguauuaaauauugugcgccuucagucauaugguuucauggucucuucuaaagcacacagucauguuucuuguaaagaaaauuguccuuagauuugauaggccuaguuauaaauaauaaaaacacagugcuuuguuuuggguuuccccagaaacaaaccugggauaaagauucaaggguauauaguuuauugggaaaugaucauaggaaacacugguagaaguggggaaggaagaaaagaaagggauagaagugaauaaagggcauuauucuggcuguuaccacugugggcaccuggaguucacucauauugggaacucugaagacaucaaauaaacuaccaucggaguuaucccaaaccaagagcaaggacaauuugaguguuaaauccaccaacuuccuagccauaauugacauuaacucucuggcguuucucgcuugucccuggagugcaagcugaguguguccuugcagucagaaagcagcacucagcaggguaucacagguguucauaaugagcagguuuccuguguagaggugagugccaacaguauaugggcaagacaccaauagcauuggcugccaauagcaaacauuuauacaauucaguaucuaugaugugccagaaguucuaaaugcuuuacaucaacuuaucaauuuacacacuauaacucuaugagauagguacuauuaguguccucacuuuacacaugaggaaacagaguacagagagguuagguauuuugcccacaaucacacagcuauaauuucagaacugacauuugaacccaggugaagcauaguauagagucuaugcuuuuaauccauauagugaucugcuucuggaacaauauagucugaagcagcaucuuuugauucuacuguuguuccauaauaacugccuucucuuucuccuuuccccuaaucucuuuuguuuuaguguucugugucuacuuccuuauuuguaguugucuccgccccucccugcaauucuagaacauuguaggcauuccucuuuccauuuuacacucaaggcuaucauaucaaauaauucuugcuaagguauuaacugauauuucugaguuuaugugaaggccucugaguuugguauugcuuggugaguaucugcauguuaauuacaaaauacaaauauuuaagaaccauagaaagaaagaugugauuauagaguuacagaugacuagguuagaauuuugggauugggagacaccuauaccuuggccaugguuauaaggagaggccaagaaaugugugcuuaggcaaaaaaagccguuuucccaacuacagcauccuguccuccagccaucacuuugucuuuuucuuuuuaaauuauggaaauauuacacgccaguuguaaaacaaacaguaugugagugcccagaauaaaagugaaagucugguuuuguugcugcuucuccuucccccagaaucuccuuccacugauuagauuagauucaagcuauaugcaucuuuggcaggaauaucacagaagugagacuguguucuauuaagaggcucacaguuuugacuuauccuauugcugcugguauuuacauugaucacuuaacuugccuuucucaaaguuccucuuuuucccuuugucauuaauaauuauuuuuugggguguggggaaagaguuauuuugaugugacuauauagaauuuuguuagccaucaaaauuugauuauauugguauggacucagauaccuguuuuauuaaaugggugguaauccauuacuaucauuuauuuuauuuuuuuuuuugcauuaaaauauaaaguaaucaaauguuaauacaaaacuuuuccuagaaauguaaagcuucuucuuguguuugaguugcuaaugaaauacacccaugucucugcauuuuacauuaucacauucauggugauauguaagaauauaauuauuuagaccauauuccaaaaugccaauauagaagaagguauuuauagcaugaauuugaauauugucuucauuuaaauacaaacguaugcacuguaaguaggugcaagccucagacuacuucauaguuucuucuaguguaguugcaccuauguugucacauuuuuuuuuuaauuauacuuuuuuaggguacaugugcauaacgugcagguuaguuacauacguguacaugugccaugcuggugugcugcacccauuaacucaucauuuaacauuagguauaucuccuaaugcugucccuccccucucccccgcacccuaugauaggccccggugugugauguuccccuuccuguguccauguguucucacuguucaauucccaccuaugagugagaacaugugguguuugguuuuuuguccuugcgauaguuugcugagaaugaugguuuccagcuucauccaugucccuacaaaggacaugaacucauccuuuuuuauggcugcauaguauuccaugguguauaugugccacauuuucuuaauccagucuaacauuguuggacauuuggguugguuccaagucuuugcuauugugaauagugccgcaauaaacauaggugugcaugcgucuuuauagcagcuuguuuuauaauccuuuggguauauacccaguaauaggauggcugggucaaaugguauuucuaguucuagaugccugaggaaucgccacacugacuuccacagugguugaacuaguuuacagucucaccaacaguguaaaaguguuccuauuucuccacaugcucuccagcaccuguuguuucuugacuuuuuaaugauugccauucuaacuggugugagaugguaucucauugugguuuugauuugcauuucucugauggccagugaugaugagcauuuuuucaugugucuguuggcugcauaaaugucuucuuuugagaagugucuguucauauccuucgcccacuuuuugaugggguuguuuguuuuuuucuuguaaauuuguuugaguucauuguagauucuggauauuagcccuuugucagaugaguagauugcaaaaauuuucucccauucuguaaguugccuguucacucuaaugguaguuucuuuugcugugcagaagcucuuuaguuuaauuagaucccauuugucaauuuuggcuuuuguugccauugcuuuugguauuuuagacaugaaauccuugcccaugccuauguccugaaugguauugccuagguuuucuucuaggguuuuuaugguuuuaggucuaacguuuaagucuuuaauccaucuugaauuaauuuuuguauaagguguaaggaagggauccaguuucagcuuucuacauauggcuagccaguuuucccagcaccauuuauuaaauagggaauccuuuccccauuucuugauuuugucagguuugucaaaguucaaauaguuguagauaugcggcacuauuucugagggcucuguuccguuccauuggucuauaucucuguuuugguaccaguaccaugcuguuuugguuacuguagccuuguaguauaguuugaagucagguaccgugaugccuccagcuuuguucuuuuggguuaggauuggcuuggcaaugcaggcucuuuuuugguuccauaugaacuuuaaaguaguuuuuuccaauucugugaggaaagucauugguagcuugauagggauggcauugaaucuguaaauuaccuugggcaguauggccauuuucacgauacugauucuuccuacccaugagcauggaauguucuuccauuuguuuguauccucuuuuauuuccuugagcagugguuuguaguucuccuugaagagguccuucacaucccuuguaaguuggauuccuaaguauuuuauucucuuugaagcaauugugaaugggaguucacucaugauuuggcucucuaucauucauuuuuauguuuagucugucccagguuuuuccagcgggagccucuuuaagcuggcuucuguguccuuuugacauguucauaucauucuuuggguacuucuuuccuuucuggaaaacaaggcuuaucuuuacuuucugucccuuaguuguggaaucagccacuuuugcaaggggcccucuuuccucuuaguagaaaauagcuuuuagaaggaaaguuuucugcuccuuuuuauugagguguuguugcucucaggaccuguuagugaacauaugccugcacauauacgguacauaaauacauuuacagcuauauuuaugucuauauccauuuauauugaaaaccauagcuccaguucuuaucuaccauuuuagguuucauucuaauuuucuuccuuuauauaucucaaacagugagacauuguaauaauggcucccauuauccuuaauauguuuauucaucucccagguguguccuccuuauccuauuucugccgcaacauacuuuucagcuuguucuccugcauggaaacccuacuuagcucuuuugggucugggaccuuucucuugggcucugacacccuaugccaggcagccuucuugaguagaugcucuuuucucucugcucaggcucucauuccucucagucucugaaaccuuaaucugguugcuucuccugugccgccuccugccccuacuggccauggauguucuucuccuuccacucaggcuccagcauccugugccuaacuucuccccuacaaguguaugcuccucaucucacucugguuuugacacccuuaggugcugccacuacuccacaagcuuguccgucaugccauuggauacuuaauuuauucauaucaggcucugacauccagcucuaggccgcugagacuucuguuucucucuuccccaugugcagacgcaugcuuuacucugcuucaccuugcaacucuuagauugaacuguucaggaaggguagaggaagaggaaacaaccaguuuguauuuuguuccaccguuugcuccaugaagauuuugcaauagauuaccauaagucuccagucucucacuauuaaggaauuggugauauacuacuucauguggcugagcauacaacauuuuuguuuggauucugugucuaguguugccuuacuuucuuuauaccagaauaucuacuucuuacuuuaggggcuuuuuaaaucuuagccuuuauuucuguacuugcuuaaaauauguucuuuuaaauauugagccuuuaucuguugauuucucuuaaaggcuuugcauuaaucuaauauuugggaaauauugauugaaacuuguuugauacuguaggguuucugucuuuacagccuaaacaaccucuucccacauucuuuuucacuaugguuuguuacugugguaggucaugauuauuuuagaugagguauuuuugguggauagguccuuuccccuugaauuugauuagaaacagauuuccuuuuuauguggagacuugaaugcugggacacaucucucaugaaacuuccagagucuuuuccuccuuagugaugugcuggcuagcaaucuguagaaugguaaaaauaaguaugaaauugauacauauguuauuuuaugauauguaaaccauuauguaauaugugaauauuugguuuuagauuuuuuaagauaguuuuuuucaaaguauuugcuuccuuuuuaaaguuaaaaaaaaaacuuaagagggaagaaagagaaagcucauguuauaaaguuagccgucaaauuuuaaggugcugacagggauuuuucaaagcuuugaaaaauacgagaacauuuuuuacucaguuucuacacuguaggaaaaaaaaggauuauuguaaacugaaaacauuuucuuaaucuucucuagcuccugcguuuagguuuucauaucacuguuaauaauaaaccuucuguuauugagcucuguauuauuuucuuaagagauguuuaauuugccucuguaaauuauaagauuucaacaguguagaaauaugaaacauaauguguuguagauugugucuggcaauguuaucucauucaauuuuuauuuauuuauuuauuuuagaaggggucucccucucucaacugggcuggagugcaguagcaugaucauagcucaccguaaccuugaacuccuaggcucaagcaauccuccugcccccaugcccugaguagcuaggacuacaggugcacaccaccaugccuggcuaguuuuuuauuuuuauuuuuuuggcagagauggggucucacuguguugcccaggcuggauuccaacuucuggccucaagaguucuuccuaccuuugccucccaaagcacugggauuauagguucuuggccucauccaauuuuuaaacuuguuuugugauguccaaagauaagaguuguggugaauaaacagaaaacagguuuagaaaguuaagucagauguaccaaauuucaauuagaaaguuaucuuuccuuauucuuuacugcagaaaaaauuugcuguuuuuguaguuaucuguaaaaaucuccucugcuguuuagucuuaaaguaguauuaacuguguaggucucuuugugauuaagucuagcuuuuuuuuugcucuuucugguuuauuaugagauaguuuuguuaucgguagguuggguuagucauauguuacuaugguauuaugaaggaauauuuucuuguuucuuggaucauaaaauaugaacuuuguuccuuuuuucuuauuguugguacaucucaauauucauauucauccuacugugugugcauauauacauauacacacauaucuauauacauacauauguauaugcacacauauguguaugcauacaaauauuugucagaaguugggucacaguucuacagugaauuuuucuuuauccuaaguaucugauagcaggaggucucuuuacuguucagacuaccuagagugaaucugaacuaggaagauuguuuccccauggaauaauggagaauacauagaggugauggaggguaagagggauuuaucuagcuuaauaugauaauauuaagugguggcuuugggacaagucuggaugaauuuguuuaauguagauggcuaguauuucugauuguugagauguuuuugauuaaagaauaaucacgcugggcgcgguggcucacgcauguaaucccagcacuuugggaggucgaggcaggcggaucaccugaugucaggaguucaagaccagccugaccaacauggagaaaccccaucucuacuaaaaauacaaaauuagccaggcguggugacgcaugccuguaaucccagcuacgagguaggcugaggcaggagaaucgcuugaaacugggagguggagguugccugagccgagaucaugccauugcacuccagccugggcaacaacagcaaaacuccuucucaaaaaaaaaaaaaaaaaaaaaaagaauaaucacauuccuguuauuuugagccagaguauaguaauugaaccuuaguuagugcuuacauuuagaauggugaaaucaggacauuacaaguaugauccauucucuuacauuuuaguagaaaugugggcauuuuuguuguauuuuugcauucucaucauugaaggaaacagaaaggugauuuaaucaacuucguuuauuaaauucacccuuuuuuucccuuaaugauuucuguugcaauuuuauaaaucucugauucuaaauuuaaccuuugaaaucuuuuaggccuuuagauguuguucuggaaaaacuuuaguaauggaucaaaggaagaaugagaguauuguuccuaguauaacucaauuagaagauuuucuuacagaacacaauuccaauguuguuuggcuccuuguugguaaguggaauauuuuucuucuauuuuauuguguuuuaaguauggauuaacagcugccagauuuuaaacagugguugacugaaguuggaacacuaacacuaccauuuauuuauuuuuaggaaggaagauuguuauuuauauuucuugaacauuuguucuggaaacugcucugaaaugcucuacuuuuucuuaggcugcauucucaucugacuuaggggaaguggaaagagaagaagaacacugcacuuagcuuaucuuucugguuucaggucaccuccccaacuucucgacucaacacacacccaaacacuuuuguuuuguuacagaaauaauaaauccucaaauauaauuuuacuguaaaaauaauucuauuuuuauaguaaaauagaauuauaugccuaaucuuuuaaucucuuuccucauuccuugugcacuuggcagugagaucugcuauuaauaauuuuuugguauaaucuagaaguuuucuagguauauagaaauagcuuaaacuaaauagcagagggagaaaggaaauaugagugaaugaaugagugaauaugaaugaaugagagggagaaauacaaaaauaauacagggaagggagaaauuauuguagguuguuucugcucuggaaguuuucaugggagaaugguauuugacuuuaauuuuggcauaagaauuggaaacagaggaaaugaggaagggaaagagaggaaacaaaggguaaugauaauauguuaagcaucuucugugugcuagaugccagguuguacauauguugucucacuuaaugcucagaguagcuuuaugaagguagguuuuuauucuuuuccuuuuaauucccuguuggggaauugaggcccauaaagauuaaguaauuuauauggguuacacagguuuuuuuuuuuuuuuuuuucugaggggaugcuuaugcuucuuucaugacacccaaggauguggguaggaauauaaguagagaugaagugucuguucccuuuccuaucaccuagaauuuuucagacuuuuuccuguuauaaacaccuccuuucuuuaagaaaaaaacaacaauaacaagcagaaaaacauugagcaauuguuuaaucccucuguuuuacuaugagcauaggggggcgugauauaaugaaaagacuacgauuccuggcuuguuuaauauugaaagcauauuuucucagcaaaugccuguugccauucugaaggacucauauaacaaccuacuguugacacagugauuuauaguaaaaauuuauacaaaaugacuuuaaacuugagauauaauggcauaucaucaaaauaacuuuacaaaauauuuuuucuagaauuuuuuuuuuuaaaauggcaaaucauagcacuugcuaugucaaagcuauuaccaucaaucuaagcugcccugggaauuguauuuuauguugacucucagugauuguuuugcuuuauccauaauacauaauuguuuaaaaguuaaggacuuaauaugauguuacuaaaggguuauacagguuaaguugcuuuucuauaacuuucucauaauuuagaaguaauacuuuugaaaaggauaaguaagagcaaauugauuaucaaaacaauguuuuccuguuuugccuuuuguauauucaugaacuagauuuuuugagaauaugaauuuuauaaguaaccauauacuuucauuaaaaaaauaaauuuagaauaucauuuacuguagcauauucaaugacaucauaacuuauugucuuacccaucacagcaaaauaucuaguuacagguggccuauuugauaugccuuuauacuaaauuccgacuucuuuuacuuaaagcacagcuuuaaaaagcagaagguuuuucuuuaaagcagagauuuuaaaaaucauuacuuuucuuccuuuacaaguggcuauagcuuguuucaggaaauaacuugggaaugaacuuguguauagaugaguuuuuggccuaauaaaggugaauuuguuucagaauauucagaaauauggccuuucuucucccaggccauauuuuuuacauaauguuuauuaacuaaaacaguacaaagcagugauaaaguaaacagaaaugaaagcaggcauacuugaaacauugcucuaauggaucugaucggaauuuaugcuuuucuggauuaugaaugaagaagaggaagaaagcuggauaaaguauaaucaaccucugguuuuaaaauuccaaguauuaaauuguaagaggacacauuacuguguagaaguaaauccuauuauuucugauuuuuuuccucccaacagcuaccauuuuguccuguggauggauuauuuaccucacauauuauaauucccggaauguuggucuuauuuuaacacuaguucuuaacagauuauacaagcauggcuauauccauauuggugaguuugaguuaacacugaauuuuuuucuuccuuauaaucuugagauguugucuuaccauuuuuuguugcuauaacugaaugccugagacuaggucauuuauaaagagaagcaauuuaugucugauaguucuggaggcugggaagucccaaguugagggggugcaucugguaaggaccuuuuuaccaguggggacucugcagagucuugagguggcacagggugucacauggugagggggcugagcuugcuugcucaggucucuuuuuccucuuguaaagccacugaugucccaacaucauggccucauuuaauccugaguacuucccaaaugucucacaucucaaauacuguagucagauuucccacccuucuaacacuguuaaaaugagaauuaaguuucaacgugaguuuuagagggaacaaacauucaaaccauagcagauguauauuauaaauuuauauuucaugaacagauaguagcauuagaaauuuaccuuuguuucaugauaguuaagauaaucuaacuggaauuucucucacacagcacuccauuacuucaugauaauauccgcuugguuauguccuuuaccccauuauuuauuacuucuuuaaguguuucuguaguaacuuuuugacuuuuuuuuaacuuauaaaagaugcucauuaaaagaguuugaaaaacuuggauauguauuaaauguggaaauagaaauuucuugugaguccaccauucaaagaaaguuuuucauguucaauguaguuuugguuauuuuuaaaguaacccauacuuuaaaaauauguaaguuagaaucaucuuguauguuucauuuuauggccugcuuuauuaauuaaauuuuugacuacuuaaaaguaggaaauuugcagguaaauaggaggguguauuaggaagcuaugugcuuugaaagcccuaaaccagugggagaaagggauggggagagaugacuggagagaaccauucuaaccugccuuauaauugaguaccuuuuagucgacauaaaacuucuuucaaacauaaaucgucuuccauuaauuugaggcaauggcugguuccugcagucacucaagauucuaaagaaaaauggugaauuagucacuacuuuggguuuauuuaauggcagugcauaauuaagggaauuauccauacaaagcaguuacuuaaacuaauauccucuucagguuauuuaguagcuuacuucauagugaucauauguauggcacuuuuuguuuuauuggggaaagaaugauggaaaaucaguaaggcuguaaggguaucaggaagagagugagaagagaugcuuauugaauaaauuuagugcuaauguuauuuuaaacuuuaagggcccuacugucuguuaaaacaguuacauuaacugcuguuuuuuccuuccuauaacagguuccuucucuuucucuguucuuucuggaaaagucaugguucgugaaaucuauuacauuacagaagacaugucuauuagguaacaaaauuaaaaaauugaaaaggacccauguuaaacauacuuuaaaaauauuguuaaaauguuuuaugauauuuuauugaaugugacuugcuucuucaaauaaaacuaaaucaaauuuuuuuuuccaguaaaucauacuugaugaauugauguuuuaaaauauuuugucaguggauuaauuuagcagaauauaaaaauagcuguuuauagaaaugaauaaucuuucauuucuagaugagaaagugaaccuuuaaauugccugaccauuuuauaucacagaguucauaguagucauucguuauauacagcaagguuuagagauguuggucugucauccauuagcuccuuauuagagauaauaaguuuauagaauuguuuagcauuuguuagaaacucuuaauuuuauucaaagaaggaaacacaaauaugaauauaauaaggauaugauugaaauguuccuucuucuguaagucuugaaagaaaagccuacucaauuuuugugauuuucuucaaauuugugacuuagguagaauucaaaaguuuugaauuaauugagaggugcuagaguuuggcagugcucacaccucacuuaaaacuagaggagacaacuucuauacuagucuaaaauuauuucccaaucaaaagugaaaaauaaaaagcucagagacuguaaguucauccuuuuggggcaugagaugauagguuauuuaugagaaaugaaggaacauccuuaaaaguuucucuuuugugugcuaacaucccucuuucaagauuuggcuuauuguuacauaauuuuuuucccucucuccuguagaacuagguaucuguaauuuuuuauuuuaaaaaauaucauuuaaaaaggaaaacauuucuguuagcgcuucauuuuccugugaccauuaauuagaagaauaugauauuucaaaacauguuguauaugauaaauauaugcaauuuuuaugcaucaagaaucuuuagcuaugcaaagucucuuccuuuuuuaacuagaagaucaugaaacauacuucauaagucuuuguucacgaaaagauguguguuuauguaugccaauguucuuuugaggauuuccuguauuuccuuguucauuaucaauuggcuuccuuuuggaauaacuaagaaaugaguuaaguaaauuguuacuuaaauucuaauuuuguaauuucccuuucuuaggauucaagauggauucaucauuuuucggugguggaaaauguauaacccaaaacagaagcaacauggugaguuuucauuuuuuauguguuuaaaauguucaaucauauaaucaggauuuuaugaaaacuaauuaaaauuagauaugaccaguuagaaaaguuuaauuuuuaggccagucacgguggcuuaugucuguaaucccagcacuuugggaggcugaggcagguggaucaccugaggucaggaauuugagaccagccuggccagcaugaugaaacccugucucuacuaaaaauacaaaaaauuagcugggcgugguggugggcaccuguaaucccagcuauucaggaggcugaggcaggagaauugcuugaacccaggaggcggagguugcagugagccaagaucgugccacugcacuccagccugggcaacagagcgauacucugucucaaaaaaaaaagaaaaagaaaaguuuaauuuuuaaaaaugagugaagagaauuauuauuaacuuuuguagcauuagcugugauuuaaaugagagguauauacucuucaguaaggcaucacauuuuaccaaaauuaauaauuugaauuguuuguaaaaauauauauaaaauagaaaauauuccaaacaaagguaaauuuuaaaccaacaaauuaaaaguacacuaccacucauguuuuaaaaaugaacuaaggaaaaugaaucagcaacauucacuuucacuucauaguaucuuucauauaguaauauuuuuaugaguaauuuacuuguuaaacaauuuuucagguaaauucuuuugcuucuacuccaguguagguuuuuucuauuaugacuucuuaggauaauugauaaaaaaaaaugauaaaggcccaauccuucaaaaaacaaauauuuagaagauguaauuuuccuaauauuuugccguaguucuuuggccuguguucccuccuguuuccucagauuuaucacaugacuaacagcuaaaauaaucucuaaacuguuauaucaagcacuucaucaccuuuacuugcuguaguuuaaaucuuaaacagacucuaggaaacacacugguguuuuaauauguaugaaguauucugagauuugauaguaauaaacccaguuuuaaacacauuaaacucugucauucacuagcguuaaaccuuuccucagucaucauccuugauuucuccucagaccacuagggucaaauaucuagcagccuacucagcgucuccaauuuuauguguaacagguuucuuacacuugaaauauucaaccaaacaccugaucuucccacccaaaccuaccccacgguauuuuccaucuuaucaacagcaagucuaucuuuucuauugcucaggccaaaaaucuugacugcugucuuuugugucccagaggucaucaucaaaucuugucagcuuuccuuucauccuacauccagaauccaacuacuucuccccacacuggcccaagucgccaucaucuuccaccuguuuuaucacauagucucuuaacuagucucccugcuucugugcacuuguuccucaaccugcucuuaauacacuggccagaucuuuuaaaaauguaagaucauuuuauuccucucucuucccagauuuucccguggcuucccaucucacucagaacaacaccaaggucuuguaagugaccuauagaauccuacgaacuuucuauaaauagcuuauaaaauccuauauuauaucccuauaaauauucuauaaaauuccuucuaccuccugaucaucuuaccuuccaccccacuccagauaaacuggccuguuaguguuggugaugaaacugcagcagagccaccaugaaauguuggccucuggauauucacaguauucauucccuuauuugcuuggugguucugguuaacuauccucuaucaaugaagcuuuuccugaauacuuuuguaaagcagcacccucccccacaaacuagcacucuuuguuccacuaaccuugcuuuuauuuucuucaaugcuguauuuuucucaugcauuccuugaugcuguauauauauuuauacuugcuuauuaguggaaucuaccuaacuugaaugaagcaaacucuguaaauggugggacuuguuuuguucuguacuguauacuuggugucuagaaaaaugcuuaguacauagaagaacucauuuguauaaaagaguaacagaguaucuuucuccuagucauacuucuaaguaaaacaaaacauugagaaacaucuuauagaaugcuugaaaaucuaacauguggaggcauaauaaaccuaaaauaugauauguuucuauucccagauagaccuauaccaguagaaauuaauucuuaugagauucuucaagguuauaaacaacucaaucaaaauuuaccaggaaacucuuuuaaauuguuuguuuucaaauuuacauaagcaauaguuuacuaaugauaccugcauacaaauguccugauuauuaggcauacacuuuaaaggccaguuggugagcugcagaagcagcaaugagggaaauuaagagccuggaccugccccuaauuggaucagcagugaugcauaaacaaacggugacuguauaaaaaugaaaacaggauuacucucaaauccgucucuaacuugcugggcauguacgacagauucucuccuuucaauauaacagcuaugauaagauauggcuucauuaauuggagacgccaaggcauaaagagaaagguauuaauuucugaauguacguugacaacacugauaaacacuaaauacugaauacuaaaauauuguaagauccuccucaacauuccuuauccuguuuuucagcuuuuauuccauuauuaucucauuuauuauuuuauuauuuauuuucaccucugcagccagaaugcacccuucugcauuagugcauaauuuuuccuauguucacugccauaucucuggugccuaaaacagugacuaguacauagaagauguugaauaaauaauuguuaaauuauuaaauaaaaauaauaaauagguuuaaaaauuuuaagguugaacaaaaugcguaaaucacucuuuuccuuccaaaaaucaccuuagaaaaguauugaacaaauagcaagucuguaagcauuuaaaaagcaccuuuugaggcaaggcauguuggcucaugccuguaaucgcagugcuuugggaggcugaggugggaggauugcuugagccaggaguuugagaccagcuuauacaacauuagcaagaccaugucucuauaaaaauuuuaaaaaaugagcugggugugcugguauaugccaguaggcuuagcuacuuggccugaggugggaacaugccucaggcugaguuacaguaagcuaugauuacaccacugcacuccagccuggguggcagaggaagaccuuuucucuaaaaaauaaauaaauaaauaaauaaauagauaaaugcacugcuuggucucauauuuuaaaagagaaacauuuagcucaguucacaucccaccuuuauuuguucucuuguuucuauuuaguucaccugcauuaauaauauuccagccaaagaccuguaugauuaaacaguaaaccagaucuccaagcgugggcugaucuccaugcuuacauggucuguauuuucuucaaggcuucuguccaggaucuuuuuuguuaauauuccuagccuucuaccauccucaggaguauuuuauguggcaacacuccuuucauccuccguaccuguaccccaguauuacacacuuagauacaaagagacagguugccuaaaagcacacccauagaacagaaacacagggaaaaggacacauacagagaggcauauauaugcauacagaaaugggcgugcacauauagguacacuuauguacagagaaacauuuucaaagaugagcacauacaugcacacacacucacacagccacacauugcaugcccacacaagugcuaguacacucacuguaucccccucacagagauaaauacacagaggcuacaugcaaaguauccucccugccccccacauacagacagggguaccauuccagaucaauggaggcauauccccagcagugagcauguccccucauaaacaaguaucccuccaaaagacaggcacuucuuccaaaggcauccaucucucauauacacgugcauguacacacacacacacacacauacacacacacacacacacacacacacacggcuucuuuaaaaaaaccuaauauguugagaauggcugcauuggauucuucaggaacuggacaaaggagguaaauaaauaguagaaagaauauaggaugugaucccuguaacgucauuuacuaauauugugacuuaaggcaagaauuuuaaccacucugagccucauuuuuuucaucuauaaaaugagaacaccucuacuuaccuguaggauugcuguacaaaauaaauacuaguuuuuuucucuuugaaggucaaauucuuacuagucauguaaauuauauauuuguuuucaaguuauucuuuuaagauaaucuuucagaaugugauauaauguucagaauaaugauaaaggcagcucagcucuauugcacucuugcuguguuccagguacuguucuaggcacucuaugcacauaauuuuauuuaauccucacaacaacucuagugauuggagcccaagauuacacaaccagcaagaaguagauuggaacccagauacuaaacucuucacaaaacaaaaguaaaaguaaaugcauuuuguagaacugcuuaagucuucugaacaaacagcuaauugagacuccuuguuuuccaaagagaaauuagaaaaaagauacguauuuaauuauguaauugggacacaugcuauuuguaguaaaaaaggcaaggugcagaagugcugccaaggcauuacaauucugagaaucaauacaaagacaaaacagucuacugaccuuuuaaaaacugcucaggguuuucuauuuauguaauuuauuuaacaaacaagguuuagauguaaccaguuuuaaauuacacuaauagauuauaguaggcuaaaaccucuaaguaauaaaauaacagaaagggacauacuuuaccaucauucuuucacuucuugguauaagaauuucuugugguuaagaagaaagcaugacuauuuauucagauccauauucauuuaaacauuaugauauaucauugccuguuaagaggcaacuggucuuacaguuuauuuuccaaaagacagucuuuauccuaaaaacaaaauaaagauuuuugacagauauaauuggucuuuagcugacaaucaucuauaaagcagaucacuaauuuuauaaccuagggaguauuuacaaacauucuaugauaaacaaauuagaugcguucuuuuuuuuuaaaagagcuauacuggacaacugacagaucuaaaugugcuccuggcgcagaauuugggcacuugaacacuccucuuuuuuccugauagagcaauucaaaaacuuaguaauaaaaaucuugguccuaccuacagacagacuuugguccaucuccuuggaaggcugaaugcacaucugucuauucaggcauaugccccaauuaggcuucuaauuuuuccaccaagaaacaucaacuuccuucuugguuaacugccaagcauauggaucugcccuuaaucagagagagaaauacugauuauaaggucuuguuagugaacauaaucuguuuuuauauuauauauaaugauuguauaagcugcuaaucuuguuagacuuuuaucaaaagcuucauuugcagccuauucauuccucuaucuaguauagucuaaauucugucccugaguaaugguagaccgauaauguacucaaaccaaauuauuuauuccugcauuacuauuugacaucaugucuuuacuuuugaaggacauugaguauguuguuaagaaugucauccuccauacuagagaauuuccuuuaaaaaagcacagggaagaaaaacuuaauugacucuucaccaauguugugcuccucuugaugagaauuaaaugucauauuguagguaaaaguaugagcaaauuauuaguaauugcaaaaguaauaauugauaacaucuaccaaccucuaacaucgcuauaaaauagagguguggaaucuuuuuuucuauugaaaaucauuggcacacaaaaaauuuaaaaaagaacacuuaagccaaaaacaauuuaaauauucuuaaauguuaagaagaauacagaauauccaaaaauuauaauauuucuauucuagauuauggacaauuacagagagcauacagagagacagcaauaugcuaauauuaaaagagugacaaaaagaauucaagacauugacagaaauuaugggggaaagccagucaagggaaggccaguauuuaagcuauuucuguuaaccugagguguaugaaucugaaguagugacuacauuuugcuauguccuuucaaagaagcugaguuuauggcacuccccugcccuccccugaguuuauugacugugccugccagguguucaggguccuccauacacaguuuccaaaucauccccuauuaccccauuaccuuaaauuuaccaccaccaaauugaauuucuaaacacacacauuuucuaaccucagugccauuggucuaaucaguuauuccaucugagcuccccuccgcuccacaucugucugacauaauccuacucacucaucaucaugcaugcuccuugaggaauaaggcauucacaggagcccuccaucuaccauucugcuuccugacaaaugggcagaacuuuauugucaaaccaugacccuguugggaccauacgaaauguucuguaucaaaguuagaaguucucaguauuuuuccuccauucacauucacugcucccuuucuccuuuaauuguaauuguuuauaugcaucugcucuaccaaaucgauucaaguagcacucauuucccucuuucuuuuuuuaaaucccucucccagcuuaacacaaugauuaauaaagugaaugccaaauaaauaccuguuaaagauuuuuaucaaaaaccaccucuuucuugaaagacacuugggucacuuauucuugacuucauacguguauucuggugaggagcaauucauuuuaaugagauguaauauuucaugaucaaaugaaguaacuacuuuucucaaaaagaaaaaaagcuggguugguugcaguagcucacacugguaaucccagcacuuuggaaggccuaagugggaggauugcuugagcccagaaguuugagaccaaccuggauaacauagugaaacccuguuucuacaaaaaauacaaaaauuagccagacauggugacacgugccuggggucccagcuacuugggaggcugaggugggaggaucacuugagccauggagauugaggcugcagugagccaugguugcaccacugcaugccacacugggggacagagcgagacccugucucaaaaaaaaaaaaaaaagcuuaaacaauuuaagauuuacauucugcacucuagaaauucuagaaucagagaauuucuaaaaucagaaaauucuaaaguggucagugucauuaggcuuauagcuuuaaacugucacuugccucuggauacugcagauguccauccuuuccacaagcugcaaucaauauuuaugauaagaauuuccaaggacuuauuugggccccaguuaacaaggcuguuuuauaauacaaggagcacuggacuagaauuuagcagaccuagguuuuugcuuugacucuacaaguuacaaucacaggaauuucuuucuuaaucagcaaaaugagagguuuuuaaaguauuaguuauuuccaaguugaugagggguuuugagaagaucaauuuuuuccaaguuuuguucuuuggaacaaaauucuaggguuaauagcaugggauauuaguucaaauggaccuucuucucuacuuuccaaccucacugucccccuacagcuuuauuuauucacacaaauauccuaaauacugaaaauaauugagauuaaaagaucuaguguaaauauccacaaagagguacauuuuuuuuuucaaaaucauaaaccagcuauguaaacaaaaaauuuuguuucagcuccacuguaaucuuguuaacaauauggcuuauguuaacuaaauauuuuuuuaaaaaagaaaaguuuagucaaaagagcaaaucaucuaacaaauagacugcaagauuaauagaagcaugacauguaggggaaaauaugcaccuaaaguaaaucucucuaaggaacaaacuagauagacuuuauaaaugaaaucaaaggcagaaauauugggccugcucaaaguuaagugaaugugucaaaagccaagacugaaaagaacguggcucuuaggaauaaguuuagccaucucugcaguguaaguaagauaucuucacuuaaaugccaccuaaaauuauuuuuuagauaguugauagcaguugcuaagaaaaaaaguuuguagggcugggugugguggcucacuccuguaaucccagcacuuuggaaggcugaggcgggcagaucaccugaggucaggagcucgagaccagccuggacaacauggugaaaccgcuucucuacuaaaaauacaaaaauuagccaggcaugauggcgggugucuguaaucccaucucacugggaggcugaggugggagaauugcuggaacuugggaggugccagguugcagugagcugagauugugccauugcacuccagccugggcaacagagggagacuccgucucaaaaaaaaaccaaaaaacaaaaaacauucauagcaguugcuaagaaaaaaagguaaaaaugcugguuuaacaacugguacuauacagucacagucuagagacucauuagcauacugccuuucuaagccacacaugagaaacugcaaaaugcccauuucauacucucucagaauauuguaugacaaaacuuagccuuuguucaaacuuaucuaaugaacagcugcucuagcuguuggaauacuuuuuccagacaugaaaucugccccuaauauucugauuucauuauuccuacagaugccaaauacuagcccauuuacgccagucuucaucagggaagaguauaucauauaguauagaagaggggaaaagcuauguggggcaagagaaugauagcaaaacgauagaagacuaaauacuagugaaguaauagugaaaucuaaaguaauuuuggcuggcucagacuuguaaguuuaaaucuauauuccuguaggaaugaaguuauaaauuacaguagauuacuaggugaaaagaaaggauuuuucaaccaagugaugauaaaaucagaguuuuguaaacuccauaguuuucuaaaacaucuguuauaaaguggaaaacauuuaaauauccguaaauguuugaauuuguucaauagagauaaaaauggauagagguuauaaaaaagaggucucagaaaacaugguaguucuuucauuugguaacaaaagaaagcauugauugugguaccuuucuucuguggcucucuuugguugacaugugaugcauuguuuuagauuauuuccuuaguagaaacaagugccucauccaucacuuuaaauggauucauuaauuacuauugcuauuucuacuuaauguaauuaugucuuuuauuugagaagauugaaguccacaguucauaaaaccuauguuuuaguguuguguauguuuauggaaauaaguauuuaugaaaaauuguaguuucugugaugcaaaaguucaaauaccaauaugauaguuaaauaaagcaucauacuuuaaacauuuuacugcauauauuuugguauaaaaauauggauauauuaggguaaagguguacuuuuacucuuuaagugguacuuuacuguucuuagcauaaaaaucuuuaaauuuuuucaguauauaacuggaaucuagaaauuaaaguuguuuuuagaaugcuaaauuaaaauauaacagaaacaucaaguuuuuucuuuuuuuggccaguguuuuguauuuauuuuauuaauaugcuucucuguaucauggaauucuauuuuaaaauaaauugaauuacuuuggguguauaaaaauguuugaguaaaaacuuugaaguucuuaaaaaguugacuaaaaauuuuuuuguaauuggugucuuuagauccaaaggcagaaaccagguuauacaucacagucaaugacuuugaauuucaugucuauaaucgcucggaucuuuauggacgccuucaagaguuguuugguuuggagccaacaauaauuccaccuaagaaagaugaugauaaaacacgggaaauuggaagaacaagaacccaaucgaaaauugaaagguucaguaucauacuugaauuuuauuaaacucuagcauuuaaacauuugccuuuauuagaauaucauugaggcuaugcaccuaaacagagccuaauauuucuuugcaaauuaacugaaacuuuuaguaacauaaauaauuauauaauuauuuuagaaauugagauaauauagaauauguaaucuaaaaaagucccguucuauucccuugcacacaaauccuacuuuucuccguauuaauaacuaauguuaucaauuuaguuuuuauccuuuugaauguauguacauaaauguauacauacauauuuaaggugcuuauaaaauacaugauuuuguucuguguguuucuaaacauauguguuuagaauaugugccucauauaguguguauuguucuguaauuugcuuuuuauguagcaguuugucuguaagauuguuccauaucuguauauguaggucugcuuuuaaaaauacauaucuguguauguaggucuaccuacaaaauuauucuggaacaggaucagcaaacuuagaccuauacuauagcacaagucuagcccacugccuguuuuguauauagaguuuuauugggacauagccacaccuauuuauuuauauauuaucuaucuguuuagugaauugcugugaaauuuugauuucuuaacauuuguguacuuuguauauggccaguuuucuuacucuuggcuuaucauuuucauuucauuaagggaaaauuaauuuggcacaaggcauuugggugagggaaggaagaggagcaacuggauuguuuucagaagugcuuaaaacaguagacaaacaucaaagugacuuguaccuuaaucauuuauguuuaauaauaacuuuggcugucuuauaaaaugucguauaguaacauaaugggcaaaaugguagauguaaugacagcauaucaucccuuauaguuuugucauuaaagcuuguuauucuaaaaacauaguuuuguuauaauagcuuauccaucuaaaaguugauaugauaagagugcuccaguagacagcuguaggaauauuaguauuccuucagaugaucauuguucuguuuacugaaguagucacuagauguauuuggaaagguaaacugaaacugugagguaugguauugugaggaagugaacuauguccucagguauuuaagguuuucuuauucaugucaguuuuauuuuuucuuguuagaguuaaaguaaaaacagaaucccaagaccccacaucuucauggagaucacuuauuccagucauaaaggucaaugugagcacaguaaguaaauucugcuacaauuacuguuucaugggguaguaauguagaacuuuuaauuuuugcaaauaugauuuuaauguaagaaaauuaaauaguuuuguggaguuuuuuuuaguucccauuucuguauagugugagugaaauaauuauuuuaaaauacuguuuucugauaaauuuguguuuaaauuucuuuaaguacuuaaauuuucuuuuaacuacugguuuaaauugaccaguggaauaguuuaaauagcacauaguccuaaaguggaaucauuaagcuguuguuugaaaauguuuguuauuaguuuagcuaaagaaagaaauauggccagaauagcaugauauaauaucucuuaucuguuuauuuuuuuuuuuuuagggacguuuggccuuuggaaaucacuaccagccgcaaacucugugcaucaacuuugaugaugcuuucuuaacuuauacuacaaaaccaccuucaagucaucuugaccaauucaugcauauugugaaaggaaagcuugaaaauguucgagucaugcuuguuccuaguccaagauauguuggucuucaaaaugaugaguaagaaaaucuuauaaaaauaauaaaaaacuucuuauagguaauacagauacagcuagaaacuuuaacauccuuuuacuuuuuuugcuacaaguuguacaaaaauuagguauauuucucuauuaaagcaguuaacaauguaguccuucuuuauaggauaaauggauaugcuauccagugauaaacucuaauuuuaaauauuuuucugcaugauuauaacuauaauuuuuuuauccuuuucuccuucuaauuguauuuuggaaacuuacuuugugcaauuaguuccuguuuguauguuaggagauacacauuacagguagguuuuuguuucuagaagaugugacuaaagaguaaauugaacagauucauugcaguggaauaccacuuugaguuauugaaagucgaaaauugaaucgaaauuacucuuggaaaauuuggugaaguuaagaugguauaguuuugagacccacuugacauuucuuuaaguuccaaacugucaguuuuccaucuagcuuuccauuuuuuuuuuuuuccuucagugaaguagcugcuuguauuuauaagacucauuauaggaaugauguacacuagacucagugugaugggaugcugagugggagaugggcucuugugauuuuuauguuuuuucucaauuuuuguguguguaaaggauacucugguugaauuuaaguguucauauggagaguuuucaguacagugucucagcuuuuaucuuuguguguagguaccuuaugagguuuuaugugaaacaugauuauuccuuuuuaguuguaacucuuggcuggccugguauucgauuuuccaggauuuggcuagaaugauagaaagaggguuuuuccuuuuugaguaucgcggugacugugggucuuccuggccucacucuucaagaucauggacuugguuaagaaucuucuggaauguggacugugcacacaaauguguaugagugaagguauaauacugaauaaaucaggauuuuuuugaaaaauuauagagaguaagaugaaaaagugucuugcuauuaauaauuuguauaaaaagauuuaaaauuguauuuuucacuuaaguguggagauuacaugaugauauuaaacauuaagcuuugugauuuaauacauauuuagaaaaaaauugcaaguuuuugcauuuaauaucaucuaaugauugagaaguuaauuuugauaugcaagaagauauugugauguauguaugacaaagagaaaaguuguuuaaucaaagcaagcaaagauuaaugguuucugggaaauuauugaugguagaaaaacguucauuccagaguuagaguucacgauguuugcucuagauuuauuucaaguugauuaaauauucauggaaauagguaauaagaagauaaaaaugauaacuuuuuuauuauuuaauguuuuugaaugauuauaguuuaauauacagauagauaaaaugauacuuauuaguuauuaauauuaaguggucaaauuuuaauuuuguuguaaaugcagaauaugaucauuuuauuccagugaucaucauuccauuguauuuaaacuuuguuuuaaaucgauuucucucauucaaaacugaaaaugaaaaauauaaaacuaaauuuuuucuuuuuaaaaccaaauuuuuuuuucuucuugaaguaauuuacugauaaauuuuuaguaucauuuuauuauuaaguccaacauagaauaaaacauggaacaauuucuuaggaugauuguucauuggaaagauguuuuucuuucuuuucaggaugcuacuuguuaugugcuuguuaguuuuuuuuuccuuuucuuuucaccuauugccagcauuaacuaggauacugaacauuuuauauucuggagauuuguuuaguuugcuuuccccuccaccuucuuauagaccaccgagauuaaugggagaagguuuuguggugaugcagucaaaugauguugacaucuacuacuacauggaugagccagguauuguuguuguuguuguugcuguuuuuuuuaaagugacagagugagacucugucacacaggcuggaaugcaguggcguaaucauaguccacuauacccuugaccuuccaggcucaaacaauccuccuacuucagccuccugaguugcuaagaugacaggaauaugccacuaugccugacuaauuuuuaaaguuuuguagagaugguauuucgcuauauugcccaggcugaucucaaauuccuggccuuaagugauccuccugccucauucucccaaagugcugggauuguagucaugagcccauggugccuggccuguuuuuuuuuaaaaguauguuucauagcuacaauucuauuucuucuaugaaaugcugauaucuaguaauauuuuaaaucuucuugcuuagccaucaggaaaugguaaauguagauaagagugaaaauaucugaaaaauaucugugucauuucucaaaacuugaauauuaguuuaguauuauagauuaaaagagaacauuauuuuuuucaaauucaguuuucauagauaaaccucaaaaauugagaaugcaaaugaucaugagugaaaaccuuuaaaggauguagugauaguuaagguaguucaucuuagcuuagaagcuuaguauauuagauuugagacuuaaaguuugaggauugaaauucaucuaguuagaauucuugacagguggcuuccauuuucuaaaaguaucuaaacauuggguuuuaagcucuuuuuucauacuucugcucuuuuuauaccuuucagaguauaaaaguauuuaaggucaaaguauuuugaaaguaaaacuaagauguuauuugccuuuucaccauguugacauuugugcuaauggugcagagcaaugguggguaaaacuguuguugcuuuaacacuaaucaaggaaaugguuccuaauuauacuaguagucauuguauuuuucaacugccacacauuuacgguaaaacaaaaugucaaaaucacauuaaaauuuccuugauuaagcaauagaaauuauuuauuuugucaaauguugaccuuugauuaaaguguuuuuaauauuuggugugagaaaaugggaaguacacauaaagugcuugugcugcauaccaaaauauucuggugucuugaggaaaagcacuuguaugauuaaguugcaagcugcacuaauugcauuuuuuuuuuucauggagugccaguuuuauuugaaagaguaauuagagacaaacuauaauuugagcuuucuugugaaaauuagaacuuuggaaaauuggagucugcuguuaugagcuugacagcaucccaauaguuaacaucuuuuaugaugagaccaccaaugauauagcaagugugauguuuuuaaauguuuaauaauggaauuggugaauauuuggaaaaaauuugcauuacucagugaacccguauuucccaaugcaugauguuacaaaagucaugcauagauaaauguauucaaagugcaagauagaccaguagauuuuaacauaacaguguaugaaaaguuuagugauauggcuucagauuccacauugcaauuaaccuuuaagaaauuuccauuuguugaauuuugggguaguaucaaagaagaguauuaaaaauuaucugaaaaagcuauuaaaauacuccucccuuuucuaucuacauaucuuuacgaggccagaucuuuuccaaauccuucaguaacagauugaaugccgaaacagcuaugagaauccaccuguuuucuauuaagcuagacauuagagauuugccaaaaaaaccucuuauacuuaucacuaaauuauuuuguuuuagaaaauaguuauucuucauuaaaagugagauuaaaauuucauuuaauuuuauauuacauguuauauuuaauuacauuaaauauuuuaugucaacaugaguuuauuuuuaaaauauuuuuuaaaauugcuaaauuuuaauuuugaacauaguaauucuugauagacauaagacaauaugagaacaaccccuuuuagguucucaauaauuuuuaagaguguaaagguuuccugagaccaaaaaauguuggagcuacugaucuaaggaaacuuuuuaauggccauuuuaaauaacugccuuuauauuguauguucuggaauauaggacuuguuccggaagaaacagaagaaaauauugaaggagaaaugagcagugaggauugcaaauuacaagacuugccuccauguuggggacuggauauaguuugugguaaaggaacagauuuuaauuauggaccaugggccgauaggcagagguacuugaguauguuauauuucuaauaaguuuuuuagauguauuuagauguauauaauuuuaaauaaaagcuagcuuaaaauuuuuauaaacuauuuuauuauggcagaggaagauaucacuaaacauuuugauccaaagaaaaacuugcuuguggcuucuccacaagcaaguucauuccaaagguggagcugaucgauuagacuuaguaucuaauucugauugauuagaauuagauugauuagaaugaggagcauauuuguugguucauuuuuuuuucuuuuggauuuaaucaacaacgauuucuucauugauccccuacuauaugccagauauuguugggacuaugggaauucagaaauaaaagacauauaucuuccaguuuuaguggggaagaaagaaccaaaagacuaauauuaggugcuauaauaaagguaaguaaagggucuucaugaagaacuuagaaaaguacucuacuaguuugcuagggcugccuuaauaaagcaucacagauaauguggcuuaagcaacagaaauguauuuucucacaauucuagagucuaagaguccuccaacaaggugguggcaugauugguuccuucugagggcuaugagagaaggaugugaucuaggccucucuccuugacuuguagauggcuguuguuuuccaguaucuucauguggucuuucccuuguguaccucuguguccagaucauacuauccagucauauuggauuaggacagcauacacuaaugacuucauuuuaacuuaauuacccuucuuaagaccccaucuccaaauauagucacauucugagguacuggggguuaggacuucagcauaugaauuuuagggguuaggacuucaauguaugaauuuuuagguuacuugguauuccuaguauauaguauauaauuuauauuaaagauuaggggagagaagaaggcuguuugguugagguaacguguaaauuaaguuuugaaagauaauugagaguuagccagggaaagaagaggagggugaaucauugaggcaagggaagaguuuuauaaaugcaugaggauaguggagaauuguucuauaguuauagucuauagugguuaagagguauagauuuuauaaugucauuuuauuuuaaaguauuuuuaauuuuuaauauauuaugaacauuuuucuacuucuugaagaauuuuaaacaaagaaggggacauuuaccauuaaauaugagggagcaucuaaguuuuuauguacaaaauuagacauuucuuaaaauuaguuaaauuaguuuaguuuuucuauucaugaacuagcuuuuuugaauagagaaauacaagccaagucguucacuugagcagauauuacggggccauugauagauuagugaaagagugcugauacuaacuugauguauugacuuuuuaaaugcuuuuuuaaaaagugccaucuagcuagcauuauuagaauuauauauuuugucaaguaguauauucuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgcuucggccucucaaagugcugggauuacaggcgugagccacugcgcccggccucaaguaguauauucuaagaaggcugguugagguauaauauaccgaacaguauauucuauuaaucuuguuaucuguaguauauaggaauaccugccucauuaaguagcuaacuaacaauuauaugguaaaugaauaagcucguuauuugaaaauucuugcauuaugcuaaaacaauacuucauuaaguucugcauuaggucauuuguuaaacuugaaaguaagcagagcauaaaauuucacguuagaaagaaaauacuuuucacauuauuggauuuaaauuuuccucuucugguaaaauuuuccuauaagucaugcuauauuugacauauagcauauaguugaaaaugagagauuuuacauuucauuaaguaauagagcuacaucuauuuaaacuauauugagaaaucucaagaaagguuuauuuuauuagguuggcagaacaguuauguauuguuugcgaagaaaaaaugaaaauaaugcuuuaacauagggccaugaaguguguuugcauuuuuuagcacuuaaauaaagugugauucuucuuaaacuguauuuaauuucauuauguauuuuucauaaauuuuaggguauauuuacacaaaaacccaaacuaaaaugcaguagagaaaugacagugaagauagaaauuugcuuuaaccacuccuuucaguagauuuuuccacugccaggagagaagagcaaugcauuucuaacccggacuuuaaaaaaaacacucagguuuauuuaaaaaagaaaaaaaaaagaaaucuauuuuucacauauauuaaauucacuaaugugagcaauauuugucuccucaauuacauguucaaaaggucuuaugcagccguuuccucuucuccuucccuguauugaguuucugcacaaauacaaacuguaaucaguaaugaauaguaaggacaguuuucuuagcagccaucuauuaacauaaggcauacagaaagaaaucucagcuguuuugcuauuggauaauucacucagcauugugaggaguuacugacuuuugaaauagcaugguuuuagccuauagauuuuauaaucauaacaugauuuuaguuucuagauuuuggugucaguucuacuaccuuuacaugguugucugaauauuuaagauauuauucaguuuuuacuucauguuuucuuuuuaugaauuuucaugacagaguugaaauacaaacuguuuuacaaugaaacuuaaucuucagaugaugauuauaauaauacaaaccuuccuaacauugucuggcauuuuuuuuuuuauugcuuucacuuaaaguacuuucauuaguauuuucugacuugauccuuauaacucagugagauucauaggacagauguaaugaacucauuaaacuugugcgaaaauggagacgcagagagguucagugauuugggcaagauagugaagcuacagcaugaagugcugagguucaaagcagcccuucaggucuacugcccuucucauuauguccuccuaucuacccaccuuguagucaaugaucaucuaauggauucucuauccuuaauauucuuaauuuucuauauuuaugugucuuaaaacauuugcagaacuuuauuuuccuuucauauauuuuaauuuaacgguagcaaguuaaagucugugagacuuaguguacagauuuugucugguucaucuaauuuuucccagucuuaauuuauucuagguagcauuuucugucacugcugacucaacccuuccuguuuuaaagccauagacuggcaccuucuuugaauguaugaguaacauuauacaauacuaauguuagcucauguagaagacucugaauugaaaauaucuugggcucuuucauuuuugucaaaugauaaggggaggcaaaaacauuaguacuuuagccuccaaauaccuauuuaccuuuuagaaaucuauugcucuuuagccuuuuaaugauauaauauugauuuaaagugauuaugaaacugauagaaauagccaauucuuccaugugccaugcacugcuaaguguuuuccaugugucuuaccauuuaaaccucugagccuuuguaugagacaagguauauuauuccuguguuacagaagaggaagcagcucaaauuuucuggggaagauugaguaacuuguccagguuggaaugaugauuuuaauuaagcuauccucugucaguucuuuguuugccauuugagcaauuuauauacuuguagagagucuuuaguuugucguaguaaucuugaauagugcaaauuuucucuuaugucucauuugauaauaguauaucuauugaguaaucaaggcucauugaucucuggaaguguuaaauacuacagaaaacagucuaauugucaaaugugauagcaaugauaauaaaaaauuagaauauugauuauguuccuuuaucagaaguaauuuuguuugaauaacaugucauuauucuuucuaccuccuuaauguagagauuguuuguggaaguuuuucuuuccaccugacuaucaaguucugaaaguuucugaaauugcacagccugggagaccaagacagauccuugcuuuugaauuacgaaugaauauuauugcagaugcuacaauugauuugcuguuuaccaaaaauaggguaauuauuauaauaauauaguagaaaauaguauuuaaaauuuugacauuauuuuucagaguuuuuuccuggugacuagucccauacuuggauuaauuuauaugagcuguuuucccuugaaauaauuuuauguauuuuacuaucaucauaauuuuguuaaaugucaaauaaugggaagaaauuaauaguaauagaccuucaugcuauauucuggcucauuuucuccuuuauaucuggcuaaauuguuuuaguguauuuuugguaaaaauuugaacuuuuguucuuaggaacuuguaauacuuacuuaacaucaauaauuucuucuguaauaauaacugaaaaguaaagaugggagaauaauuauaauuaauguuuuauaugaauuaauuuuuuucuuuugguaggaaacaaaugcuguacauguaaauguaggagcuggcucauauuuagaaauuaauauuccaaugacaguugaagaaaaugguaagcugcaacuguuacuuuucuuuuuaaauaauuagggaaauaauuauaaauaauaaaguuuguuaaucaucuuagacuaacauuaauaagguuuucuuuuucaguuuuuuaauuauauuuugaugugccuauacucauuaaagggaaauauuauauaauugagcauuuagagaaaagggaaaccuuuucuaaucaaguucagucuuauaugcuuuuauuauaacguauacauuucuuuuguagaacugagcauaauuuacuuaaugcaugguuuuccaguuagacuguugcacuuugagagcaggugcuguuuuuuuucuuuaguguauucucagugcugaacccuguaccagacguuugggcaguaauugauuggaugacugcaaggcuuuguuuuagguuauauuauuaguagauuucgucagggaguaagccggguggguacuuugaguggcauaacuuuaauaaacauuucauguuaaaaauguuaaaguguguccucacagcuuuaguuucaucugagcugagaugaucuaaguugaucaugcacuugaaauaugggcacugacacaguuaauaacaugaauaaauacuuuuuguuaaauuuaucaaauuguuauaacuucauuuugccuuguaauugagagcaguuaagaugaaauucugcuuuauuuucuuucuugagaguaaagaguagcaacuuacccacauuuaaaaucaaucaucauuaguguuucuguugcuaaguauaauucauuuuuguguaauucuuagcucuuguuucuugguucugucacuuauuuuggugcuguaagaggaaagcaggcagaggguugacuacguucauuaguuuauguaaagugguagcauucaggccugccugcuuagauaaucaauugaaaaagugacugugaauggcauaguguaucuuuuccccauaacucugaggcuauuuuagugaauaacuaacccuuaucuaguguuaaaaauacaaucuuacuaaggcuugaaggaaauguuugagauucucuaggagugcuaauucagaguacgcaguucgaaagaagcaucuuuuagaaaagccaaaagcaucuuuuagaaaagccauacaucuuuuacagguguaugaugggguauaaaggcaguugagaguuuuacgcaauugauaauguuucaguuaaggaagugcuucugccuuuucacaacugaugauacacauaggaaauaguauuuuuacuguuuuaugcaguauuauacaaauacugguacacuggaguaaaggagucaccugaggacugaggagucaauaucuugaguauaucuauuauaaauguguggcaaguaccacagcauacuuguuguggaacucuugaguuaagggucuaaggaaagcccagucagguuuuggguauagagguuagguagcuuuuaagacaacuggcaaagagaaaauggacuuaggugucaggcaagaacaauauauaacaaaacuuuuuagagauucagguauuuaaaaaaagaaaaaaagcccagagcagaaugcaggaugcauguggaacuagccauauaauagugaccacagaaguaguguucauaggaagagauuucuuuaagaaaggaaauacaauacucuaaacuauucagcuuuuguugagaauggacuauauugcugagaaacugucauuacaugaggggaauagcuguuacuuaguaaccaucauuauauaaggaguaguugaaaaugaugaaaauauguacccuugagucaguggaagaagaaaaguaguuguguucuguaacugaaaacuacuguuuaaagaauagacuuguaguuuugcaaacuacaaaggaaaguaaaaucagaauagauauuauauggaguuggaacuuuguuccuuuagaacaugagaaggaucaccuauuaaguuagcaagcucccugucacugagguguguuuaaauagugacuaccauuuuucaaggauuccuucuuugaguggugguaggaguugguucuaguccaaagauguuucauuuuguaauuguuuuccugguucuuaguuuuuauguuuuuauuauuagguuacacuccugcuauuaagggacaacucuuacauguggaugccacuaccagcaugcaauaucggacccuuuuagaagcagaaauguuagcaguaagucuguaguacaugaugauauacauacuuguaugaaaaacaauugauuuuaauuuucuuauauuaaguuuaaguaaccaggaaaucaucaaaugguccaucuucuaguucaagaacagcuagggaagaggaguggauucccagugcuauggacuccuguuggcaucucucuguugcucuccuucuaguaugagggaggugaauaaaaggcaaugauacauguuuuuggccugaaaaauaugagaaguuguuagaauauuguuuuuaaaguacauuguguggcuggauuaaaucucuucuaaguucuaaguaagauaauucuuuaauauauguuuucuagccccgcuggauuucuuucccaggguuuaaauaauguaauuuauugugccuuuuacuugaugaguaagguaaaaugaagaaaaucuuguugauacccuggauuguuucauauuauaaagagaaacaauauguaaaugcccaugauuaaaauugcugauuggggacucauuaaucaagcagauuauuauuauuauuacuaucagggacaacaacacuaacaauaacaaaagcugcuauguaaaaugguuaauauucagagauucuuucauauaagauggugccauaagguucuuaauuucuugucuuaaacauuuuacauaugacauauguaaauuaagagaaaaauucugcaauuaacaggaauauauaaaauacuauaaauauaccuuaaaguggcauauucaguauuuuaaugaauucuucaucuauugcugauaaauagugcugugugacaaugcucuuccuagguaggcagcuuuucccuuugcagaaaugccaaacugcgcaggauguggugacucacaccuguaaucccagcacuuugggaggcugaggcaggcggaucacuugaggucaggaguucgagaccagccugaccaauauggugaaacccugccucuacuaaaaauacaaaaauuagccaggugugauggcgcgcaugccuguaaucccagcuacucuggaggcugaggcacaagaauugcuugaagcugggaggcggagguugcagugaggcgagaugugucacugcacuccagcuugggcaauagagugagacuccgucucaaaacaaaaaaaaaaaaaaaaaaaugccaaacugcagaaauacuaauguuacuuugugugacaguacgcaucacacucuaucuuccuucacacugagccugucacuuaacagaugaggcuuaaggagaaauuagggaugucgguuguuaccccauugguuuaucuggagugcaguaucaacacuguagccugauuuguuguucugaaaguuuuuugaccacaucuugacuuaauauuucaaggagcuagauguagccauggauauugaccuucagccacagcaauauuaaagucucaaagggaccuucuguucagcucaguaggaaaauguuuuaauuacucacuagcguguguaacuucauuucuaaugcuguucacacagugucacauuuuaagccuuaauuacuuuuaccuaacauuuguuuugcaguuccacaucaaugccagcuacccccgaauauggaacaugccgcagacauggcagugugaauuagagguuuauaaagccacuuaccacuucaucuuugcacagaaaaacuucuuuacagguaauuuucuaauagauauaaauacagugagauuuaucacagugaacuuguuuacauuugauaaguuuuacuuuuaaauuacauagggauaugauaugauucauauuuucuucaacauuucauuuugggcugaaaauguuaaagagaaaauuuaaauauagacauuuugcauucuuuucuaaccuaaacaaggaaaauauaaaccccaaauugagcuuagaaggaaaugaaagaacucaauuuaggcugcugcuuuguaucagucuaguuggaggguaggauggagaugaugaaucaauuucucucucuucccaaauuaggcaucagcauggcuucauuauuuuguuuuaauaauuauaauacacaacaguauacgcaaauagcuaaauguuauuuuuauacuuggagcccuuauuuaaucuuuucuguuggcauggauaauugaguuggugcugucacuaguuggaagaaacauuccuuuauuucuugcagcauuuauugauagcuuugcauauuuugugacuauaagaacacauauuguuggucuaugaauagcauaaauauuacuacauuaaaauaaguggcauuuauugagucuucuucuaaaaaguuuagccccauaaaguuggucuaauuugccagggucaguuggcuguuccacagaaaccuaaucuuugcuugacugcuugcuacauuuauccauccauccauccauccauuugugcaacaguuguuuuauacaagcgucucaucgaugcugaguacuauuagauauuuggagguguagugguguuuaaggcauauguagguaguccucuccugacaauacugcucuauaauguuguguaaaugauuucacuguuuaagcuucaguuuccuuguuugugaaauagggauaacaauuucuacccuaauuuugcuauuacuagaguuuugaccuuuuaaaaugccucuuauugcaauauguucaaucaagucuuucauauuucuuuucugguuugacugggagccuuggggacuagauagacugcuucugcuuuccuggaguuacauacuucuccaaggcuugaaccaaugucccaguaguagaaauuuugacagucccuggcaaguuaagcuuuugcuagugaagcagagcauugaauaaacacuucucaguucaaauuuaugaaaaaaauuauagcuaaaacuuauaguguuuauuaugugucuggcucuguccuaagcaguuugcacauauuaaauuauugaauccucacaauaacucucagggaucaauauuauuauuauuuuccuuacuuuauagaugaggaagaugaguuacagagagguaaaacaguauguccagggucacacuugguugagcuggaauucuaacucaaguagucuggcucaagaaucuguuacauuacuuaccucuuugacuagccuuuugcuucucacuuaagauuuuguauuuuuuaacuuuacuaaucuuuuaaaauagauaccuaucaucaaguauuuacuccuucacauuacuuuucuuccagacauuucccaucuuuagacucuugcagugcuaagaauagcugcaguagacauauacauucuucaugauuugaaaauauuauuuuguacuagcacuuucauuuacacuauuguguuaguuacaucgaaacagcuaaguacacauuuccuaaauugcaacugauuuuccuuaaauuauuuucuuucucuaacucuaauuuuuaugcuuucucuauugaaauucacucuuuugguuauuuuuuuaauaaaauuuauuuggagaaauuuuuaaaaacauagauacaaaaguaaacauaaucaccguuuuacagauuuaacaacuaacaauuggucauauucuguuguuuuuaaaagacauauagcauaacaaauaacuguagaguccuuuuuaaacuuauucucuaaaaaggacaacuacuagagaauaauauuaguuuaguauuggagugaaccuacuuggucauaguguuuggauugcuuugucuauuguuggaauucuauagaaaagaaauuaucucucugaugugagggaaugccuaauguuccugaacagccauucucauaccauuuauuaauaagauaaaauuguucuuaagagauuucaaugugggacaaagauagcuuuaugauaaauauaauauagagccucagaaaugaaagcuauaaaacaaaagcagaaacugaagccucuucugggaauaaugaaaauaacuuagauuuacucugauaaggaggagaagaaaauaauacacuggcauugaaaagcucuaauaccaauugauugauguauuauaggguguuugccuaacaacuuaaagauaaagugaguuguugguggguuuuuucagaguaacauuuagcuugccauaacuuuuuaauucauuguacaaaugaguaaggcagucaucaggaaagugcuuccuuuuucuaaucagauuauuugauaagacuaucugguaaugagaaacagauuuugguuuaauaacaaugcauauuaaaaaauuguugaugcuccuaauaaaaauauuuugucaccauaauuuuuaauauuuaucaguaaagauguuauagaaacugguagguaaacuaauuauaaaaugauauguugaaauuuuaaauuaguuauuaaagaaaaaaacuaacacgauuuauuagaaauagacuaauagcugcaacauuucacaugaguuguuaaagaauaaaauaauaagauuuguuaaaauagaauuuggcuaauaacuuuauaaaauuauacuuguuucuucaaauaaguaguaaucugaauuucuguuuaguucaauuuuuguuuauuucacuagcaaucguaucucaaucuuuugacuaauagaaguauaaaguagauaaaauacaaccaauauacauuguaagucucauacaugaauagagauucaaaacaaacauuaaauaugaucucugcccucacuuaugggcauuucuuguuuuguauuauuugucucaaguacauuggcauguguacuagacauagacaaaugaaacaauaccagacauuauguauauugagugcaagugcaaaaugcaagugugaaaugugaagcugacaaaugcauguaagaccugaguacagaggaaaucacuguugucugaagguaaucagagaaaguaaggaaagacacuaaggucugaaaugguguuuuuaaaugaauucaguaguuuuaacuaaaauaggauaguauuuugccauuuacaaagcauguucacuuguauuaucuucacauaacucuaaaauaggguagcuguuauuacuaucccugaguuaauaaugaggaacuugaggcauagaaacauugcaugacuugggcagacuuaugaggcuaggagguggaagacauuuaagaacaauuuucagacugcagacuguuugccuucucuguaauauuauguuggcaauaaagaugguuaguuuuuccuuagcagagaggauaugaaagacaguauuuaguuugaccaaaaaugcugaacuaugaaugagugaaaaaggugagaaaaucagucugaugaaugaugaauauauuguagaguugguuauauccggagaugauuuuugggcauuucccaaguguuagacgcugugcuaaagacuaaaguuagaaagcagggauagagucagccuaguuagguaggaguaaaagauuugagguaagcauagauuauguaaagugugaugaaucacugugauuguuaaauaaaaauauauuuaagguaaauuugauaaauggaauuuucuguugucuauuaauagaacagguuaauagccacaugccuuuuauuguugaugcaguaaaacucuauaucucauuaauauuaauuugugauugucauuugacauuaaguauguuauucugccauuuuaguaagacaagaguuucuaauacauuugugcuagcuucuguauguggcagcuaaauuuuaaauggguucauaugauauuauguaagauaaauuuacucugaguucauuauugaaucuuuuuucuguuuaaauaucaccuuuaaaauacaaggaaaacuacuuuaaauauuucacaguuuuaccuguaauuuuccuuaggauaucuuuaauaauaaacgcuaccauuuguggagugcuuacccugugccaguuacuuuguucaaacuuuacauaaaucgucugaauucucaucauaagucugugagguuguucuuauuuuguacaagagaaaacugauaacauuuaagucacuuuuuucaagguuacacagcuaguaaaaugauaaagucagaauuuaaacccaggacugucuaaugucagucugugcuauaauaauacuguuuccaauuguuucucucucucucucucucucucucucuagugucaaagucugugcuauaauaauacuguuuccaauuguuucccucucucucucucucucuaguaucaaagucugugcuauaauaauacuguuuccaauuguuuccccccccuucucucucucucucucucucuagugucaaagucugugcuauaauaauacuguuuccaauuguuucccucucucucucucucuaaagucugugcuauaauaauaccuuuuccaguuguuucucucucucucuuucucugucacauacacacacacacacacacacacacacacacacguucuaauuuuauguacaugguauuguguuauguacugugaguauacaaaggugaguuugacaccucuaggaggagcccuuuuauugaaagacauugcugggaguguacaaugcauguaaaacauuguggaggccagaagauaaaguuguacaaacugcuaugguagaugguagaucagugcuaaugucuuuaaagagcuuuuauuuauugggauuaaaaaaacuuaaaguaccaaaggguaaacagacaaaauauaugaacacaauuuuaaaaagcaguuuaaacauacagugaauuggcaaugaacaaauaugauugauuauaauucuaagaaagucaagucuauguuucauucaccauuguaguccuagagucuagaacagagccugagacacaguagacaguagauauuuguuuaauuaauaaaacaacaugaaaaauuguucagccaugcuuguaguuaagaaguucagugaaagcgagauaccauuuuucaguuauuaaaugucaaguaaaacaaaacaaaaaacagauagaugauagaaagaaauagaaugcagaagaaaguucagugaaauagguagucaagcauaccuuuccgguaggaguguaaauggacucacuucucuucgagugcaauuuauaauagucuugaaaaauauuccuaaauuuugacccagcaauuccacuucuagaaucuauacugacaaguaauccugaauauguaaaauaucuuuuacaaaaauauauaauacaugauaauauauauaacacaaaaauuuggaaagaguauaaauauccaacuauaaaaaaugguuaaguagguccugacaaaucucauuaaugagcuauuaugccaaauuuauguaaacgugugaaauaacacggaaaaauauuugaguucagugaaagaagcaacacauaaaaaaugugcauauaggauagugucagucuguguagaaaaauaacuggaagaaacuguauccacaauguuggcuauuuggguaguggaacagcaggugauuuuuuuuuaauuuucuaaaauuccuuaaaaauagauauauuaauauauaaaauuucucuuauuuggaacugugauuaguaaguaaacaucuguuuacugucaaauuauuuaaauacauccuaaucaccuuuuaaauauuucaguauaaaauuuuuuuaguuacacaaaagaaaaauucauuuuugacugguguuagaaaaucuguguuuuacuuuucugaguuucaacuaacuuuacaauuucuauucacuaccccaauaauuuuagauuuaauucaagacuggucuagugacaguccuccagacauuuuuucauuuguuccauauacguggaauuuuaaaaucauguuucaucaguuugaaaugauuugggcugcuaaucaacacaauuggaucgacuguucuacuaaacaacaggaaaaugguaagacauuaaaaaaaauuagguuaaauauuucucucauuaaggcaaauaccaacuaagaaaauuaguauugauuugauaguuuuaacagauacuagaaguuauuuccccccauuaucuuugugagacucucagaagacuguuucagaguuuguauuggacuaaaacuuaauuuuguuuaguugugcauuuuaggcaauuuuauaauugaaauuuaauggacauuaaaaguaaauuuacuuuuucuucuuuuuuuuuuuuuuuuucuuuuguaguguaucuggcagccuguggagaaacacuaaacauugauuuuucuuugccuuuuacggacuuuguuccagcuacauguaauaccaaguucucuuuaagaguauguauaguugaaugcauuauuuauuccacagguguauuaguaaauuugauuucccaaagcuuaucuucacucucuucuccccaguccauugcaacuucaaaguauuuuuagcuuuccuccaaugucuacuaccuuuagugucacagaguuccuguuguuuucuuuuuguaguuaacugcaucuaagaaauuggucaauuaaaaauaucucaaguugauuauuuucuuagaguucauuucugaucucuguggcuaaucuguauguuagcccuucuagcucuaauguuuacuaauucauaugaacuaauuuuauacuucccuuuauuugauucuuaauuguaaacaugaauucaaggaguaaccacaguagcuuucuuccuuuuaucugaaugccagcucuuauguacuucuaagcucaaaauuuuauggaacauuuuugguauggauaaccaguaguacuuguaguauuaauagugguuauacugguaaaauuagcaacauauagaaacagcuaacaucuauuaaacauuuucuggguacuacauagacacuauuccaugugcuuuauguaguaacucaauucucagaacaacccuauugagauuauuauuaacugcauuuauacauuaggaaagugaggaacagagcuuuuguaacucaucauacaacuagagaguuauugggcaguauagcuuagggcuccauucuuuuaaccacucuaccuugcugccuguuaagaaacuagucaucaagaugaacaaagaauagaaguccuauuaggaaaaaaguaaagccaaaugaagauccuuugauuugccaguucugaauuauuaaaagccaguugaagaaaugagacuuacuagaaucaaaugagacaauacuaucugaaaaauuaauaaaaauauagaacauaguccaccugagcuuauaaaaguuuuuuuaaaaacugaacuuaaaaaaaauaucuguggauacccauggaagacauucuuuucacuguuuggaaacuaugcuguuucuuucccugauuauuuuguuguuuuucaauucaaauuuaguuuuagucaauguaaaaucuuauucauuauuuaccugacugucgaaugcaaaaucugccauuucaaauuuguuuaucucacucguguaaucccagcacuuugggagccugaggcaagaugguugcuugaggucaggaguuugagacuagccuuggcaacacagcaagacccugucucuaaaaaaaacaaaaaacagcacauuccucuagucccagcuacuugguaggaucacuugagugcaggaguucaaggcuucacuccaaccucagugacagagugagaccauuaaaaaaaaaaaaaaaaaaagauaaauaauacaauaaaauaaaaauaaauaaaauuuguuaauuuucuuucaaacuuauuuccaagauuguuguagacagguuugcccguaaguauuaaccaacauauuuaugcacuaauuuuauuacuuuggcuuauuauaauuauuuuuuagggagaagauguugaucuucauuuguuucuaccagacugccacccuaguaaauauucuuuauuuaugcugguaaaaaauugccauccaaauaagaugauucaugauacugguauuccugcugagugucaaaguggccagaaaacaguuaaaccaaaauggcgcaacguuacucaggaaaagugaguacguaaaauuagugacacaggccaggcacaguggcucacgccuguaaucccagcacuuugggaggccgagauggguggaucaccugagaucaggaguucgagaccagccuggccaacauggugaaaccuugucucuaguaaauauacaaaaauuagcugggcaucauggcgcaugccuguaguccuagcuaccugggaggcuaagguaggggaauggcuugaacccaggaggcggagguugcagugagcuaagaucgcaccacugcacuccagcuugggcaacagagaccccaucucaaaaaauaaaucaauuaguaaaauaaaauaaaauuagugacaaguauuuugugcuuauauguggagaaauucuucuuucaaaaaauaauaauaaaauuugauuaucugcaacugguaucucuguacaauuaaaggaaugaguaucugacuagaaacugucuguuuuacucuucaaaggucugguuggguugaaugcuggacugucccaagugucaugcuuacaauugauuauacauggcauccaauuuauccacaaaaagcagaugaacagcugaaacaaucauguaaguguuuuuauauaauuugugcuuuuauacagcugcuauuaugauugauaaucaugaaaaauaagaagcaaauaaauugaaaugcaucuauucuugugacauaguauaaauauagucuuacauauuuuagauuaauuguagcuaccuuuugagcauuuacuuugugucaaauguugggccaagcaauuuucuggcuucuauuaucuucuauuauguuuaauccuuauaacaacucugugagaaagauauuaucauuauuuuuaucuuaaaguugaggaaauaugcucagaaaagguaaguaauauucucaaagucugccaagcuagaagcagcagagccugaauaugaaacaagguaugugugaaucugcauauuuaaggugcaugauuuugugaaauguuaguuucuuuaaugcauuuugacaguucucauaugauuuauaguuuccugaagguaauuugccuuauuaccuagguccaaaaaagaauuagagccaaaugaugauguuuucuuuguauuuuuccagugaguuaaguuucaaaggauaguuuucauaguuguuucauaguggcuugauaacauuacacuguauuuaaauagcuauuuauaugaaaaaauuuuguaguuagugcccaagaauaguuaaggucuugaugugacccaaauuuauauugcagggacucaauaagaauguuguuuauguuaacagaaaguuuucauugauucucugcaggcugauuuauguauuucucucauauuucaaugauuuauucuuuauuugcuuucuuaauuauuggucuuuuaggucuguuuucauuauauauacauuauguaaagauuaguugaugucauauuugcaaaguaaaauuucuuagugaauauuuccuugaagaucuuccaagaagucuuuugucccccaccccucaaacauuagucuuuuuuuucuuaauuuauuacaguaucagaaauggaagagacaaugcuaucuguauuaaggccaucccagaagacaucagacagaguuguuucuucucccucuacuucuucacgcccaccuauugaucccucagaacuuccaccugauaaacuucauguagaaauggaacuuucuccagauucucagauaacucucuauggaccucuacuaaaugccuuuuuguguauaaagguaugauucuuaaaaacaacuuacauacuuuuaaauauagacaaagcaauuaaaauuuaauugaaaauugagaccguuugaaauagccaguuggauuauuuaaaguguugaggauauaccagauauguugacuggacuuggggugcuagacucaauuacaaaauuauuuauuaaaaauaguacuccucaguucagcauucuuuugugcauuuaguauguucuaggaauggugcuaguugcuauagauagagaugauguagcaucuguucucagggagguaagcuagagggauagcuaggauagacagauauauggacaaauuuuaacacauuguaaguaauguagcaauagaaguacuacauauaucugagaauaauugguaauggaaaagacuacuuuaagugaaucccuuaaaaauaagugacaacguuuuaugauaaugaacaaauauuugcuuggugcuuuauuugaaaaacugaaggaaauauaugaaaauaaguuuauuucagaguauaucaaacuuagguucuaaauaaauaugcacuaaugcuuagaacaaagaacaaguguugacucauuuugguauaauuuuuuccacugaaauuguguaauugcacaguaugacagcacuuuaaaguugaucucuguagaaugauuaugaagagaggcuauuuuuggauaaauauuugaggaguucaucaguuuuuuggaaaucacucuuauucuuuugauguucaaaucauguuuuaaauguccccaacagauuaucaacaauucuuacugauuuaaucuuuaugguaacuacuauaauccuugcugauccuuacuuaucaccuuugccugugauuagaggaguuauccaacaucacuuucaacaacuuaagaaauuuugcauuuuuacaggaucggcagauucacuuuggauaucgaauaccuagcugacaaggaauccuguaauguacaguaauuaauucuggagagagggacuaggauguuuaggguuggacagggaagcacaaucaagguuuguuaguaaaggcucucugcaggaagugcuggcugaacuggguuuugaagguauauagcaucucaauauuugaguuauuauauuguauuuaugaaaaacuaccauaaaucaucagaugauguaacuuaguauaaaagaugcaagggaaaaugugguuaauauuuguagauaccuagaguuucuguugauuacauacacacuuuucuuccuucuugugaccaucguuugaccuaaaauguaugucaaauaugucucccaaugucuuacuuucuugagauugcaugugaauaacuauaaaggauuuaaaagguaauuuucaagcuauagucuuccugaagaggcugcauuguauuuuacuuaaauauaaguaaugauuuaauuaguaggugaagguagucauagugauacagcaucaguuuuugaauacuacuagagugguauuaacuuuuguuuuuguguuacuauguacacauggaaccucaguuuguuuuuaucaaaaaaaaaacugauaguaauacauauucaccaaaaauaagaggacucuaacaaaacagaauacagugaaauaaauauaugcuuucauuuuagacuuguuuauaaguucucugcagauguagccauugcugauagguuauuguuuucauacagacuuuugugcauuaaaggcuuuaaagcaacuuuuugguaguuucaaaaguuugucuugcccuaaauauuauauuagugaugacauucaucuaauuagcuuagaaguuguauaaaaugucuauuaaagcaaauuguaaaauuuuaaauuuugacauguuuacuaaauauauaucaaagacaugacagguaaaaacuuugucuagcccaaugaacgcuaugcuuccuuuuauaaggaauuugugcaauucuuugaguuucugguuuugguuucgguuuuuaagagacagggucuugcuuugucauucagguuggagugcaguggagcaaucauagcucuuuguaaucuggaacuccagggcucaagugauccuccugcuucagccuguugaguagcuaggucuacaggcgagcaccaccacacccaucuaauuuuuaaaaaauuauuuuuuggagagacuggguccugccauguugcccagauuugucucaaacuucuuccuggccucaagugauccucccaccuuggccucccaaaguguugggauuauaggugugaaccaccauuccuggucuguuuguuuaacuauauaauguguauuuuacuugguaucaguauuaguaccuuaaaacuuuuuggaaguucaaaaauguauauauuauuuuuauaauauauucaaauucauauaugaaauuuucuuguucauguauuuucauguauacaugaaaaauaaaaugggaauuuaaaggaauguaaaaauucauguaaccgagauugucuuuuuuuaguuaucaaaauuaaacaucaagaaauuauaaagaauaaacuaggaaaaaaaucacuauauuuguuuggcuguauaugaaagacugcuuuccaaaauccauggaagaaacuagaccuggcauuaucauuaaaaaaauucuaagaagaauaugucuacugaauaugcauuaaaauuuaugaggacauguauggaaauggaaggucuucugcagauguagacaauauuguaauucuaacugucagcccaaagucauuucagucauauuaaaacuuugucauuucuucuguuguggauauaagguuggauaacaaugcuacuuauauuacuuuucugaauugacuucucuuuagucuuauuucauuuuuuuguuaaugaagaaaaauaaaucuuuuuauagugauaacaugucagugguagcaaauaacugcaugaaaggguauauauggcauauauguucuuauuaaaaauaauuuuaauaaucuugaacagaaaccuggcuauuaauuuuucuuuuuucaaaaaaguauaauuuuggaaacaguacuuguggacuuuuccuacuguuucucugauuguauuagcugucaucuuuuagccuauuguuauuuuuuuuuucuguuuugagaaaugagcaucauuggauaaguauacauuuuuagcuaggaaaaacauugcagucucuuacuugaaguaggugacaagacacucauauaccaaaauaccauuauguaaagaaaauuuuggagaauucuuaaguaaauugaaauguaguuuaucauucauaaauucaagcauaauguaaauuugacaaaagaacacauuuucucgguucuauaagccagugaauuuuuucugggguuguuuggaauuuauuuuaaagauaguuuaagcuuacaugccaucuauuauaaaaugaaauugaaaguuuuauuuguauuuguaaauauuuguguacauuuauuaaucuuaaaguaccauaaaaguuugccguaauguauuaccaucuaccuuacauuugaucaaccuuuuugguaacuauuuuuuuuuuuuucaguaaauucuuuuuuuuuuuuuuuuuuuuuuuuuugagacagggucucacuuugucacucaggcaguggcauggucaugguucacugcagccucgacuuccugggcucaggugauuuucuuagccucccaaguagcugggaccacaugcaugcgccaccaugccuggauaauuuuuguauuuuuuguggagacaggguuucgccauguugcgcaggcuggucucgaacuccuaggcucaagugaucugcccaccugggccuccugaagugcugggauuacaggcaugagccacugugccuggccuuucaguuaauucuuaggaaauuaacuaauagauuuggaauucauaaauuaagagaaacccuuaagucacacacccagcauuagacauauaacauuagacaaaguucuuaaaggaguuauaauuuuaaaaguacauuuuguugauaauauucaguaacuacaaauguauuaacucaugaaagaauccuaguguuuuauaacuccuuuagagcaaagucacugacacauuuaauaaaaauuagcaaauguucucugcuauguuggacauucaguguucccuaaagaauuugauaugaauuauuuccauuucagauaauuaaauggagauugcuuuaguagcaaauugaacauuagacccaaggguaucuuuuuucuuuuuacuguaauaaucuacaggaaucuaaauuuuuuuaagauuuacaaugauaacagacuacaagggaauuuuuaaaaaauaagagaucuguuggcuaggaucauuaaaaaugacuuaaaaugagugcugguaacuguuuuguugguacauguuaguaugcugaaaccuaauaguaguugaguccuuagaucagcuguuuggggagaaggugggacagaggugauuuucugggggccauuuacagauggaaguaucaaaggaguuuuuccacuuuacacuugacccuggacucugccuacugcaaacuuugugaacagucaucaggacugggguggaauguguauuucauaaaggcuucuggaggggagaacuacugcuuugaacaucuuuaaguuuuguuuguuuguuuacuuuauuucaauaguuuuggggaacagguaguuuuugguuacguggauaaguucuuuaguggugauuucugagauuuugcugcacccgucaccugagcaguguacacuauacucaacguguagucuuuuaucccucaccccccccauccuuccucucgagucuccaaagucuguuauaucauucuuaugccuuugugaccucauagcuuaucccccacuuaugagugcaaacauauauuugguuuuccauuaauaaguuacuucacuuagaauaauggucuccaauuccauccagguugcugugaaugccauuauuucauuccuuuuuauggcugaguaguauuccaugguauauauauguguguguguguguaucuaucuuugucugucuaucuaucuaucuaucuaucuaucuaucuaucuaucuaucuaucuaucuaucuaucuaccacauuuucuuuauccacucauugguuguugggcauuaagguugguuccauauuuuucaauuguggacugcgcuucuaugaacaugugugugcaagugucuuuuucauauaaugacuucuuuucuuuuggguaaauacccaguaguggaauugcuggaucaaaugguaguucugcauuuagugggagucuccauucuguuuuccauagugguuguacuaguuuacauucccaccagcaguguaaaaguguucccuuuucaccacauccacaccaacaucuauuauuuuuaacuuuuaaauuauggccauucuugcaggaguaaggugguaucauguugcgguuuugauugcauuucccuaaucauuagugauguugaacauuuuucguauguuuguuguccauuuguauaucuucuuuugagaaaugucuauucauguacuuugcccacuuuuugaugggauuauuuguuuuuuccuugcugauuuguuugaguucccuguaaauucuguauauuaguccuuugucagaugcauaguuugugaagauuuucuuccacucuguggguugucuguuuauucugcugauuauuucuuuugcugugcagaaguuuuuuaguuuaauuaggucccguuuauuuguuuuuguuuucguugcauuugcuuuugggcucuuggugaagaauucuuugccuaagccaaugucuagaagagucuuucugauguuaucuuagaauuuuuaugguuucgugucuuagauuuaagucuuugaucuaucuugaguugauuuuucuauaaggugacagaagaggauacaguuucauucuucuacuuguggcuugccaguuaucccagcacaauuugcugaauagguuuuuguuucuuauuuuguuuaugugaugugucacauuuauugauuuguguauaaaccaucccugcaucccugguaugaaacccacuuuucgcacuuuauguuuuuguaugcuuugucgaugaucaguuggcugcaaguauuuggcuccacucuggcuuuauuuuggguucucuauucuguuccauuggucugcgugccuguuuuuauaacaguaccuugcuguuuugguaaugauagccuuguaguauauaguuugaagucggguaaugugaugccuccagauuuguucuuuuugcuuagucuuacuuuugcuaugcagguucuuuuuugguuccauaugaauuuuaggauuuuuuuuuuuucuaguugagugaagaauuacgguaguauuuuaaugggaauugcaauuaauucauagauugcuuuuggcauuauggucauuuucacaauauugauucuacccaauuguugaauagguuuuuguuucuaauuuuguuuaugugauauaucacauuuauugacucaucccuucaucccuggugugaaacccacuugaucauggugaauuaucuuuuugauaugcucuuagauucaguuagcuaguauuuuguugaggauuuuugcaucuuuguucaucagggauauugaucuuuaguuuccuuuuuuaaaugucuuuuucugguuuugguauucgggugauuacugucuucaaagaaugauuuagggaggacucccucuuuaucuuuuggaauaguuucaguaggauugguaccauuucuuuuuuaaaugucugauagaauucagcugugaauccaucugguccugggcuuuuuuuuguuggcaauuuuuaaaaauuacuuuuucucucucacuguuuguuauucaucuguucagaguuucuguuucuuccugguuuaaucuaggaggguugcauauuuccaggaauuuauccaucuccucuggauuuuccaguuuguucaccuaaagguguucauaguagccuugaaugaucuuuuguauuucugugguaucgguuauaauaucuccaguuuuguuucuaauugaucuuauuuggaucuucucucuucucuucuugguuaaucucauggaugguccaucauuuuuuuuugucuugucaaagaaccagccuuuuguuuuaucucuucaaguuuuuaauguugaucgaacucacuuagacauuuauguuauuuuuuaaaaauucaauguuggaauuuaaaauauaacccaguguuuucuguuauauuugugcauaaauuuguccaugcuucagaauuguauuauaaagacaguuauuaagauuucaagcagguuucaaguggcaucuguaauuaggagguggacagcaauagggaauagaggaaaaagcacugguuuugugagccgguagguuugggauuuaaauauuaaucccccuaccaauuaacuguaugacuuuaagcccuucaacauuauuuccuaugaaaagauauuauguacugauguccauaacucuagucagaagauaauuuugucaauaaccaaagugcagaauuuaccaaaauacugucuugguucuaauauuuaacagauaugcugacaauguuaacaggaauauuuaacaacuuuuauuuacuacugagagaucaaauggccaaaauuuaaauauagaaucaaugggaaaaaauaaauuaaauugaagcuaaauuuauauuuucaugcaaaagaaaacaguaguugaaacacuucugcauaaaaaaccaggaugaacuaugugaaaggaauuuuuguuaauuguugguaacacaugccuuuaucucaucaauaaccaagauuggauauuuuuauuaaagcuguuaaaacaugcccaauaaauauuccaacaggaauaugugaauuguacuaguuaccuaauugaauuuagccagacugauuuucagugaauugcuucccccaaaggauguccucgguauugccugagaacucugaggagcagugauugaaaacuguuuaaccaugcaaaccuucagaggucucugaggaccuaaauuacaagguuuugcuguaauuggggcaaugccaugaaguuuuucuauaaaauaggcucuguaacuuuuugcauuuuuugcuacugaauauuugccaagcagcuauguguaagucuuaacauauguuuucuuuuguauuuuaagacaauaggccugaugccuuuuuauuaaauauaauagguuaaggaaaugcauaauuuacaaauuuaggcucauaggugaaaauauauuuacauaccucuuuugacagcaauuuguguuuucuuaauauuuauaggaaaacuacuuuggggaagaugacauguauauggauuuugaagagguuaucucaaguccuguuuugucacugucaacaucauccagcucuggguggacugcuguuggaauggaaaaugacaaaaaggaaaaugaagguucagccaagucaauucauccacuugccuugcguccuugggauauuacuguacuuguuaauuuguacaaaguucaugggcgucuuccuguuguaaguguuuacacaugaaaguagucuggaauauauuauaacauccaccuguguauagaugugaagcauucagcacacacuuagaaaaagaaaaucagauuuagaaacuucuaaauuuauucuuuuacuguuauaaaacucauguauuuucuucauaauaugauuacuugaucauugguaauuuuuauuuucuauuuuucuucuaauuuaacuuuagcuccuucuuugcuauauguguaaugucaggacaucgugucauacauugaguuguuggguuuauaauuaaccugauggguguucaaggacuuuacauuuucuuagcuuuuaucucuagaccccagaccaguuuggggccuuaugguggaccuguuauaaaauggaguuucuggcuugacccuggggguugaauuauguaguuuggaucuagcacgguauccugggucgcucuaaggacaaccuguggaccuguucuggcugacauggaaugauauuaaauugccccaagaacccagggacuuuggugcagggccagaugagguguguguccggguugcaguggggugguggggccgguggcccucuguugcuuagugcagcuaacgauccuacugagguacagaauaguuauuuuucucaguaaucauaguuucucuguuuuugaaaaacaaauucucuuaaucaugacagauguaauuuuuauuuuccuauacuuccuuacuuuuugccuuuucugcauuucaacugugcuauuucauuugacuguagcauggaacuacugaugguccugaaugcccuacagcuuucuuggaaagacuauguuuugaaaugaaaaaaggauuuagggagaccaugcugcaacuuauccugucaccccugaauguguuugucagugauaacuaucagguaaggugaaaaugaaauaugguggagacauagagauuuauuauuaauauuuauuggguuaaaacaauguauuagcuucugugcauggacuuuguagcucuuuaaguuggagacuuuuaaguuaacuguauuaagaaguuuuguauguauguuuauguguaugagaguuguuucaagaaucucaauuuucuuuugcugcucccuauuucugugaucccaauuauauuuuauaccuuuugcuauuauaauagaaauggaaauaaguacuuucucaaauauuuauggaagggaaaaauuaacuauauaaaauguugguagguucuguugaguaucacagcauaaauguuaauauuaaccaguaccauaauauuuuaaaacguguguaucuacaugaucaaugauuuauucuuauucaucuaacauaagauacuuuguuaauuccuucaagauaccucugggcucuuuuaaaagagaaccaaugauauucaucaagugagaauuugaaaauguauuacauuucuggguagauuauaauuuuauuauuuuuuucaugccaaauggcuuucuguggcaacuaccaccacuuuauaugccccugucuuacuuuuaaucaaguugugugauuuagaaauauaaauggaacuuaauacaagacaaaguaaaauuauaaaugggaaggugaaucugacaaccagaaaucaucaaugaaugaucauuuauuaugauuauauguaguaauugaucauuuuauuuaaaauagcauaucuccuuuucauucuuuugccaucacugacuauauuuuucuucauggaauuuuaauuuaauuuuucauacauauauuugacauauaugagaucauauuagcuaaaacuuaauaugugcuaggcauuguuuuuguuuugccacagaauguguguuucugguuuuaaacuuuuauuuugaaauaauuauaguuucacaggaaguugcaaagaucagagcgauccuguguguacucuuuacccaguuuuuuuccaugguuaaguuauuuuacauaauuauaguaucaaaacaaggaaacugacguugauacaaugugugugcguaguucuaggucuucuuaucauguguagauucauguaaccaccaaaaugaagauacagaacuauucugucaucacaaagaucucacauaacacauuauuuuaacuugccauauuaaccuuaaaaaaaaaaaccucuuguccucucuauaauuagcaggucauuagaaucgguuguuuuuuauucugggaggcagguauguggagaggaagcccaucucccuuuuucagucuauuaaggaaauuaauaaagggaaaagggaaagucuucuauggaugaguucugagaaacuuagaugacuaucccugguuuuuuaugaguaccugguagcccuucaacuuuuaaucacugcacuuuuaaaaggcuuuuccagacauagaaaacauuuuauugagcugauuaugaauguucacauuaauucuuauuauagagguaugcaaacuuguggagagacugaauuauaaaguaugacuuauuuggggauuagagaaggaguucauggaguagagauaccaaggugaaaguagaaguacuagugauaauucauuuccccgauuguugacaacuuaccccgaagacaaagguaccauauauauccucuuggaauuugcuugucuacuuaccuuguuuacauucuauaguguugacacgacuauuccuaagaauuuuuuucuucaucugucguuauacuaucuaauguucuuucacagugagaggguucacacugugucuacucccaaggcucaaaucuggguuacccacuuguaguuuauccuggguagcaucagucucuuaacucaaggcuucaagaugaagguucuaaggugacugauggacuacugugucccauuaugacacuaugcacuuuuuacuuuguggucaucuuauguauuaauuucauagggaugccguaacaaaguauccuaugcuaggugacauaaaagaacagaaauuuauucucucacaguucuggagguucaaaguccuaaaucaagguguuggcagggucacauucugucugagcuguaggggaagauccuuccuugccucuucuuaggcucuggugguugcuagcaaucucugguauucacucaaauuucugccuccaucucgacuggcugccacucucucucugugccugcaugucccacuuuuucuccucuuauagggauaccagucauauuggauuagggcccaccaucaauguaaccuuaucauaaccuaauuauauccgcaaaaauccuguuuucaaaaaagaucauauucacagguuccagggcuucagacuugaacauauauuuuugagggaugccauucaacccacgcaugaugcaaacuguaauaacauuuagaauauaauauuuauugguguaucauguaggcuauaccuuaggaaagcccaagauccacauguaauuuugagauuaaaaaauuucauaaaaauuuuauacugagaauuauugagucucagcgucagaagauaacuuucuugaccacucuccccaguucccucaguaaaaaagguaaggaaauuaaugccuggagaagucaggugauuuuauauaaagucacacagcuuggaugaaaauaaaaugaaaauuggaucagaagagcuucuagagugauuauuguagucacaauuugaauuuuuuuaaaaaaaguuucuuaugaauuagaguuagcccuuauccuuaaaaaaaauuuuuuuaagacuguuucccaacauauauugaaagcaaagaacacuaacccugugagauagccuagacauacaugaagaggacuacuguaauaaaacuagguugagaaauaauuugcgaacugccucaauguauacugguauguugaaggcucugugaacacuugcugugaagaaaucugucuaaucagcagcaucuacuuuuuguggucacuguuaggugcagugauacuuaguacacaaggcagaaaugguuauuaaugaaccugggggagaagauaaauauugagaacauuaaaauuaagauaaauaauuucaaguguaaaaagcgccacaaggugagguaggcagugcucugguagcauuuaauggucuggaggcaagaacaggaucagauuuguauguuuagaagaucucugugauuacucauagaguauggagcagagagauguaaaaaguuaaugccuugaaaagguccuggcaagaggugauacuauuuggaccaggaugagagcacugaagaugaaaaaaagucaaugcauuugucagagacugggagguaguuuuaacagaaauuggugacugaucaguagggcauucccaaacuuauuugauucuuuauucuuaauaauguguggaacuaguguuccaugaaauaaucuguuuuaugacauauccuuuauuucucugaauacguuagaaauguucccuuugaaauacgugcugcuuuuuaguagugaguaugaaauuauucucuguaagaaaacucuccuuguauuuacauaguccucagaaucuauauggaaguuuacuuuuccccaccauucuucauuguuuggucuuaauggucugaguucuucaauguugucuuccuuuuaaaaauauuuuaaucucaugauucuuagauuucuuacaaaagacuggucucuuguauucccugucaaaguacuacuguaguuucuuguuauucauaaaggcaguuaccaaucagagaucugucuacuauuuaagacucagcuaucuugcuuuuuauaauaguuggacucucauagguauuguucauuaaagaugcuuaacucagaauaccucugcggguacaagguuguguuaggagcuuguggauucugaaaccuuauagauggcaugaguuuauuguucaucucugcaggggguguggggggaaacaacuagaaauuauaaugugauuuucuuauacauuuuacagucucaucauuauuguuuucagcagcgacccccuguggaugaaguacucagggaaggucacaucaauuugucaggucuccagcugagagcacacgcuauguucucagcagaaggucuuccuuugggaagcgauuccuuagaauacgcaugguuaauugaugugcaggcuggaagucuuacagcuaaggucacagcaccacagguaugguuuucagaguacuaucuccugacuuauuuucuuuuuccuuucucuacccaccuucucaagaauaacuuguaugccuguuugaauguucauugcauuuccacugauggcauucugaugggagucauucuugccauucagaauuuuaguuauaggugaaucagagacaaguuugacuuuucugagccacauauaauuuguuggguguaauguguguagaccuauauaauauuucaaagaauuugagacuuucuuugggaaaaauucaggaugaguacuuuucuagaagucauuaauauauuauuaaaauuauauuacuuggcccuccauuguuggaaaaaucuuauuuuucuacuauauggaguaauuuucuaagaacuuuguuuucuuacauauguuuaaaguaggauuugaaaguagcccuuaugauacuaaggauuagguaauaagguucuuugcuugucaugucccaaagcaagauuacaucauuuguaccugcuguuagugauguggauaauaguuucaaaaaacaaaagugaauuuacugguauguaagucuggucuagaauucuagaugugauccuuuuggauaaauugucccccaccaccccuuucacuuaauccuuagaaggcacaaaagccuuaauguauuauuuguuucuaauuggccacugaaguuuaguugaauugccguauuauuguaacauuucaccugagucauauauuuauuauaauaugaaugcucaucuugauauuucaaaagacuggaauuugauaggaauguuacauacucaauuuugauaaaaaguuuuagaauggguauaaaacauauaauuuagagguagguaguagcaacaagaaaguaauaaagaaccuagaugcccuuuauaccuggaagaaaucgucagaggguagcaaaaauuaauauucuagaaauggugagaaaaugaauagaauugaaaagggauauuuuggaguugaacgucaucucaauauaauauuagaauguauaaugauauuuauaaaaauaugugaaaagaaaugcauaauggaauguauaaaaauggaugaaaagcaauagucauugcucacuggucuuguaacuguccucuccuuauuaucucccauuucccaucccuaaguauacuaguaaaaacugaagcauauuccaaagcagcuuguucccuacgaagggaauaaagccaugcugauccugcaagacuggguacaauuccuuuauuccaaggccugcuagaaucuuacauguuuauaaauugccuuuauaagguaaaacauuucucuuucuccugcauaaaaucuuggcaucacuguuugcugcacaguucaugacucuguaggcacuuuuauguuuauuccauucucuguauguuuuaaaaguaaaauuuauauuuuccaagaguuuaaauuauguacuuauuugaggggauaaugucauguguaucuaucccucaauguuuuuaacagcucuaaucaauuaggguguuuuuuuuuuuuaaacugaagauuugaagaauuaugauauauacuuacuuaagcuucuauuuacauaaacaaaagugcuuuaaucuucaaaauaccugguuuuaaaaaaacuguagcucaaugugauauuuagauacuuuuucacauaaaaguuugguuuaugauuggagaauuuuaggugcuuuucuauguggagauuucaguuagcuauauaagagggaagauauauaaccuugaauaaaaggauuugcguuaaaaguugcugaagugaaauuuuucaguugcaauuaguuuucauuuugacagugcauuuugucauucauaaaggaaaaguaacauaagcauguaaaugauauuaaagguagaaaaaaaucauuggcuaacaaguugcuuauuuagcagaaguuuuaagacaguguuuggguucuuucaagcuacguuaacauucuucagaagcuuuugaacucuaaacccuuguuuagaaugcuaacaguguugucaacuugucacugauuaucuguagcuggcaugccucuuggaguggggacagacauuuguuuuucaugugguaugucgggaguaugaacuggaaagaccgaaaucaguuauaauaugucagcauggaauugaucgucgguucugugaauccaagguauauuaacaaauauguuagcaauauuauaaacauuuaugaauuuuaaaaaauggaauauugagauaucagcuucaagucaaauacacauagccaugcagcaaacuacaguuuuuucaguuaauaaaauuauuuuuuaaauucuuacccauuuuaguuuuaaguaucuaaaauaugagauaauuauuaaaacauacaaauuaaaaaagaaacagaauuauaaaaauuauauuuugcuuacauuuuuacuguuaacauucaugucauauugcauuauuauacuuguugggauauggcuauauauuuauguagaagauuuagaaauugaagcaaagagaagguugaauucuucacaugacaugguuugcagaccacucuggacaugccguuucucccauaauguaauagcaagguuggucauuugccagguuuccugacuccacauguuaugcucuuuucacaacauugugccaccuucauuaagagucauuacaauaucuucacaaggguugcaaaaaguagaugguaaucccuaaaaccaugugcaguggcaaugaaaugccauaguauuauugugcaauaaauacucucccuuaugaauuuggggagggaggcauuuucuuccccugauuuuggaagcaugguuauuucagaaaaucuggaaaacauggcuguuucaaaagagaaaaauaacuuacccugguucuacaacacagugguuaacaacuuaguuuuucuuucuaguucguuccuauaugucuuuccuuuuuuguucuucugcuauacaaauuauauuuguuugcuguuauauuacugugaauugaaauuaguucauccuacuuuuauguccaaaaaaaaucuguaacgcauccuuauauauugacaauaaaggaaacagcuauacuuggugauaaaaauuuuuuuucuuauuauaaacacauuuccaggcuccacagaauugguuccuuagucacaggucagggaggcaguuuuuuauggauaauacgcacauaccuuuaggugccucccccuccuuuuucuuuuuuuuuuuuuaacuugaaguuuuuauguugcauuaaaauuuuuuuuuuuuuuugagacagagucuugcucugucgcccaggcuggagugcaguggcgccaucucgacucacugcaaacuccgccuccuggguucaugccacucucuugccucagccucccgaguagcugggacuacaggcgcccaccaccacgcccggcuaauuuuuuguguuuuuaguagagauaggguuucacuguguuagccaggauggucuugaucuccugaccucgugauccgccugccuuugccucccaaagugcugggauuacaggcgugagccacugugcccggcucuuaaauuuuuaaaaauaaguuucauugaggcauaauuuacauaauuuacaguaaauucauccuuuuaaaguuguacaguuugaguuuugacaaaugcuguauauaccuguguaacuauuaccaccagugaagauauagaacauuucuaucaccuuagaaaauuccuuugugugucuuugcagucagccccuaccucaggcaacuacugaucuccauucugucacuucaguuuguuuaggucuauuuuuguccagaggaaauauauccuuauagaguauugacuacacuguaagacaccuguuucuaguucuggcucugccacuaaugagcauuuucaugcuauugggccaauaauuuaaucagggcugccaucuccucaagaaauuuauugauauaggugauauauacauuuucuucuaaccuaaacaucauaaaaaucuguguuuuaggaguaaaauaaaauuaauguggauugucuuagugaauuugugugugugugugugugaaaauacaucugugcguauggaguaccuguaagaaaaccuuacaacucuaaacucauacaauucuuguaaaccuguggcacuguuuuacuuuucacuuuacuuugcuuauccucucuaguuucaguaagaaauugucuauguauuguccauuagacuugcuauuugccccuucugaaugaaaauggugcaugcuuacuuauuguuuucuaacguauaguuuucuaauugauaacacuuuaacugcugauuucauuuauuauuauaaaagaaugaaauuagacugauuuuuaaaaaauacaucaauaacuagauuuuuuguguuuauuuaaagaagaugacuuaaguaucaaaauaauaaguugauggugaugauuuagauguacaauccuuuuuuauuuuaguugaguuguauuccugggccuuguccaacuucagaugauuugaaauauacuaugauucguuuagcaguagauggagccgauauuuacauuguugagcaugguugugcuacaaauauaaagguaaguguuuugcuuggcugguguagugcuuuuucguuuuuacuaaaccaaaccucuauuucuugaaauaaaacacacauuuauaguuugucaucucacagacagccacaaaauuuuaggagaaaacuuucuaauuuuuacuaauccauguucucuuccaguauuauuuuuuucaaggcauacuuucaccaguuauuuacucugaguuauuguaacauugcuuuaugggaaggauauaaaauaguagguuacuuuuaugucagggauauaaacuggcagugcuuuuaaaugauuugauuuuugaaugucuuuaggauucauacauuuauauuuucugccuggcucuugaaaacauuuguuucccacucuuuuauggauuguagugcaaaaucaagccuuguuaaguuucuacuauuucauuauuuacuucucuuguucgccuguggauuucugcuuuuuuccuuuucuccuuuuuaaaaaauugucuauuuuuguuuuuauuuuguuuaacuuuucuguucccuucuugucccuuucccauuuuuuccuuuuuuauuucuuuuuccuuuauuuucuccuuccauuuauguuuuacucuauuugaaaugaucaccuauucaguaguuuuggcuaagcuacuuaaaaauacagaaauuacacuuuuguuucauuuucuucauucaauuuuagaugggugcaauucgaguugcaaacuguaaucuccacaaucaaucgguuggggaaggaaucagugcugcaauucaggauuuucaagugagacaguacauugagcaauuaaauaauugcagaauuggacuucagccugcagugcuacggagggccuauuggcuugaagcugggucagccaauuuaggacuuauuacuguugauauugcuuuagcugcugaccaucauucuaaacaugaggcacaaagacauuucuuagaaacucaugaugccagaacuaagagguaggugaaaauguuaagaauggcaguagucuccuguucagaugaaaaaaacuagauaauuguagaggaaauucuacugagagaauggacuaagaauauuuuaaauaaagaccuaacaugauugugcugcugcaccucaaugaauauauaaggaccugauauuuaaguaaauauauaucuugucucuggugaugguguaguuguuggaaauaacauuauuuucugauguguuucuaagucuauaccauguaugccaacagugaaacaaguuuaaguuaugguccccaaauaacguuuuguaaaguacuacauuuucucucucaccacagcucuccacuuucaagucaucauucauuccuagaaaucacaguacuacuaucgucuacuguauaaaacuccuuuuaugggccuucagaacugcaaggaagacuaagaguacucaggccuauuuccuugguccuuaggaaauuauuauuauauaugauuuaaaaaguugccagcaccucuuacugaaucacuuccauuuaaaaugacagugugacuuuuuccauccccaucuuccccauuguauauuuaauaugugcuaauucuagaaauauaggaaacuauuaagaaacaaaagaaaauaaugaucauaaccccaccauaugaaauuuuaucuccaggauuuugcuguauuuuuuuaaugcuugaaaucauccuguauauacaguuuaaaauucugcauguuuguauuaaacuuauaucccaagcaucuggccacaugauuaaacauuuuauaaagauccuuuuaaacaaaugauaauacauuaccaaaaagacaaaacauguuuuauuuagccauugcccuuauauuaaauauuuagauuguuucuaaauuucccauuauaaaugauagaggaacauuuuugcacauaaaauauuuucccaugcuuucuggcuguuuccuuuagauaauuuccuggaagggaguaugaaugaguugaaaauuaagacuuuucauaugcauucccaaauuacuugccagaaauuaauuucaguuuauauccacaauggcuuuuuagcuagucccugucacccugcaccauugcuaccuuuugaguguuuucugauaagugaaagguggcaucucuuuauuuugcauuuauauauuucugaaauuaacacuuuaaaaaccacauuuguuagcuguuucgauuucuucacuugugaauugaauguuuauauucuguguacauuuauuuacuggggucuuggugguuuucaauuuuuaagagcucuuuauagaugaucaccuuuuugugaucucuguugcuaguauuuuacaguuuguuuuaucuuuuaauuuuguuuuuauuuucauauaugacuuuaauuuuaugcauucaaguaugucaguuacuaauuugagaaagccauucuuuugcuaguaaucaaauagcaucuguauuauuuuuuucuuuuccuuuuucuuguuaacauauaaaacucgaaucccucuggauuuuauauggggugcauguguauauuauucuagguaaggagauaaaucgacauauucauuucucuguuuaacaaaauguuuauuguuaccuguuaacuuucccaaaagaaccugggguccauuuuucugguuaaaaaaagaaaaucuguugagauuuuuauugaaauuacauuaaucuuuuaaauuaauugaggaagauuugacauauauccgaguaugaaagcucauguaugaagaauauuguguaaaauaaauuggauuucuuuguuauauguugugcaggaagccacuuagugugaaccaaaugccugucuuugauuagguuaggugguagagcaaggugcgaauggaacuaaggagguuacuucaggugacucgaguugcuccaaguagcucauuuagguugguuucagugcuguagcuugugaaaaauugugaagagucugggguuuuuaucuuucuuacgaguuaacaaguuagcuguuacaauuucauggaugcuggaaaaauacacaaaacuucugaucagagacuauauuacagccaaagcgguagccagucaugugugggcggguugguucccuguaucccccaaguagaguugccagggaaaauacaggaugcccaguuaaauuuaacuuucagauaaacaacaaaacacauuuuaguauaaguuugucccacauauugcauagaacaaacuuauuuuuguuuguauuuuauucgcuaaaucuagcaacucugucccugaguccuauaggggauaacguagucccagcuacuugggaggcugaggcgggagaaucgcuggaaccugggaggcggagguugcagugagccaagauugcgccacugcacuccagccugggcaacagagugagacucugucucaaaaaaaauaagauaaaaaacauaaagccccaucaugaugaauaugugcauaaaguagauuacguuauagaagaggaacacugaacuuaggguaucuuacuauuuuuauaguaaguggaagcaagccuacucuuuuccagagagaaagauuaccucaacccucaagguugcuugcucccaacacaacccugugaaauagccuggacagagcuugcauucaugucauacccagcaggaacauacagggauuccuaggacucgugacgauuugccucuccccacaugguaacucacugaccuucagguuuggcugccuuugugcauauuggauucccaggaguuuuagagaaauguauauucauuucugauauuacuggaagagcuacugaauacauaggccauuaguuccauuagauuaauguuuuuuaaaaauauggcucccaaacuaccagcaucaacaucuccuuggaacuuauuacaaauauacauaaucaggccuugccagaccucaaucagaaacucuggaggugaagcccagccaccuacaguucaacgagccauucaguugauucuaauacaagcuaacguuugagaacuagugcauuggauuaugcaaagauaggaaaggagagcuaacguuuguuguguaacuuguguaguccacauuuugcaucucaggugcuuuacacguguuaugcuauuuuaugcccacaaugaucuuuaauuagauauaucauaccaucauuuugcagaugaggaaacugaggcucagagauguuaacuugucugaaguuguagaguuaguaaguggcauagcuagaauuugaacucaggucuagaggacucaaagccaugcauucuaccaagcuuuugcuguggaaaugaaguaaaaaaagucuauuauguauauaaguucuuuuauuuugaugguguuuuaagauaucuuugcugcuugacuuaauacuuuaaaauacagaagugauuugaaauggauaacauccgaccagugcaaucucaagcucucccucaucuuaaggccugcucauacauuuuuccuucugucuucucuagauagauguuccacuucuaaguuguuucaccuuaucuuuaaugucucuauguuacuuuuugaaagauucucccuauuuucuuugucacaacaccuuguuuaccucauaacacuuaauacaauuuaugauuaguuauuauuuucuuguuuauuguuugucuuugccucuguauuguaaacuucauauggauaaggacuauaucaguuugcuuagcaugacacuaggcacuuaauagauauguucaagaaauauaaauuaaugaauguaaaaugaaggugauaauaccuauucuguuucccugugagggucuugagaauccaaggugauaauacauguaaaaaugcuuagaaaaauagacuguaaauaugaggggauuuuauuaaaguaaaaaaaaaggaauaaagguauaucucacagauuucuauuauauaauauuguuuaagaaaagaggggaguuaauaaauacugacagaucuaugagucacuuauacagaaccugaaguuuacauacauuuuuaauacuuuauuuguaguccuuauuacaaaggaguagaccucgauauuauuuuucucuaaaauauggagugguucauuauuuuaauuuuauugagaaauaauuucuuaguugcuucauauuuguaauuuuucaguguuuuaaauuugcaaugugaaauaggcccugagaugcuaaagguaaugagcuaucaagcauaaucuauacuaaugguuuuuuuggauuagugucuuaaaauuuuaguguuuuugagaauguuuacuacauuguaaaacuggacuuaaaugucugauuuuuauauuugcuuuuuuuuuaaugcuuugggcuuuuuaauguaugccguaucucuauuauuauugauucugcuuauuuccgucucacuugcucugguaagacuauauuuuuuagaaaggcaaaugauuuaaaaaaacacagugggaauaaaccuuuguguuuguguuuacuuugucauuuaaaaauauuuacaauuaacuuauauuuaauuaucuaucaaaaaguuuuucauuucuuaaugauuuuuuuuauguuguuguuuuuuguuuucuuuuggggucgguuuagguugugguuuuuauggccagaugauauccugaagaauaagagguguagaaacaaaugugguugucucgguggcugcagauucuuugguggcacaguaacuggccuagauuucuucaaacuugaagaguugacaccuuccaguagcucugcauuuucaagcacaagugcagagucugauauguauuauggacagucucugcuacagccuggagaauggauaauuacuaaagaaauucccaaaauuauagaugguaauaaaauguuucgucacuugugcuaauuguuuacuuucuucaucacuaugccauuuugagagaaauucaguguuaacucuguucaacucaauuuacuuugugugauguuaugaguaggguuuaguauaauccaccuuuguuuugcacaugacuuaacuaaagccagauaaaacuagugauuuuuucagaguuagaaguaggucugcuauucagaucuucuguugacguggguggcuuuccucacagaauuuuuucuaaauauuuccuuacauacuguuauuuuccuguagcacagcauccagauaaauacuuaggaauagcugugcuucaagguaacaauuguuucaccagcuugcuuuuauaggauaacuuuuggauaguaauauuuauacuguuggcccccauguuaccaauuauauuugcagaauaguuuccuuauaguaaaauuaaacaugucaagaaaagaacuccagucuuagaaucuuuagcauaacucuggccgggcgugguggcucacaccuguaaucccagcacuuugggaggccaaggugggcggaucacgaggucaggagaucaagaccauccuggcuaacguggugaaaccccaucucugcuaaaaauacaaaaaauuagccgggcgugguggcgggcgccuguagucccagcuacucgggaggcugaggcaggagaauggugugaacgcgggacgcggagcuugcagggagaggagauggcgccacugcacuccagccugggcgacagagcgagacuccgucucaaaaaagaaaaaaaaaaaagaaucuuuagcguaacucugcaaauacaccaguuugcuaugagcagugaagaguggcuuuaaguguauuauauuuagauuuaccuagagucuuuucuccagagacuucagaaacagauuuuuccucuggauuuuuuuaguucuguguuccuaugauucagugcaauauuuacuguuuaaguugccaugcugugaagauguuaauuguagaaaagucuugauacuucacgaauauuuagccauuuccccuuaauuaauuuaaaaauauuaauuuaccucugccuuuuaucaguacacacaaaaagauaggaaagggguaauuuuaccuucaagaguugaucagauugcuuucccauguauaggagcucuuagaggaaacagcuggacuacauauacuaaauuccuaaaugauuuuuuuacugaguaguaguaagugugcacaaguuauuuuaaggucauuguacuuuggcagguuugcuagaaugagagcagauuaucuuauaaaaucagcaaacaccaaaacuucuuggcauuuaagugauaagauagauuguaauaauuuagcugucuucuuauauaacuuuuuuacauuugaauaauguucauuuuuaaagauuuacacuggcauuuucucauuuaaucccuaagcuaccauguaaaguggauauuauccuuguuuuuuaguaaggacacugaggccugucagugagacugaguugcaugaagugauauagccaaguauggcugagaagaaaauagaaucagggccauugaagccacuuuguuguucucucuaauguucuacaacuggugcuaauuauaaagauugcuugauuuucaaagauuaaccaucacaaacucaagaaagaauauuugcagggaauuuauacugaugugaaaugaggaaaauaguaaauucucuuucuaacauugaagaaaguaaaauucuuauaauguguaauaggaagugucuguaucucuuggugauucucuuaguagugaguuguaauugccgaauugccauaaguuucuuguccagggaagcuuggaaauaaccccuacauacguaccugaguuucugauuguugagucuuccaggaauggaguacagaugcagugucaggauaaaaucaaggagggcauauggguagaauuaaggaucuauuuggaaggucagugagcacuauguuccuguaucacuuagaagcaaaucaagaccauuuuuucuuuugacuuucauugcucuauuuuacauuugugguaguagaaguaacuaauauuauauuuuagguuuaugacucuuaccccuugaaugccacuagaacugcauucuguucacagagauguuuuuuuccauuagcggauuuacuuuuuuuggcuaaaacagggaugguaggaggagggggaaguugagcaagaguuauuuuuuuuggaucuaggcagcuauagaauucucuuuuuauuucccccagccccucaguuuauauaacacaucacagagcucuuuaugaaacugugaaacaguggugcuucacucugauccuaaagucguuauuuguucauucauaaaaucauguauugagugccuucuguguaugaggcauuauucuaggcacuggagguacaucagugaaugaaaaaugauacagucccugucaacauugaacuuuuagagcaaaaggggaaaaugcuuaaaauaaguaaauccgaauagaagauauaugggguucuuuguacuauucuugaaaguuuucuguaaguuugaaaauuuuccaauaaaagauuuaaaaagaagaaaaaaauucacuguuuaugggccugggaucuauacuuauguagauauauuucuaaaacguuuaacaaauugcuauauggaauuagucacuugugcuuuuuacacgccuguaaucccagcacuuugggaggcugaggagggcggaucacgaagucaagagaucaagaccguccuggccaacauggggaaacccuuucucuacugaaaauacaaaaauuagcugggugugguggugcgugccuguagucccagcuacuuggcaggcugaggcaggagaaucucuugaacccgggaggcagagguugcagugagccaagaucgugccacuguauuccagccuggugacagagcgagacuccaucucaaaaaaaaaaaaaaaaaaaauuauacuuaaaaauggauuagauugccauguuuuuuauaaacugcuguugagauuuguguguucacuuaacccaccuuuuguuuguuuagguaaugugaauggcaugaagaggaaagaaugggaaaacaaaucagugggaauagaaguagagagaaaaacucagcaccuuagucuucaaguaccauuacgaucucauaguucauccucuuccucagaagagaacaguaguucuagugcugcacagccuuuguuggcuggugaaaaggaaaguccuucaucuguugcugaugaccauuugguucaaaaagaguucuugcaugggacaaaaagagaugauggccaagcaaggucaguauucacuuagauuuagaagccugaucauaaauaggauuauaauuguuuaaaauucuggcaagaaaaacuucuucccucuccacucccccacuuuagaaaauuguuaccuguauaucugaacauauuuugaaaugucaguuugcuguugucugauuauaaaagucauacauacauauauucauucaagauaugaggaaaguacaggaaaguguaaugaaaguggaaguuucuugucaucccaccacucagagugaaucacuguuaacauucagauauuauccuucuagucuaauggauacuuuuuguuccuccucuugccaccuuaauaguuggccacucccuucuugaaucacaguuuccucuugguuugauagcacauuucaaaauuucgucccaccuccuuggcuauuccuucucagucuccauuguccuguccuccauuucuuccuccuuucuuuuuucucuuccuuuuauagccugcccuuuguugaacauucucuccuuuuucuccacuuacucuauauuauuucccuagggagucucaauaacuguuugguuucaauuauguucucuagcuaacaucuuuuaaauguaaaacuccagccaaaaccuuuguuccuaaggccuagcuaccuucuugauguaucugcuuggauguuucauggagacuucaaacucaacauauuaaaaauggccuuauucuuaccaguuuuaacuuguucugccuuaguaaauggcacuacuacaucaguugcugaagucagaaauacugggguuauguauaacuucuuccuccagucuccuuuaaucagaggcaccugguguauuuuguuggacaaguuuuuaaaggaugugaaagaaaaaaaaccuuuauaagugcauuaguguccauggauuauggauagaagauuacauucugggguuucuuuaaguuuuuauuguguuuuaagcuaccucaaaauuuuuuggaacuaaugggggaugugaacacauauuguacuguuuugcuacuuuggguauuuuauuauaaaauuguagauuuucuuuuacuuguaaaguacaugauuaaaauuacuaaaaggauuuuuauugauauuuguuuuuaugcuuaaauuuuaugauguauagaaaaugguaauagcuuugcuuucuguuuuaguaucccuacagaaauuucaggaaacagcccugugucuccuaauacucaggauaagucaguaggucaaucuccucuuagaucucccuugaaacgacaagccucugucuguuccacccgucuuggaaguacuaagagucuuacugcugcuuucuauggggacaagcagccuguaacaguuggaguccaguuuaguagugaugucucucgaagugaugagaauguacuagacucaccaaagcagaggagaaguuuugguucauucccauauacaccaucagcagacucuaauucauuucaucaguaucgaucaauggauuccagcaugucaauggcugauagugaagccuacuuuucugcugcugaggaauuugagcccauuagcagugaugaaggcccuggaacuuauccggguagaaaaaagaagaaaaagcaaacccagcagauugacuacaguagggguuccauauaucacaguguagaagggccacuuacuggacauggagaaagcauucaggauuccagaacucugccauucaaaacucauccuucucaggcuucauuuguuucugcguuagguggagaagaugauguuauagaacaucuauauauuguagaaggugagaaaacaguggagagugaacagauuacuccgcaacaacccgugaugaauuguuaucagacuuaccuuacucaguuccagguaauuaauuggucaguuaagcacccaaccaacaaaagaaccucuaaauccucauugcaucguccccuugaucuggauacaccaaccagugaagaaaguucaucgucauuugaacagcuuucuguuccaacuuuuaagguauaaaccaaaucauuaguuuccauugauaucuugauuuagaaaaacagauuuuuaagaaguuauuuucauaauuacucucauucuuuuuagcuaccuuucugagagagagacuuucugaagccauagcuuuauguaugauaggucacagaguuauugaugaauauuagaaauuuaaguaaauuaaauugagaaaugguuuaugaguugccacugcauuaaucuaaucaacacauauucugugucugcauuauacucuaagauuaggaucaacucucucugaauucauaucuuccgugucuuaaaaauaaaauuuugaaguuguuuuuaaugauguucuuuuuauuaauucauaacuccuuccaugcaaaggcuucaauguccacuuacuugacauuugaguucuuauaauucaguaugaauaugguuauugggcauuuccguaauguauucugaaaaugcauuacagaauguuuuagguaagcuaaaaauaccucaaaauaaauuuaggggucauagccaauaugaaauacuauacuuauuugaagugucuaaaugcuuauuuaguuauucuuaauucagauauuuauuauacaguauugugaacaaggcacuugauguagaguggugagggaaauggauauggagcuuaugguuuagagguggaaaaugacaauuaauagaucaguauaucauuacaaagugagaagagucuaugaugauaaccaagggaugcugggauagagaauaacaagggguggggacaccuagauuguauugagaugaaagguccaucugaggagauaauauuuagacuuaaauuugaaggaugaugaggaauugaagauaggaggaccuaggggcacugcauuucaggcagaggcaacugccuuccuaaagcccugaagagggaaagaggucagcaugcccgagaaauagugaguggagagacuugcucguaaugaggcuggagaccuaagcaaaggcuaggucauuuagagcuuauagaccauggcaucaggaguuugaauuucauuuuaguuuaauuuauuaacucuucagaguuuuaaggaaauaugauaggaucucauguacuuugaauacuacguagaauugaauugucauuaagcaagagaggaauuggggugaucacuuaggagacugucucaguagucugugcaagaaacgaccagggcuuggacuuaaacuguauuaguaaugaugggacaugauacauggaguugaauauucucauagauuauguaggcauuugaauaauauguauugaaggaagaagaaacauuagugaaaguugcaaaauuuuguuuuuaagguuguacuguuuucuuaucuugcccaaaaccaauugcccaugcuaagauuucaaaauguccuuuuuaguacauguggaaauauguugguauaugaauuuuccaguguaaaacugaauggcccuugugcagaauaguaccugagaggauagaauuauuucaguauuuuaaauaaaucuuucuaguuugauuaggcagucaaaucucuagagaagacaggucaaggaauuaguauuuuuagacagcuucaaaaacagaacauaggccauugucagaaagacaaaaaaaugacauguauuggugaggauguagagaaaagggaacacuugugcgcuguugguggaaauguaaauuaguauagccauuaugaaaaacaguauggagauuccucaaaaaauuaaaaauagaauuccauaugauccagcaaucccacuacuggguaauauccaaaggcaauuaauucaguuuauuaaagagaugucuguacucccauguuaauuacaggaguauucacaauagcuaauauaugggaucaaccuaaauguccaucaaugaauagacagauaaagaaaauguaguauauacacacagugaaauauucuucugccauaaaaaaaguaggaaaucgugucauuugugacaauaugaaugaaucuggagggcacucuguuaagugaaauaaguaaggcacuaaaagacaaauaccucaugauuucacucguagaaucuaagcaagcucuuacagauguagagaguagaauggugguuaccagaggcuuggguaguuggggggaaaaaaguaaccugggagguaagaaaguuauuuuuugccauuaagucuaaauaacugacaagcauuuguaaagguucaauuugauuagucagguucauuuauuuauuuuccuuguuaucauuuauggauauaaaauacaagacuaguuuuuccuauaguuuaauguuucuguggcucucuuucccacuuaaagguugguuuugcuaggagaagucuaaaauuagcuugagaaaaaacucaauuuaaaaagaaacucuggaggaaagacauuugaaacacuugcuuuuaaguuucaguuauagccuuuuacccucacaacccugcuuugccauuuauuugaaucaacaaagugaaacugccaauugaauauauuauuugauuugcuuaauuugucuguuaaauguuuauaucaaauauaucaaaaucauauuagguaauucagguauuuacauauaucaguugauaucauaaaauuagggaaauauauuaaaaaucuagacuauaguauuuuauauucuagguuaucaagcaggggcucacagcuaauucuuugcuagacagaggcaugcaacuuucaggaucaacuucaaaguaaguaaaaauaucaugcuuuuaaagugucuuccuugauuaugagauggguagaguuuauucugaauaauaaucauucuuuauuugaguaugaacuuuauauuaagaauaaauuaccaaaauaauucagcucuuuucucugccauggcuuuggcuacauuuauaaguagucaguagcauuucuauuaaacaugcuguaacuuggcauaucaaaauugcugacuaauaagacuucaguaucauauuuuucauaauuuggcaaagguacaucagguaaauauauuaaaauuuucucauucaauguauuagccaucuuugaucaauuagcauuuuaguacuucuuuuuggccugucuuuggaaggucuuugggacauaaaaugucaaguccaggccaggcauggugguucacaccuguaaucccagcauuuugggaggccauggcuggcagaucacuugaggucaggaauucgagaccagccuggccaacauggcaaaaccccaucucuacuuuuuaguacaaaaaauacaaaaaaauuaggcauaguggcgcaugccuguaaucccagcuacuugggaggaggagguugcagugagcugagaucgcaccacugcacuccagccuaggugacagagugagacucuaucucaaagaaaaaaaaaaagucaaguccaauuccauaaaauuuuuaguuguaaugaaugcauguguucacucaucuuaaggaagcuccaacuucuaauucauggucuuuuuaauauacaauuugcuuguuaaauuguauaguacgccguauacuccauuggaaaaaaaacucgcugauaacacagaugaugaaacauuaacagaagaguggacccuggaucaaccagugucccagaccaggacaacagccauaguugaaguaaaaggaacuguugauauuguuuugacuccccugguggcugaagcuuuagacagguauugauuuugucuagaaauacaacuguugcuuuauacaaugauuacucugugauaugauaaguauaugugauauguucguguagaagauuguugauaguuauaaguauaugugauauauguucauauagaagauuauugauagcuauuuugauugaauaaaaaugaaaauaugcuuaaagaggucuguguuucaguuaucauuugcuacuuucucagccuaaauaauuggaguugucccuccauaucuguuggcuauugguuccagaacaccuguggauaccaaaauccacagaugcucaagucuugcaaguugguccuguggaacccgcggaucaaaaaagucaaccuucuguauugguggguucugcaucccacaaauacuguauucugaauacuguauuuucagucugcgcuugguuaaauguguggauuuggaacccacagauauggagagcugacuguauauucaaauuaauuauuauauugcaauaauauaauaauauuacaauaauauaauauuacauauuauuauauaaaacuaacaugaauaaaaaugagaauggaacauaauggaagugguguagaagcgguugggaagagaaaagggguucgguggaaacgagcuuucaugaaaaucuuccuuuuccugcaaaagcacauaauuuucuucgauaacuuauacuauuaagauucuuaugauaugucauauaaaugaagaacacaggaaaucuucuucagaaguuuguuaaagaaaagaucauugcccaguguggaacacuucaucuuggggugaagguggugauguggggauaaccucagaaauguuucccuuguauaauuucuaaauauguggcuuagacauucucauuucaauguugagcaauuguuguacauauucagauggugcuacguuucaugauauguuuacauaaacuaaguuguagaaucaacgacauuuaaauauuucauuuacuguuuuuuccccucagauauauugaagcaaugguucauugugcuaguacccgacauccagcugcaauuguagaugaucuucaugcuaaaguccucagggaagcuguccaaaauagcaagacuaccuuuucagaaaauguaagaacuuuuuaauucaaugggcauagcaaauugaauauuuaucaugguuacagaauauucaaacuugaaaaauuuucuuuacaaguuaaaucagaauauuuggacauguucuaaaagcguuuauaugucauuggcucuguaaaagauaggacauauaacuguacuauagauggaauaguaguaaaaauauuuauuuaaaaaauauauuaauagcuuucuuuguuucuuuuauuucagaagcagcuuaguuccaagccuuuucuaaagugcuuuggcccuaagugaaugaauauucuuuaggacugacaccuugcuuuucuaagacagcuguuuauguuuugauuuuccucuaugauuagaugacuuguaucuuaauauuacuuuugagauuuuccucguucacuucagugaaucaagucacuacucucauuguaugauauucuacuuacauugugguuccagccacgaagccaguugcuuagcagucauaucccagugcucuuccagagcuucuccauuugauuuucaaauuuaucuggauuauacuuagaguagggaccagaagagagaugaaagugagacugauuauuuuaguuaacuauuuauuuaauauauauuggcauuucaugugauagaguagaagagugaaaaaaagaaauuugaaaauauuccuagccaaaaaggggccaauuaucagaaaccaaguuuguuuucaagccagaagaguuuagugaucuuaaaaaaugccuguaauuacuguaccauuuuuucugucugcuucucuguaggcugauuucaauuuaauguguauuacuuuucucaaccaugaugcuaccagucuuuuuccuagcuuaucgaaaguuuggauuuuaaggugggauauaaaacuagaacgcagcuggcacauagauaggcauagaggggcagcgugaauaagugaguugcuguuguggaugauguggaaguuaugaaaagcuugugaaauaauuucacuuacgaucuuuuuaguuaucuuccaaacaagacauuagaggaacaaaaacugagcagucuacaauaggaacgacuaaccaaggacaagcacagacaaaucuuacaaugaagcaagauaauguaacaauuaaaggucuucagacuaauguuagcauaccaaagguaacaauuuaauauuuaaaaauuuuuuccugaaagaggagagcauuuugaugguguuuguccuuuucaguuaccaacgugaauaaugguagaacaguguguaauauuaaaaaaauauguuuuauuucuaugaucuaauguagaucuaauggaauguaaauaguuuacuuaagcagaauauuagguaauaguagaauguuccacauccauccaguaaaaauuuaauuaugauuauuuuaugagaaucuguauucauaagcuuugucuucacugucaaauacauagauaugccauucuuaacaguaguuuuucauuuuugugcauauuuuauguuuaagugguaauuuuucacuugucaguucugaaauuuuguguguguguuagguaaacuuauguuuguuacaagccucaguggaagaaucuccaacuacggcuccuaguaggagugugacucauguuucccuaguggcauuguguuuugacagaauugcuacacagguucgcaugaacagguaagaaauacuuuauuaaucugagccaugauuaucuugcuggauguaaaagcaagccuugaucaucuuuucuuuuaaaaauacauuucuaagaauguaauguuaaaacucagaacugguuuuggaauuucaaaucuuaauuuauagauuaguaacauaugucuuuaaaaaauuuuuacuguuucuauucauaguaucuuucaguaaacauugaauaauuuuuuacuacuauugguguauaauaguagaguguuuuguuuuuuuuaaaggaaaccuuuuagguaaauguuuucucugaacuguauuauuuaaauguuaaacauuuuacucucuuuuuuuucauaaagaggugugguugaagagacuucaaacaaugcagaaccugguagaacaucaaauuuugauagguauguucaugccacaaagaugcagccucagucaucuggaucucucagaucaaaugcuggagcagaaaaaggcaaagaaauugcagcuaaguuaaacauucaucgaguucaugggcaacuuaggggucuugauacaacagguaggauucuacaacaaauauguuuuuucuuggcauauauaaauguaagaugauuuugcagaagggaacauguuuuuuuccuuugacuauugcuacaauucgguauucuauaagaaagagaaagguauuucucccuauauugaacacgugguauuuagcuacuugucacucacauucuguacagaauagaaaauaaacuuugguaagaaaauuaagugguauggccccaaauuaggaacuucuauuucccauguuucuauuucccauguguuuuuuccaugcuauuuacuugcucguuauagaacagagaagacaugaucuuuauagucuuucuuauuuuuuaagucauucuguuuguaaaacaguguuagaaagaauuaauuguaauauuaaucaaaaccagagagucuguaaaauacagcagcaauaaggugacacacauuccucuuaaagucccuaguuagguaaaaggaaaguagagcuguuauacaucauuuuaauauuuuugauucuuauuuagcacauuuuaucauuuagaugcuuaaauguuuucagaaugucagagauucaauucagaaaaaguuagauuugcuaaucguauuugagaugauugcucugcugaaaucuuuaugugggacuggugaccaauucugaguaaacaaaugaauucccugaauuugcuuacuguauuuuauagguucugaaguuuccaugauuccugucugcauucugggucuguguaccuguuuugacuuucucaaggcuuauuuuuuucaucccaggugugaggcugaaagcauuugaccugagguuuucaagggacuuuucaugacuaccuaagaucuguaguccuaaaacuggugaaaaaugugguggcuugagugaagacacuuuuaucagcucuguaguuugcguggguaaccaauuugcacuggguauuauacagaccauaagcagaaccuuauauaauuuugaaaggcauuaucaugcagaaaacacucucauugaagacaaaacucccaacgaaauuccaagguggacauuucuguaaaaauguagaugucuuugcuuauauguacauuaguuaucugccaaagguuacuuaauaaccucauaauauuuguuacccuuauagggaggggaacuaggugucugguugugguguuagaggcuuuucauugcguacuuuuucauaauuuuuugaacuuugauacaucugaauauguaugggauuaaagacaaauacaaaaaaauuaaauaaugagaaaauuauaggaaaauguaggugaauguuuauucucugaauaagaccuuuuaauuauaaaugcaaagaaugacauuuccauagcauagaauauuauauagcuauuaaaaugauaucuuugaaaaaauuuuaaugaccugaggaaauuauuuacuguugcaugaaaaugggagccaaagcuggguuugcaaagugaucucuaaagggcuagagugcaguguacuucaaauauaaacaaguucuccuugaaugguaaauuuacauguguuuuuaauauucuuuuuguuuuuuuauauucauuagcaauaaucagagagagaaaugaaaaaaguaagauaaaguaaaacuucucucaggcacuugggguguuaauuuccacaguguaucuguaagcaguggaaccaugacaaggucuaugaugaauuguaguuauguaaaauaugucaguauaaaacagucuuuuaguaaaagcuauaauuugccuagaaaauaauguuuuuccuaaggcuugguaauuaauugaauuuuuuuuuuauuuugugagaugaugaaaguauuuaaaacuacugugaagauaaauuauuuaggauauuuuuaacuuuauauuuuuuagaguauccuguaaucauucagaaacaaauucauacuaccuuugagcaacuuguuaaucauaaaaucuucuuuucuuccucuuaggcagcauuauucuaaaaguuagcucauuugccuguuuuucuaucuuuuugacagagcacuaagauaucuuuuaaagacaaccagugugccauauguccaaauguuuguguuuuuuaauguaagcuuaugucuuuaaaaauggucauuuugcucucuuuugauaauagacauugggaccugugcaaucacugcuauuccuuuugagaaguccaaaguuuuauuuacucuugaagaguuggaugaauuuacuuuuguggaugaaacugaucagcaagcuguuccagauguaacucgaauaggucccagccaagaaaaauggggauggauaauguuugaauguggacuugaaaauuuaaccauaaaaggcaagcauuuuuuauugaauucugcuuaagguggggacaaauauguccuauauugcagaaauguuuugaacaaucauggcuuucaguaaccugaaucaacauaauaaagcagaaagugugguaucugggauuauuuaccgggggugagugccucauaccaauugcuuaaguggagcuuuuccuccauuaugugauuuccaaaguagguagagcuugaaaaacaacaauauguuuuuccgaauaaauucccaaauaaaauauaaagccacccaauuuuuugaaacuuugcaucuuugaaaacuggaucuuuggucaguagaauuaugccauauaggauauaaaaacuguaaauucuuuauucagcgaaaaauaucuacuuagaauuauauuugcuuuuuuauauauucuugaguaauagcucaaaaaggaagguugaaauguguauaacacuuuuuuuagguuuaguaauauauaauauaguaacuacuauaaauaauaguaguuguauaugccuacaauuauuuaccugauaauucagugauacauuacuuuuauagauuagggcaaagacuuggugagaaaaaaauagucuuuaugaaauuuuauacagauauuguagaguacagcauuaagacacuuauucaccauuuauaauaaaugcuuuuuuuuauuuuuauaggaggaagacagucuggugcuguuuuauauaacaguuuuggaauuauggguaaagcuagugacacagaaagggguggagugcugacauccaauaauucuucugauucuccaaccggcaguggcuauaauacugaugucucugaugauaaucuuccaugugaccggacaagcccuuccucagacuuaaauggaaauucuguuucagaugaacagguuagugacuuucuaauaguaauaauaauggugcuuuagaaaaauaacaaagaaaacuacauaugcaauucaaaauuaguuucuggaguguauuugccugucuuucccuauuuuggauuuaugauaucugcuuaaauguuagucaaaguguguuggugaauauacuacuagaauauaauuuccaaaguauaucauagauauauuuauauccaucauaguccuagcauuaugccuugcucaaauuagauaccuaauaaauauuuguugaauuaauaaauuaacaaaauuuaagagaaauccaccuauaggguguggaggauuuuagcaggcagaagucauuuuguuauugguaguauuuuaugucaguucuaaauauuuuugucaguguuugcuuauuucaguuaagaguucugaauggcaccuuauauucaacucacuuuuuauuuuuauuaugguagaauuacauggguggugaugaguacaguaacagcaacaacaaaaauauuccaaauuuuugguugaagaaaugucgugccacuaacuggugaccuggggcaaguuccuaaccuuuuccuaagucucuuuaccuguaauaggaguauggucauguuauugaccuugcagcguugugaagacugaagcagguaauacauaugaagggcuuagcucaguauguaguauguaauaagaauguaguaacuguuguucuuaaacguauguacauauauuucugaucacuuugaaaauuaggccaauuggagaggaaaaaguuccaaagaaaccacuuuuuaauuaggaagucuaguauggguaucuaguaaucauggguauacucaccuuuaccccccagauuccuagggauuuauuuuuaaaacauuuguuuuuauuuaauauguaguuuaaugaguuuaaucacaguuuuauuuuggugucuuuggaaauguuuaggggauggauuaucacuuuaauuaaggaaauuuaaaaauacaauagcuacucacuggacaaaagagcugagaaaagccuagcuguucuuuccuucuccuucaccuacuaaaauacuugacagaaauucaggcaucuuucuugaucucucagauccuacucuucuugcugaaagcccuugaauuggcuaacauuacuuucuuuggguucucugacuuuauugguccauuucuuuauggaauuuuuucuucuucuuaaauguggugguuuccucagguucuguucuuggcucuuccuuucuucuugcuauuugucuacuacucccugaugaauuucauuuccuaggucaguuccguaauuuaaugacacuucucuuucccacuggccacaccuuuagcaccagcucuucaccugagcuccaggauuguguuuaguggccuuuuagacaucaucauuuaguauuuaacagagucaugaagccuccauugcagacccuagcuccuggacaacauuucuagacacacccuaggccagaagggaacccacugcauugaaggaaaggacccaguccuggcaggaucaaucaccugcugacuaaagagccuuugagcccugaauaaccagcagcaguacccagguagcauaucaugggccuugggugacccucuacgaugugcugguuuaggugugaccuagcacguuccuagcugugguggcuauagugagagauucuuucugcuugagaaagcagagggagaaguaauggggacuuugucuugcaccuuagaugccagcacagccacaaugugcagagcacuaagcaggcucuugggguaccugauuucaggacauggcuccuggauggcauuucuggaccugcccugggucagcagggagcccacuguccugaagggugaguuucaggccuggcagcauucaccacaagcugacagaacagcccuugggccuuaagugaacaucagugguagugugacaguacuccccaugggccugugauggugguggccaugggguaaggauucucugccuguggaaaggggagggaagagugggaaggucugugucuugugauaugagugccagcucagccaugguagaauaaaacaccaaguagauuuauaagguuuuugucuccaguuguuggcuccuggauagcaucucuagaccugcccagagccuggcgaacucgccacccugaagggaaagacacaagccuggcuggcuucgccaccugcugauuguacagcucuaggucugugagcaaacguaggcagaagccagguagugguuacagggggcccugggugagacccagugcuaugcuggcuucaggucuaaccccacacaguuccacuggugguagccacaggggugcuugugucacugcaccagcuccaggaagcucagcacacacagagagagacucugcuugggagaaaguaagggaagauaauaagagccucugucugguaauccagagaaucuucuggaucuuauccaagaccaccaaggugguaccucuauaaguugcaagaacagugauacagggcuugggaugcccccuaaugcagauaugacuuugcugaccagaaacuuauaacacccaagucccuuugaauaccugaaaagccuucccaagaaggauggguacaaacaagcccagagugugaagacuacaauaaacaccuaacucuucaaugcccagacauugaugaacguccacaaacaucaaaaacagccagcaaacuacgaccucaccaaaugaauuaaauaaggcaccagagacuaaucccagagaagcagaugugugaccuuucagacaaagaauucaaaauaacuguguugaggaaagucagagaaauucaagguaacacagagaagggauucagaaucuuauuagauaaauuugacaaauaauuaaaaagaauccagcagaaauucuagaguugaaaaauccaagugacauagugaagaaugcaucagagucucuuaacagcaaaauuguucaagcagaagaaagaauuaaugagcuugaagacagacuguuugaaaauacauagaggagacaaaagaaaaaaggaaugaaaaagaacgaagcaugccuacaagaucuagaaaauagccucaaaagggcaaaucuaauaguuacuggccuuaaagagaagguagagaaagacggguggaaaguuuguuuaaagggguaacaacagagaacuucccaaaccuugagaaagauaucaauauucaaguacaagaagguagagaauaccgagcagauuuaaaccaauuaagacuaccucaggauauuuaaucauuaaacucccaaagaucaagcauaaagaaaggaucccaaaagcagcaagagaaaagaaacaaauaacauacgauggagcucugauaaaacuggcagcagacuuuucaguggaaucuuuacaggccaggagagaguggcaugacauauuuaaagugcugaaggaaaaacacuuuuaaaagaauaguauaucuggcaaaaauauccuucaaaccugaaggagaaguaaagacuuucccagacuugauuugaugaaaagguuuugcacuuaaaacauuagccucuguguuagugguuuuaaggggcuguauguuaauaaguuuuuggcauucuauuuuauauaggaugaaggagucgaaucugaugauuugaaaaaagaucuaccucugaugccuccuccuccagauucauguagcaugaaguugaccauuaaagaaauuugguuuaguuuugcagcucccaccaaugugagaucucacacacaugcauuuucuagguaaagaguuuuuaaaauauaguaguaucgcuugauguuucuuuauuuuaaauaguauacaauucuguuucauauuuuuaaaaauuacuuuucugguauauauaguauuaagguugcaacuuuuucaucauucuuacuucauauguucuguagacauuagucuuaccuuguuugacccaauuucuuucauaguacuuuaguuuuauuuuuauauguuccucugccuuagacuuuuguuuacucuuuuuaucucugacaggcuuuuuuuuuucuuucuuuucuauuguccauuuuuuuuaacauuucuuaguuaugcuuucauaauuuaucagugcucaaaaagaaaagaaauuaauuuugccugaguaaaacaaccacuaaguacaguagguaugggagauuguuuggaauacaaauuuugacacuuguuuuuauaauuuuuuauuuauguuaaaaaggcagcugaaccuuuuaagcacugcaacaccagcuguuggugcauggcuuguucccauugaccaacucaagucaucuuuaaacaaauuggaaacugagggaaccuugagaauuugugcuguuaugggaugcauaaugacagaagcauuagagguaugucuuuaaauaauacaagguauuauacaaacuuuaguauugaaaaugaccccuuauuguuaaucauuauuggaaaauaucagauuuacaaguucuuaauuacugaaugucuuuuauuuguaggcucuuucauaccuaucacucuaaaucuauuguuguuucuugauuuuagaauaaaaguguacauuuuccccuaagaaguaaauacaacaggcuuacaaaaguugcucgcuuucuccaagaaaauccuucauguuuacuauguaauauacuacaccacuaucugcaccaggcaaauuacuccaucauugaugaugcuacaaugguaaguuacugaaacuacauuaguuuuaaggaauucucuauucuguugguggaccacugauacacaggguuugagaugcaugugagaaugguuagaaauacaagucuauaggccuguaaucccagcacuuugggaggcugaggcgguuggaucauuugaggccaagagcuggccaacauggcaaaacucugucucuacuaaaaauacaaaaaauuagcugggcgugcuggcugucaccuguaaucccagcuacuugggaggcugaggcaggagaacugguugaaccugggaggcagaggcugcagcaaaccaagaucgcaccauuucacuccagccugggcaacaagagcaaaacucugucucaagaaaaagaaaaaaaaagaaauacaagucuauagacaaagagugugcucagacuaaugauuugggaguugccagcauaaagguguuaguagaagcuguagacauggaugagauuuccaggaaugcuauguuggguaagaaauugcucagggauggaauccugaagaaagccaaaauuaaaggggguguaggugguuggauagggauacaccaagugaugggaagggaaagaaagagguaggagaacuaggaaagagugaugucuuggaagcuaaagguauaaagaguuuuuaagcaagagaauaaucaccagagccaaauuucacauacaguuugaugaaacagggacuaauugaugauugaggggagaauauacaaucacacaaaauaaauacaauccaucucugccucuggaaaagcagauaacaucaugauuagaguuuuagaacuuuuaggaucucucuucuccaaguugcuggccaauaggggacacacaagaaucuuuagucaaauuagggaccaauguaucaguauuauuaauggccagucaagccauuguucaggcaagucaagaaucucuaguaaguguuggauuugaaaaagacacuuagaccuaaggcugguguaguacuuuuuacucccucccugugaauugaagacugggaaaucuacaguuuaagccuaacuugccuguguaguuauagguagagaagcuugaacagagagaauggcagguguuucccauggauggaugcucugccagauguguuuuccauguaagaggaagaggcacaacauggccgucaugcaaggcugggaaugaaaggagaggcuaguggacuugguguuccucagaaaguaaacggggugauuccugccuucuaguaaauagugcucuucaaucaaauuaaccauuucuccuaaaaugaggaaugauaggaaacaggauggagaggaguuagauauuuuucucuuucuuuaggcuaaggcaagguaauuagacuaagguaacaggaaaagagccaaaaguuucuuucuuacaaucaucaccauguggaauaaaauguauuuuaaacuauauaauuauuacugauaauacaguuaacuuucaaggcaguuacaaauucaucuaugucuagcauacuacauaaguuauaguaauuuauuuuuuuaaauguuaacacaaugguaguuaccuaaucuuugaaggaaauaauuuuacuuccucuuugcuuauugaauguuccaaguagcucaaaaugcauuuugauucuucacuugggcaaaauaaguaaaguugauugaaugcuucuuaaggaaaauuccaacuuugcacuccacaucuaguaucauauugaccugugcuauuguguuguuuuaugacacaaagaugaaacguugugccuagagauuagauucuguagucuacauuauaauugaaauccugacucucuuggguaacuuugaacaaauuacuuaacaucuaaguuuuaauuucuuuaucucuaaaugaguauuaugagauuugaauaaauacaugcaaagcacuuaaaugguaacugauauuauuacauuagauuacuucuaaccacaugauuauuguuacagagcgauggacuuccugcuuugguaacuuugaagaaagguuuaguugcacuggcaaggcaguggaugaaguuuauuguggugacaccagccuuuaaaggaguuagcuuacauagaccagcucagccucugaaaccucaaauagcuauggaccaugaacaugaagauggacuuggauuggacaauggggguggucuucaaagugauaccagugcugauggagcagaauuugaguucgaugcagguaguuuuguaagccucuauugaguacuuucuuacaccucacaaaacuaggguguuuucuuacucaacacaauuacuguauguuuuuugcuuagauauuaugcaucuuuuaucaguaaguuaauauaccucuuuaaaaaugucaagacccuuuguuuuuccucacaguuacaaauaaauuacuaauauaagcaauuuuagauauuacauacuuguuaauaugguacuugugauaauuuuaauaauucaugucccaaauuggaaaauggucauggcuuaaguauacacguaugauuuuuauuggccaaguaagugauaaugauuaggaaucuucauacugaccugauuuuauaaguucaguuuugugaaauacaguagacuucucuugaucuauccaggacaaagauaauauaaguagaacguuuugaaugaaacacauaaaccucuauuuaaaacuuguauuugucugucaucuucccuaugccacaguauuuuaaaggggccuuugucuuuuuaccugaugccugcuugauccugaauuuauguaaacuuuggggccugcgcucagccuacaauuuugucaacaaaauggcugugucagaauaaagauaguggauauacauuuaugaaauguacuugcauaccuuaagcuuugccaaagauuaauuuuuauuaucaugaccuaucauauuuauugaaaaugcauguuaugauguuuugaaaaaaauauugaaagaguagucuuagagauuuuagaacauugauauauaaaacuuuaccaagcuuaguuuuaaaaauaacuugauauuuaacaaauaaaugaguuaugaggaauaggguagauuuuauuacuuauuuuagaaaauuucaaaucuacacaaaaguuugaaaaccaguacacugaauaucccuuccaauuaucugcaaaucccucuguuaaucuaugagcagucugugcuuucuugcgcuuaguugaauugacuuuugguccgaguaucauuugcauggaauaugugaaagucuaauaaaagccguuuguuccuuucuugaaacugagugagaggauuggggugggggagaaaauaauaaauauuugucaaggaauaugaaaguugagugucauuauauaacuagaaacauaggggcugauguuucaugaaaaugugugauaaucuauugcucacuuauucuuuugaacuguuucagccacagucagugaacacacaaugcuauuagaaggaacagcuaaccggccuccaccugguagcucuggaccuguaacuggagcugagauaaugaggaaacuuucuaaaacucauacccauagugacucugcauuaaaaauaaagguauauuauugcucuuuuugguuagaguuauccagacuuacagagaaaaccuaaaauuuuaucucaaauuuaaauguuagguguccacccuaaauauucagauagcauuuucguguugaaauuaacuugauuuguaauuucaguguaaauauuucuuugaaaauuguaucaucaguaacugcuguugauuaaggaccacuauaacuaccaagccuuagagcugucuccaguuuauugaauacuguauuccauaaaaucccaaauugaaaauguugauaaucuuauaauuaucaguuuuaaugagaagccuuuuaggcagugugugaucaauaggugguuuggguuagacuguuuuaugauuuuaauuuuuuugguuuuaugaauuuaauggaugcuugauaagagacauauagcaaagugguuagaguaccaccuugcaagccagacugccuugguuugaaaccugccccgccacuuaguugcucucugacugaacaggcuuuaacuguacgucaguuuccuugguguaagauggagauuauaauaguaaacuucugaagaggguugugagaaauaauugaguuaauucaugaaaaaugccuagagcaauaucugacccuuaaugaaucauuuguuguugguucuuuauuuuuugcuaguuauuguuguuggugguucuuuauuuugugcuaguuuacuuuugugagcacugaaaaaguuaaaauuuuaacuuucuggccaggcgcggugguucaugccuauaauuccagcacuuugggaggccaaggcggguggaucacaaggucaggaguucaagaccagccuggccaagauggugaaaccccauuucuacuaaaaauacaaaaauuagccgggugugguggcaggcgccuguaaucccagcuacucgggaggcugaggcagagaacugcuugaaccugggagguggagguugcagugagccuagauccugccacugcacuccagccugggcgacagagcgagacgccaucucaaaaaaaaaaaauuuuaacuuucuuugaaagucuguguauagacucacauugauacccagaaucuguaaaaugauaauuuugacaauauuaaauaaaaauuucuacacagaacaaaguaauauauagucaugcaucacuuaaugacagggaugaugcauucugagaaauggaucauuaggcaauuugucauuguguaaacaucauagccuguacuuacacaaaccuagaugaugguacagccuacuacacaccuagacuauaugggauagauagccuguugcuccuaggcuacaaaccuguacagcauauuacuauccugaaaccagugggcaauuggaaugcaaugguguuuguguauuucaacacagaaaagauacaguaaaaauaugauauuauaaucuuauggguucacuguuguauacguugccuguaguucacuuaaacuguaauuauguggcacaugacuguauuguaaacagaacaguaagacacaugacaaaaggcuaauuuucuaaaauauaaagaucucauccuuaucaguaagaaaaaagccaauaccaaauagaaaaaaugguuaaaugauauaaacagguaguucacagaaaaauacauauacacauacaaaaauguuuucuuauaauuaaagaaauguaaauuaaaaugagauuuccauucucacuuaucagauugaaagacuaaaacuuuugaauaguguacauuguuggugaagauguaagaaaacagauacucauacggcauugaugagaaucaaauuggugcaaccucuuugaauaacaauguggcaauaugugucaaaauuuagaaggugaugcucuuuuaucuaguauuuccauauugaggaauucauucuagagaaagucauagaugugcgaagacaugaugagucuaagaacguucuuugcagcacuauuuauaaaaggaaaauaguggaaacaacacaaaugacuaaucauuagaggacuaauaaacuagcguacacugauauagaugcauacuaugaaaucuuuuagaugaaguagaucuguaaguggauauggaaugaucaccgaaguacacugauaaaguauaggaugauaucuauuuguguguuuaaaaacggauaaauauguauguacuuauauaggccuaacugauuuauguaaagauagauaagaaacaguuaagagagucucugggaaagggauccaguauauuggaacacaggacuuacuuucuauugaauagucucuugggcuuucaaaguuuuuauucuguguaaguauggcucuuuuaguuaaaacauucaaugauaguuugauauacuuuaaaaagaagacugaacuauugagcuuauuguuuccacaguauaguuagacgcuugggacacuuuaaucugucuuagcuuuuuuuccugauggacaguuuuuucaaccuucugaaucauauuuagguguuuuccuguuaaagcuguucauuuucagaauuguuuugaacauucuuuugcuauggguuauuaaaguccucuaaaaaugugaaauuccaaaugcuuaguuuccgaucuuugcuuuucaagaucuuuuuugccuguguagucuuuuuuuguacuguauuuuaaauugaucggccauucuaaucauagaugugacagaagauagaaaucgaaaaauucuguaauuuuuaauuuuuuuucauuaauuguggaaagucuuuuuggcauuucagagcucuccagagaauuaaaucuuaacacaccuugauuauuagaguaguaggaaggauaauuuaguguuaagaauuugaagguagaaguuagguagauggguuaaaaaucuggcuuuuuccuuaguaaguauguaagggacuuuucuucauccuuuaggacagaauaucuuaccuuggagaacuuaaggauuaaauaagcuaauacaugaaacaugcuuaucaaguguuuaauacguugugaguguucuuuuacuuccugugucaacacccuuccuccaccuuuccucaucuaagugaggaugacugggagggcauugaaaagggaauaagcuuuucugcuuuucagaggagguuaagacauuuaagggcuucacagcacugguauccauugcgucaacauuucuugcuauuagcaaaaagccucuaguuuccuuccagguagaugucuauucugacucccguaaaaaaaugcagggaagguugcugaagauagauagcuuuucuuucuuuaguuucuuugaguaccuagacuuacuuuugaugggaucagucauguuacagauccuuuguguguguguguguguguguguguguguguguguguguauaguaaguuuuucuagggaauauuuuguguaagggauauugugucuagguaucaguuugcugguucaguaaauaagcagugauauaaauauuucaggcuacuguuuuucuuugcuacccauaugaauguucucuggcacuuccacaaacaugcuauguauaacuuucugaaguuucaauauacuauuuacugcuccuuagguaugaauagugcuucauuuccaccaucuauuugauauacggugcuaugugguuuuaugucuugucaccagauucccucaucagauuaagaagggaauuaaagauccaugguuaaaauaaguggaugugcuucauuauaauauugauaauaaaaguggcucuuugucuuguacuauagaguugcaaaacauuuuuaccuacauuuaaggacguauguaaaaaggauucaccacaauccuaguauacaugaucaguuuugguauuaaugugcaaaguagcuagcaguuauagcaacaguaauaguaauagugguuguaguuaucagcugucauuuuuauauacauaagaaauaacccuaaguuacacuuucuguagggcauucacccauaucauucucugagcuauaccaguggagacacugccacugauucuccagugcauguuggacgugcugggaugccaguaaaggacaguccaaggaaggagagccuacucagcuaccugacuggaagcuucccaagccugcacaaccuccuggaagguacuccucagagaagcagugcugcugugaaaaguagcucccuaacgagaacagguacguccucuagauuugauaauuacauguuuauauuuacgggggaauugagaugaaacaggacuuaaguuuaguuagauauauacuuugguaguacaacuaaucucucauaccuuaucuuugagaaaaaauuuuaggaauccauuguucuguuuguaacuuuucggagucuucaugcccuuaguuugcauuuuuaaauugcagcucugacgaaugucaauguaggcauuuggugugggguacugucuagaccagcaacauagaauuuccccuguuauaauaaaaauaagcuauuuauuaaugcauuaauauccaaauaccaacauuaugcagugagaauucaaaaccaucugcaaacauacauuuuaacuugauucuucaaauauagguauauaaauuacauuuuuuugcuccuuaguauauaaauaauauuauacucagaaacauuuuauuuucaggaaauacaguagccacugauauguuaucugaacaucccuugcuaucugagccaucaucugugaguuucuauaauuggaugucaaaugcuguggguaaucgaggaaguguguuacaagaaucuccuguuacaaaaucaggacacaauagucuucccacagguauugaguuaucacauuauuuugcuuaacugucuuaaggggaacauauaccaaaaucuuauuuuucaggggauggguuaaaaaucaaacaaguacuguuugguugaaauugguccauuuauauuuuuaaaugccuuugauaauauuguaauugagagaguaguaagcagucacucaguguucuuguugaaaggcaaauaugucaaaugugagauuguauauaaagaguuuaaagcuuccuuuuaauguggcugguuuaagugguaaaugaaaaaaugcaaaguguaauuacaacaucauauacuugauauuacaaaagauaguuuuaauuuaucuagaucccucugagaccuaauaacuaucauucuaaaccuuuaguuacuuaacaaauauuuaauuaaaucuaaaacaguauguauguauaaggauagauaaggaugacauguguucugaaaaguuaauuucauuuuucacuaauaaaucaugucuguaaaauaaccuaaaaguaugcauuauuuuuuuucuuuucaauuuaaucagucuugaaaugguacuacuauacaggcuucaaaaguuuacccugcuguacacuuuuauguguuucuauuccccaauaauuuacauuuuauucuuaaaaauuuacuccauuagguguugcacccaaucuuccaacaauacccucagccucagauuucaacacugucuugucuagugaccaaaauacuuuggaugggacacauucucagcauagcaccagucaggaugauguggcagguguagaagaagcaaaccaaggguuuccugcuguucagcuugcugaugcacaggugagccagccugcuuuuuccuaauuauaauaauaccuccuuaggcauugcuuagcaacuggaaccuccaauaguacgcaccuuggaauucuagugaggcuauaccuuaccuaucugccuacagccuucaugcaaaacaggaggagccuuuaaaaaguacauggcuuaguuauaaaugcaaauuaauuaucuauauguaaucauuaaauagaagagucucauauaguaaccuuuuuguuauucguaacaaauuggcuaagcaacaugaauagauaaucauacccuaugguuuuuagugcuacguuaagacuuuauugagcgagcaguggggaagcauugaugauuuuagagcagaggaauaaaguaaaaaacuauagauguagaaauauuauaugaguagcaaauguauuaaauugauugaaauagagaaacuaguguugaaaagaugaauuauugaaauaguucacccagugguaaugagacucuaggcuuagauguuuauggcuuugaaaagguaaaugaggauauggugaaagucuuauuuaauugcuuaaauauggcgaauaaagagugaaacccuuuaaaacauacucuuugguuugaacagccagcaggcaagugugagagugggacgugggugagaggaggcaucauuuuuucaggauaaaggugucuugagcauauuuacauacagcucucccucaguauucaagggauugguugcaggaccaacccccuacccacccucugauccgccacccaggauaccaaaaucugugguaugcccaagucccuuauauagaauggcauauauuugcauacaacauacauacauccuucuguauacuuuaaaucuuuucuagauuacuuauaauaccuaaugcaauguaaaugcuacgucaauaauuguuacacuguauuggguuuuuauuuguauuuuuuaauuguuacauuguuauauuuuauugguuuuuacucccuaauauuuucaaugugguugguugaguccuuggaugcagaacccuuggauauggagggccaacuguacuugagaaauuaggaagcuaaugaucaaaaauaaaggaaagaacgguuagcagauggagcaaaaucaguagaaaaaugagaaguauuggaauuuagagucaguuaaagagagagcugucuucccaagcacacacaaaaaaaugaggugaccuaggacaaucggaaauacaggcuuggcucucauuguguaaauggcacuuguccauuuagauauuuuuuuguuguuguuuguuuguuuguuugagacagagucuugaucuauagcccaggcuggagugcaguagugcaaucuuggcucacugcaagcuccaccucccggguucacgccauucuccugccucagccucccaaguagcuggaauacaggcacccgccacuaugcccagcuaauuuuuuguauuuuuaguagagacaggguuucaccguguuagccaggauggucucgaucugaccucgugauccaccugccuuggccucccaaagugcugggauuacaggcaugagccaccgugcccggccuagauaggguuuuuuuaagcuucaggaaaagaucacuaagguagaauguguagugaaagaggaggcugagaaaagcacuggauagcaccuauauuuagaauguagaagggggaaaaggaaccauguggcagaggaugaguagucagagugauuuuagugcucuagcauugaacacauguaguucuuucuguucagguuagugcugugucugaaauucaguuaacuagagauuuaaccagaauaaucuaucuccauaagcauguaugauacuuaaaauguaaaggaaguucucugaagauaaauguuaaaugacuauuacaaccaagugcuuccauuuaaaaauaggucagauauucauaacauuuauaauguuuuuauauuaacacaggaaguugaaaagucaacuuugugaauguaauauauguuuuuuuuuguaaauggaaacacaauaggaauucauaccuguuuuaaaagcaagagguagaaugauuuaacuaauucauaauuuuauuuuccuuguacuuucagacacuuagguagggucaaggaaucuguguccuuauuuauuauuauuaauuugaagaugaguggccuauaauagguacuaaaaauauuaaauuuuaaguaaaguuagagucaauuauaugagaccauuuuugcuucacacuaugauaauaauaauauguacugagguaggguaagaaauaaaagcugcauuuuccuacauguaauuucuacaguaaaugauaagcuguaaguugagcuaauaugaauguuuaugucuuuuagguuguuuucaagccucuucugagucauacagggauccagucacaggauacaaugccauucugcuaccgaauguacuuuggagaacaccuuucauuuucagggacuuuggacugccucagagcagauauuguggauucagacacagccaaagagagaaaaggcaaaagagcaagaaggugucuuuugcauuuuuguguauaauuuugugcaagaauuauaauacguuuguuuuuuaacguuacuuucguguaauccaaauaaggaaguaauuuuuuuuuuuuuuuuuuuuuuuuugagacggagucucgcucugucgcccaggcuggagugcaguggcgcaaucucggcuuacugcaagcuccaccucccggguucaugccauucuccugccucagccugccgaguagccgggaccacaagcgccugccaccaugccuggcuaauguuuuuguauuuuuaguagagacgggguuucacuguguuagccaggauggucuugaacuccugaccucgugauccacccgccucggccucccaaagugcugggauuacaggcgugagccaucgugcccagccaagaaaguaauuuuaauauguuaaucagaagauaauuaccuuuuaguaaaaguaguagccacauuuucuuauuaauaacuaguugcauuuaugaacagauuaugaggccuauuuuuaggcauauuuuugaaccacguuagcacauagaugagggucauauauauugauauaugcacucaccauuuauuuacuuggcucuuguaauaguggaauuuuuaugaucuuaaggguucuggguugacgugucagguaguauuuuguauuagaaauagggcagaagucauauugagagucuagccaucagaaacaaauagaaauguagcaugguaaaaguuaagaaccaucuuuugcuguuauuuuauauugucauggaugguucuucaguuucuuuaguguuuaauaggaaauaauauacccacuaacaggauuugaguaauauuuugggaacuugggauuuuauuuucagugggacuuaaaucgauagaaauaguagaauauggagauaaauggcauuuaugacaagagguuucuguaguauuguuucuuucauccuuuuuguguuuuugcaaggugguaaauuaaaauacuugugucugauauauagcuaaguaaaauauauuuuucauuugaaauauuucuauuuaaauuuuaaauaauuuaacaaaaguucuugcuuuucacaauagucuuauaccauaacaaugaccguacaagcugaaacuacaaggcaauuuuaauaaucggugaaaaaaauuacuuuugugacauugacaguauuuguaaaaacauuaaaaauguucuuacuauuuauuauaaauguauagggaaauaaaaaaaaguaaaacuaauauuuaguacauuggaauuuaaaauguuagaaacacugagaauuagacuauuuuauuucuuuuuaaaaacuuaucaaagaguaguuugaaugguccuguccuuaugauauaacauauaauacagaacaaggagcuuuugugugccuugguaaaaugucgaacuccuuuguauguauggaucaguuuucagcauuuuauccuuugcacuuucaaugucaugaaauaaucuuugauucccuuuacuaugaaguuuuuugucagcaucacuuccucugggauaucuucauccuuucugucguggccacuuuccucuuuaugucaauaauuuugccuccacugaguuuuucuggcuagauauuaagagugucucaaacaguggaaguaucaacauuuccauggucagcuguuucuucuauaacaccguucaauugaucuucccuaccaauaucuucauuuuuaguuucuuugcugcauuuucaucuuuguuguccaauucccucauuugauuauucauuuuuguaaaauguuauggggauuuauuacagagagagaaacaaggaggcaacacaaguaacuacauauugugcuuucugugcaugaagugaacaauagguaugcuucaacuaaucacuaucacugacacauuuugaagugaugugacuagucaaugaucacagugcucaucuguuguuuuguacugacuugugggcugaagagcuagcaguaaguuugugcuuuaugcaguuuucacaguaagucuuuguuacaaauuuguaucgccuuauugggagacuuguuauuuaaguaaaccacaguaacugaaauuuuaaaauauuggaaccaucaaauccagacccaaaacauuaauaccuacacauacucucuaggguuaaaauaucugagcuaaauuuauauuuaaauuugcaagagacagcuuucauacaaauauauccauuuauauauaaauauguuuauauguauacauacagucuauguuuucauauauauaacuagguuauauauaauucaauuauauauaauuuauauguaauaggcuguauauagagauauagauuauauaaauaaaauuauagcuguagccuauuuauuggccuaguaaaaaccauauaauacuacaacagacuagaccuucauuugagcacacaaguaagucuguuuugagugagagcuucuuugagugauucugugaacuucauugcguuuggucuagcugaacuugacauuccuuuuaauuuuucuacuaacgcgccagcuccgaugcuccacauucuuacaacuaacucaugaucagcuuuuauuucucagaucuccuguaauuccaucuuaagcucuuauuuauuuggagaccuucaccgcaauauacuuuucccagccauuaauuucaguauugucuggguuuuuuguuuguuuuuguagcagauuguucauucugcugauuguuguauauuaguuugggguuacaguuucuuguaugaauauguauaacucuccuacuacuuuguaaagccagggcaguuacuaaacauuuagcauugagucuggcauguaguaaguccucauacaugauaguuucuuugucucuuugcugucucuaguaaaaguagcugcacguaucagggacuuauauuuuaaaauuuuaauuguaacuuuggcucugcagugcccaugucaggcuuuuacuugucaggcaaauuguuaugguauaccauuuucuuuuucuccuuuauuugaaucuccccucuuuaagauuuucuuacuacccuuacauguuuuagauucuuguuuuugcaauuguggauuauuuucaucucuuuuuagucuucuccugucuguucuaauucucaaaaucaaguuuuuccaucucugaccauaugccuaguuggcauugauuguacacuuccugugaguuuaugcauuuacauaaauuacacuacaauggggcauuuuucuuauuaauuaagaaauacuaguauucauuaaggaauuauugcucuguaguuauaaauucuuuaaguuaaaugcaaaauaucaaagcagcuucugauuuuuuucuuuuuguuacagaaaaaacucccaugucugcacauucauagugugcauggaagaagagggaaaaauaccuuuuuacaguuuuggugcuuggggcuuauuguuauuauugguagcugguuuauagaaauuugagauauuuuugacuuucuauauuaaaauuuacuauaauagucuuacaugaaaaucuuuagauaagcaggaggauuugccaaaauaauuuuuuuaucagauuuuaagguuuuguguguauuucuaauuuuuguuucaauugcuuuuccugucugcuuucaacuuagcaugagggcuuccuaucuaauaucaaauaaaauuauguuaaauaugaauauauuagauacagauuguaggagggggggaugguuaagugagguauccuaauugaucuauacuuaacucuaaauuccaauacucuacggcaauaccaucaaaugacaguaaaaguuguguuaucacuucagugaaaucauuucuuaacauaagaagacugauuuugacuuacuaguuuuagaauaagauuaaguaagaagacuuaaaggcccaccuuugaacucauaaaaagccuggccuagugaaaaagcauauuuuacugguuugcuugcuuaaaauuauuuaagacucauauuuuaccuuggagaugauuuugccuauaaauuaauaaagauguauguuucuggaaaaauggaagaaaaaccguguccuuuuuuuauuucacguuuuuaggcaaggccaugugaaucuuccuccacuugaguucaaaccagcauuaauguugggaaccuuuagcaucagugcuguuguaauggaaaaguccgugugcaccccucagaacucuaccagugcccuuucuuuucaugaucucagcaagcgguauuauaacaccuuucacugcaacuuuacuauuuccugucagucaauaagccagcauguagauauggcuuugguucgucuuauucaucaguuuagcacaaugauagaugacaucaaagcaacucagacugauauuaaacuuagcagauauacagccggaucugcuuccccaacaccuaccuucaaaaccagaaaacaucgggacuuucguucaucugacuuuagccgcaguucuagaggaagucuuaaugguggcaauagaguaaauaaugcaaagaacaaacggaccaacaaugagaauaacaaaaaggaaucucgaaacaagaauucauuaggaagaucugaaagaagaacaucaaaagugucuaggaaagguucaaaagaugugguggaucacaugacuauucauauggaugacucugauucaauuacagugucagaacaaagugagccuucagcugagugcuggcagaauauguauaaauugcuuaacuucuauucacuuaucuccgauccaacaggaauauuggaaaagucuucagaaacauuuggaccagcagguaacagacauuuuuauguuuuaaaaauuuccauuuacaauaacaauaauaccaaagaagcagaagacuguucaucauguuuucuuaaugucguaaguggauaauugaaauggagagaaauugucuaucaccagggaaauaaaacaguaauggaauucagauauccugccaccacauuucccaaccuuuuaaacucuuacgugguauguucuuaaaggauuuagacagaccugauuuaaaauaucuggcucuacuauucacuuucaguaggaacuuggaaaaauguugaagaaauuuuuaaucauuuuguuggggauuaggagaaagaggacugguugggaaugugaaggaaagaaagguaagacaauguuuggaauguccuuccauuuuucagucuucguaucuaaaauuguauauuuucauuuacuuauaaaggaguucggagcccuacagagccaacauguaaaguuguguuugagaaugaacaagacaacagcaguuugacuaagacucagaggaaacguagcuugguaacuucugaaccucagcauguuacucuaauaguguuugggauuggcauggugaaccgcacacaccuagaggcagauauugguggacuaacaauggaaucagaacugaagaggauccauggcaguuuuacucuuaaggaaaaaaugaaagguaugaaugauuuuucuaauaaagugcuauguauacauaauaauuagugcuacuucucugaagaaaaccacugccaugucuccaaaauuccuaauuggcaaauuuuuuuuuucccagaaaaacuggacuucccaaauucugagguaccaagaacuuuguuguaauugaguaucagugaauugaggcagcuuugaugucuaaauauuuuagcacauaaauauugagucgauguaccuauacucggugacauuuauucuuugucuuuuaauaucaacuacuaagaugucucuaaaggcugaacauuuuaccaaaauaaugaaauuuaugaaaaauuugcuuuuguuaacuaccauagaaaucuuauaaucuaauacuaaguaucucuauaaaaagaagucccuuuaguugauauaaaauuuccuagguuagugaaaacauaccauuuaucuugagaaugauuacacaagguaugauauuuugucaaauccaggagcccaucaauuugaagaugcccuauuauuuuauguaucacaaagaaaauaccauugccagauauggucagaugccauugauuguaaacugcaucccacuuucagagaugcuaaaauaaaaaagcaaauguuucuuagacucaguggauacagcaauaaaguugcagggauucucuugcagcaaugauuauauaaaaccagugugguuuuuuuucugguugugaaaauaaccugacagauuauauuacaugagaaaaggaaguuaucaaucaccauguguuuuuauuguuaacuuuaugauucagaaauuuguaaggucuaaucaaaacuuacuuugaaccuacuuuuuguuauauacccuucuuuaccuguuuuguacccuaaacauuuauuauuuacucaaaaaacuaauuuuaaauuugaggauuauguacuugggauugacauggugaaccacacacacgguucucugaaaaaauuagguggacugacugcaaauugcuaagaaaaauacaaauacaucagccuucccuggaaauaucacaaaggauauaaacaauacacaaaugcucagaugucuaaguugauauuuaaaaaaaaaaaauugucaguuuuuucaucuguuuagccaaaguuaagaaugaccauacucauuuauggugagaauuagagaaauggacauuuucauucacuuuuaaauugauauaaauugguuuaaccugccugaagguuaauuuaauagcuuuuaucaguagucuuuagagcacauuuaucuuuugacucagcaauucgaggucugcaaaccuagguauaagaaaugaucagaauugugugaaaagauaucuguacaaagaagccgccaagugucuggcauuaaagaacugguuauuuuuauaaacaaacauaugccaguuuacaauuuacccauuaaaauuauacugcagaauuuauuaauaugaacaauaaugcuaaaugaaaaaaguaggcaaaauuguuuaugugauuucauuuuuuuaaguaauuaaaauauuuauacccuccauuaaaaucacaggaauuauauggaccaagagugcugguuuaugugguuucuuuuucuuauuuuuuaaaauuuuccaacuuuucugcaguaaguauuauuucugagauguaaaaugccauuaggcuauguaaugccaguagacuaaugcaggaauggcauauugaaguguauauuuugcauuauugcaauuuugacauuuaauauguauguauguauuaaaugcagagaaaugaaaaacuaaggaaauuuuuuaaaaaguagcucugaaauaguugaacaaaauuuaccauaacuuuaaaauuaucuuuugcuacugaauauauuaugaauaaaauguaauuuuaauaugaaaugcaaguaucuuauauccagaauucaaauaaauauuuuuucucauauuuaagauguuuuacaucaaaagaugacugagacuugugcuacugcucauauuggugggguuaauauugugcugcuugaagggauuacaccaaauauacaguaaguaugucaguuuuuauuuucuuacacuuauaguuuuagacaaaaauggaaauucuuuggauaaacaugcugaauuuugagguuuguauauacaauaucaguucccagauacugagaauccugucguuaagaauaucaccaaauaaaauauuuuagaaaaauacuuuuugucuuucuaaaauuggugguauauaccuucauuccuaacuuccauucagcagagcaguuucauguuaacuacaaaacagccuuugauaauuuaggucagauuuucagaauuugcucuuucuuaauauuaugacuaguuaauguugugcuacuguuauccuguaacacauccaacaugacuaaauagaggauuugguucagcguuauaaaaauuaaguauuaguccuagauugacuaagaaguaugauauguuacagcucuaauaauauuuuaaaaaucugaauaaugugauagcuaccuuggggaauauuuccugaaauggauguuuauuaaugggccauagcuuucugcaaugaguuuuggcuaaaaucagcaacucagacagggcccauucucaagacuuccuggagacugucugagguucgguuuggaccuauaaguguagaacuaaagacuguauauuucauaauagcugccuacuauucagaucacauuuccuaagaagucuuuucaagaaaggcaggaaauuccggugguugugagagaugagaucuuuuuuuguucauucaauauaggagaagggguuauuauuauguauuaauuauaauauuauuaagugccuacugugggccagaagccucaccuagauuauuauauuuaaucuucacugcaauuuugggaacuggaguggucuuaucuaccuuuacagaacaauaaauugagguucagaaagaucaacauagugccuaaaauacuuaauauagucaguaagaagagaugccugaaucuauacucuuucgaccuuauaaugcuucuacugaaagucauagaccauggauuccacgaauccuucauuuacucuaaauuugaaguaccauggguacguuaccuucagaaaguaaacuaaauuucuuuaggugucccaugaguuuuauuuacucuauccuccuggaucacuucucuucauuauuuguuaucucuuaagagaagggcuuccaauagucuuuaaccuugcaaaacauaauguuuauagaacagauuuuugguaaaguauuauauagcugauauuucuugcucuuuuuucccccaaguaaagaucccuuaacuguuuuauuugaaaaauaaaaauuauuuauuaguuacugccaaacucguaguguauucuuugguauuucauuuucaauugcaaugaagaggaaauggaauggaaaaaaaugguucaaaugguacuuuaaaggaacauuuuaagagugggaaauuagaaaagcuuuccagaugauuggucauauuguaacuaauuugugcaugaauguuuauuugccuccuuuuuguuuucccacuuucucuugacucuucaucuguagacuggaggauuuuccuacaucuccuacaaguacagccaaacaagaguuucuguaugucauauuauucuuuuucauggcuuuguaauuacuguaguauugaauaguuuuuaaaauauuuaaauuuuuuucauggcugugaauuauuuaguuauuguuuuguagcuguaauauaggcccuuuuauauaauagauuaaagcuuacugguaaucaaggaaaacacagguaagggcugcuuuuuugguaauucauaccuugucuguuguuguugacaaguuguaacacuguaguuguguguugcuugugccuuuucagacauguuacuauuaaaauuucuaugaucaaaguacuuaauuuuugauaugauaauggaagcuuaaaaaauucacuuugcaagaaagaguuuucacuaauuguagaaauaauuauuaaaacacuaacaaaacaucuguacaucucagccuuauaauucuguauuuaagauggggagaguugacuacucuguuaauagauuuucauggccuuuacuauauguaaauauguguuuaguuucauucaauagaugaaugcuguucacaucuagagagccauuugcaugucagcaccaucuggguguguucuggcuuauguugaaacugaacuugaaauguugguguuaaacaaugguuuuaauuauuauaauguuagaaaugauucaaaauucaguaaguagcagcauuucagagccuaccuucaugcugacuaggccaauuccguaaacuacugccuccacccucuggugaucaucucugagaaauagugucuuguggaagaaaaaaguguauuucucuaguaauugguuuugaauuuuauguaauaccuagauuuuacuguuuauaaacaaucaagaccucugauagagcuacuguugggcuuugcguuuauccuaauaaaaguuaaaugugaugaacugguucuucauaucuuugagacuauaaauaauuggcaaauuuucugcagcccagcagagauuauguaaacuggccuguaauuaauaugaaauauguauuuuguguauuuugccaaauuuagugauugucaagaaucauuugcccauuugaaggaucacauuuauauuagaaguuauuggagccaaggugggaggauugcuugaggccaggaguuugagaccagccugagaaauauaaugagacccugucucuacaaaaaauuuaaaaacaaguuagcugggcaugguggcacgucucuguagucccagccacuugagagacugaguugggaggaucacuugagcccaagagguccaggcuauagugagcuaugauggugucacugcacuccagccugggcaacaacgagaccccaucuuaaaaaacaaauaauguaugugaggguguguguaugugucaaacacuacuucauuauggcuucuacauaaauguccuaucauauccuaucuguggaauuccacaguuguagugguagaagucauucuuuugcuuuacuucuuucugcucuuucauuucacaaauauuuggcaagugucuauuuuaaucucccaggaacuguucuaggcauuggaaagagcaaaagaaaucaagaaagaucguaucuuugcuuuauaucuguacuaguaauuaaaggauaccaauucuuaauaaaaguaauagccuugcucauuaugaaucagacuuuuaucauuuguuuaccacucacugaaaaugaaaagcagaaaaugcaaguuacacuuccuccuuccuaucaauuucuuguaacauaguggaugauuguuauucuaauuucuuugacucccuaauuagauuuuaagaaguauagugaauauuuuuucuuuucauauuuaaugucuguauagugguuguacagaucucuaaaauaagguggagaagaaaagaguucugaauggggguaaaauaaaaaguggaauguugugugucuguguauguaauauaaaauaucuuguucauguuuuuacuuacaugugagaauauacuuauuuucuucuauagauucuuccuauuaaagaaauuaaacacuauucagugcaaauagcauaaaauaaauauauuaauauuuuuagauaacauuguuucuucauuguauaaacacauaaaaauuuuuaagucguuucaguucauucaguuacgagggggcuucacaaacuguggaaaauggaauuaaagauauaaaaaaaauaaacuuuauuucccaacauaagguccaucaaguucaagacacuuuucuaaucagugauaccagccauuuauuccuucgcuaaugaacagaggggucccaugacaaugcagucuuuuucacauuauuaacugaagagaaaugcgcacccuuuaauuuuuuuucuuuuuaauuaggaaacaaaaaaagucagaaggagccaaauuaagacugugaaauggaugccuacugauuucccaucaaaacucuuaacagaauugcucuuguuugacaagaggaaugagcgagagcauuguugugguggaggacugguaaagcuuucccgagcauuuuucuaguaaagcuagggcuaccuuucugaaaucacucucuuaauaagcagauguuaucauucuuuggcccucaagaaagucaacaagcaaaaugccuugagcaucccaaaaaacuguugccaugaccuuugcuuuugacugguccacuuuuaucugcuccccaugcgggagugcaguggugcaaucucagcucacugcaaucuccgucuccuggguucacgcaauccucccaccucauccuuccaaguagcagggacugcagguaugugccacuauacccagcuaauuuuuauauuuuuucuagagauggguuuuuuccuuguugcccaggcugauuucaaacucccgagcucaagugaucugcucaccucacuuucaaaguguugggauuacaggugggagccaccaugcccagccaugacugaucugcuuuugauuugacuggaccacuuccacuucuuuguagccauugcuuugauuguacuuuaguuuuaguauuguacugguaaagcuauguuuaaucucccauuacaauucuuugaagaaaugcuucaggaucuugaucucacuuguuuaaaauuuccauugaaagcucugccuuuguuuggaguugaucugggagcaaugguuuuggcacccaucgaguggaaaaguuugcucaacuuugauuuuuuagucagaauuguguaagcugaaucaauugaaguugucuaugguguuggcuguuguuugugcuguuaauuguugguccucuucaguuagacacaaagaagauaaaauuuuuccuugcaaauugauacuugguuugccacugugggcuucaucaacauugucuugucccuucuugaguuauccauuuguaaacugcugauugcuuugggauacuauccccaaaggcuuuuuauaaagcaucaaugauuuugcuauaauucgcccaaacuucaccauaaacuugaugcuuguucuugcuucaauuuuagcagaauucauguuguuuugaugggggcucugucaaacugauaucuuauccuucuugguacuuuaaagaagaucauguucacauguuucaacaagugaauaugaguuuauuuuggugcaaaauaauucugaaaucuacacuuuuuuuguaauacacauuuuccaugaacuuuuugaagaccucucaaauuuauaaguauuuuucuugcucucaauauuuuuucaaaauuucucuuuacuuggcuguuggcuguauuuuaauagucuucuuucucuauugauagaacuguagugaaauguaguauugccaagucccaagcccucuacagugcccaaagagggcugaagacaaacaaugcugcuguguucaaaguaggagcuaucaguaucaacauuccucagcacccugccaccuuacauagcaugaugguucgaaguucucaccaacuaucuaaacaaaucucagaccuaaucagacagccuucuacagcguaaguuauuuuauuuguucacauucugugauuccauauacuaccucaggguauucuuugcugcauuaacaaaaguuuggagggagaugaaggguuacuucuaaguaucgaccauuauggacaguggagcaagaggagaguagccaauugugaucaugugagaaugacuuuugaaagcauuaaaguacagugucgucagugcaauugucaguguuccauauugcauaaacaaagcuuaagagauccuagagauuuguggguauuguaagagguacuaauaaaaagcaaauuggugaauuccaggaccaugucaauccuuguuuacuuugaauucauuggaaacuuaugacugcacagauuuaagaaaguauagcaguggucauuuaugucccaaggcagcauuugaccaugccacauaaauguuuuaaagggcaguaaauuugagcauuaaccuuuauucccuaugucuguagccuuuguucauacaucuucacugcugagccuuauuccuggucuccaaaaacuguaacuaauaaaaauacgugguggcaggcaucuguaaucccaacuacuugggaggcugaggcaggagaaucgcuugaacccgggaggcagagguugcagugagccaagacugcaccauugcacuccagccugggcaacaacagcgaaauuccaucuaaaaaaaaaaaaaaaaaaaacaaccauguaaaagguuaaaaauuugucuuacguuuuauuucccacauccuauaagugggaaaacauuagugugucuuuugaaggugccucaaagcugauuuuuccaauuguuuuaucuaaaucuuuaauucugauauaauguuuaaucauggcugaagcuaaguaguaaaaauuuaaauguuuuuccucugaauagaaauauggaauccagaguguauacuuaaauuuuaguuuuaaaaugcuccaaggagcuuuuccuuacuauaguaucaguagaguguaguaguugaaaaaucagacccuggagucagacugauuggguucaaauccuaguuucagcacucuagcuaugcuuccucauuuugcaacguggagacaauaguaccuacuuauuaaagugagauaaaugagacaaagcacacaaugcacuaagaacaguaccugccacucaaauuguuauuauuguuauuguugggguugguguugucauucuuaacaguaguaguaguaguaaugucaauaauaucaguaguagcguguaauaguuaagugauagaauuuggaaucagacaaaucugaguuuaaaucccaguuuuguaauaaugauaagaaucaccuucacaguauaacauucuaagagucucauauuguuauuacuuuuucuugucuacuuuuccauaucaucauuguucaacagguguuuuagaaagucugaauaugaucugauauuggaaagaaaacaucuauucacaguauauauuugcuauuuuucacugagaaauccagugauuuucuacaauaaaaugguacguccuguguuuauuuuuuaauuauuuuuuuuuugcuuucuagcccacagccuguaaaagaagauauugcaaccccacuaccuucugaaaaaaccccaacaaguguuaaucaaacuccuguugaaacaaaugaauuuccucagcuaccagaaggcuuagaaaagaagccuauuguucuuaaauucagugccauguuagaugguauagccauuggagcagcacuuuuaccaucucugaaagcagaauacaagaugggaagaaugagaagucauggaaugacagguaauauugaauucugaauucacucucuuaaaauuuaugauuuguuugagaaauuaguaauauuuugauaaaaagguaaauuugguuuuauagauauuauaaguaauuuugauuauaacauuuaaaguucauuaaugauguucucuagucaaguaaaaauaucaaucccccaccccaaaaccuugaaugaccagaaugaacucuuuugaacuccauaaaauuauucaacuauggaggccauuucuccaauuuaaacuuaaguugaagaaauuaacccauuucuacaucuauuaaguuuuuaauagacugaauaacuugguuuauuuucacauuggguucauuuagcucaaaucaggggucauuugauuucuucaaaacagcuaauucuguaugguuuugugacccuuauauuaauauauccuaucucaaaauuccuugcuuuuaauauuuaugaaauauaucauguauacaaagcauguaaauuauacauauacacauuuuaaagaauaauuaaguacugugaacucaccaacccacaauauagccuaagaauuggcacauuaccaauacuuugaagccuucuuuggccgggcgcaguggcucacaccuguaaucccaguacuuugggaggcugaggcggguggaucacccgaggucaggacuucaagaccagucuggaaaacauagcaaaaccccaucucuguuaaaaauacaaaaauuagcugggcaugauggcaggcaccuguaaucccagcuacucaggaagcugaggcaggagaaucgcuugaauccgggaggcggagguugcagugagcugagagugugccacugcacuccagccuuggcgacagagugagacuucaucucaaaaaaaaaggcagucuucacuuuucauggaauuacugcuaucaugaauuuugucuuacccauucuuuugcuuucccauauaguuuuaccauauauguauauacucauaaaugauuuaaaguuugcuuuuagcuguuuugaacuuuguuuauauggaaucucacauuuuuuaacuaggaauuuuuuuauuugacuaagagcuccuuacgaguuuauauauauaaaaugccaguugaugguucuuuuuuuuugcucacuuuaccauugagucauuuguauuuuucuugauucgcaauaauucuucauaaauucuguauauuaacucuuugauaucauguuuauauguugucaccuaguuggaggcuuaucauuuaacuuuuucuuuugaucagcagacauucuucauuuucauguaauugaauuuaccauuauuuuuccuguaugauguguauuuuuauguccugaagaaaugcuucucuuccuaggauaauaaaaauauuuuguuacauuuuuucuugaauguuuugaguuuugcuauucauauuuaaguuuuuaaucuaucuuaaucaauuauuauuguucuuagauuuggcaugggauaguauauaaccagugaucauuguauauaaccagugaucauuguauauaaccaaugaucucagcaucacuuauugauuauucuuuuuuuccaguggcauauaauccagaaauuugucacaucuuaaguguuauuuuuaaugugggagucuaguucugaguuuucuauucugcuucauugaucucuuuguaccaguaucauguugcugccugacuuuuucuuuuucaggaauuguccuggcuguuuuugauccuuugcucuuucauauacguuguuuauuuuuauuuuuugagacagggucucacuuuguugcccaggcuggagggcaguggcaugaucacagcucucugcagccuugaccuccucaagugauccuccagucucagcccugugaguagccaggacuauaggcaugcaccaccacaucuggcuaauuuuaaaauuuuuuguagagauggugggauuucacuguguugccuaggcugguguugaacuccuggccucaagcgauccgccugccuuggucucccaaagugcugguauuacaggcaucagccaccaugccuggccucauaaacauuuuagaaucaguuuaaguucccugaaaaagccuguuuagacuuuuguaggaacuuaauugaaucuauagauuuauuuggggagaaaugacaacuaaacaauauucaaccuuccuauccuugaguaagucuuauuucucuguuguuuaggucuucuuuaauguuuuuguauaaaguuuaaaauuuuucuacuuaaagguuuuugugcgucuuuuacaagauguauuuauuuauuaagauaucuagguaucuugugguguuguagcuauuacaaauguuaucuuuuguaaaauggcauuuuucuaaacuguugguagucuacaagugugcuugaugcuuuuuuguuaaucugauacucagcaaccacauuaaacuauuauuaccaauaaguuguagauucuuaggaguuuuaucuauagacagucauacuguuuaaacagcaaauaaugauacuuuuguuucuuuccaacuuuuauuucuuuuucuugccuuauggugcuugccuugucugauuuucuuaaaggaaucaacauuacaugaauaagucugaugucugcucuagguuucugcuaucagguuaagaaaauguacuuauuuucccacugugcuuaagaguuucuaugaagaauuauugguaaauguaaucagauacuuuguucuguaucuaaugaaaugaaaauguauugucuccuuuauuauguuaacauaauuuaaaaauauauacauauauaugaauauaugcagacauguacauauuuauguaaguauguguauacaguagucccugcuuauucauguguuuugucucuucacguuucaguuaccuauggucaacuguaguccaaaaauauuacauacaauaagguauuuugagagagaccauauuuacaaagauauuuacagaacuuuuguuacaguauaacuguucuauuuuguuaucguuguuauuaaucucuuguugugccugauuuauaaauuaaacuuuaucauaggaguguauguauaggcaaagacauauauacgguuugauacuaucuaugauuucaggcauccacuggggaucuuagaacacaucuuccccaaauaaagggagauuacuguauauguguacucccaucucuaccauuuuaggcuuucuuuauuaagaguaauuuugcugaacauuuagaacuuucuauuaccagaaagagaagcauuuuaaaguaaauuucuagauuuggcagagucagaagucuuaggccuucagauauuagaguccagggcugacaauaaguuacacacauuuggucacuuauucagggcacccaugaaauacagggguccacagaaacagcaagucgaaagccagauaggcaguuuaggaucuuagaguaaacauauuguuaaauauccagagagauaagaacccaaaauucuuauugaaauugaaggaaagggauaaaaacaguaaaagaaugacuauacuaguaauaagggaugacucaguaacugaggccuaggauuauuucaaucuuggcguuuuuauuucaaucuuggaguuuuuauuugguggugugcuagcaauaguagugguggcagcgacagugguagacaguccccaccccuugcaguuuguaaaugauagucaaggagucucuugguuggaguagugagaggagaucagggcagucaugacucaucuggccauucacagaugccccaguuggugagugagcauuuuucuguuuuuggcuaacucauucuaggugcaaacauuaguuaaugaauauagugaaugugacauauaggagaugacccuugauuaguauuuugaaaaaaagagaauuauuucuggcucaguugagagcaguagggauauauaauaaauuauauauguaggcuaaauaggcaauuugaugauguuugaguggagagaauugguaaugugcagaagaauaucaguagauuuugcugguuugaaaggagcauguguauguacauuacauguguaaagggcaauaacagaucuugauuuuaauaaggcuucuccuuaugcccucauaaacaguuggagaaauauggacugaauaauaguaaagcugguauauuuauauuuguuugaauaauuaugugcuagauuauugauuuaaguguuuaaggucaauaguaaacuaaaauucauaacauauccuuauuugauauauggucccaugaauaauuaugaaggucaaagagacauauguuuguauaauuuuauacuuuaugaauguuucagugaguacaauuuaauugauuuggcaauuuuagcuacuuccacacugaaucaggaucaguagacauauuguuaacuaccuacuauucucugugaauaaagcacuguguggacuggggaaauuuuuuuaacuugauuuucuuguuacaaugcuucuguaauaagggcacuuuauuucuguucuaccuucuaugaaauaaagaacauaaguguuuuucuagugccuaacacacugccagucuuaauaaauaauacuugcuuaauaauacuggcuuaauaauacuugcugauugacuugcguauuuaaagauagggaauauuuuauaagcaacuuuaaaauauccuuucauauauuucaagauagguuugggaauauccaugcauuuuucuuagauacccuuuuuggaaaaagugaggaaugaaugagugaaugaacacuagcacaaacaauaacuuuucucauuucuuacaggugcacagacaagauuuacauuugagcugccaaaucacagauugcguuuuacuucaaaaguuucugccacagauaugucaaccauuccuccuucugccagucuuaaccuucccccuguuaccaugucagggaaauauauaauggaagaacaugauaguuauucggaucagguguggaguauagaugaacugccuucuaaacaagguuacuauuuacagggaaauuaucugcguuguguggcagaaguaaguuuacuuuaaaauuuucuuacucuucguaauuuaggagucuucaagauuuauauguaccaaaauauguaguaauccaaacuuuuaagguaaagucuuaaaauaauuuguuuucacagaagaauucuauaccaaaucaaguguguguguguggguguauguguguuuuugugucuguuagucugacuacccuguaguuuuauuuacacaugcuuuuaaaaauauguauuaguuauguauuccaucucugcaauauuuucauaguucaaaugauuauuaaaagcaaaucacagcuaacauucauuaugugcuuuacacgcauugacuucugcagugcuuaaguaaauccuaugagguagaaauauuuguucucauuuuguaagugagcaaacuaagccuuagcaagguaacaaauucauacagguauacauaauuauuaagauaaucuaaaggucauauugaaagauaaauuagacuuacagauuaauuucuuuacuaagguuaaguugaaaguagcauaucuaauuccaucauaauuuuuucacuuuguauagcugucaaaaguuuaaaaagcauuuggacacauuuuucauuugauuugugguaagcaggucaucuguuauuuuccuaauuugauauaaacuugaagcggagaaguaaacaccuuuccuuaagucucgagaccuagcuaucaacugagagaggcaggagccacgccuuaguggucugccuucagacacacugugcugugucucagcuuaccuugucaguuugucaaaaacuguugcaacuuuaugaaaaagcaaugugcuauuuguuuuauaaauuuuguucuccauaaccugaagcaucuauaagaaugcucuuuggguucucugauagaaauauuauaacugcgggggacauauuuaagucugauuuaccuucuuagguccugcuugcccuggaagcucucuaagaguugggauuucuguguaugaaaaacaaguguacgaaaaaauaguguucagauucuaacaagucaaagauuuaacugaaaauauuuuaaaguguaucccacuuguacuuucuacucugaaaacuaaaagccccaagcucuauuuuagcaauacuauuauuaauguuccauuuaaaagaaaauacacgaauacaguguauuguauaauuccuugcuaauacuagauauuagaaagguauaaguuuguaacgagguggaacacaaucccaaauuuaguaaaaaauguauuuaauuucaaccauuucaaagacucuaaaauugcaucccucuuagaguugccuauuuuacuauggccugaaauaaacauaccugaaaauaguuucuggcaaauugguuuauuaacuaauuaguuuauuaacuaauuugccagaaauuuaauaccuuguacuaaucauaggacacaaauuauaggacacaaauuaaggacacaaaccuuaacuggguaucucugaugauuuacuaauucacucaaauguaagccugagacccagaauuuuguugguuuuuauucauagcugcauccuuagcaccuaacaugguacauagaguagacagucauuaaauauauauuugauuaaauaaaucuauuuuuggcuggacauaguggcucacaccuguaaucccagcacuuugggaggccaaagugggcggaucgcuugaggccaggaguuugagaccagccuggccaacauggugaaacccuaucauaguggugggugcucguagucccagcuacucaggagccugaggcaggagaaucgcuugaacccaggagguagagguuagagugagccaagauugcgccacugcacuccagccugggugacagagcaagacuccgucucuaaauaaauaaauaaauaaauaaauaaauaaauaaauaaauaaaucuauuuuuacuuaacucgucuaugauucuaagaccacaaaaguggccauuaaaaugaucauuaaaaguaaauuuuacucuaggagaaaauuuaauuucaaaauuagcaaguuaaauauauaacuucgauuugcuccccagacuucucauaccuuauuaacuacuguuauuaaaaaacaaaaaacaaaacccauuuugggaguguacuauaauaguuucuggccaguaacguauuaggaacgcugaauauuuuuaacuuuucuucaauauauugauuucaaaucauauagagauaauuaucucuuuuuuccucaguuuagggugauuuauguaagaaaaaaguguaaagcuaauguaaucaguguuaaucuaauaugauuuugucuggcagguugguuccuuugaacauaaucuuacaacugaucuucuaaaccacuugguauuuguacagaaaguguucaugaaggaaguuaaugaaguaauacaaaaaguuucugguaagaugaucuaguaccuuauaguauagguguagguuuuuauucucauugagcgugugauaucccauauaucugugguauaaguauugauccagcauuuggauauaguugucaaauaacuccuaagaaacugugcauuccuuuuauggcuuuuccaccuacaguguuugcuuaucauuuuugucauguauaauauacacauuuaagauucauaaacuucagaaagcuccuuuauguuucacccugaaaaaagaaaagcuuacaguaugucuauuaaccaaauuaaucauacucauuugggaacaacauuuagguaacuacuaagauuucaaccuuuugucuauaccagaugauggcuauaugcuggcagcaugguaaauugucuguggaaacccucauuauauuuuugcuguuccucaagaauagcuuacaguugagcuuagucauugcucuacauuuuucacaagcuaaaguauuagggaauuagggugaaaaguugacuguauaacaguucuuaaugcugaguauuuuuuguaugaauguuaucauguuaaaagaauuuuuaagccacauccauaaauuggcaucaaaaggaguuuccuuuaugcucauggauuaauucauucauuuaacaaauuuaugaaguaucuagguauucacuuacaauuuugaugaguucugcgaaugacaagaacagggugcuaugagucugugucauaggaaaaacuacuguagucuaaaggaucagaaaaggcuucucagaagaagucguaucccaaaacuuaagaaugaagccuaguuuggcaagaaaggagagguagagaggacgcagacagagcauauguaccaguauuugauaagggucugaaggaggacagugcuccuuggaugaaggaacuacauuauguagcagcugugugagcagccaguuuccuugauucuccugggcugguucugguuguaucugaggucaggaagcuacuuaaugaucauauugaggaagcccugcagagcuguagaauuuuacaaguuaggucuuaaaagaucagaucauugguagccauggaguuuuuccaaaaaugguugacuagaaaucauuaaggaagaaauaaauauauaguaaaauuccuuucugccacugaagaagccuuaacuugggaaacauacagaaguuuuggugugucccauuuaccugguaaaaaucacauuaugacauuuuuuaugauaggaaaguuguuaagacuauaucaagcugguaaacuuaugaguucuaaagaauacuuucaagauaguuuuauuacugaaaaaauauaagccaggcaugguggcucacgccuguaaucccagcacuuugggaggccgaggcggguggaucauuaggucaggaggucaaaaccauccuggcuaacacagugaaaccccaucucuauuaaaaauacaaaaaauuagccuggugugguggugggcgccuguagucccagcuacucgggaggcugaggcaggagaauggcgugaaccugggagguggagcuugcagugagcugagauggcgccacugugcuccagccucggugguagagcaagauuccgucucaaaaaaaaaaaaaaaaaaaaaaauauacacacacacacacacacacacacacacacacacacauaauauuauauauauuauauaacauacuauauaauauauauuauauauaauauauaauuaaaaaauaaauagacucuuacaugaacuaaucuuguauuucuuaugguaaaaaaaacaaguguuguggaguuccuaguaucagacugucaggguaagccucucuuaagguaguuuugauuaaagagaaaggcuuuucuuaaccuuuagauuguagucaggagaugaaaguauaucccaaggucuaugaagaauaagauggacaaagaggacuggaaauuaauauuucuaaccaugaagacuugcuguuuacugugagagaaucagaugauagugacaaaggaguggcuagaucugcuccuugaaccauuucuuucugacuuuagcgacagccaugaaccuugagaaaauagcuaaaguguaaaucacauaugauuuagcuggccacagggccugauggcgcauaggcauucaguuauucugucaagaccaaggaacauaacagaauauugagagggaauacuuugaacccuuguagcucaaauuucucaguacucugaucucuguauugcuucuucccucucccauaaucuucaguuauuuuccuaauuuuuucuuauauucuucaugauuuuccaucauguuacguuuaguguuaggacauuuucuguuauguaggaagacuaauguucauaacaaucaucaaguuuguuaggaaaauacuuuuuuaaaaaauugauuaccuuauuuguccacgaaggacuuucaagaaugcuuggguuucagaaagauguaaguaagcacugaucaaguaaacagaauagacuauuuuuaauguacagccaucuuagaagcauauaaggagguuaccaucuuagaauugggccagguauauauuuguugauaaagacauaaaauacuauggaauuaaugcaaauaauauaauagcgucucuuaugguuccauaagcuaaaauuauuguuuaguauguuuugugaaugguugagcuuuugcuuuuaaauuuuaaacuuuucuuucugaaacuagauaaaagguauucaagguugugauaggcaaacaaaacaaauaggccuuuaaggugugcucaugcaucaaacaguuuuuuuuuuuuuuuuuuuuuuugagauggagucgcacuuugucgccaggcuggagugcaauggcgcgaucucagcucacuucaaccucuaccucccggguucaggcgauucuccugccucagccucccaaguagcugggacuacaggcaugcaccaccacacccagcuauuuuuuguauuuuuaguagagacgggguuucaccauguuggccaggauggucuugaucucuugaccuugugaucugcgugccuuggcuuccaaagugcugggauuacaggcgugagccacugugcccagcccaucaaacaguuuuaucuucagagauggauuaucaaaugaacagacacaaagccauuauuuuuuuuguaaaacaacuugaguauaagaaaaauuagacagaugugaauauucacaaagcucuagacauuuagaguauuaguauuacaauauucaaagugaaagugugcuaagcaauguaaaaaucuaagauuauuucagauauguuaaaacauguauuuguuuagcaaaaugauuuaagagaauaugaaaaagugaaaggcuuacauuuagacugucagaagaaaauaguauguuaacgaaguauacuguuagguaauauaacaugaagauuucgcucuacuuaaguaagugaaaauugaaaaagaaucugcuuuuaaccaagugaaaaggauaauuaaaaagcaugaauauuaagaaaauggaaauugaugagauauuugccugguuaugagaauaacuagagaaacaauaagccuauccaaccaacuuguauauaaaucuacagguccaaaugagacacaucgaaguuauuuaaaagaacuaauggagguccucuugguaccucugagaauguacuucaguaaaucauggguaucaggagaggucuccaaacacaggaaaauugggguaccuaacuuaaagaaggguuggaaaggagccucaaggaacugauaccccaaaggcuaauccaaaaaaaaaaaucugauguuuuuuacuuagucuagucucccuuaggaaauaaccuccuuaauaacacuucuuaagucaugcuaauacuuuucagaaaaauaugaggcuagcuauaauuucaaaauaauuuaagcaaguuaauagcuuaaucaaguauagaggauaugaugcacuuaaacuuauauauuuaugccauacuaugaaauaaaacuugauugacacaaaaguaggacagugggccauauuuauacuaugaaauaaaacuugauugacacaaaaguaggacgguagaagcagcuguaguccaggacucucacacagaggaaugaaaauggugagugaauucagcacuuucaacugacguauucaguuucuugcuuugggagggacuaggcagacagcuccaccacggagggcaaggaaaagcagggugaggugauggcccacccaggagcagcaaaaagccagggagcccccacccccaggcaagggaggcuaugugugacugugugacccugccagggaaaaccagguuuuucccacagaucuuugcaaccuguggaucaggagauuccccuugugaguccuaccaccagggccuuggguccgaagcacagagcuguguggagucucggugaagcagccacucgggcacgcacagagacacaggaguuuugcauacucuggcccugggaauuccagcaaggcaggaaauccauccaugcauuccccuaggaaggaggcugaauccagggauucaagcagugucauuuuauagaccccacucccagggcaacucacaaguuaagaaccacuggcuuggaauuccagccggccaacagcagaaggcuggagacugccugagacggccccugggagagcugccaucucugcaguucaagucagcaggucuagccugccugcuccagggaguccgggcaguccagacugggaggaguucccuacaagacagcacagcugcuaugccagauuguggccagacugcuucuuuaagugggacuccacuaugccagauuguggccagacuauuucuuuaagugggacuccgguccaucccuccucacugggcagggccucccugcaggaauuucagcaacuccaaccagaguuauacauacagaacucacagaacucugaucucucccugggggguggggcgcugccaucucugcaguucagcugacuuagccuuuucagccugcuggcucuggagagucccgguggucuggaugaggggcguuucccccaggacagcacaccugcucugccaaggggcagccagacugcuucuuuaagcagguccuugaccccauucugcccaacuggaugagaccucccaacaggggucuccagacaccuccuguaggaguguucgguccagcauuaggucgguaccuggggcagaggccccagaggaaggggcaggcugucaucuuugcuguuucacagccuucacugauaccuggugcaggaggaaccuggugcaggaggaacucagaacacuagagucuggaggggacccccagcaaacugcagcagcccuacagaagaguggccccacuguaaaaagaaaaauaaacagaaaacagcaacaucaaccaaaaagccccacaacaaccccauucagaggucagcaaacucaaagauugaagguagauaugcccgcaaagaugagaaaaaaaaucaauccaaaaaugcugaaaacucaaaaagccagagugucuguucucucccagaugacugcaacaccucuccagcaagggcgcaggacugggcugaggcuaagauggcugaauugacagaaguaggcuucagaagguggguaauaauaaacuuagcugagcuaaaagaacauguucuaacccaauggaaagaagcugaggaucgugacaaaacauacaggagcugauaaccaaaauagccauuuuaaagaggaacauaacugaccuguuggagcugaaaaacacagcaggagaacuucacaaugcacucacaaguaucaacagcacaauagaccaaguggaggaaagaaucucagagcuugaagacugucuuucugaaauaagacaggcagaaaagaauagagaaaaaagaaaaggaacaaacaaaaccucugagaacuaugagauuauuuaaaaagaccaaaccuaugacugauugggguaccugaaagagauggggagaauggaaccaacuuggaaaacauacuucaggauaucauccaggagaacuuccccaacugagcaagacaggccaacauucgaauucaggaaaugcagagaaccccaguaagacacuccacgagaagaucaaccccaagacacauaaucaucagauuauccaaggcugaaaugaaagaaaaaaaguuaagggcagccagcgagaaaggccaggucacuuacaaugggaaacccaucagccuaauagcagaccucucaguggaaacccuacaagccagaaaacauugggggccaauauucaacauccuuaaagaaaaacauuuccaaccuagaauuucacaucuggccagauguacaaagaagagcuuguaccauuucuauugaaacuauuccaaaaaaaugaaaaggagggacuccucccuaacucauuuuauaaggccacuaucauccucauaccuaaaccugacauagauacgacaaaaaaagaaaacuucaggccaauaucccuguucaacauugaugcaaaaauccucaaaaaaauacugacaaaccgaauccagaagcauaucaaaaagcuuauccaccacaaucaagugggcuucauccccaggaugcaagguugguucaaaucaauaaaugcaacucaucacagaaacagaacuaaagacaaaaaccacaugauuaucucaauagaugcauaaaaggccuuugauaaaacucaacaucccuucauguuaaaaacucucaauaaacuagguauugaagauacauaccucaaaauaauaagauauauaugacaaacccacagcuaauaucguacugaaugugcaaaagcuggaagcauuccccuugaaaacuggcacaagacaagaaugcccucucuuucaccacucuuauucaacauaguauuggaaguucuggccagggcaguccggcaagagaaagaaaguguauacaaauaggaagagaagucaaauuaucuuuguuugcagaugauaggauccuauauuuggaaaaccccaucaucucagcccaaaagcuucuuaagcugauaagcaacuucagcaaaguugugcaaugugcaaaaauugcuagcauuccuauacaccaauaacaggcaagaagagacccaaaucaugaaugaacucccauucacaaucacuucaaagagaauaaaauaccuaggaauacagcuaacaauggaagugauggaccucuucaaggagaacuacaaagcacugcucaaggaaaucagagaggacacaaacaaauggaaaaacauuucaugcacauggauaggaagagucaauauugugaaaauggccauacugcccaaaguaauuuauagauucaauguuauucccauuaaacuaccauuggcauucuuuacaacauuagaaaaaacuauuuuaaaauucacauggaaccaaaaagagcccaaauagccaagacaauccuaagcaaaaagaaaaaaguuggaggcaucacacuaccugacuucaaacuauacuacaaggcuacaguaacuaacacagcauuguacugguacaaaaacagacacauaggccaaugaaacagaauagagaacucagaaauaagaccacacaccuacaaccaucugaucuuugacaaacuugacaaaaaacaaacaauggggaaaaaggguucccuguuuaauaaauggugcugagaaaauugguuagccauaugcagaaaauuuaaacuggaccucuucuuuacaccuuauacaaaaauuaacucaagauggauuaaagacuuaaauguaaaacccaaaacuauaaaaacccuagaagaaaaucuagacaauaccauuuaggacauaggcaccagcaaagauuucaugaugcaaacuccaaaagcaauugcaacaaaagcaaaaauugauaaaugggaucuaauuaaacuaaagagcugcuucugcacagcaaaagaaacuaccaucagaguaaacagacagaauggggaaaauuuuuuuaaaucuacccaucugacagauguaauauccagagucuacaaguaauuuaaauuuacaagaaaaaaaagcucauuaaaaagugggcaaaggacaugaacagacacuucucaaaagaagacauucacguggccaacaaacguaugaaaaaagcucagcaucacugaucaucagagaaaugcaaaucaaaaccacaauuagauacuaucucacaccagucaggauggcuauuauuaaaaagucaagaaacaacagaugcuggcgaaguugcagagaaaaaggaaugcuuucacauuguuggugggagcguaaauuaguucaaccauuguagaagacaguguuggggcaauuccuaaaaaaucuggaagcaaaaauaccauuuugcccagcaaucccauuacuggguauauacccaaaggaacauaaaucauucuauuguaaagauacaugcaugcguauguucauugcagcacuauucacaauagcaaagacauggaaucaaccuaaaugcccaucaaugauagacuggauaaagaaaaugugguauauauacaccauggaaugcugugcagccacaaaaaggaaugagaucauguccuuugcagggauauugauggagcuggaagccguuauccccagcauacuaaugcaggaacagaaaagcaaacacugcauguucucacuuaucagugggagcugaacaaugagaacacaugaacacagggaggggaacaacacacacugggaccugucagcagggacagcaggagggagggcaucaggaagaauagcuaauggauacugggcuucauaccuaggugauggguugaugugugcagcaaaccaccauggcagacauuuaccuauguaacaaaugugcauauccuacagaacuuaaaauaaaagguugaagaaaaagaaaagacaagaguagccaauauuagauacauagauagaucauaauaguagauucauauuuucuucagauuuguuuugauucuuauuacuuagauaaaauacuauuuauuauuuaauugaauaaauagauaagacagcuaacuuucaaaaucagaaucauguaguuuuuauuugaucaccuauuguguuguguuuguuguaucucaugaugauuccuaaauaaccugcaccaugcucuugccuauagagccaagagaaacuaagaacucucuuagcuuaauuucacccauccuguuagaaagugucaagauauacauagagucauaaacaauuuuuuguggcaguauucuaacaaauccucaaaauguagacauuauuucauguaauauuuuccucucuauaacauaacucauucuguauuucagaguagaaauugcaaccguaucuuagaaaauauaaaagaagauucuauaauccauuccauaguuacuuauucagaacuuuaaaaacauaugaccccaaacuaggugauaagcaaauuacaaagauauguggguaaaaauuuuacuuacuucuguuuggaacauuagguauuuaaacauauaauaauaaaaagauuuaaaugaauuuuugaugaaugaagaaguuaaguaguauaaauagaggauguauugaggcauaggaaugauucgaacugauacuugaguaaguucuacuuuuugaugauugagcgccuuucaagagagggacaguuugaugaaagaaaauagcaagaaacugggacugaaagacacauuuauuugcugagaaugagauaagaauugugggaguaugaggaaaauuauaaagacuugcaguaauuguugugaggaguguguuggagaaaugacagaagaugaagaguuggaucaccaagcaacacaggugcuuuauacuugcguucaggaaaagacugagggucagcuaagguacugcuugcuaggauccacauauauauggcccuuccccuuaagaauuauuuaauuagggaaauugcuguguagauaaauuaauauacagaaauguguauuuuuuggcaaacaucauguaggaaggaaggaccaaaugcugauaaggguguaucagaaagaguuugaauaaacaaaaugugauaaagaacuuagaagagcacuuggcacucaguaagcacucaaauauuagguauuagaauugauaaauauaugcacucaguaagcaaauauuagguauuagaauuuacacauaacuacuuaggaguaaaaaauaaauaagaacagaauguaagugaggggauaaagucauuuaaggaaagugagcucaaggaacagggauguguaagagggcugugguuuggaauucaaaugaugaaaagcagagacaguaguaguuuaauguuuuggaaauagcauugaaaaguaagcuaaacaccaucugcugcuggaucaaaggaaugaaugaauuugagauuuccaaauaauaauggcaacaaaaagccauaugcaaaugaaguuagagaaucagggaaaugaaaagcauaauguaagacaguggaagcuuuccugguaguagauggaagauagagacaacagggaugggaagagguaguugauagcuggguugggggggugauauuauauacacacaaauacacacauacauauauguauguauguauauggcuguagguaggguuaucaaugaugaggcuuagguaagggaugauuguagauuugaguuaggaggcagagagaaguacuuaauuauaaguugaagaaaagaaaauguaaucuguaugcuguauauuuuagagaaggauagcucagagaggaaagguacaagcguacaggcaggcacuaaguguacaaagacacauauaaucuacaaagacacauauaguuuauucuuccaaaauacaaauauauauuuuuuuauuuuguuuuugagucagucucugucauccaggcuggaauguaguggugccaucucggcucacugcaacuucugccuccuccuggguucaagugauucuccugccacagccucucgaguagcugggauuacaggugcccaccagcacacccagcuaauuuuuuuuauuuuuaguagagaugggguuucuccauguuggccaggcuagucccgaacuccugaccucaggucauccacccaucuuagccucccaaagugcugggauuaaggcaugagccaccgugccuggcccaaauauauguuaauuaauauguucugguauaaccaauccacaaauccuuaauacuuuacuuuccaucucuucauccauaucauucuuucauucccuuucugguguauuuauucaucuuuauguacaaaggucuuuuuuggggggccaaguuauguccuugucucucuuuucuuggucuuaucuuggauguaccuucuguugacuguugccucuauuuucuuccuauuuucuguucuaguagaaaacuaaaaaauauuuuuaucauaguacuaacuaaauagauuuuugaccccuaaauuucaaaagcccaaaaaagauuaauuucuccuucaaaacaaacaaaaucugcuuuuuaucuauuugguucuuaguuauuuugauaauaucuguggucccuaauaggggaagaaaacauuccaucccaccuauacagacucccugggaugaugaucaacucaacauauguacaaaaagauuaaucauuguaagaaagaauauuugaaagauaggcaggcagaauguuuucaaaucaauggaaagagaaguggaaacagaaguaagauauuaagauauuagaacauuauuuucuguaugccacauugcccaggcaaaaaaaaaaaaaaaugcucucuuaauaguaacuucaccaccaggggcucugcaacagaauucacauuauuaguugaagaaauuaguccaguuuacuuuuuucccucaaauguguuuucugagauguauaaacacauguuuugguucaauaauauauacaguguuuuaauugaauauaaaauguuauuaauaaaugucuacauaugcagaauuaucccuaucuuucauauaucugucucaguuaaauguaacuuagcuaaagaucucuguaucaguggucaguaaaaagaaaauauuuugugaggauuuuuuuuuaaugcacaaaauaguuauuuuuuuucuuuaaaaaaaaaaauugucccgaacucuucuuuccuuuagguggggagcagccuauuccucucuggaacgaacaugauggaacagcagauggagauaaaccuaaaauucuccucuauucccuaaacuugcaguucaagguaacauaaauauaaugauacuuuuauaaaaauuuuucuaaucaauuaauauaugcuuguuauagaaaauuuguaucuuacauaaauuaccaaacagaaaauaaaaaugaucuauaacuccaucuacucagagaaaaagcuuuaacaauaauuauuugaauauucuuuaggacuuuuuuccuguuaguauuuuuauauaugcauauauuuauacauuugaaaaauaauuggauaccuuuccauauuagaauauuuagauuaguuuuaucuucuugaacaucuguauuguauguuguacaguuguaacaauuuauucagccacucccuucugacgaacauuuuguuuuucuucaaguacugcuguuauaauuuacucugcaagaaauauuuuaugcacuuuuccaguuaacuauauuacuuuuagaaggcugaugcaggaggauugcuugagcccaggaguuugagacuagcucuggcaacauagcgagacuuugucucuacaaaaaauuugaaaaaacaaaaaaauuagccagguggguggcacacaccuguagucucaguuacuucggaggcuaaagcaggaggauugcuucagucuggaaguucaaggcuacagugagcugugguugugccacugcauuugagccugggcaacagagugagaccugucuuaaaaaacaaacaaagacuauauuauuuuaauagaaaacuuaauauuuccaauauuuaagauacugguguucauaaaaguuauuuaauuguauuuaauguauucaauccauugaauacuaaauuuuaaauauaaaauaucaaaaugaaacauaaugggaaaaaauugcuacuaacacgagaaauuaacguugccaguuuuaucaguucauuagacauauccuauacaggcauaccuuguuuuauugcacuucgcuuuauuguguuucacagguauugagguuuuuuuaugaauugaaggugccauuuuuccaauagcauauauucacuuucugugugucauauuuuacuaauucucacaauauuucaaacuuuuucauuaguauuauaugucuguuauaaugcucugugaucagaaaucuuugauguugcugcgggaauuguuuaggggcgccaggagcugcaccaauguaggauagcaaacuaaaucguuaaauguuguugcacaucucucacuuucaaucaaaagcuagaaacgauuaagcuuggugaggaagauaugucaaaagccaagacaggcugaaagcuaggucucuugcgccaguuagccaaguugugaaugcaaaggugaaguucuuaaacgaaauuaaaagugcuacuccagugaacacaggaaugauaagaaagccaaacagccuuauugcagauauggagaaaguuugaaugguguggauagaccagccacaacauuccccuaagcuaaagccuaauccagagcaaugcccuaauuuucuucaauucuaugaaggcugggagaggugaggaagcugcaaaagaaaacuuggaagcuagcagagauugguucauaauguuuaaggaaagaaccugucuucauaacauaaaagugcaaacugaggaucaagcuagaauaauugaugaaggugguuacgcuaaacgacagauuuuuccauguagccuucuaugggaaaaagaugcuagcuaggacuuucacagcuagagagaaaucaaugccuggcuucaaaggacaggcugacucuuguuagggucaaaugcagcuggugacuuuaaguggaagccagugcucauuuaccauucugaaaauccuagggccuuuaagaauuacgcuaaaucucugccuaugcucuaucaguggaacaacaaagucuugaugacagcacaucuuuuuacaacaugguucacugaauauuuuaagcccgcuaugggucuacugcucagaacaaagaguccuuuaaaaauauuacugcucacugacaaugcaccuggucaccuaagagcucuggugaaaauuuacaaggaaauuaacguuuuuaugccuaacacauuucuucugcagcucaugaauugaguaauuucaacuuucaaguguaugauuuaagaaauacauuuuguaaggcuacaguuuucauagauagugauuccucagauggaucugggcaaaguaaauugaaaaccuucuggaagagagaacacuuugauucaugagaggaggugcuaauaucaacauuacuaggacuuuggaagaagucgguuccaacucucauggauuacuuugagggacucaagacacuucaguagaggaaguaaaugcagacaggguggaaauagcaagggaacuagaauuaaauguggagcgugaagaugggacugaauugcugcaaucuuaugauaaaacuugaaugggugaagaguuccuucuuaugaaugagcaaagaaauucuaucuucagauagaaucuacuccuggugaagaugcuguaaacacuguugaaaugacaaaggauuuagaauguuccauaaacuuaguugaugaagcaguggcaagguauggaaaggauugacuguaacuuuggaagagguucugcuguggguaaaaugcuaucaaacagcaucauaugcuacagagaagucuuucaugaaaggaagagucaaucagugacacaaaccucauugucauuuuauuugaagaaacugccacagucaccccagacuucaacaaccacuaccaugaucagucagcagccaucaacaucaaggcaagacccuccacuagcaaaaagauuacaacccacuaaaagcucagaugauuguuggcauuuuuuagcaauaaaguuuuguuuuguuuuugagacagagucuugcucugucucaggcuggagugcaguugcaugaucucggcucacugcaaccuccgacucccugguucaagcuauucuccugccucagccuacugaguagcugggauuacaggcacacaccaccaugcccaucuaauuuuguauuuuuaguagagauaggguuucaccauguuggccaggguggucucgaccucaugaccucaagugaucugccugccucagccucccaauguggugagauuacaggcgugagccaccacgcccagccaaaguauuuuuuaaauuaaggcauguacaauguuuuuuagacauaaugguauuacacauuuaauggacuguaguauaaccuuuuauaugcacuggaaaacaaaaaaauuugugugacccacuuuauuacaauggucuggaaccaaacccauauuaucuccaagguaugccuguucaugguuuaaaacacgacuauuuuauuuaucauauacugaaagacuacauuugaguagguauauguuguugauuuaagauucauuuuuuuccuccuaacauauaaucugcuaggguauucaaguaacggccacuacuccaucaaugagagcuguaagauuugaaacuggauugauugaacuggaacuuucuaaccgacuucaaaccaaagcuucaccaggaaguagcagcuaucugaaacuguuuggcaaaugccagguggauuuaaaucuggcauuaggacaaauugucaaacaucaggugaguacagaauauguugauguuagaacgauggcuuuuaaauuuugcacaucaauuuuaacuacuguaacuuauguauuauuauauuuacaaaaauauuuaguuuaauuuccuaaaguuucugauuauaaauucagugaaaacucauuuaccuuggcauuucauugaaaauuguagccgcauauuguuauaguuuagugcagaugcacucacauaaaacuuaauccaguaucuucguaaucauuugcuuguaauuuuuuuuauuuugcuaaacauuuuuuauuucaaagucuugugcuaacauuacucaguucuuaaaauguuaaguguauaccuuuccuguagaauauuagcaaguucugcauauaguaauguuaaauaaaguuaaaaaacagcaguuagauucucuauuuuauaaaaaugaauguucacagcuuauuggagauuuuuuuuguuuuuauuuugccaaaaauuauuauguagauuuuaaucuuuuuuccucuuugaagaaccaaguagaaaaaugccagucacaguuucaaaacugaaucgcugcauuaaagauacgaggaaaaaaugaacaaaaauuucuugucaucucuuagagguucuaauuauucugaaauauuuaauacauugccauuuagaauauggaccucauccuaacuuuuauauaaaguuuaucuaugacuucauauuuacuucuugcauggcuauuuuguauauuaauuucaaguguuuaugguacagaguauaaggaauauacauuaacagcugaauuugagaaaaauguauuauaguuuuuuuggugaacaauaccauuaauaauguuuaguuucauauuaaaacuuuuuccauuauuuuauuuuauugagcuuuaaauuuuauuuuagguuuaugaggaagcugguucugauuuucaucaaguugccuauuuuaaaaccagaauuggauuaagaaaugcccuccgagaagaaaucagugguucuucagauagggaagcugugcuuauuacuuugaauagaccaauuguuuaugcacagccuguggccuuugauagagguaagauaaagucaaucacuacuauccucugggaucuaggaaugcuuuguuaaugcuagauaagaaucuuguaguuuacugguguaaaugcuugacagcuaaaugguuccuaaaucugaaauguguguauccaaaaaaaaaaucuugcuuuuugccuucaguuuuuaaaaguuauuuuacauuuuaaaguuauuuugucuucuggcuggauaacauaagagugucugcuucagauuauguaauuguaaugcugauuuuuuuuguuuugauaauuaaugcacccauuuguguuuuggcacuguguuuauuuuuauauucuauaaacauuuaucagguacugccuagaaguggaauacaaaaauaaacaacaguaucccugcccucaaggaccugucaguccaguggaaaagaaaacaaaguagacuacacaguggagucagagauguguucuugguucugaggaauucucuaccuuugccuaugcuucuuagaggagaaacuaauucuugauuugacuuugaauuaggaguucaccagggagauaaggaaaugaaauuuacuuuuauaucccagggccuagaacagucccuggcauacaauaagaacgaaauaaacauugaguaagagagaauaagaaugaauguguuuaaacacauaagucuaagaaaauauagcaguagguuucauagaagaaaauaaugggaaagaaggcugaacagguagacaaggucuaauuaauguggauugggcaaauauauuugaacuguauuuuagaaguaaugaggagccauuuaagaagccauuuaagaucuucaucagugauggacauaggcuaguaacagaauccuguuagaaaauugcccuuuuggcaguguuacagauagcauuuuauuuugcugaaucccauguacauguuuuucaguucucauuuuacugaccucucaucagcuuucaucagcuucuuaaaguauuuuguacccuugguguccuugacacaaaacagguugaguacugguuuuccaaaguaauugggacaggaaguguuucagauuuuggauuuuuucagauuuugguauauuuguguauacauaaugagauaucuuggggcugggacccaaguuuaaacaugaaauuuauuuauguuucauauacaccauauacacauagccugaagauaauuuuauaaaauauuuuaaauaauuuugugcaugaaacaaaguuuugacagcauuuuggcugcagucucacaugaguucagauguggaauuuuccacuuguagcaucauaucaacauucagaaaguuuugggauuuuggauuucggauuagggaugcucaaccugcauuugcuuuuccuccuacuucucuggccucuccaucuuuauguccuuuuuagaggccccuccaucuauacacugcugugaaaugaagguuuuccuuaagguuuguuucuguuuaacaaacucaaacaucuuugacuuuucucuguaaaucagauccuuuuaaugguauguuccuagcauuauguaccuuaaagaauuuuaaaagaaguaacagcucuacagaugaaguuaagcaccaugucuguuuucauuuguuauuccaucccaguaucuaacauauaauaggcauuucacaaauaaguuagagggaaugaacagaccuggauuuucuucuuccuugugccauuaugugguugccugcuuucuguuuuauuuuuucauuuguuauuuaaaaaauggugacuauauguccucuuagaucuuuccuaauucuaaugcuacaguuuucuggguguaauuuuuauuaagcaacaggauuuugcagcuuuugaguuuuacuuaacauauagauuuacaguguugauuuuaauuuucuuucugcccugucuuaauuaucaaaagcugugcuguuuuggcugaauuauaaggccgccuaugacaacuggaaugaacaacgaauggcuuuacauaaggauauucauauggcuacaaaggaaguaguagauaugcuaccugguauccagcaaacaucagcccaggccuuugggacucuuuuucuccagcucacugucaaugaucugggaauuugccuaccuaucacaaauacugcacagguacaaaaagucaagucauauuccaggauuaagagccaggcauuucuacauaaccauuucuaaguauuuagaauauaacaguacauuuuucaguguaacaguuuauaacuguuuaguagguagcaaguaagauugaauuccuucaaccauuacucaucucaauguauuaaaucuuaaucucaugggacuuuucucugaagcacucuuauaugcuucagaauagugauaagauugauaccccccagauaacucuuaauuuuuaccuucauaaaaagaagcuuaguuucagaaucauuuuauuguuuucuuuuuuaacaaggaagucauugguauggacuuguuuauaagauggaaauaaaaggacauuuaagaauacuguuuaaugaacuuaaccuguaauagaauagggaauuccaaaaugcuuuuauacuguaauauuuaaugguaaugaaacuucaaagcagugugcacauaaaccaggaauuuucucuuugcaacuuaagaccaauuuucaggaauauguaacugcaugcacauguguguaugagagagagaaaaggcuaugaacaccugucaggccaagaagcaacaguuauuaacaauagcauauagagaucuauauuuuacuguuacaauuuaccuuaauaacuuguaaccaguuguugaauuaauuuaucuuuuaggauucuguucgguaagacaguguuaagaaaaacuucagguugaggauggguggcauugguauguuuguguuucaggaacugaaauauaguaguuuuuuaauagcauaaugggcacugccuaggaaggccauaaacaccacagguggguggcauagugagaucaucuccccacaacuaaaagagaggcuugagauagaaauguagauagcccuuuguauguuaaguaagaaaaaaaaugcacauggcaaguacauugcacuuaagcaauuuaauuuuuaaaaggcaucuuucuaagcugcucuuuaaugaacauaucuaggcuugaccguuucuagauuucuauuccuaugaauccugugaggauuucuaaguuuaaaaaauugucaccuuuugucuuauuucuucuuuaauauauuuugcagucuaaucauacuggagaccuugacacugguucugcuuugguauuaaccauugaaaguacucucaucacugcaugcucuucagagucucugguuagcaaagggcauuucaaaaacuuuuguauccguuuugcugauggauuugagacaucaugggaugacuggaaaccagaaauucauggggauuuagugaugaaugccugugaguaucuuuuauuucuauauacaguuuagaacuuaaaaaauaaaacauuaagucuccauuugugaaauuaaaagaugcuuagauauagcaaauguuuuuagacuuugagaaagaagggcuauuucuaguuacagguaacaaaccauauucgugaaaaacuacagcauugaguaguuuugguaaguaaaccaaccaggcauucuuuuugguacuauaacauuugaauguuuacacagucccugauuuuuccuguaauugauccauguuugaccagauaaagcauuuuugaccugucggaaucuugaaaaaaaaugauaaaugugcaauauccaacucaccauaaaacacagaacagguuguaaauagccaggaccaggaacgccagccuuaauuaauauugacgugaauaaauccacauguucaaauuuguaggagugcagaguguaacaugaauuccugcaauuccauaauauucaagguuggguauaacuaaagcuguguuuauaggccguauugaagauacggaauuuauuuguauauauuuuuauauuuuaaauauuauagcagaguugguaaagcaucauuaaucuuaauaauaaagaaaaauuauaaauaaggaguuaaaagguuaugaacuaaaauuccucaaucuuguaaacuaaauuacuuacuuuuuagaaagcgguagcccauuguuuauguaauuuuuuccucucuccacuagagggaaaucuuucuacuucccauuuucuuugaggaaugagaaaauuucuauuauuuuuacaaaaauugaaguuuuagcauucaaaaugaaaaagucuugguuuuaauguguagggaaggaaaaauaucuuuuccuacuacccuuuuaggcuauuugcuggggggcuuguguaauaaaagaccaauuaaugagagaaaagcauacagguuuauuuaauaugagguuuuuuugugacauggagccuucauaaggaaaugaagauccaaagaaaugguuaaaccugaguauuuuuaugcuagguuugaugaagaguagagaguuguagagcaaugugagaaaauaaaaagggguaugaguuaagcguaguaaacugggggaaacuaaccaaggucuguuuguucagauucaucucagugucccuccacuuuggagaugaggaugcuccuuuccucuggguauaggaagggcaucucucacaugugguucauaugaccuacuucagaagaaagucaaaguccuuccugcaucugcugcuucucaaauugcuucaguuuaaaauaccuuccauaugacaaggugccauuuuagaaggcaguguguacuaaaccccaucaaauacuuugcauuuagauaauuauagguaaaauaccaguacuuauuugaaauacuucagguuacugagaagacuugauauggaaauacucaugccuauuauccaaaagaccaguaucagccuacaacagaaaucuuuauagauuuauuauuuuacacaauaguuauacauggcuuuuuaaaaaucacuaaaacauaucuuuuguuuuuuuaauaaaagacaaaaauaaauuuaaacuuagugauuuuuauuaaggugacagcuuuaccaucauuguauuuauuaaaauaaguagaauauauuuggaaaaaaaggaaguaaaccauuuccuuaacaguuuaucuuaaagggcaaaugcauaagauauaaaaugagaaauacgcucugacucagaaucagaaacaugcauuaaaaaaugaacaaauaauuuagcaccucaguauauauucuguuaauacagaacacuaacaugcugguaaucaugauacucagaauaauuuauuuuggguuuuagaggggacuaacugacaugcuucuguaacaugcuuauuguuuggguuucuugggagggggccagaaggagauaagcagaguaguuauguaacugacauauuuauaaaacuuccaaaugauaaaauggacaaauuaguuuacuagcuuauaguuuuuauuaguaauaaguauaccucaauauuuuugaacaaaggugauguguauagggcagagaaauaaggaauguuaggauuaugccuuagaauuuuuuuaacaggucauuuuuaaaacauacucuaaaaaaaaagugacccaguaaaauuucuucucuaggugauaauguuuauugagaaaugcauuagaaauuaacaaggacagucuauaggaagaguucaaagaacgauuuaaguagauaguaaauauuaggacaauaucaugaauguguauucagacaaaauaaaccaucagaaguuuagaugucugcaagcucucuguaaaaccuagguagccuuuggucaucagagcagaaaaauuaccauccugcauucagccuaaugguugcuccaagucaucauucugucugugauacagaaaccacagguauuauggggaagagacuaguugauuucuuaguccucauuuucaggauucagaucuacaucuaaaaaucguaauauuccuuauuaauucaucguggcucuauauucuaugaguuuauauauucaucuuuuaagcuuaauguuuuuguugcuuuuuagagacagaaucuugcucuguuaccuaggcuggagugcaguggugccaucauagcucacugcagccuugaacuacugagcucaagcaauccucccgccucagccccccaaguagcugggaccacaggcacaugccgccauaccuggcuaauuuuuaaauuuccuguauagauggagucucacuauguugcccaggcuggucaugaacuccuagccucaagugaucuuguggcuuugaccucccaaagcacugggauuauaggugugagccaccacaccuagccuuuaagcuuaauuuuuaaaaauucucuacuacuccuugggauaggaaauccuaaaaguuuucuucucccuuuuuauuuacuaauucuuccuuucacuuggccucaguuauguuauucagauuucaaaggguuuucuuuucauucuagcauucuuggauuugaaaggguaaugugggucuuauuguucagauuuguaaccaugacuacaaaggugaauugggugauacuccaaaaucaaaucuaguuauuucuuaauuagaauuuguaugugagacacagguacuauacaguucaaagguauaauuuagauguuaaacuuauuggcagucuuuaaaaaaacauaauaacaaguagauccucucucacaaacuaaguuguaauauuucuaaguuggaaagauuuuucccuuuugaaauuuuucaaagacagaaauguaauaccaaauuaccuaaaauaugaauaguaagcucaaauuuaaguaacauuugaauaccaauuuaggauucucagagugaauuacaaaaggacauuaaagauauauguacucuggaguuuaaauugauauuuaguuucuucuaaggaugacugaggaaggucuuaauucuauguuuagaguuuacuuuguuuaaaaguuguuucaacuuuuacuauguaaaauuguugaauuuaauuaacaucuuuuuugaagcugaaguuaccagauuaaagccaguugguaguaaauguuucaaaguuaaaguagauauauucuggagauagguccaugaucuugagauugacaucauagccuucagccauuuuuuuucucauaaaauguuccaugucaaaagagaagguaagacugaugaaucaugugucugaccuaauguggcagcucuuaguuaccaaaauucuauuuuaagucauuugcauucucaaagugccauucauuuaugauaacaaauugucacagcauccuggauauuaguagauaagccaucuagagugucagaguuggccagguguugucacucaaauaaggaaaucacaugcagaaaguaaagcuaaaacugcaguuaaauuauuuaaaucauagaauaaaauauugugaaauauuuuauuucacaauaagaaucgaucuuaugagucauuaagauagcccuuucauuccaaagauuaagaacuaaaaucuaggaaggauaguaauccucuuuguauuuagacaauaaucuugugugaaaaauuaaagaguacaauauauagucacaaauguauuuuuauugaaaacuauuuuuggggugauuuuuguacagguguaguuccagauggcaccuaugaaguauguucaagaacuacaggacaagcagcagcugguagguucacaugcagcauuauuuuauguuagauagaauucugccuuuauuuuaauggcaagagaaucuuuuggcuaagcuaauucugguguucacuaauuuaaaaaaaaacuauuuuguauuagaacauuuguauuuauuuaacaauuauuaaucagacaccuacuguguguuuauauauauauauauaaauauauacauauauauauacuacaagauguuuuagaaaagauuaaaaugaauaagauauacuuucuauccuucauacuuuuaaauuuuuacaauguaguuaaggcacauguacaaaauuacauugaaauaugugauauguacaauaaaacauaaaauuccgguugcuauugaaauguauaaaaagaagagaauauuuucaaauaugggagaauacugggaucagagaaaacuucauggagggacaaacauuuaaacaagcacucaaaggacaggauaaaucuuucuuaagcaaaaacugggagaugugggccagggaaaauucaggcagagagaauaauguaacaugaaucaugauguuaaagcgcaguauucagauuuguccaauuuagcuagaauagaguuauauaaaaaaaaagauggaaaaauguuaaaugccaaauuaaggaguuugauuugguggguagugaguaggcuagccauugaauguuucugaacaagaaggcaaaugacgacacuaucaaaggaacacuuucaaagauuagagggcaaaaaagccuaggaaaucaguuaggagguaacuaugaaagugguaauugacuaagaugauagcacaauauaaauuuuuauuguuuugcuuguuauaaaauuggacagggacagggugagcuacagagauacuuauuuaagggcucuuaaaauguugagagagguagaaauugauuaagguuaguagauugccagucucuccuuaccauucuguuuuccuccccaagccuagccuuagugcucauccuaaguuaccuuagaaagcaccaaggccuagagucugacaaagaacuggaaaaguuagagaauuuucaacugaggucacaaauaaaucuucgucaggacuuuuaagugacaacaacccacuuagacuagauuaaccaaaaggggaugcuuauuaaaaggauauuuucagacuacaguuaaacuuaggaaugguuauuucagggaagagaaggaaccaggucaauucaggagcccuuaggaacuacuagaaccaagaucccaacugucaccaagacucuuuguagcucuugucuuugcuucuuugcuccccucuuggcuacuuguuuuucuucuucuucuaacuuguaaccucuuucuuauacauggcaagaaacacaguggagucucguuucuccacccucagucauuagagaacgaccaaccuuuccucaaguccaggcaaaauaucuuauuuuuccaacuuugaccuucaccuggaccaauuaaccuaauuaauucugucuaaugagcuaaggucauggcaauuccuacuguagcuauaggaugguggaucaacuuggggucagggagugaaccuguaguucauagggaaaaagaaaauaggugcuauacagaggaaacaguagaugcacacuguacacauagagaaaucaauccuguagucugauguuucugacaaguuuagcagugaaagacauuaguuauuauauguggccauuauuacuuuguaaaguuauuucaauuucuauacccaggacuuaacaaaaaugcaacuucuuuauuuaaacagaaagcaguagugcuggaaccuggacacucaacguauuguggaaaaugugugggauugauguucacauggauccuaacauuggcaaaaggcuuaaugcucugggcaauacucuuacaacacugacaggagaggaagacauagaugacauugcugacuuaaauucagugaacauagcugaccugucagaugaggaugaaguugauacuaugucucccacuauccauacuguaaguaaacucacuguuagaauuuuucaggauuggcuuuuacccugagacagggauauuuuuuguucaguguuauuuaguauauuauaguugcuauuuguggaggaagagaagggaauggugguucacugugucuacauuucauaauacugucuuuuaaucgaguucugugcuacauguugacugucauccaacuugugcuuuaaccuauagguaaaauaauaauauuaaaacugaaaugaguagggaguggggcaggguggggaaugggaagaaauugcuaacagguaugagguuucugagugaugaaaauauucccaacuaagauuuuaaugaugguuguacaacuuugugaauauacuaaaugggugaguuuuaugguacgugaguuauaucucaauaaagauguucaagaugaauuucaaagcaaagugcauauacaaaaugaaaugauacauuuuaaaaauacguauuuucaucuauacuauacacucuguaguuucaaguuauuuuguggcaaaaagaaacuuauucuuugauuucauucugguauugauuuuuaaaaauuauuuucaauaucuuuuaacuauuauaccaugaaauaguuuuguucuugggaagaaauuuuuuuaaauuuaauauuacuguuuauuacuuagaguucagauggaaguucaauaaguggagauggccacaaacucaccuuugggcagcgacuuguaaaucaccuacuaggccugacacccccaaaucagcgccauucuguuccugcagaguaucugugugacccagagauguggggcuccccucagucuagccagucccauuugaaagcaugcagagcacacucauggggaaacguagguagcaacuaaauagauuccuuaugaaauugaagggauuuaaaucaauggagaauuccaaccuuaauauagaugguuuugauucuugcaugcuuugauuuaagguguuaauuuugugauaguauagauuugcugugugacuugagggugguauugacagauacacuuuugacuuuucaggaagccacagauuaucgaagacaggcagcaucugcuagccagccgggagaacuuagaggaagaaaaauuaugaagcguauaguggauaucagagaacugaaugaacaggccaaaguaauagaugaucugaaguauguacaaugauuuuuaauuuaauauaauguucccuaauuuuagaaucauaagauguuaaaaguggaagaaacuguauuuggucuaauacaaacucuuuaguuuaucugugauaucaccaggguccagaguuguuuaauaauuuggucaagauuauacacucauuagugauaaaguuaggcaugaggcugggcaugguggcugaugccuguaaucccagcacuuugggaggccgaggcaggugggucaccugaggucaggaguucaagaccagccugggugacauggugaaacccugucucuacuaaaaauacaaaaauuagcugggcguggugguacaugccuauaaucccugcuacucgggaggcugaggcaggagaaucgcuugagcccgggaggaggagguugcagugagccaagauugcgccauugcacuccagccugggugacacagcgagacuccaucuccaaaaaaaaaaaaggcaugaaauccuaguguccuaguguuuuucacaacuuauuucugagcacuuuaugacugaugguuuauaucacauauauguaucuuuacauguguauuuacucuuauauguaucuucacaggcauauauaaauaaauccauuaaucuuuaucuguugccugcuggauauuacuaaguaauacuucuucuauuacaguaaauauucuuguugcuaaacuucgcaauuuuauuuucccaaaagguaauggucaugccucaucuuuucuaaucugcauauacuuguacuggugcuuuuuuuuuuuuuaaacaaucaaggaccuuacacaacuauaugcauuuuguauagcaaaauguauugucugaaacuugucuguaaguuaucaugcagugauucacauuuuccuguugacuuacauuacaauuugaguuuuggucucaggggaaaaaaugacuugaagcaaaauauaccuuuccuccaaaaucguacccaaggcuuauauuauauguagaauuuuacauccagacauuuuuuuugcagagugggucuaugguuuucaugagauugccaaagagacucuugaugcagcaauggauaagacacauuuccucaaacauuagagagagauguuuuuuguuuucuuaacaguucgccaaauaugaguguuaagcuuauugaggguuuuggcuugucuguauauaaucaucuuugguauucugacaagaauuaaaaaggagcaaguaaaaaaucagucuuacuuuguuauuuauuuacaauaauugccauauuuguuuugcauccagaaaauuaggugcaagugaaggaaccauaaaccaggaaauucaacguuaccaacaguuagaaucuguggcugugaaugacauuagaagagauguucguaaaaaauuacggagguccaguaugcgggugaguucucuuuuuucuuucaaugcuggugacaaaaccaccugacuuuuuccuaucauaucuacugcguaccagguaccaucuaaagcacguuacauguaaucacccauuaaauccuaacaacaaacuuaggagguagcuuguguuauuuuccuauuuuaacgaugaagaaacugagacacaggucaaguaauuugaccaaaguuauacagcuaguaauccuggggaagacaauagucaaaccuagguuguaggacucgauagucuaugcccuuagacacuguguuuugucuguuuuucaugaaaucacucuucuuuuuagucucuaaugugaacucugcaaaaaaugugaaaaauuuuaagaugucuguucuucaccuaucccauucucccaggucagaauuuaccugucagcuacugugcauuguaaugcacuuuauaaucuuuauuuuuugcagguuuagucggucccauuagaguuugagucuaggaguagaaaacuuuuuuuaaaaaccauuuugcccuuuuguugcuucauuuuuuaaauuaaagguaacuuguuaagaguuaucgauucacaaguguacccaccugggccugcugcuuuuuguuuuguaaaguuauuaauccaguccuuuaauaaaugcaggccuauuuggauugucuuuuucgucucuccauuuuagaaaauuguauguuucaaggaaucggucuauuucaucuaggugaucaaaucugugggcauagauuuguucacuguauuccuguauucuuuaaauagccauagggucuguuguuguauacccuccuuuauugcugauguuaguaauuugugucuuucuuuuuuucuuaguuguccuggcuagaggcuuaucaauuuuauugaucuuuucaaagaaccagcuuugguuuuguugauuuuucucuauugauuuccuguuuguuuuauuucuucucuaauuuuuauuauuacuuuucuuaugcuuaauuuggauuuaauuugcccuuuuuuuucuaguuuucuaagauagaaguuuagauaauugauuuuagaucuuuucugauguaugcauucaguucuauaaauuauccucuaagcacugcuuuugcugugucgcacuaauuuugauaaguguguuuugauuuucuuuuauauuuuaaaauuucucuuuagauuuuuuucuucaacucauguucagguaucuuucuguuguugauuucugguuaaauuccacuguggucuaagagcagacauuuuaugauuuauaauuuuuuuuuuuuuuuuuuuugacacagagucucgcucuguugcccagauuggagugaaguggugugaucuugguguacugcaaccaccaccucccggguucaagcaguucucucccucagccucccaaguagcugggauuacaggcacccaccaccauaccuggcuaauuuuuguauuuuuaguagagacgggguuucaccaucuuggccaggcuggucuugaaugucuuaccucgugauccacccgccuuggccucccaaaaugcugggauuacaggugugagccaccaugccuggccaugauuuauaauuuuuaaaaauguguuaaguuaugcuuuuugguccagaauguggucucucuuggugaaaguuccacgugagcuugagaagaauguguuauuaugauguuguuagaugaaguugucuguagguguugauuauauccaauugacugaugauauguugaguucaacuauguccuuauugauuuuuuugugugcuagauauguccauuucugauaaaggguuauugagucucaaacuguaauaguggauucaucuguuucuccuugcauuucucuuaguuugggccucacauaguuugacacucaguuguuuuguuuuuaagaaauaggguuucacucuguugcacaggcuggagugcaguggugcaaucauagcucauuacaaccucaaauuccugggcucaagcaauccuccugcuucagccucccaaguagcugggaccacagcacaugacaccaugccuggcaggauuuuaaaacauuuuuuguggggacagggucuugcuauguugcccaggcuggucucaaacuccuggccucaggcaauccuccugcuuucgacucucaaagcacuaggauuacaggugugagccaccaugcucagcccacuuuguuguuaggcauguacacauuagggauuguuauuuguucuugaagacuagaccccuuuaucauuucauaaugcucuucuuuuucuuuauaccugauaauuuucuuugcuuugaaaucugcucugucugaaauuaauauagcuaucccugcuuucuuuuaauuagugauaggaugguauauuuuucucaaucuguauacuuuuaaucuaugugucuuuaaauauauaugcuuaaauauguauauauaaguggguuucuuguagcaacacauugucagaucuuuuuuaauccacucugacagucugucuuuuaagaucauuuuacaccacugacauuuaaagugauuaaugauagcuuugaauuaauaucuacuguauuuguuacuauuuucuacuuuuugccuuuucucuuuguuccugucuuugucuucucguuuuucugccuuuugugguuuuaauugagccauuuauauaaucucauuuucuguuuuuucuuagcauaucaguuacacuucuuuuuuuacuuuuucuuuucuuuuuuuuuuuuuuuuagugguugcccuagagacugcagucuacagauucuucucggcuuaugauuggguuacaucccaauaaacccauaaguugaaaagucaaaaugacuuaugauaucuucaacuuaugacagguuuauccagcuugaaccccaucauaaguugaggacuguacugaauguuaccucuuuugugccaucauaaagucaaaaaaucguaagucaaaccauuaugagucaaggaccaucuguacacguauaauuaauccaagucuacuuucaguaacacuauaccacuuuaugggcagugggaguaccuuaaaacaaaauaaucauaaucccucccuccugucucuuguaucauuacugucauucauuucucuuauauuuaagcauauauaagcauauacauaaaugcgugugcacauauauacacacacauauauacacaugcacacacauuuauacauacaugugcacauauacaugcgauuuauauauagucauacauuauugguauuaaaugugugcauguguauauauguguguguauauauacacacacucacacacaugugauauauauagucaaauacauuauugguauuauuuugaacaaacuuaccuguuaggucgauuaugaauaagauaaagguuuuaccuucauuucuucuuuaaugcucuuccuuuuuuaaauagagaucuauaucauuuuccuucucucuauaaaacuucuuuuaacauugcuugcaaggcaggucugcuggcaacaaauucccucaauuuuugugucugagaaagucuucacuuuucaagaauaauuuugcaagguauaugauucuagguuguuggguuguuuuuuuccucucaacacuuuaaauauuuuacuccacugccuucuaccuggcauaguuucugaggaaaaagucaggcuuuuuucauuaucuuuuuuuuuuuuuuguaguuugauaaugauauaacuacauguaauuuuuuuuuuuuuuuuuuuuuuuuuuuuuuuuuuuuggcauuuauccugcuugguguucuuugagcuuccucuaucugugguuuggcaucugacaacaauuugagaaaacucucagucauuauugguucagauauuucuucuauuccuuucucuuucucuuuucuuucugguauuccauuacacauacuuacacauuuuguaguugucccacaguccuuagauauacuguuuuguuuuguuuuuuuagucucuguucugcuuuucacuuuuugcaguuccuauugauauauccucaaguucaaauauccuuuccucagccauguccagucuacuaauaaguucaucaaaguaauucauuucugucacaguguuuuugauugcuagcauuucuuucugguucuuagaauugucaucuuucaacuuacaguguccagcugaucuugcaugcuguccacuuuauguuagagcccuuggcauaguaaucauaguugguuuaaauuucuagucugauaauuccaacaucccuucuaugagguucugaugcuuguucugucucuuuagauuguguuuuuugcuauuugauaugccuuguaauuuuuuauugauagccagacaugauuuaccaaguaaaaagagcugcuguaaagaagcuuuagugagguaauguuaaggugucaggguaagagaagcauuuuaucgucuuuuaaugagccuaugccucugaacugugaacuucauguuugucaguuuuuuccucccaacuuagauggaccaguauggauagaacugacugcauugguauuguauuucccuuccccaggucaguuauacucugauaauauucccacugguuaggcucugguuagcuaauuucuccuaagggcauuuuuucuuauucagaaaaagaaaguacucuuaguguuuuuucaaaauguuuccuuuucccuuccccguguuggaagccuaggggacuuuucuccugaggggauuuuuuuccccugacauuuucugugggaaccugguggaacuacugaaaggcgaucucacaauauugcaggggcaccggugacugggucccccuggaguuuuuaacucucagacuugucugcacugaaccuuccagcaauucuucaauuacaguucagguguuccuaccccaguguugguuccugcagcaguuuuuacuugugcaucucuguccugguaagcuguaacucacuguauuuacuggucucuuucuccaaugugaggggcagaaguuguccuuccuugucgccuuucuuacagcuccaagaacagcuguugauucuuaaguuuguucagcuuuuuacuucuuguuaggauggaauggugacuuccaaacuccuuacaugugaaacugaaaacaaagucuaaaaaccacuuaaaaggaaaaaaaaaguaauugguuuuaaaauuuuuuaaaccaacagagaacccucuuuuuuuuuuuuuuuaaccaggaugagauuuuuaggugguaccccaacacaugaaaaacauauuaaaucagagcugcaggugucaaaggaaaggggaaaguuugaugcaggguuccaggagcuauuggcuugaccugcccuuccuugaucacuucuuaacucccagagaauauaguuugaauacugcucuccaauuuauuugucacuagucucugauaguaauaauggauagugagaucuguaacauguaauuuuauauuuuaaauuuuugcugucuacacaacagucauacaauauaauuaaaauauuacuuguguccuguuacaagucauauuugguaauugacuguuaaaaauaaaacuagauagaauuagggaaguuguuaaaacaucugcauucuuaacacaucucauuccacauauuccccucaauucccauuauccaucuuagacuccaaaacuccacuguauuaaaaucuuuuaacuaucuagcaccaucacgaguuucuagaagagggacuuagagacagggagaguguuaagucauuaacacucuuacuuuccuuuguuguaaugaagaguccuacaaacgggaugcccuuggagaaaagugaucuuuugucuccacugccccgaacuuagcuuucucccaaaacuuuaauucucaguuucuuucuccauucuuaauuuuaaaaucauuuccuuucuucucaccauguuucuguacccucaucccuacccccaaacuuucucuuuucuucuuuuuucucaggucagcugguggcuccuguuuucauugcgccuccuaauugguguuagaaccaaagaauagcugauuccuccucuauuuugacucauauuguuaaguaacauuaaaguccccuggggaaaacaacuuauuuaauaguagaauauuuucuuuuauuugaagucaaauacaguaaauaaucaccuauagucacccuuuuuucucucccauuuuguuaggcugcuucccuaaaggauaagugggguuugaguuacaaaccaaguuacagccgaucaaaaagcauuucugcuucuggaagaccaccucuuaagcgaauggaaagggcaagguaauauauauuucagccauugaaacaaguaauaaaauuguugacucuuuuaccaaggucaacuacuuuuuuauguucuaauuauaaaauuaagauaacaaaaauuaauuuuauuaguaaaauagcaauaacaguggauacuaucaaacucagaaguuuauuuaaggaaucucucaucacauuuauaaccacaaugcgguaagugcuuuuuaguaaugaaguacgcugcuauuuagacaaguuucuguuuuauuuacauaaaacugugguuuagaaggauagacaaguuuuaugcguaaacuuauagauuauccaaagaaauuaaaaggugcauacuaguagcuacugcucuagauuugucaguuuagaaaagguauagucacacagacauuuagcauaugaaaaaauggaaauuuuacauuuuauugaagugaauacaguuuuaauaguaaaucagcacuauaacguaagaaguauaaauucuuuuuauaugauuuaguuuuagaaaaaucuugaguuaaccaaaacauugacucuuuuuuaugggaugcuaaagguuaagagaaaguucaauccuuugauuagguaaauacuuacaaauaaaaugucauugccauuaaucagacuuuuauaaaguccaggaauuuuuuuaaugagaauauugguguuuuauaacuuuauauuuacuugcaguucucgaguaggagaaacugaagagcucccagaaauccguguggaugcagcaucuccuggaccuagaguaacuuuuaauauccaggauacaguaagagauauauaauuuguuagagauauacauugcuaaguaguuuuuacaaauuacaaaauuaugguauuauacuauuucaaaauacugauuucuuacuauaaucaaaguauggauugugaugacugaacugugcauauuaccaaguagugggcacugcccuuauaacauuuucugagagccaugaagcagguguuaguauuuuacauuuuacaugcacaauaaaggcuccauaacugcuuucucuuaaguagaaagguuuuuguugaauaauuuuucuuucaagugagaauccauauuaaacuacaucuuacacaaauguaaacguggaauauugauacucauuuauguauuuuauuuauagauagcagaaauuagaaggaagaagaucagcuucaaaguuguauucuaauuucauagcauauuaaacauuauauuaaaauguuuauuuuguuuuuuguguauuuacuuuuaagucauuguuauuuuucaugaguuuuuuuuuuuuuuacuuuucucauuauuuuaauuaaguugaaaaauacaguauggggaaguacaccacaauccagcuguccuggggaaggguauuuucagguacuuacuaagaacaauauaaauuuugcuuuaaaacuaaucaaccacacugaaaaucuacuuucaaaauaucuuccucucauuucaaacuuaacuuagaccucagaaauauuuuacauaaugguuuaagacuguuugaaucucauaaccucuugcaugcauuugucuugguuuuuacuucuguguaguuuaauacuauuaaagacuaaaucagcuaaucaaaucaauucaaccaaaucauaaaaaaaacuacaauuuauuauuuccuaaucccuaagugaagcaguuuuuccuuauauucaacuacaaaaugaauuuuuucauaaacaaagaucaguucaaacuagaauuaaauuuaauucagaacaaacauuaauaauugaacauucuuuugagucacugguguaaaagaacauuuaugaaacuauccauuuuuuaaauuauucucuuguucaaaacaauguggaagaaugaauagaucuuuuuugucaagguacauuuaaaaauuagcacuuauccaaauauauuuuguuucccuuuugucacucucuucaagcuugagucucaacauguaucucauacugaauuuagucaaacuggauuuuuuaaagaacuauuuaauuguaauguagugagcuuguucuuuuuuuaugaagaaaacuuggaaagaaagaauuuacacgaauggaguggguucugcuaacuagaugauucucaaagggauuaauauuugaagugauucaauucaagucccauuuuaaauuagccauguacugcuuguaaaaaaaugguauauaaaaaaucaugaauuauauaauagcuaugagauuaaauauuagauuuuucuaaucauaaauuagaaaauaauuaaagcaugguuaaauauaaaguaaauaugaaacaaauauuuauugucucuuaccaaaguuuuaaaaauuggcuguucuaacagucuaauuuacuuguuaacucaguaacauguauacuauauaaaaugaagaacaccuggauuugaaauuuucaauguaggacuuaacuguauauggaauagcagcauccaguaguuuuaauaacaaauugcacauaaauuaccuugcacauuaaacuuuauaaaggcuuauuacugcucaaguaacucugugacucugugaagcugggcaucaaaauuaggucauagggggguguuuuguuuuguuuuguuuuguuuuguuuuguuugaccuauuuaaaugcaguggccuccuggugaaauccugaguuagugacaugguguuuauacaaacuguagucaucucucaauaucugugggggauugguucuaggacccccaugcauaccaauauccacaaauacucgagucccuuuuauaaauggugcaauauuugcacauaaccuacauacauccucccauauacauuaaaucaucucuagauuacuuauaaugccuaguaguacacuucaaaugcuauuguaaacaguuguuaaaucuuuuauauguauuauuuuuuauuguacuauuauuuuuauuuuucccccaauauuuuccaucugcacuugauugaaucuguagguguuuacagagagccggcuguauuuaccuuaaaauacagcauucuucaguuugauugauacauguuuuauuacucggcuauuugcacauuuuucuuuaacucauguggggcucauuuuuaaaagauccacaaaaagcauccacaaaaaagcaucuacuagcuuuuaaaagauccacaaaaagcaucuacuagcauuuaaaagauccacaaaaagcaucuacuagcaugaugagaaaacaauaaacuuuguacugauacugcaugcucuuccaucacuaauugcucuugccauucugauuuaaucauguuucuuuugcuuccacauguuuaacuucugcuuuaaagaauuacaguguuauugauacaguaauauauguuuauauuaaguaaaauuucauucugauuuuuaguaugucaguaguguaacuuucugugguuggcccuuuugcuuccuuccuugguguacuauuucauauguucaugaaucugaccuuucuuucaguucagagugaagaaauucaacucugagauaauuuuuaaauguuuaaauuuauauauuuuuucuuuuuuuaauugaaauaugaaucugauucauguuuuuucuuuuuacaaucaguuuccagaggagacagaacuggaccuuuugucaguaaccauugaagguccaucccauuauucaucaaauagugaaggaucauguucuguguucaguucucccaaaacuccaggaggcuuuucaccaggcauuccuuuccaaacugaagagggccgacgggaugacaguuugucuucuaccagugaagauuccgagaaggaugaaaaagaugaagaccaugagagggaaagguuuuauauuuacaggaaacccucgugaguaaccuuauuuuaagaucauaauguaguauuucagaaucuagaaaugagcacaaaauguuauauauaacucagcuuuuacaaaaaacauuuuuaaugugccucgcuugagugagacuaacagacucauuaaaauaaaauuuauuuuaauaaaauuuaucacaugguuuauugugauguagcuccauauaacauuauuuuuuaaauuuaaauuuuuuuuucaugucaccuaaguuuaauuaucuaaaauaaaauggaaauaaagaugugguuacgaguaaauuaaaggagagggcuguauuccuguggcauuacauuaacagauugcagcaaggagauauguaauagugaaggcuaguuaagaaaaguaguaaagggaaaugguuagcaauggaugaaagacuuaagcaaauucuuagaagaaagaaauaacaugaaaugguguuaaugaaauaaaugacauaugugaaacuuugcucugaauaugcccucaagaggagcggcaaggaucuuuggaacuggucuauuuaaaccgcccucaagugagguugugacaauaauaguaagaguuucuaauaaugguaauaaauaaugagaaauuggcuuagcacaagaguguaaccaaaagcugaucuauaagaaacucucugucuucaaucuucuacauuuugaguuuuagggauucuuuccucccuuuccuagacugaagccacugacugcugaaucccauacaucagcauauuugguuuuauuccuucauuuuucuggaguacauucucaaauaacuuacuaugaaaaguuauuauugcagaucuacuucauuuucuucaugucuaaaguagcuuuacuauuuuuguguuuauuauugaguugggaacagaauucuagucuaauauguauuucuucuccuaaguaagaaaaacuguucuguuaucuuccagcauccauauucggcauaugcugguuaucuuuuucaguucugucaaugugacuuaaguuuuuuugauauuuuauaucuguuuucuuccuggacauuuuuagaaucuugucauuauauuuaauuucauggugguccaaguuugcgucuuuucuaacaauuuuucuagguauuuugguauuucuuagaauauaaauuugguuauaggaaauauuacuuuauaguuguguggauaaauucuucccuuuuuuuuuuguuuugucuuaacaguaaucggacauuugccuuccuggacagaugaucuauaucucuuuacuuuuuauguuuuacguugccuucguaaaaacuauuuugucaguuuuauugagauauaauuuacauuaguguaaccauauuuuccagauauacaauuugauaaguucuuuaaauauuuuauuuugguaagaucacuuagcaugagaucuacccucuuaacaccuuuuuaagugugccauacaacaguguuaucuguaggcacaaucucuagaacuuauuaaucuugcguaacuaaaacuuuauacaugauugauuagcaacggccaaccucccccagacccuuaaccccugacaaccaccauucuauucucuacuucuaugaguuggacaauuuuagauaccucauguaaguggaaucaugcaguauuuguccuucuguaucuggcauacuucauguagcauaauguccucaaguucauacauguugucacauagugcagcauuuccgucuuuuuuuuaaggcugauaaaauuccauuguauguaugcaccacauuuuuuaauucauuugucugucaauggacauuuuagguuguuucuacaucuuggcuguugugaaaaaugcugcagugaacuugggagugcuaauaucucuuugagaucccgauuucaauucuuuuggauaaauacccagaagugggaucucuggaucauguuguaguucuacuguaaucucuugaggaaucuccauacuauuuucccuagcagcugcucuguuuugcauuccuaccaaaauaugcaaggauucuguuuucuccauguccuugccaacacacuuguuuuugcuuuuuguuuaaauaauagucauguuaccagguaugaagucauauuucauugugguuuugguuugcauuuccuugaugacugguaauauugaacaccuuuucaauauacuuguuggcugauucuuuggagaaauguguacuuaaguucuuagccaauuauuaaaaucggauuuuucugguuucugaaugcuaggauuuuguuacauacuuugggaauuacucccuugucagauauaugguuacaaauauuuucucccauuccauggguugccuuuucacccuauuguuuccauugcuuugcagaagcuuuuuuaguuugauguugucccacuugucuuuuuuuacuuuuguugucugugcuuuuggugucaggaaaucauugccaagaccaguguuaugaagccuuuucccuauguuuucuucuaagaguuuaacaguuucagguguuaagucuuuaauccauuuugaguugauuuuuuuguaugguauaacauaaggguucaauuucauuuuuuuugauguggauauccaguuuuuccggcaccauuuguuaaagaucacauggcauuauuuuucuuuccuuguuguucugucuuuaauaaaaucuggaaaguaacauuuaaauguuauaauuugagaaaaugaaauauuuuccaacauacacaguauauuuuauauacugauauucagacuccuuaaaaguggugauuaugucuguguccucaucaccuagcaaauagccuggcauauaauaguuauucaguacauaguagcugaauaaaguguggcuccauuaaacucacucaugugaauuuacaaaauaguaaaauuuauuuacagacuguugcucacauaacauguuggaaaauaguuuguuaaaaagaacucucauuuuacuacaauguaaugaucaauuguucuuucuguagacauacgucucguaaaaaagcaacaggcuuugcugcuguucaucagcuauuuacagaacgcuggccaacaacaccagucaauagaagucuuaguggcacagcuacagagagaaauauugacuuugaacuugauauacggguugaaauugauaguggaaaauguguacuccacccaaccacccuucuacaagaacaugaugauauaaguuugagaagguaagaaauugauuggaaaaggauacaugaaacuuuaucuauuagaaauacuauucauauaucacugaauuauaacaaacuucuccaucccaaaaugcagauuugaaguguaaauguaauuauaguuauaauggucaaguguauauuucuuauacaguuucuuauaaacaagugcauaauauuuucuggcaacuagaaauggaugucugacuuagauuuuugcaaguuuuuuaauuaaaauaguuauaucuuuggaauucuuuuaacacacaugaauuucucagugucugucccuguauuauacauauuucaguuuuaaagaacaacacaaugcucagaaguaucuugguuauugagaguuugauaaguucauaaagaaauaagaaagacugggagacaguuacacagaccucaguagacugaaauuguguucaggauauaacugcagcuuuacuauuuguuuacaucacuaacuaaaugaugauauaaacaggauuaacauuuuuuucuuuaaauuuuguuuuccuuuucuaaucuaaaaaugaacuguaaaaaaaauaguuauaauugagcggauggguggagauguagauaaaaagaaugcugacaauuauugaaacuggguagugggaacauggaggaucauuaaugauacuauucugauuauuuuuuauacauucaaagauuuccauaauaaaauauuuaauugaggcuuuuauaaaauaugagaaaauaaaaaagguacuauaaacaguuaaaaugucuuacaaauguaguagugaugauaaaaaggaugacuauuaguuuauuuuugauugaaacauaacccauaauaaauugcuaauauuuagcuguauuuuuacuauauaaagggcaguuucauuugguucaaccuaauauauucaaaugaaagucacgaccuuaggaaagaauaaagguaacugcccuguauaguuacggaacauacaacauuuacaucacucaugcaaggcauuaaccagucucgcuagagauacugaugaacuuuacuuuuuucaacuucuuaaaugaaggauuguauuccauuuacuguaaaaauaaaaguuugcuuuuuuuuuuuuuuauuauacucuaaguuuuaggguacaugugcacauugugcagguuaguuacauauguauacaugugccaugcuggugugcugcacccacuaacucgucaucuagcauuagguauaucucccaaugcuaucccuccccccuccccccaccccccacaguccccagagugugauauuccccuuccuguguccaugugaucucauuguucaauucccaccuaugagugagaauaugcgguguuugguuuuuuguucuugcgauaguuuacugagaaugaugguuuccaauuucauccaugucccuacaaaggauaugaacucaucauuuuuuauggcugcauaguauuccaugguguauaugugccacauuuuguuaauccagucuaucauuguuggacauuuggguugguuccaagucuuugcuauugugaauagugccgcaauaaacauacgugugcaugugucuuuauagcagcaugauuuauacucauuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccgcauccucuccagcaccuguuguuuccugacuuuuuaaugauugccauucuaacuggugugagaugauaucucauagugguuuugauuugcauuucucugauggccagugaugaugagcauuucuucauguguuuuuuggcugcauaaaugucuucuuuugagaagugucuguucauguccuuugcccacuuuuugaugggguuguuuguuuuuuucuuguaaauuuguuugaguucauuguagauucuggauauuagcccuuugucagaugaguagguugcgaaaaguuugcuuuuaaacaaaaagauaaaugugucauuuuuuaaaaagauaagaacauuuuucuguucacaggaguuaugaucgaaguuccaggagcuuagaucaagauucaccuucaaaaaagaagaaguuucaaacuaauuaugcuucuaccacccauuuaaugaccggcaagaaagugccaucaucucuacagacaaagccuagugacuuagaaacaacaguauuuuacauucccggaguugauguaaagguaaaaacccaauugccuaggguaagggauuagacuauugguagcaauguuuauuuucuaucauauauguucaucuuuuucucauuauauuaaaaugagacuuagugacuucuuugucuaauauagccauauucuggacagaagaacaucaaaacugcagguucccacuucauuuauguagcauuuuccaugaaaguuugauggaaagaaguucgguuuuuuaauaaauugauauucguaacaaacuugcuaaaccuugcuagugcaacuucauuaaacaacaguuuuuuagauucuggaauuauagaaucauagacuauucaguucgaaaggacauuaaagauuaucugaaaugaccuuuuuauuuuaaaaaaugaauaaaagcaaagaaacuugccaggaucacaaagcuaacuuuuaaaaguuaaaacagucuucugacuuccaauguucuuucuaccacauuuuucuauauuucuugauuuuccucaucuucauaauuuuaauuuuaaaaguuuauuuauuucaauacaguugcauuacaauuccaagacgcuaaagacugaaucaccuaaugccuccaggggaucuuccuugccaagaacacuguccaaagaguccaagcuguaugguaugaaagauagugcaacaucuccuccuucuccuccuuuaccuuccacuguccagagcaagacuaacaccuuacuuccuccccagcccccaccuauuccugcagguauuuaaggaguauauacuuuauuuuuugucauuuuaaaaauuuuuaguuauuaccuacuugcucuuuugagacuuuccaaugcacauguuuaagaaaaaaggacauacauuugucaauaaugacucuacagacuucauauauggaagugugggccaaccauuuucaccuguuuuugaaauugacauuacuuuagaauaucuguuauaaaauaaauaauauaccaaauaguuuacguaauuaaauuuuuaggucuguauauauaaaaagaguaguuuuauguagcucaaauuugggagcuuaugagcagauggaaauaucaaacuugagaguacauuggguuuaaccacauuuauuacuucucuguuguauaacacauuacccagaauuuaguggcuuacaaccucaaccacagguucugcugaucagaaauguaggcacaguuuggcucaguggaucuaacuuauggucuuuuacaagauugcagucauggcagauuuuucagccccagucaaguauucagaugacaauacuugacuggggcugaaacaucugccuccaucaugucucagucaugugacuggcuaauugguacuucccuuccucucaugugggcuucucuacugggcuucuugaguguucucaugauauggcaguugacuucccuuaaaaggagugauccaaaagauaccauggcugaagcugcauuaucucuuauggcuuagccuuagaagucacacaccaucacugccacaagguuuuacucaucacacaggucaguacggaaguaaacuacacaagggcaugaauaccaggaggcaaggaucauugaaugucaucuuggaaucuggcuaccauagcacaugaaugauaccguacauacauggcaggauuuccaaaaaaaggaauaucagacuagacaagaauuauuugagaaaguuucauuugggagacaaaacuugauauauaaaccuuuuaaaauaguaaucaugcugagaaugccuaguaucacuuuucagcuaacaaggcacaucuguguccauuaagugcauggcagcuauuaaccccuuuuauaaaggaaaguuaaggcucauagaaguuggaugucuuuccuggauuugaacaacuaauaaauguuaaaaguuggaaaccuuagccaaagcuaacuaagucuuagauguuuuacucauucuccugaagcagauauauuuaguuagguaaaaggaaagagaaauggcaucccauguagggaagcauuauaaauacaugcaagcuaagcacaggaaagccugaaaacagugacguuuuucuucacuugccacuaaauauuguuaaaguucucuauaucuucuuaaauggacaaaaggacuaaugcuaaugagagucuaaccaaaauauaaagcugaaaaacuggaccaaaacuugugacgcagagcaaguaggaauaaccaacuuauuauauguuauuaaucgccucuguauucuaacauuaacauaucauuccuaucaaccugcuacuuuuauuauuuucuuguaaggccuuaaaugugagguacuuugcuugauuaaacuuuaauauaauucaaauuucuguuuaauuggaacuuuuuauaaaauccauuaaauggaauuuauaaauguucuagccaaaggaaaaggaaguggaggaguaaaaacagccaaguuauaugccuggguagcacuucagucauugccagaagaaaugguuauuagucccugccuauuagacuuucuggaaaaagcucuggaaacuaucccaauuacaccaguugaaaggaauuauacagguaagcauccuucuuauauaccuccccauaacauauauuuugggaucuuauuauauagaagguuuucuuaaugcuauuauacauuauuacauaauauaugcaauuauaaauguuaaagaauuauaaacuguaaaagaacuugagagaucaucuaauugucauuuacaaaugaagaaacuaaguccuggugagguuacauaacuuucccauggccccaccuaguuaaugacaaaauuaacauaaguucuacauccuuagugugucccuuggacuggaaucucuuugagggcaaggauauaaucacuaguuucuuuguacaguguuugguauagcagcaggaaaauuugaguuugggggaaugagcaagaggugcgaacagggaaaaacguauagaaugaagggcuacagaagcaaauguuuccggguguucauaccuuucaucucacucuaguauaaacaauaaggaucuuuuaauaaauaguuugccuuugaucuaauaauaaaacuuaaccaaauauuuuaaacagcugucagcucacaagaugaagauaugggacauuuugaaauaccagauccuauggaagaaucaacaacaucacuagugucgucuucaacaucugcuuacucuuccuucccuguagauguugugguuuauguacgaguucaggugacauacuucauuucuuucuuuuuguuuuaaagagaaauguuuuucuuaaguuuauuugaacauuucaacauuauuacuguuuaaaaguuuucuuaaccucagguucaugaaccuuuaguauguuugugauggcuuggagguugccagaauaugugugaaguauguguaaaauuuuauguauauacagaugcucaaguuaugaugcuguucugauuaacccaucacaaacugaauagcguaagucaguaaugcauuuaauacacuuaacuuacugaacaucauagcuuaaacuagcuuaccuuaaaugugcucagaacacauuacucuucaguuggguaaaaccgucuaauacaaagccuuuuuuauaauaaaauauugaauaucucauguaauuuauugaauguuguacugaaagugaaaugcagaaugguuguauggguccucaaaguacaguuucuacugaauguguaucacuuucgcccagccuaaauuggagaucaucuauauucacuuuucuaccaagaaguuucauagaucuuuggguuuucaaaaauuaaagcucauacuucugugacaaaaauaaaaauauuuaaguuaaaacccuuuuuuaagcauuuuaugccuuuauuuuggcaccuuaauuucuugccauuauaguucuuucugggcagauauaaaguguaauugagauauaaagucacaauaguaccuuuguucaaauuuuugcuaaguguuaccuaguuuuuauuuaauauuuuauucuaaaaugcaguccuaccaauaggccuuugggaguauauauuagcauauauacuauaccaaauauauuaguauauauuauauauaauaaaauauauauuagcauauauacuauacaaaauauaguacauauuuaauuaaaucuguuuaucaaggaggauuuaaaacuacuuguaucaaaacuucaggguuuaguugauccucaauuaaaaucuaauaaucuuaagaguaaggaaacacuaauggucaucuguuccaacuaucuucuauaacaguaauguggccaaaagagcuucagucuuacauuccagaauuuuuagcuagcuuuuuuaaaggucugaugaaaacagaaugaaugaggguuugaggguuauaaaaccuuugggcugggugcaguggcucacaccuguaaucacagcacuuugggaggcugaggcggguagaucacuugagccugguagaucacuugagcccaggaguuugagaccagccugggcaacacauggagaccccaucucuaccaaaaaaaaauaaaauaaaauuagcgaggcgugauuguauguaucugugguccuagcaacuugggaggcugagaugggaagauggcuugagacugguagguucaaaggcugcagugagccauaauuguaccacugcaguccagccuggacaacagaguggucucuaaaaaaacagagugucucuaaaaaaacaaaaaccaaccuuuguuaauuaugaacaaguuuaauaugagcauaaauuuuuuuaagguucugaacuaucuaaauaucuaaauacagucccuccguguacuuaggagacuggcuguaggacuaccccugcccccuaccauguauaccgaaauccacacauacucaaguaccgcagucagcccugaggaauuacuaaaaaaagagacaccccucuguauaugcggguuuuucaucccaaauacuguauuuucaauccauguuuggcggaaaaaaauucauauguuaauuggaccagcacaguucaaaccugugguguucaagggucaacugucuuauuguucugagauggcuccucaaauauuuagguuuuuaaaaaugauagcauuuuguuuauacauuuugauuuuuauaucaugcuucuguuuaaaaagcuaggacaaugaacacaaaaucuuaaguaucaaaugaguaaacaugaucaauauauguagacagaaauggaaauuaaauguaacuuuugaaauccaaggugaaauuucuuaacuuuccuguagauguugugguuuauguaugaguucaggugauauacuuuauuucuuucuguuuaaaaaaaauguuucuuaaguuuauuugaacauuucaauauuauuucuauuuaaaacuuuucuuuuauccaguuccuagaaaccuuuugcugucuguuauuuuuagcccucacagaucaaauuuagcuguuuaccaguaucaagaguagaaugcauguuaaagcugccaucccuggauuugguguuuucuucaaaccgaggagaacuggagacuuuagggacuacauauccugcagagacuuuauccccuggagguaaugcuacucagaguggaacaaagacuucugcuagcaaaacuggaauaccagguauagauaauguucuuuuauuccucuaguauaaagccaaauacuauuuuuaaaucaauauuuuaauaguaauuaauacauauuuuaaaauauauuuggaaaaggggaauauuugaggauuauuuauagaaagaaaucuauagcagaccaauguuuugaguauauuucauguguuauuugaacuugaguuacccuuugguuucuguuuuuagcugaauggcaauuagacagcauuuugaauauggcuugaauguacauacuacaagcgcuaugacauaacuacuauauaauaauccacauguucaaguacuuuugaauaucuuuuaucuuaagcuacauuugacauuaaggaguaaucaguauuauaaauggaaaauaagaaacauaguguuaccuuacagggauuucuuaucacacugggugaaaacuguaucaaguagcaguagcauauguauuuuuaaauggcaaauuugguuauacaacucaaauauguguuucauaaagguuuuguuuuuaaaauauaauugauuuccugagaugauaggcauuccucacuauguuaaagcugggugccacuucuguccuaaaaaugaaauagagaucacacaugcaaaugguaaaaauuuuauugaauaccucugaaaaaaagagacuagacugaaugaaaacugauaagaagacuggaaugucauuaaaauauugguucuuaaccaggagcuaucuuguuggcaauauuaggagacaauuuugauagucguaacugaggguguacagcuggcagcuagaagagaaaccagagaugcugcuaaacauucuauaguauauaugacaacccccuccacucccaaauaauuaucugguugaaaaugucaauaauggcaaggcugagaagguuugcauuaagcgugaaaaaaauaaaaucccaaauuccauuuuugagagaggcaugaagacaguggagggggaaauaccuuucugauuuguaaggaaauacagcuuagguuuuggguccuauuuuuagagagucaucuuagauucaaaucuuuauucuaacaaucucaucaagcaucaguuggaaaaauuauuacaaacuggcuugugagaaagcaucccaaaagucaucuuugaaaaacugaaauuauaucucuuaacacaguauuuacuuguauuaauggggaaaugguuauaggaaaucauuuguuuugcugugugaaucuuugaaaguuuucacaacaaaauuggaaaacaaaaaggcugauaccuuagaaauaaagcuuuugcuaauguggucacccauuaucuaguacuuagcuucaaaauauugcuguuggaguuguguugucaacaaaauauuguagugguaguguugguuuuugaaaaacauuuucugauuauaaaaguuacacucacuauucauuauagaaaaugaaaaguacuaaaggugaaaugaaaaugagaauaucccuuuauccuagauaacuaguguugucagcgauaacacuacaacauuucuguagugauaccauauuuuuccaaggcaaaaauugaaauauggccucuucugcuauguaacuuuuuaaaauuuaaaguaucauagguauuuuccuaaauuauuaaauauucaucucuaaaauuaauggcuauaagauauuccauuguuuggaucauauacuugagauucuguggguuauuuugcuuucaaaauaauacuaaaaucaacaucuuuguauguaaauauuuuuaaacaaagauauauucuuaggagaaauucuuaaaaguggaauuucuagguuaggaaguaugaacauuuugaaaguguuugauacauuugcuuucugguaagacuguaagauuucuacacucucaucacaguguguauggacaccagcucacuguauucuucccaacacugcuuuaaauuuaauuuuaaucauugucaaugugauggauuaaauuuggauuuuauuauuuuaaucuguacucuauuacuuuauuagcuauuucuugggagugguaaauauaugcccaugcccauuucucuuuuggaauguuaaucuuuuaaugacaaacugucauaaugucauaaauuauuagcacuuaaauuaauauagcaguauauaugcaccaugcuaggaauagguagugaaaggaauaugaaaugagaaauuuuuuaugcccaaauuuuaugauuccuuagaaaacaacauaaaugaauagcaccccucauuuuaucauuauuuauucaaggaaugaugauaagaauauauagguugcgacaauauccauucuuucaaaggaucuuuacuuuguggucugggucagugcuagggcauaguaauagugaacuuagcuaguagaugugguccauacuuacuaauguggagccuaaacugaauuuggagaaacaaguaauagcccagcaaacaaguuuauuuuaaauggaaacgugaaguaaguauggguuagcgaagcagagaacugggggaauggacacucccaggagagaauacaaaaugcacgaagaagaaacaguuugucaacucugaauaacaaaaaggaaaaaaaagccauuguuaaguguggagacuggcauaagaaagguuuagagagauaggaaagagccaacucaugugggaaagccacugaaagguuaagcaagggaguggauaugauucacacacauacuuuuagaauaccaguccagcugcaguguggcaguugauuggaguagcaugaggcaaggagagccauuucugcaguccaggcagaguuaauaauugcuuaagcuagaauggcagcagugagauggaaggaaauggacagacuuuauaugccugagauauagaaaugaugaaugauaaauugcaugacagagucaggaguaggaaggaugacggauaacucccagguuuugguugagcuauuuucuuuuuauuuauuuauuuauuuauuuauuuuuuuuuuugagacuaagucucacucuguuguccaggcuggaguguaguggcgccaucucagcucacugcagccucugccuccuggguucaagcaauucuccugccucagccuccugaguagcugggauuacaggugcgugccaccacgcccggcuaguuuuuguacuuuuaguagagaugggguuucaccacauuggucaggcuggucucaaacuccugaccucgugaucugcccacuucggccucccagagugcugggauuauaggcaugagccacugugcccagccugguugagcuguuuucauggaaguauucauuuacuggagauggggaccacuggaagaaaaacaaauucaaggaaaaagaucaagagugcaguucaguuuaaaugccugugacccauucuaauaggaggucaaguaggcaguuguaauauauaaauccaaaggaggucuggucuggacauacauuuuggaaucaccagcaaaaucauuuaauaaucuauucaaauggucucauauuuuuuauguuuuuggaauuuaccuguccaucccuaguaaauguuaccaacaaggacacuuggcucucuaacagauuuuuuuacuuucugcuuuugcauaccuugcccuguuuccacugcaccuacugaaauguggacuccaaguauaugauauggauuuuuuuacaguauguucucccccacuuugcuuaagcccuagcuauuuugggccucuuccacugccugcuucuaguagugaaggagaaaagaaauaggaaaccaugcaguaggccaaacauauauauaaaaauaauuguuuuaaggaugaacagaguauucaacccugguguaaauuaauuggaaaauacaucuaagucuuuauuucaguuuuaaggauuuaaaucuauugaucuguuaaaucuauugaucugauguuugaguguuuccauuuuauucugaagucaugucugguucuuaagaacauauuauugacuggccuuuuuuucuuguagcuuauauuuucaauuuccugugcucacuguagguucaucgggauuaggcagcccucuuggccgaagucgacauaguaguagucagucagaccugaccaguuccagcaguaguucaucuggcuugagcuucacugcaugcaugucugacuuuucccuuuauguauuucauccauauggagcagggaaacaaaaaacugcuguuucuggccucacaccuggaucaggaggauuagguauacuuugcauguuuaugucuuuuucagauuuacagcaucuuuucaagcuuucaagcuuuauuuucauaaaucauaaggacauagccaagaucagaugcuuuuuguauuuuuccucuuugauaauaccuaucucauauuuacguaauaaguagacauauacaauaaguaauucaggugaauuaauuauacaagaauuuuaaaauucagaauauuuucuaagcgguauacacagcacaguaaucucuggauaucagagauuacuuauguuauugaaauauuuaaaugucuuagcaaaucacuguccauuuauacaacaaacugcguagaaaguaaaauuuuaaagugcaugggucacaauuguuaauuuaaaaagagacuauaauuuaagucagccauuucgugaaauuaaauuucauugucacuuugaagagcagauaaaacacugcaaaugcauaaaagcuucuuauuaguaacuaacucuugacuuguauuuaaauaaaugaugaaaacauauauuccacgucaauucuaguuucuauuguuggagaaggguuguaaaaaucaccaauuauguuuguggguuugaaccucuuaaauuguuguuagaaaugcuaaugcucauuagaucccucugcuuaaauuuuuaccucaagugauuuuaauucauggcauauuacaguauauuagauaauuuucaccuaacuagacagcuguguguauauauguauauauagauguggggguuguguuuguuuguuuguuuuaaagggaauguggaugaggagcccacuucagucacuggucgaaaagauucacucaguauaaaccuugaguuuguaaaagugaguuugucacggaucaggcguucaggaggugccucauuuuuugaaagucagucuguaagcaagucugcaagcaaaauggauacuacguuaauaaauauaucugguacucaauuuuauaguuuuuaaauuaaaauacuguuuuccaaaauuaaauaauggccucuguuuuaauaguguuuaaauauuaagucacuuaauguuaagcuuucagugauaaguugauauaaaggagaggaaugcccagccuacgguacugugucaauccaaguaauaaauguuaggaauauaauuucuagauaaauagacauaucacccaagggccaaguaugccuaauuaaaucaguaaaaguugcuucuuuucuucacuuuuucuccaccaugaauugguacaguuucuuuuuguucuucuaauuguaaaugcuuaaaacacuaaaacgggaugagugauguuuaaaaauguuuacuugaugucagaaaaccuugaauugugugcauguauacugcugguuuuauaaacaucuauauaacuaugggcaagucauuuccuuuacauugcgauuugaguguuuaaaaguaaaugcaaauagacauucugaagaauccagaauacugaguaaaaacuuucauaauuaugaaucaaauaaauaugguauguucacuuaacccaauauucugaaaauauauauuaagccuguguuuuaggguaaacuuuuaccugagauugcuaggugauugaggggagcaggcaugaauaagacaaggucuuauguguagacaaauaaaugaguccaggauaauaaaugcuauaauggagcuuucuacaaagagaaggaaacaauaaauucugucuuguaugagaaaucagaaaaggcuucacauaggaaauguuauuuggcccacauuuugaaaaaugaguaggaauauucuuggagguagcaacaugguauucaauggcacagaagcaucaaaauguaugcuucuggaucauacuuugauuugcuguggcugaagcacaggguauaagugaacauuuaauugguuggagccaauuaaauguugaacauuuaauugguuuaaguggauggagccagaaauagagaggcuagagguaaagcugauaaaauaggaccugauuguggagggacucauaucauaugccaugauaaagaauuggguucugauuauuucggcacugagaagccauuagaaguuaagaaauggguugaugcuucagaaugguguuuuagaaagagaguugaggguagccugaaagacaggaaagaaaagaugcuugaggaggcugcugaaguagaccaugcaauaguagaugagagcaugaacuguggcaguaaaaaaaggagaaaagggaaugaggaguggguucaagagagauagaagagaauccauaaacuuaaguauaaguuguauuaggggcaacagaggagacaagaaugccucaaacuuuuagcuuagaugacugaaggagcagugaagccauuaacuuagaaaauaaagaaggaaaugucuauaggacauuuagguggaagguucugguagacaacugacuuagcggguaucgcuauguagguaugggcucagacaaaaacagaaauuuuagcugugggagucauuggcauguaaacccuauagaaacuaugguagaagaauagaagagcacauacaacaggaguagaagaaugcuccagagcagaacucuggaagaaggccaucaaaauguuuuuugucuaaagucacugcuauuagucugauaggaaaauaguagucccugccacacagcuauuugguuuacaauuccuuuugagaaaauuuguauaccagcucauccugaugauucauuuuccauaauagaaaagacugcuguguuaaaauugaaagcuggcuaucagacugaucuuuagaacuucucugaggauuucaugauaaagugauaauagaauuccaacuugccaucaccucaaaaaagggaagugguacuaacaguguuagaaugugcuguuuuuguaauuuguggaagaauguaacacuaaucauaauauguaacuuaaguauaauucagcuguguaauaacccugucuuauaccuaccaugugaaaacauuaaagguuuuagaaaucuguacuaacaaauguuauuuauguaucagcuguuugugauauagggucugccuccuuuaaauaugauaugcgccgacucagugaaauucuggcauuuccaagagcaugguauagaagaaguauugcaagacgucuauuccuuggagaccaaacuauaaauuugccaaguaagcuuguuauguaauuuuaauuuugguuacuguagcagcaagaccuacaauugauaacacaaacgugaucuuacuuggcaggguguaccaugugaugcguucagucauucaagaaauguccauugggccccucuaauaugccaaccacaagggauauauuagcacugaggauauaucagagaaccaaaaagacaaaaaguuuugucuucuuugagauuacauucuggcugaauaaauauaguuuauucuauaacuauccuaacaaauuaguaaauuuauaaguuaguuaauuuguuaguaaauuuauucuauaaugauuacucuguaauccuuuuaaauauccaaguuaaucaugguuagcgaagcaugggaaacagaagaugcuggggacauguuacuagcuugccugcauuugucugcuggauuuagauauuguuguagguaaugaaaucaagagauuuuuggaaaugaaaacuagagucaguuacauagagguaaauuugagaaacccuaagucugaguguauucccucaccuguaaacugagaccagagguccuguuuugcucuuuucauggaguuuaaacaaaacacuggcauguucuuugcaaacuguaaauugcuguacagcugcuaaauagagaacuagaaggaauauguaaugugauuagaaaugauggaugggugaacuuauuuuauaacauagggauuuuacccuguuacuuuggauuuuuuguuuguuuuguuuguuuucuacuagcaucuggcccagggacaccugauuccauugaagggguaagccaacaccuuuccccugaaucaucaagaaaagcuuacugcaagaccugggagcagccaagucagucagccuccuucacccacaugccucagucaccuaauguguucaaugagcauaugacaaacagcaccaugucaccagggacaguaggacagagccuaaaauccccagcuuccauaagaucaaggaguguaucugauucuucaguuccucgaagagguaacacugcucuuuuuguuaucaguagcccuacaguguucucaggauaaaaucuuaguuacucucagauuucagcccuaacuauaggaaaauaaauucuugagguuuuuaugacacgucaaaaaaaaaaaaaaaaauccccaacacaguaaaaacaacaaaacaaauauuucaaaguauugccaucaagacagcuagauggccaguagcuuuacaaauagauaaggggagaggaauuagcauauuguuugugugcuccauaugggcuuggccuuguacuugugccugauuguauaaaaaugaaugauguaguucucgucaaaagauuaaaauauaaugagcaaaugcaggauucaagauauauacuaaguccauaagaacacaaaagacaggcaccccaaccggcaucugcauuucagaaugguuucugccuuugaguccuguauuuggcaacagcaccuuaugauuuucuucuuuguuaaacagaauccuagggugaugcaugaucugugcugcuauaucccaugcacaccagaauuuccucauauaaaaugggggccauacauaauuuuaugagcuuucaagagguaaagcugccagcacuuauaaacauuuaguaagugguaacuauuauuuuagaggcaauaggauaaccauuaaacauuagauucuaauacaagaauauuauauuuuuacuuuuuggauuauagcaauaaaaauaguuuuugcuuuguaacuagcuuggcauuuaugugaaugaacauguauuugauuuuucuauuuuuagauucacuuucaaaaacaucaacuccuuuuaacaaaucaaacaaagcagcaagccaacaagggaccccaugggaaacacuugucguguuugcuaucaacuugaagcaauuaaacguucaaaugaauaugaguaauguaaugggaaauacaacguaagcuauucagauacaaaggaaauguauuuaaucauuuuuguaacuuuucuucuacuguaguaaagauauucagaaccuuuuuugaaugcuaaauauuugaaaaagaaguagauaaacgauauaaaauguuuuauccugaaaauggcuuaauucuaaggauacugcaauauaaaacaucaugaaauauauguucuauaaaaagggaaucaauuauaaggagaacaggguaauuuucuagcuuuucuagcuaggaguaaagcuucauuaucaauguuaauauucaaauauuuaccacacaguuuuuauauaaaguauguuguuucauugucaaacuugaccuuuuaaauaaucugauuuaacuccuuuuuaauuuaaauccuguuuuaauucaugacacuggaagcuauauauauaauaaccuuuuuuucauuuuuuaguuggacaacuagugguuugaagagccagggccgucugucaguaggaaguaaucgugaucgagagaucagcaugucuguuggucugggaagaucacaauuagauucuaaaggaggaguaguuggagggaccauagaugucaaugcuuuggagaugguugguauguugaaauuuuaaaacugaccuaacauauccuuaagauauauauaucaaaaaaaaugcuuuuggagauggauucucaugaguuuuucccauggacaugucugucaaaauuaauuauuguuucuauuuuagcucauauuucugaacauccaaaucagcaacccagucacaaaauucagauuacuauggguucuacugaagcucguguugauuacaugggcucaaguauccucaugggcaucuucaguaaugcugaucuuaagcuucaggaugaauggaaaguaaacuuguauaauacauuggauucaagcauaacugauaaaagguauuuauuaaggauuacuuuuuggacacuuuacaugacuguucucaacauauugucuaucaucuggugagaaaacagcaauuuuucuuacaaaacucuuauuuauuaugcaauuaauacaaauuaaaaagcugggcgggggaagaaaauguuucuuguacuuuuugaguaucugcuguaagacaucugacaaagauuuuguuuuaugcucuagugagauuuucguccauggagauuugaagugggauauuuuccaaguaaugauaucaaggucaaccacaccagaucugauaaaaauaggaaugaagcuccaggaauuuuucacacaacaauuugauaccagcaaacgagcucugucuaccuggggaccaguuccuuaccuuccgccaaagacaaugacuagcaaccuagaaaaaaguucacaagaacaauguaagaauuagaaguaagcuuuuauauaugcuuuaucuuucacuaaauauguuacauuuuuaauuuaaaauaauaauaaucuguaugccccacuuagaaaauagcccacaggcucuuuaucucacucaguuagcaaaggaccagaauuucuaccugccaauggaauuagaggccaucauuuaggaagacaucauuuguuaucucuucccccugcugcagugcaucugcauccauacccacuccacgcucuugaauaguguuuaugagaauaucauguucugguuuagaaugucuguggagucagaauaucugaauuuggauuuauuaggugauaagcaggucauuauuuucacuuagcaauucaauuggcaaauauuuauuaagcuacaaccaugugcuuaggcacuauucuaggcacaggagaucuagugguggacagaaucacuacccucaugaagcucagauucuaaugggagagaaagaccauaauaaauuuacuaacuaaauauauaagauaauuucaguaagagagaagugcuaagcaaaagaacaaaacgggaagaauauagagaaugauuaaaugugaggauagcuauuuuagaaagggugaucauuuaggccuuuucugaagugacauuuuaguggaaaugugaaugaaagaacaaggcuaagaugugggggaagagaguuccaggcaucgggggauacugaguccaaaguuccccuaguaggaacaaacuuggcuugaggaucauuaagguugccacuguggcuggaacagaaaugagcaaggacgaaaaugccggacaugaauucacagaggucuacuacagguaagauuuuuaauaugaugguuagcuaucagagaguuuuaaacagauuugauaucggauuuaucuuuucaaaaaauacucccuuuuaaaguucacucuggcuacugugugaagaacagacuauaggcaguuaagaauggaaggaaaccauugcaauaauuaccauuaucauuguuauguacauaguuacaucauuauuguaaggaagccauugcaagaguccaggcaagaaaugguggcuuucacuaggaugauagagguguaaguggugagaaacagucagaaugaggauagcuuuuuaauaacuuuauuaucacagaaguaauacguauacauugaaaaaaacuagaaaacacaagagaagcaaaaaauaaaaccaucacauuccacucagaaaucacugugaacaccuuagagcauacaccuccagauauuuuucuguguaucuguauauaugcguacauuuuaagaaaauaucaaaauucauaccauuuuguaggucaacaaucuccaacuuuccauuuugcuaauuaucuccuuuagcuuucaaaacacauucaaauuuccaugauugaucuaaaaauguccucuauaaugguuuuguccaaaccaguuuauccaauccaaagucacagguuaaauaugguuauguuccuuugccuucuuuuaauuuagcacaguucauuuuuuauaugaacugacuuauugaagagauguagccaacuguccuaaagaauucccuaccuucuagaucuuuuucaguuacuucuuuguggugucauuuauguuuuuccuguaguccauguauuuccuuuaaacuaaaauuuauauuaggcauauaaaaauugagggauguucugcaaaaugccuggccuggauucuucaaaaaaacuccucgucacaaaaaacaaacauaaaggcuuagggaauuguuuaaaggaaaacauaauaaaugaauacaauucaugaucuuugguuggauuaugggugagagguauggaaaacagccaaaaggaacauuauuggaauaaauggaaaauaaacguuguauguuugauuagugcuucucaaacuuaacaugcaucugaaaccccuggagauguuauuaaaauaaagauuuugauauaguagguacaggugggcuuaagagucggcauuucucacaagcucccaggcaaugcugauucugcuggcccucugaccuuugaguagcaaaggaauaugaguuuaaaagcaguacuuaaaauaagggggucugcauuugauuucuaggucuuccaguuacugguucacuuaaccucuuuguucuucugcuuauucacuugaaaucagucaagaugaaauaucuaguuuacaaaguuauaaugagaauugagaauuacauaaaauuccaugcaaguacuuuguaacucauuaaucauuacagacauauuagguuuugguuuuucuuuuuuuuuuuuuuuuuuuuuugagacagguucucacucugucauccaggcuggagugcaguggcacgaucucagcucacuacaaccucugccuccuggguucaagcaauucuccugccuuaaccucccaaguagcugggacuacaggcgugcuccaccgcacccagcuaauuuugguauuuuuaguagagacaggguuucaccauguuggccaggcuggucucgaacuccugaccucaaaugauccacccgcuacggcuuccaaaagugcuggguuuacaggcgugagccacagcacccagccucagacauauuaguuuuaauuauuuuuagcaaguuacuacuuuccuuagcuauauccauccucaugcagcaucuuuuccuagaaugucucuuuauuagcuauugcuuaauguuuaacaggcacuggacacuguuuucaucccucaccugagacuguagaaaguagccacuugcugccucacucuacccuauccaaggguacucauuaggcacuucaggauauguguuuuuugguuuucuugcaguacuugaugcagcacaucaucgacacuggccuggaguauugaaggugguaucaggaugccacauauccuuauuucagauuccauuaccagaagauggaaugcaauuuggaggaucaaugagcuuacauggaaaucauaugacacuggcauguuuucaugguccaaauuuucguucaaaaucuugggcccuuuuucauuuagaagaaccaaauauugcuuuuuggacugaagcucagaaaaucugggaagaugguaaacugacacauuuccagcuuuuacuuucuccuaucuucuguuaugacuauaaaugacaauuguauuucugaaguccaucucuguuuguuaucauguaucugacauguuaaggaguucacuaccaauaagucaauauuuauaaugucuggaacauguuaauuucugaacuugccaucuuacuccauguuucuuacuuaggcaauuaaaguuucugcugcuguggcuaaacauaagucaugguaauaguuacuguaaucuuucuuauaaaaacaugaagugaaggcaacauagugguagugugaggaaauuauuugccagucaagacuauauuauaaaauauauaggcaaggcugugcuuuuaucucuacagugauaaacccauuuccuuugagcuuuacuuuucuacuuggugguuucuacauugagggaaaaaaauguuugauguuugaugcuuucuucaucuuacuagggacaaauccaauuaccacuaauagaagaauuauuugugaauuauuugguuuuuauccucauuuauucuucauuuuuauagccuuccuauauaugacaacugaauuuauagcucugaggccacaauuaucaucuugaaucuaaauaugguuuauuacuuuaaaaaaguauuuuuauuuuguuguaggcuccagugaucauucuacauauauuguacaaacacuagauuuucaccugggucauaauacuaugguuaccaaaccauguggugcuuuggaaaguccuauggcaacaauaaccaagauaacaaggcgucgccaugaaaauccaccccauggaguagcaagugugaaagaaugguucaauuauguuacagcuacaaggaaugaagguuaaaauuuugagucuuuggagagauuuauuuuguuuuuuccauuuuggauucuguugacuguguuuagaauuuaaauggagaugguguuuucauuuccuuaaacaauuuucauuuuaaucuugcuggcugacacaaguaauaauuauuuaauaccacccugguaauguggcaucucauggacucaacuuauuuuagauguuauugaaaacauucuaaauaaaauuggcuuuaaauaaaauuaaguuuauuacauugagaaauauuuuaggaaauauuuaggaaaugauucuggaaaaauauuuuucuaguaaugcuaaaaaauggaaguuuggggagguuguuacacaacuaaauaaaggaauaccacaaacuuaaaguucgaauagcuagaacaaaaugaaaccaaauauuaucauucuaucaaguuguaaguuuaaaagaaagugcuuuugauaguuuuuuuuuuucauuugauuagauacaacagucuugugauaguguggucaugauaacuuauuuuguggugcuuuugggauuuggguuuauaguauugcuuuuaccaauuaucucuguguauuggaaagcugacuagauugacagguguugagacuuuucaauguuuuacauaaaaaugaccuuuuuucuuuucuuuuuuuuuuuuuuugagacagagucuugcucuguugcccagacugaaguacaguggcaugaucuuggcucacugcaaccuccauuuccuggguucaagcgauucuccugccucagccuccugaguagcugggauuacaggugugcgccaccacgcccggcuaauuuuuguauuuuuaguagagacaggguuucaccauguuguucaggcuggucucgaacuccugaccucgugauacacccgccucagccucccaaagugcugggauuacaggcaugagccaccaugcacagccaaaaaugaccuuuuuucaaaauggaaaagauuaggccccaugagaacaguuaccauggaauaggccaucucauggauugaauagagacuguuaaaaauguuccuagaacaaaggagaauaagaaagugaaucagaagauuaugccuguacugacuauuuuaccuuccaaacagggauuugggggaagggggaucuuuauggcuggaguguccuaaagcgucuauuagcauaaugaacugcugucugaagaaaaauacuaauuauuauaauucuaagaccuauaaaaggucuuuauaaaacuaagacucuauaguuuaaucauagcacauauguuggggaaaaucaguacuucuaccugauuucaagaccaggauccuauuuaaucucaaauucuuuaagagugaaguguucaaucuauggagcccuuugggcuuagugaaauuccaacuucagacaugaauucaguugagaauaauauucauuuuaaaaucccagaaaccaaagcuagaauguauuggguuuauacaaaucccauuauaaagcuuuggucuugacaacagugagcuacugauauagauauacuacauauauaucuauaucauauguauauauauaaauauauguauauauacauauguauauauauacauauguguccauguauauguauauaucuguauacauagauauauguaguauaucuauauauaaugugauucuuuccaacuuuggaaauaauaguucuguauauuauaguugucuugaaagcuauauaggcuugucaaugccuauuguuuuaauuugacucucucuuuaucauuaugcauguagagcuaaaucugcuucguaauguugaugcuaacaacacugagaauagcacuacugugaagaauucuaguuuguugaguggauucagaggagguucuagcuacaaccaugaaacagagacuaucuuugcauuaccaaggaugcagcuugacuuuaaauccauucauguucaagaaccacaggagccuucauuacaggguauguagaaaaacaauuuaaaguuaauaagaaaauucuaaaggcacuucaaacuacugcuguguucccauggauuuuuuguaauacuaauaucuaaugaaauuaauuuucuaggcaaaauugauuuauuuucuuaucagcuauaugaccucuggaaaauuauuuaaccaacuuauaccucucucuccucaguaaaaugaagaagaauaauuggacuucauuuauaggacuauuaucaggaauaaauggcauauauagguugagcaucccaauccaaaaaucugaaaugcccuaaaauccaaaauauuuugaacacugacaugacacaggaaaugcucauuggaggauuucagauuuuuggauugggguucuaaaaccaguaaguauaaugcaaauauuccagaauccaaaauuugaaagacaucugaucccaagcauaauuggauaaaggauacucaaucuguacuagggaagugcuuaacaaacuaucaucauccuguaaaucacauacagauauuacucauuucuuuacaguugcauuucauguggaugcauuuacauagaccuauauaaauccuuauuaaugggaagaugacucauuuuauuaaaucuuuuaccauauuauugcagaugccagccugaagccaaaaguagaauguaguguggugacagaguucacugaccacauuugugugacuauggaugcugagcucaucauguuucuucaugauuuaguaucagcuuaucuuaaagaaaaagaaaaagguggguggaauacucuuuuucuuuuaggcugcaagaauggcagcugucaaugccauuuacaugaauuguuauggucuaaugagaaaaugaguggaauauaucucccgugaguugaagauaucaguaaauagcguuaguaagacuaucacagacuuucugaguacuugcuauauauacagcaccaaugguguuuuauacuuuacaaaguguuucuguauacauuaucuuauguacauuuucaguuagaucuuacaggagauucuugaaaaauaggaaaaugugagaaaauacugcaaaucaaagugaaaugacuaaagaaacaacuacauaauaaagaagcaugaguuauuuaccuaauugugaaaacugaauugagaaagcugauaaauguuuggaaugcagaaaacauuuucuuuuuaauacauaaauuauuuaaaucucaguggugguauuuggguucaugagcuugcuaacauugguuuacacacugguaacuuaauguuuacccauuaagaaauguaugguggcugggggcgguggcucaugucuguaauaccagcacuuugggaugccaaggaggauggacugcuugagcccagggcuuugagaccagccuaggcaacaaagugagaccccauuucuacaaaaaauacaaaaauuagccaggugugguggcacauaccuguaguccccagcuacucgggaggcugugaggugggaggaucgcuugagccugggaguucaaggcuacagugagcugugagccauaauugcaccaccacacuccagccugggugacagagauccugucucaaaaaaaaaaaaaaaaaguauggcagcccuaauaucuggaauuagcuaauacauuauaguacucucuaacuguuuaaaagaaugagguaguuugaaauguaaugauuuggaaugcuuacaaaauauauggccauuuauucauucaauauuuauugcaccguuaugaauauacaaugguaaaaucacauaugugcuuccuaauaaauaacuuggaauaaauguaauuuguucaagucacacuauaauauuguuucauuuucuucaugaggaaaaaauauaaaauuugucuugacuuuuaaaaauaaagauuaucaaacgaccauguugaaagaguacaaagguagcauagcauacauugaaaugcucuuuuauuaauauucaauugagaugugcccaaaauucagugagagaguaaaaucaauaaugauggcugggagaaaucuauaugaccucaguagaaacuucaaguaaaaugacagaaacuguauaauaggcaaucuuguauauuauauauaaguagauaaaaucuucacauacagccccaacagauaccagucacuggcaauccuuuuuguuuuuaugccuuaauauuuaaacuuaauguagaaaaaaacagauucaagacaaaccugugaaguucagaauuauuuucuagucuaccuauauuugaaaaccugacaaauuuguuucucuuggguaugaugugaaacauuugucauuuuaugaaauaguguguuggucuuggucugccacaaacuacguguauuucuaaaaaacaacaacaaaaagaccguuuuaauauaaacuguuauaaaacauuucaaugggaaaaggggguggauuuacaauaacaaaauauguaugugaggauuucaauuauaaauaaguuauuacaaacaacaagcacuucguuuuggccaaaauacucaaauauaccugagaaaaugcuuaacagcaugucagacuauaccagaaucaacauauuuagagaacaucaaaauaaauuguagcacuguaaccaccaccaguaauaaacaaaaacccagcaacugagcaggccuuaacugaacagggcaucuguguucuuacguagugcguuacuauggcuuaauuuugaggcucauucccaaucaaguuauaaccggagcuauauaacacauauuaccuaauuauucaauuauuucacguccaguuuguguauugaaacuaaugcccuaagaggaaagcuguauucauuaaauaagaucauaugaaaauauuaauggcaaaaacugcaauuacuuuugcaccacccuaauaccuauguugcagauuacacuuuauauauaauuauuauagccaauuaaaagacuugucuuuauaaagagugaaaagucugcuuaaauaaaaaccucuuuaguaccacuguucaaauauauauacaacuagccauuagcauacaaaaaccauugaauuacacagcuuaaauuaaugaaugguauggugugugaauuauaucucaaagcuguuaaaaaaaaaaacaaaaaagggagcggggagggauagcauuaggagauauaccuaaugcuaaaugacgaguuaaugggugcagcacaccagcauggcacauguauacauauguaacuaaccugcacauugugcacauguacccuaaaacuuaaaaguauaauaauaauaaaauaaaaaauaaaaaauaaaccuacuacagccauucuuuaggaaaccuacaacuaucaauuucagugccauaggcuugcuaucaagucaaugaucucagcauuuuuuaucauuaauguugacacuguuaaucucuaagaauuaucaauaauugguacuuauggcuuauuuuaaaauauuauuuuuaagaaaugcaauuaaaugaggcuuuggccaggucauagauaaaaugagaaaugaaaccaauucuguucuaauucuuauggugauuuaacauaaauguaucauacuaaucuaaauuuuccuuauagccaucuuuccaccucggauuuuaucuacucgaccaggacaaaaaaguccaauuauuauacaugacgacaauuccucugauaaagauagagaagauagcaucacuuauacuacuguggacuggagagauuuuaugugcaauacauggcaucuagaaccuacucuuagguaaguaaugaguauauacauuuacccauaugcuaagggauuacuaugagcaaaaaguuaugaauaauguaaguuacauaugauuaucaaaaaauauauucagaaguuagucuccuguaaugucuauagcuucugugugcugucuuugcugcuucuuucuguauuuguuucuagguaaggcgaaugaaguacaaauguugagaauagcucagcacugaugaguuguccaaugggugacauuacuaaaauaugagaauaauuguccuuccacuguugccacuaguuuuucaccuucucaccaagauguuauuuucaggguuugagguagcuacuguaaacuguuuuguuacuuaguauggcaagaugcagcagaagucauauuuaauuguuaaggaacuauuuuaauuucuugcuguauauaugucauaacacuguaauaaaaccugcagcaucacagugccccucucuuugcauacuaagcauuauaaaaccaugccuaauaucucaaauuuaacacuaucagauuaagguucccuuacugagucauggucuacuacaauuaucccaauuaaaucacuaucccaaaauuucaaaaguauuuuuuaguuucaguuauauuuaugauaguuucuauaacuaguggugcuugcuuuguguguccuuguuugugauuaacacuaacagccuuccuguuuuuuuuccuuucaucucaucugcuuuguuaauccuguuguaacugucugaauccugaaauaacacuauuuuuaaaaauccauuacaucccagcacaacauucugcaaaaugauauacauuuuauuuagauaagguuuuuauucagacauauuuaugucacaaaauaauuccaaaauaaaaucuccauuaugcagugaggacucuuguauaggcagaaaguacugacuugguguguuaauaaauaauuggcauacaguaaaauuuguuguaacuaaauaagcaaaacacuuugguacuaauagugcauauacccaugagaaauauuaacuguuaaaauacugcagagguccuaaugcagaaaacuauuuguaaaaucuguuuuguauuugcaaauuuaaauaauaauguauuuaaauugaauacaaaaugaauuuaguuucaagugagcauaaaaauaguuaccauauuccuuuuuuuagcaaacuaucaagaguaucuaguuaaguaaugugguauagugguagagagcgugguuuaagagcucuggcuguaagcccagcucuuuugcauaguagcugacugagcuaggccaaaacaccuaaccccucuguucucucugccucaguugacucaugaaaaauuuggaaaaugguauuacccaccuuguaggaucguuacacugguuaaaugaauuaacgcaaaaugcuuauaacuauuugaguuugaggagaucaaugccuaaccacccccaacccccacccugaguucagaaccaauugaaauagugggagagauuaauauggauaaagcugauaacaagacauguggcuuagauauacggcaacaauagcuuucuacaaaguucggguuugguccuaccugcagggcaucgaugcagaacuuaacuucggggaagggcgggauggggguugcuggaguuguacaaucagcagcucuauguauguacucagccacagacaacauagaauacucuggggcuaaccuguuuaggggcuugcuccugaaaaaccugugguaugaaggaacagacuaaaaugaagggcuccaugagggaggaggguacugaacuguuacuuccucuguuaacuuugccuguuggauaaaucaucaauacaggggcagaagguggccaggagcgguucaguaacagcuguuucuccacguauaaggaaauagcaagaauagggaaaaaaugguucucccuucaaauauguuuagcacauagcacucaguaaauuuuagccuuuuucucccauuaugccacaugcuuaugaaaucuacuaaaauuaaccagauguccuuuuauauguuuaagauaacuguauaacaggccuaaaauauucaggaugaaauauaguaaacacuauugcuguguuuagguugucaaagagauuuauaaucauacauauauuauuuuuugaaugcuauuauuauggugaauccaggaauuaugggcucauuuauacaaauguaccuacugaaaauauuuugucuugaguauauuauagaggcuuagugauguucuuuuccuaccauuagaaccaugcuuuagggcauuacacuccuuaauaauaacuguaauuuuuauuuuagauuaauuucuuggacuggaagaaagauugauccaguagguguugauuauauucuucaaaaauugggcuuucaucaugcuaggacuacuauuccuaaauggcuucaaagaggagucauggauccacuggacaagguucugucaguucuuaucaaaaagcucgguacugcacuacaggaugaaaaggaaaagaaaggcaaagacaaagaagaacacuaaaaaaguaauuugaucugugaacaaauuaugauugugucuguuuuauuacacuggaguguuuuuuuaguauaauaauuugaaauauaacuuuaaaauaauucuaaauuuguggcuauaauuaaaaguuuguaaguuaaccuguucuaguuccaucauucuguguacagugaaguauugcaugauaauguaaauuuugugaaaaacuagauuaaaauauauaacugcuuguuaugguuuauaauuauauaaugugcaauacaauuccugcaucuuuaaaaugucugcagaauaacugugaauuuuuuuguuauuggauuggccguaacuuuuagaaaaaaaucuuguugaugauaaugugauuuuggggaggucauuaauugcuuuuucuuuuuuaaauguagacuuauauaaauaccuguuuguauauagcuugaguaauugugauaugauuguauaccacuaaaauauuguuaacuauuauaauaaagucacaguaaugguuuaagucuguaguaguuuuucaa

SEQ ID NO: 13603 - RNA, 5155 nt, Homo sapiens
ucuacauauuucuucagagaaagagugacuuuuguaagcauuuuaaccauccuacaguucacacaaguaacuaagaaauauuuaaaugcuuacucugugcuguuuccaaaauaacaaauauccaggcuuguuuauauuuaucaaauuuauuaaauaguuuuacuaaccaaucuacauagauacuauauuuaacauucaacauaauaauaaauauuuugggauaaauaagugaaaccauuuuagagccccuagggcuuacaaaaagaaucauaaaagauccauauuuauaguuuuaagauuaagaauaauaguuacaauagguagcaaaccauacauucaacaauaaauauaaaauuuaaauauuuaaauaaauagaaggccugauauguuuuaagugggaagcacuuaauuaucaagucaguguugagaugaugcuuugacaaaagguaauccaucuguucagaaauucuacaaugguugcugucucaucagcauauucacacaugaauguuguuucagaucccuauaaaagaaaaauguuaauuuuuuaaaguacagaguaguuuaccuuauauacaguuauucccaauugaagucuuauaggccuguugccuuuauuuucaagcuuaccaaacauauuaauuauucacauuuucuugaaaugaucaaaaugaaugccaaaauuacauauuuuguuaugauaccaaaugauaguaacacagaagcugagauuuuccucauuuguuaauucagucaaugaacacaaaaauuuuuucccuaaauugggugcaaauaaagauuuaaauaaaaauagaucuagacaaauauuaaaugcuggaugugaaauaaacuugaucgcuuuuccucugaauguacaccuauauuuguguaaguuaaauguaugaauugauaugcacauuauacuuucuucuuuucuaaaucuugauuagagucuccuauuuuucuacuuaagugaaucuccuuauauuuuccccaaagcagaacagaacuacacuagaguaagcuaggacaugcuucuguuugggauaaauuugugugaagaacaucuucauaaauacuuacaccuaucccuaccccaucauaguaucaaugcaggugaauuugccaacuuuuaaaaguuuaaacauuagaaauuuuguucuguggacuggcuuuuuagaaauuaggcuucucugcugaaaggagcuauuuaaacgcuuccucuaguugauaagcuaaggaggaaauauuuugauauauagugagauuuaaaagagagcuuuucaaauuugaagugauuccuacccugggaacaaaagcaggugagauagaguguucccuuuaaauaaguauucucuuuuaaaaaacuguugcaguguucuguauccucuuaagcauaauuguuuaaauauugucauaucuugggauuuuuuuauuuuaaaaaguguuuggcuuuugaaacacaguuuucagauuuuugcaugguuuugucuuaaauuuguaucaagaguuaagaaugaguuuucugauguuaauuauuuuagaguaaaacucuugccauagauaaggaacugaaucugucaaugucuagaugacauugaucucaauguauuuuuuuaauucaacugaaacaguccacuaauaagugauucauuuggacacaacuggaguuacuuuuaggaaugucuuuuacuacuauacuuaugcugcuuauuuaggauaccuauuaacucaugaauuuuauaccuuaggagacgggauauaaaaagacaaaagugaaucucuuuuacaucaccugagucccuugcauauuuuaugcuuccugugcauuuaaaaauacuuaagauucugaaaguggggauugccucuaaaaagauuguuguuuguuuaguccacuggccauuuuaauggcuccaguuuuuuuuuuuaagacaaaucucuuauggguaguccuuccaucaaaugauaaggaaacaccauuugaaaagccuuucagguaaucaguauuggcuauuccaguaaaugaucugaaggaauugaaaaauauauaguaaaaucugccugcuuucugugaaacucaacucaguaccuucucucacucccaguuuuguguuaauaugaaaggugauggaguuugggaugaggcuuguccauuaguagaugguaggugcaaacucaguagcuuauacuccccaguuaaucauuuaacauuagaaaugauucauguucacaguguacuuaaaauguaggcuaauuacaugcauggguacuuuacaaauaccaaaaauguuaugucacuuuaaaaugugguacuuuucccccuacuuuuuuuuuuuuauuuccaggagagcaaauaaaguaaugccuuaccuuuaguuccagaacuauuacguugauauugcugauuaagucccugggucuuaagugaaaguuuuugcuuugagcuaaauuuagcacuuccuccagagguuugaguucuucuucuagacacugaagauguuucaguucuguggccuagaauaauaauuaucaucagcucaguuuacauagaggucagaaucagaaauuaauuuccaauuuauuuuauuuggaguagcaguauguaguuuuuaccauucucucuguucucaaugucacuguaaagauggaccaguagaguuuacauuauaaaacuggaaaaacuagggcucaaguaccuaugacuagcguuaagugauaguugacucacugguuuuagcuuaauuuggcuuugcaaaauguuagacuuucugcaucuaaaugccuauuacagauguaggcugauuacuuuuccaaucugcauagaaaaucauuagaaccagaugaguuagaauguggaagcauaaaaaucacauucuaugauuauaauauuugauagucuaagaguuaagaaucacagaauguugagagagaaggaacucuuggaugccaucuaucacaaucccaacauuuuacacuagguaacaauaaucauguaguaguggcucucaauauagccuugagcaagacacauuuuuaaauaugucuuaaauuuuuacuuuucuacaaucacuacauuaagaugcauuuuaaaaauguuugucccagugaaauaaaaaauuauaauacuuugggaggacuuuuggacaggccucuugauucuauauuauauauaauauuucauauuucuaugguauauuacaauuuaaaagaauuuucuccaaaauaggcccauuuacuucucacagucaucuuuugaaguaggcagugaaguaucaucuccacuuuauaaauaagcacacuaaaucucagaauuugaccacauaaguagguagagccagaauuagauuucauuucuuucucauuauagcauuaacauagcauccuuggaaucaaauauuuuuauuaguuucuaaaaucuuuuguaaaugugcaaugaggguuaaaugaacaaaugaauagaguuuaucauuacuuuugguuucaaacuuagauuuccaugaauucuaccacccccuaaauuaugcacauaaucucaucuuucuaacacucuuuagugggaaagguaggucaagacaauaccaauccccugauauguccaucuauugcgcuuucaauucaccacuacaaauucuacaaauucggguuuaaguuuuuggcaugaacaauguggagaaauuuucuucagaaaacagcaucuaguaucuuuauguugcuggaguugcauuauguggcucugauuaaacuagaguaacaucuguaagcugucuccuuuacaucuuucagaaggguaguuagaagcagauuucucuugaauuaauagaauuugagucaaugggauugcaucuguguccccuuaaauccuauuauuuucugggcuuggauucacccuggcacaagcucuuucuggcaccagauuuuguucauucucucuuaacuggcacagcuacuagguagcuuuacacaccuaauguagccuaggagcuuggaugauuaugcuuaugcucuaucugaauccaaaaacaaccuaaugaagcuuuuaaucuuggaaaauaagucauauagcauuauaaaucucaaguucuauugguaaaaagauaaaguccaaaauuuuacuuuguauuucucagugaaaauuuuaucuuuaauacuacuaauaauagcuaaugcuuguaugguauuuaccuuaugccagacacgguucugagugcuuuacauuuacuuacuaauucucacaaagccauauuaaguauauacaguuauucauuuaaguagacaugaaacugaaucacaaacagaguagguaauuugccaaagaucaugaaagcuaggacauggcagagcugagauuucacuucagauaucuggccccagacucugugcuauuaguguuaugcugccucucacuuagaaaccuuuccuaaaacaagaaaagauuuuuaaaagugggcuccuuggaaauagauuuugguauuuuacauacuaaaaugacauaaucaaauauuuuagaguuuuacauuuuuaaaugaaaccauaaaugaacauuuuuguuuagaauugucuuaucgauaaagugagaauauuauuuuuauguuuucuucccacccccaccaacacacaaauauauauuaaaaauauagguaaaacuguuuuaauagaggcuucauuaucaaacuuggguuuucaaaaaaacaaauuaaaguuacucuuuaccucagaugagcugcuauuagucccaucugugcaaauuuucauauuacuuugaauuuuauuaaaacagaaauugaacauaaaauauuguacuuaccuucuugggcauguaaaacuuaaaugugagcauccuggugaguuugggauucuuguaauucuaagaaaguauaaugcauuguuauuaagaaaugaucuccagcuagauuacuaaauguaauaauuuuaguaagaaaggaaauauacuuacauuaauuccauucaaaaucaucuguaaauccagcaguaaaugcuccaguuguagcuguguuuucuuuguagaacuugaaguaggugcacuguuugugacaagugcaagacuuagugcaaugcaagacaggaguugcauccuguacauuguggcaggaguugagguuacugugaguagugauuaaagagagugauagggaac

SEQ ID NO: 13604 - RNA, 1121 nt, Homo sapiens
uaguugugacucauucacuuucuaaacuuuuacacauagucauuuacgauaauuguuuucuuugcaauguaucuucuuaagucucccccuuuguaguguccuaauuacugguagcacuuuuaguuauucuaauuuaugcaauuaaaggucugugacaaugaaaacauuuccccaauugcauuuauacucucaggguaccagaccagaagaucagaucguagaaguuacuggagaaaaagaucagcggacagcacucuugaacuacaugccaggccucuucuuccuggaacucuaauggauuuaaauggcuuaagagacgggaugaauuguugaaaaugguucuuucaaaagaccucacggaaggccaaagacaagacucacugaggccaagguauaugugaauuauauucugaaggacagcuuugauuuccacaccaccauuucuccaugcugucccuguaaucuaauucuuucuuucuuucuuuuuuaaguuuguuauuaaaagguuaauucugcuuccuacuguauguaucuauguuucuucgguaggauaacaaagaaggcucaaaagcuuucaugcccaagggcucuuaaagaguaacuagcugugcauuguucagaaacugaucagaguauagauuucguuucuaguuuuguuauucugucucagcaauacuacuuaggaguacucuuagagauucuugaagauaaacauaguuuaugaggaauauaauauagcauuuuuuaguugguuuuugguaaaucaaugaauuuaaccaaaauauaaauaaauauuucaucaauuauuagaccgcuaaguucauuaaaauucaguauacuccuauauaaucaugcuaaugucuuucuuauuggauuuaaaaacuuauguccaauguauuuucagaaauaaauucaacuggucuuaccucuacaucuucuggagcuggcagaaauucagggaccuagagcaaaagaaaauuuguucugaguuauuuuuauaagccaaacccuccuuuuauauuaauugaaaaguaugauuuagauuuuguugugacaaauauagucuuaccaagucauucacauaauuuuucagcugaucaacaauaucuauaaguugacgc

SEQ ID NO: 13605 - RNA, 7012 nt, Homo sapiens
gagacaguuucauuaauuaauauauuuucugcauuauaguuaacauauguacuuucuucgugucaccuuauuuuccguuaaguauugauauuuuguuauauucaaacaugaguacauuucaacagucuuuugcaauaaauaccauaaaauaauagagauucgcauaauaaauauucuuuacaauaaaaaaguuuaacagacuuuugucuuaaaaauagucagaauucaacuuugugauuuauacauaaaauauacaaaaagcaccacaauuugugguuaaggcaaggaaaacacagaagagauuagaauuacucagcuguuaacuauccaaggggccaaaaggaccauuaaggagccaagaucacuuuaggcagcauaguucugugacacauauagauugaucagcuauaaauaucaacuugaguuauccaagugcccucaaugacaacaaaaauuuggugagaagcauggggugaagaaggaagguggcugaguccuucacaaauacgaaggcuagagugaagaugggcaagguccaaccaauauuaucuccaaugugaagauuuacauuguaaggcgaaucuaaaauuacauagaaagaaaaaauacacuuggcaucuccagaguaagacaacaacaaaacugagggggaaagaaccuugaaggagaaagaaggagagggcagugguuaaaggaaaauuuuuacguuauagcaaaaaauauaucccccaugcuacuuaaggggccuaugcuaggaagauagcccuaacuggagacagauuuaauacauagcuuauuuaagcaauuaaacaguugcuuuuuaaaaaaccaauuucccugcucccacgguacccaaucaaaacaacucuaaaucacuguagucuggauguggguguauguucauguacacaacuuuagaaaguugcuugcagaacaaaaaggcuacacaaaagcccacuggcucucaauacccucaaguggauggcagaggcucuuguugaaagugggagccaggugcagcuucccaguccacucuugcugaagaucauccaugaggaaagagaaaaauccaugaguuagaccuuggcaacaggggaagagaaggugggaaacagggaaaaauucuaaagaaaacaaaaacaaaaacaaaaacaaaaaacagccacaacuugaaagcuaaaaguucaggagguacaacccaccuccaaaaaucaugaugguuuacccugaccccgggaggggcagcucuccagcuuacaauagacaguguuggaguucuuacaucugcacccugggcgauggauccagucauaacaccuccugcacagcuucaggcauccuuuagcaggaggauaacagaguaagcaagguaaaaauaaagacauggcucccauacacagguaucuagagcagcagugugauugugaacaggagcaaggauuaucugaauaggaauccccuucgucgucauuggagcagugguagaagaugcccuugacuaagcacaugcagguuccauauuccaccaugcucucagcagagcaaaggcacugccgguuacaggccaaacaggaugguaggguccugggagcagugcauucuccacacuugcacuucccacacuguucacaaaugaacuugugcugugucagguccucuuucaaggaacccuucaagucauccacaaucaguugcuugggcuggguccggauugcccuuucagaccuaugaccagggacuggucugguugguggugaccuuccuaacagucccuguucagaagaggcacugcuguugcucccagagcuggcugcacuuccagugcugguugaucugcucaaaauggggccccuggcauuacuugggaguacugcaugucccagguggcuugugugucugugcucguaguuauuauucacauuaauugguaugauuucaugaguccuuucaugcuuuucuugucuuggugcuguccgaggagcaggucuuuucaccaccgaaggcccuucuguguauucauugcugccucuuauggccuugaucuggucuaaggacaaaauagcaguaggcugaaucucucucucauagucuaaucucugacggcuauccaaagaaggcugcuggaucacaacuaacgaacugccacugccauguugauuuuggggauccauguguagugaucucgaguucuggcaaucaguggaaaccuggcaugcaucugaaauccuaaaacgaaaucaaagaugaaaaaaacagaaaauaaaugacaggaagcauuuuuuuuggggggggggaauccugucaaaucacaaauugccuaaaccgccuaguaaugaccuccuucaucaguggauuacaaugaugcugggguccuggccagaguccaauucuaggagaggcuggggaccacaucauagaggaagacuauaaacaagagaccccaugccaugaacauuauaaguuuuuccaacuuuuaagaagcagaaucaggagaaaguaaugccuuccuguuugugaaucuaauaauuaaaauggagcaugccuucgcagggaauacugaguauaagcaggagaauaacucucaucuaaagaaagcucaguuaucaguucauagguggcuuccauaaaggaaaaugucuaccuuuuaagaaauugagaauggcuuuggugcuacagccuuuuuguugugugcuguuauaugcauuagauuaaugaugaaaaaaauuaaggcauuaaaaaauugagacucuuaaaaugaaaucgcaaaauaauagguaauuuucuauauaaaucagaauuuuaaaacuaccuuauuauucaucuaugagaugcaaaaauaaauguaucagguacacaacgauucuugguguuuuggagcuacaaacacacacacacacaagacucaauguauaguccagugaaugauauauaacaguacucauauuugaaauccugagaggauuuuuuuuaagcugaagggcucacucacaaaacaaaguaaguuuuaugcacaaauaagugugaggccuuuaacgcaguguagggaaauccuggcaguuuuaauuaucuguauuuccucugauuuaaaaaucuguauuuacaugacagaccuugauuuucaaacgcacugccaauucugauucaacguucuucuuguaacaaaaucagcacacuaauauccagauaaaaauaagcaguuguguuuccauacuaauaguaaguuauuucuaauuuauguguucuucacaaacugccaaagaugaaaguuucugcuuucaguggugaacuagaguauuuuucacacaaauuccuucuaaagucuacagagucgacccaauucaagaaugaaaagaaaaagaaauguccauucuccacuaccaaccugaggcaaaaaacaugguuuaaggaacaacgcagaaagaaguccauuuccuauauuuccuaaacuaaugucucuaaacuaugucuuacauguuaacuucuuggagcucccccucguuuucacaacucagcucucucgaguuucuacuuuauucuaccuucuuugcgcaugaggaguaacacauucauaaccugcggggauuuagucucggaguccucaacaucuaauccugacuccugcacaauuauuccucuucuucaagaacuucuuaacucagugcuuucaaagcaaaagguagcuaaaaguacuaagccagauucacaaaaccgcagaggauuugaauaguguaacccauaacaccaggcacaacuucaauuugcauuuccaaugauaguuguaacaaacuucauacuggcugggaaauaaaguugccagacaaaaaaauuaaaagcaaagaaaauucgccaccuccgauccgaagaaaagcccauuuucaagcagugacagucuuggacaagccccaaacacgcucacacgcgcucggcacacugccuuccccaagaaaacgcgaauggaaguagaauaccuuuucggacaaucccaucaccauauuaaggaucaccguggauuuccaacacacuuuuuggguggcccaccaagguuucugagaaaucaugaagagccuucagcguccacgcgggagcccaaagcaagcccacggucuggcugacccuaagcaaggauuugucuaugcuuuaaaggaaaagcuggguucaccgagggccgaggagaaagaagccagcgcaggggcggccacauugcaaguuaccacgguggagcugcgcccucugcaauccgcacugaauaaauaguugacggaagaaggaaaaggaaaaaguuaugaaugaaaacaaguucuuucucccucucucugugguaggaggaggggaggaggcugagguuaccaugagcucaggagggcggacuuccccacuuuuuuuuuuugagccggagucucacuuugucucccaggcuggagugcaguggcgcgaccuuggcucacugcaaccuccgccucccggguucaagcgggucucccgccucagucucucgaguagcugugacuacagucgcgcgucaccacggccggcuaauuuuugcauuuuuaguaaagacgggguuucaucaguuggucgggcuggucucgaacuccugaccucaggugaucagcgcgccucggcccccccaagugcugggauuacaggcgugagccaccgcgcccagccgacuuccccacuuuuaaaguggcagugcccucucccuuccccugucuuugcacugugcuccaaaccagaagaaaguugcggcuggcuuuggggcugccuaauucuaucgaggggguaaucggcgaauuccggggaugugccuacacacacacacgcacacacacagccuuugucgucccccugcuugaggcacacuccuccaaagagggccuccggggacauccccagagccgccugaaaucccccuugggcgugaagggcucuccgagaggacaaccugggccaccgcgccgccgcuccggguaaucggggauggaggagacccuguccuguuacguuccgcagccgcagaccgucgcccaccccgccacccaaccuugagcccccagaagccgcggcccccagggggcagggagcggcgggaggggccgcgccgagcgaggucgucccuccccuccccuccucucccggaguccuggcucgggcagcagcgccgccgaguccgcaccugccgcgccgagcgagccccgcccgcgcgccuacagcccagcgggccgagggcggccgccgcacacacucaccuaggccgaagcgguggccgggggccaagccgugcgacccggcccagguccuggugcgggcggcggcgugcacgugccgcaucaaccgcggcggggagggcgaggcggcaucgccggaguuggagcgccucggcucgcggccucccccgcccccgccgccaccggccaggagcgcuccccgcggcccccuuccggcugcggagggcaguucucccgcggcuccgcgcggccgggcccggaccugucacggcuggugcucgccgggcggcucaguaacauccaccucgggaggucuucugcagccccuuuccaagaaccaguuuuuacaaauccuuucaggaaggcuucccaagucucagaaaaacaaguaggggaguggcggagucgagugcgugacgggccagcugacggcacggugugcucagagaacucggguucuagucgcuccucgcaaggaacgaaggaagggauggcggcuuccugacgagcgaaaaauccacgucacgggcguucgagacuccgcagcgcccgggucggggcccgaaccgccgucggcgggugggucacggagccgcgcaguaccccggcgaaaccucggagcacgcgccugccaggcagaggcugccgcggccgggagggggagggggauuuuuuuacccuuuucuuuuuuuuuuuuuuuuuagcggggaggagugaagagagugagguuuggggauccuucucggagagagaaaggcgggcgucgucccuugugccccgcgcaggccgacgcgcuuagccgauuccgcacguugggcaagugggggcacagcguccccgggcacuccggucccggcaggucagccucucccgggcagcgcucacacccaguccuccgagccugggguuccacggccgaaaugccugcgacagagaauuagagauagaagcucgugaaugucccuuucuucgaagggcugggaccccgggcgggccgcuggccagcucgcccgcagcccguugccaugugcucccuguugcugcucccggugauugacaggccggcgcacagucggcgugucagccgcgaaccaaaguaacaugcaguccugcacguuuuugccgaggugcuuuugcccccuggaaugccuaggaguucaaacaacguucaagcaacgccucugcgcguuaggaaucaauacacagagacgggaaauucagguuuuaaaccaaugcuucacucgggauucggucgccaacaaugccuaaacaaacacgcauuugguccacacaccgagugcuagccccucuucgcauaaaggcauuaacggcucuguguuucacaaauucgaucguuucagacuuuaaacgucuacuguucgguuaaggaaaggugaaagggacccugcuuuuucuuuuagcgguagcauuuacuuuaagagcauuaguuuuagcagugggaaugcuaccgguguuuugaaaugcaaccaguaaccuuagcuggaaagcaaguucaaauaaauaaauguucaguuccuugcaaaagucaacauuucucaccuuaucuuuccuaaaaugucuacggaaggaaacgguacuuaccuaaugcaaagauugcaaauugcuuuucaggcacauuuaacagcgacuguagcuguuccuuauccagggcagggaacugugcugauaaucacucugcaaagcacgcagugguuugcagagcggucucacuccggcuacgcagaauuucagcuccuugccuccaccuccaccuccacuccagg

SEQ ID NO: 13606 - RNA, 19853 nt, Homo sapiens
cugaauaguaccugauuggggcaugcacaggcugcuaguuccucuggagucugacagaucugcaucauaaccugacugcugcacacuaugugaccuggggagagugaccucucuaaaacgucugugaaauggagaugauaauauaguaccuacccgauuggguuguuaggaggaauagcgccuggcacacgggaaguacucaaugcauccccaauacaugcuaacuacugucaugauuuacacucauauauccaucuccccagauaacccauaaauaccuuaaaagcagacaccaugcccuuacuuccccacaguucacagaauccauacuagaugcuuuaaaaguguugguugauuaauggacacuggaagaggagacugagcuccuuagauuacaugugacagcauguuccaguucucaaagaaacucccuacaagcccuuuauuugggcagaaagcagcaaauucuugcacccuuaaaguauaucaaagugucccccacuuuccccauuucauagaucaaagaagaaaucugucaggaacaaacgagggaccgcgagagccagggaaauggacaggagggacaggcuucccagccgaggccugcagcucgggcuccugccagggcggcuuugcccuccccgugugcagccuccgcguucagacuugugcagcagcucccauaaaacccgcuccgccuuuuccuccuggagaucguccuuccuuugucuugcagcucaguucacgccauaaaaccccauggccaaucgugccuuuucauuuggaaugaucaaagugguagcugucugauguagaagcaagcaccuuuuaaauaaauacauguuuuuaauucugauucaaaacacuaccuugggcucaccuguccccuaguuuucugaacaagguaugcauuuccccggugcaggcaggaaaggucacguggucgcgccuucgcagcagcaggccgccgccuaucccgucuggggaaucagguuaccuagaaugucgggccacuucucagagucuggguagaggccagaaggacugggugcggggaguggaggacuguggggagacugggugaagaaaccagaaaccugggaggaggaaaacagguuucccuuucuagggcgccugugcugcaggcacauguaguugggggcuggaggggggagggcggggugaaauaccaguuacuuuuguuugucuugaaacaaagaaagaagaggagggaggugcauuuuuugccugcaaauauaugugaaaugcacaccugaaguuguacugggugaggaccuaagucauuggcacccacaccguagugggacaaaucagaagggucauuguauaagcaguggcuacugagaauggcuguauaauaggcguauuauaaaaugcacaccuggcuccugcaacacuggggagugaaaaacuacucucagagagccaucgagugagcaauaggaugaaggucuuccguugugucagaacaagguugugcacaauauacaauuccaggcauugugcaaguucuucacagagccccacguaugcacaagugcgccugccaaccauuuaccaaccaccaagucaucucaguauccccacgauuuuuucuuaagacaaagggggaacaauuugcacucugcccuacagaauuugugaaaaaucacacgcuaacagggaaguuccuccaugguuugcuucugaguuuaccguggacagucuggacuaaggcaagggaagaguuuacccuuuugggaaggcagauaacucugcaggggaaauaggggaucuucaagauuaauccuuaacuggaaauggaagaaaaaucagauaauaucuuuucugccguccccugauaccuucaggaguucaaacguuuuccaagcccgcggcacuuggcaauuauaauuacacaguaaaauaccuaagguuaaugaauaaccucuaaaggaaguuacuucacauaaugacagcaauuucucugaacuaaauguuaauuaauaaggccuguaauacuaugagaaggaaaugguggcaauuggcaaauggaacucuguugcuugguaacaaaaccugagguaugaacauuuucuuuaccugacgggaaagggguggguggaaagauuacaguuccagccugaacaguuugaaaugcaggcagcuuuaugaagcccauggcuguccugcagcacauaaaguggaagcauauguggcagaucauuuuguuagcagagagaaguuggagggggaauaauucccuaagaauuacuuagcagcacaguaaaggaaaugggguguaaucuguaaagagacugagggcaacuuaguucacauuaccugguacaaaucacugcucaacaaauagaacauuucagcaaaauccaccuaagagcuaaaucuucuccccugccucucugcuucaguuuguuccaauggagacagacacuuugauccuccuguuugcuuuuuucuguuuuagagcaacuguggcauuugagagaugaauuagaaaaggaaugcaauuaagacaaccuaacagugcaguguuccuuguagaggaaaacuuuacgcauuugaacugcaggcgcagauuuaguugaguaauuauuggcaggcugaauugaaaaagccuagagacaacuucuuccagcuggucauuaaucaacaggaaauagccuacaacaaggucauuauuaccuuaaaccauuacaagagcauauucagugagaggcuaagauaaaauugagggcuuuaaaucccuguuuguuuuauggcagugguuuucaaaucugccagaauaucuacaucaccucaacagcucuuuuuaaaaugcagauucuggggccccacucuuggaaagugauacaguagauccaggauaggugccugggaauguguacuuuaaauucuccaugguguucucaucaucagccagguguggaaacuguugcucuaaauuauguuagcaguagaguuuuuugcuuugaccaaagauagaaagugagagugaauacucuuuugcacuugaauauauuuucauuucugcucuaagagaaguuuaucuauacaauuaaagauaaauauucuaagugcauuauuuuuucauuuuuuaauauuaaaaaaguguuaaaacugaauauaauaccaaaaacaguugacuuucugacuauaccaucauuuaauuaaaagcuauuuucuguaacuugagcaucuuccuaagcagccaaauaaaaucaucugccauaggagucuuaaaaggcucacccuuugcccacaaaaugggccaaguuuguccccuaaucuugguuauuuuuucaugguguucccuaugaagcauuggccaaugcuuuuagaagcccuugguagacuucuuucuuccaauuuucgcuucaccacaugcuaccucugaguucucucuccaauucuuugauuucuuuaaaaauaauaaucugcuauuauuuagcugugggucuuaauggacuaguauuauuuuggccaaauaacacaaguaauagacaaauaacuaggugggugggcaacuugauucaaaggaaugacucuugaauagcaagauguuugggacagauuaaaauucugguccugaaaaugauaauaucuuauacacagauggcauucugaaucuuuagggucucugcauucuaaagaucuuuaggaucacuaugcacaauguagggaauuacauauuaauaaggcuuucuaacuauauucaaagaaauuaaaagccaucaucacaaggucaagagauugagaccauccuggccaacauggugaaacccugucucuacuaaaaaacuacaaaaauuagcugggcgugguggcaugcaccuguagucccagcuacuugggaggcugaggcaggagaaucgcuugaacacaggagguggaguuugcagugagcugagauugcgccacugcacuccagccuggcaacagagcaagaaaacgucucaaaaaaaaaaaaaaaaaaaaaaaaaaagaaaagaaagaagaaauuaaaagccaucgacuaaauaaauaaaagaaacaccaucaaaauaauuaaaaauaaacacuaccagaauguguagauugccugagccacaagaaaugggugccucacaaaggguagaacugaugacaaaagcuauucccauuuuccccaaaucccauacaaguccuuaacauggacauuuagaagccagaauuagguucaccuuaaccccaaauccuaauuuaugagaaaguucuuuaaaagagauaaagucucuacccuuaccgccaaacucugggacuagcaggaacuucugaguaccuccacuaugguacugauaauucucuggacauuuagaacaacucucuucauccccaguccugccccaaaagacauacaacaccuuaaagauuacuuagaaauucugauucaccaaccugcuugaacugaggcugcccaacauuguugaaagcugggagagcuguuuacccucacaucuugcaguucgaaugugagccuuacggaaugugauuggccaggcagagaaaagcuacucuucccugaacacuccuggccacucccaacaaccucccuuugcucucacaggacuuuugcggguaaucccagugacaccuuucaugaggcauugugauaguguugacuuaucugucuccuacauuggaauauaaacucucugagggcagaaaguggauuuuacucaauuacuuuccaggguugagcucaauaccaaguauauuaaaggguuagauacugaugacuaauaaaugcauaaagauugucaaagaaaaccagagcuaaaaaguaaaauaauaaaaagagauuuuauucaggacuauugcaaucuggaaaaaguacagaacucaguauagaacgaugcucaauucuuuuuuuuuuugagauggaguuucgcucuuguugcccaggcuggagugcaauagagcgaucccagcucacuacaaccuccgccucccagguucaagcaauucuccugccucagcuuccugaguagcugggauuacaggcauaagccaccaugcccagcuaauuuuguauuuuuaguagagaugggguuucuccauguuggucaggcaggucuugaacucccagccucaggugauccacccaccucggccucccaaagugcugggauuacaggcgugagccacugcacccggccgaugcucaauucuaaauacagcaugaggaaguaggaauuuauagccaagaagacuggagguuggaggauaaaaaaauuacuaagaggaauaucagggcuaaggggagauucugaccaaacuaaccuaacagcauuuugcugaggcaggccggggugaucagacaucaccugaaagaugguggaggaugaagaacccaucuaggcauagaggguggucagacauggaggaugggagauucaugcuaaaguuagcaggcuucaugcuaaaacuggauuuuauaaggaagugcacagaugggccuaggagaaguuucaggagccugacuaaaauuugaucaagcaaauaaucuuugucaagaucuaugcugcuaaggauugcuuucucuguguuaaccauuaucuucucauuucucuuuuuuuuucuuuuuuugagugacacgcuagagugcagugacaugaucacaugucacugcagccucagccuccaagguucaaaagauccucccaccucagccucccgaguagcugggacuacaggugugcaccauauccagcuaauuuuuuaauuuuuuguagagacgaggucucacuauguugcucaggguggucuugaacuucuuaacucaagugauccucccacguuggccucccaaagugcuaagauuacaggcaugagccaccgugccugccaucauuuuuuuuuuuuaaagaagacaaaauacuagugaugcacuuagucacugauacauuaauaagaauuguuacagcuggugauucuuuugcagaucagaaacucugguggacuugagaauauagucagaaaggcacacaaaagucagaguaaauaauaaugggaagagaccuuuuugccaauauuucacccuguccacagguugaucccaaacaauucauuuuucccaccccaggggacaggcggcuguauaaugcuuggugauuugcuugauauggguuugucccauaacccaccacuaggauacugaagacaaaauauguacccuacuugaggccuaaaauggauagugauaauuucuugguaaauuacuuaccugguacaaaaaugcacuacucaaaauaaacuuauggcaauucugacacuaaccuauaauagaucagcaaggaauguaagauagguaugaagaaggucuggagguuuaaucauggaaucuggagucagagagaccuuuguuaaauuucugguucagucauuuuacaaccugcauuuccuugagcugguaaccuaaccaucagauuucucauauguaaaauaguaauaguaacaccccuacuuucucacaggauuguuuuggaucagcaauaaaacaacuggccacuggcauauaacaacaguagguuugaugcuuuuaucaugugcuuaauaaauguuaaugaaauaaaacggaauggaauggaauguacuaagacagcauagcccaugguuuuuccuccuaggauacacagccuacuuuagacucuucauuauuucuuuuauuuuuuauuuuuuuugagacagagucucgcucuguugcccaggcuggagugcaguggcaugaucucggcucacugcaaccucugccucccggguucaaguaauucuccugucucagccuccugaguaccugggauuacaggcacgcaccaccacgcccagcuaauuuuuguauuuuuaguaaaaauggguuuucaccauguuggucaggcuggucucaaacuccugaccucaugauccgcccaucuuggccucccaaagugcugggauuacaggcaugagccaccgugcccagccaacaaucuuuauucuuagugcacaagagaguauuaggauuugcuagaaguugaguccccauaacacaaaaugaaugagagauuaaauuguuuuccaguuaauuugaucacuaaacauuguuaaacuccauaauuuuuuuauuuuuauuuauuuaauuuagauggagucucgcucugucgcccaggcuggagugcaguggcacgaucucaguucacugcaaccucugccucccagguucacaccauucuccugccucagccucccgaguagcuggaaauacaggcgcccgccaccaugcccggcuaauuuuguguauauuuaguagagacgggguuucaccguguuagccaggauggucucgaucuccugagcucgugauccaccugccucagccucccaaagugcugggauuacaggcgugagccaccgcacccagccaaaccccauaauuuaaauuaucauacuucuugguuugacuaaauguguaugcucaaaacuguagaacugcuucuacuggugcgcaucaaggacauaguauuaugaaaccuuaaucuuuaaaaucauggaccuugaaaaaccugcccuuuuuaaaucucaucagggauuacaagucaaaaugaaauagcuuuaagcugaguagguuaaagcagcauagcuuugguccaagagccaaucaacauuauucccuacuucuguuaagagauaauaaaggccgggcgcgguggcucacgccuguaaucccagcacuuugggaggccgaggcggguggaucacgaggucaggagaucgagaccaucccggcuaaaacggugaaaccccgucucuacuaaaaauacaaaaaauuagccgggccuaguggcgggcgccuguagucccagcuacuugggaggcugaggcaggagaauggcgugaacccgggaggcggagcuugcagugagccgagaucacgccacugcacuccagccugggcgacagagcgagacuccgucucaaaaaaaaaaaaaaaaaaaaaaaagagauaauaaaaaguuuucucuuuucuuuuagaaauaaucaaaacccucugcacucacucagaaguguccauaaguccuguucaaguaaucuuaaaagagacuguuccaauauucgaucugccucguucaacaagguaaauuuagccuuuuccccuagaauugacagucuguuuaucugaacaacaaaacccauaguauguguaguccuuaaagccucuuugaggaagaagcccugaucugaauguccacuuuuagguaacuuuaugccauuaccauuggagaauugaggcuucucuuuuuuuuuuuuucuuugagacacagucucgcucucucgcccaggcuggagugcaauggcgcgaucucggcucacugcaacuuccgccucccggguucacgccauuuuuccgccucagccuccauaguagcugagacuacaggcgcccgccaccaugcccggcuaaauuuuuuuguauuuuaguagagaugggguuucaccguguuagccagaauggucuggaucuccugaccucgugauccgcccgccucagccucccaaagugcugggauuacaggcaugagccacagcgcccagccgagguuucucuuuuaaacccauguuccuuaaacauuuuuauuccuguaggguacuuaccccugucuuauguccucuaaaacguagcauaugugguuucugcucagaguaaauucucaacacuggugauaucaaaggauacaaauuggguaucuccaggugccugggauuuuugaguuugacuugaugaacaccgaucagaauguuaaugaucuguccaaugccuauuucugguucaccuucaaauugacuucucagggacuaauaguucucuuacuguguccggaauugguggguucuuggucucacugacuucaagacugaagccgcgaacccucgcggugaguguuacagcucuuaagguggcgggucuggaguuuguuccuucugauguccggauguguucggaguuucuucuuucugguggguuaguggucucacuggcucaggagugaagcugcagaccuuugcugugaguguuacagcucuucaggcagcgcgucuggaguuguucauuccucccggugggcucgcagaucuugcuggcuucaggagugaagcugcagaucuucgcggugaguguuacagcucauacaagcagcgugaacccaaagagugagcaguagcaaaauuuauugcaaagagcgaaagaacaaagccuccacaguguggaaggggaccugagcagguugccccugccgaauagggcagccugcuuuuauucucuuaucuggccccacccacauccugcugauugguagggcccaguggccuguuuugacagggcgcugauuggugaguuuacaaucccugagcuagauacaaagguucuccauguccccaucagauuaguuagauacagaguaugggcacaaagguucucgaagggcccaccagagcagcuagauacagagugucgauuggugcacucacaaacccugagcuagacacagggugcugauugguguguuuacaaaccuugagcuagauacagagugccaauugguguauuuacaaucccugagcuagacauaaagguucuccaaggucccaccagaguagcuagauacagaguguugauuggugcacucacaaaccccgagcuagacacagggugcugacugguguguuuaaaaaccuugagcuagauacagagugccgauugguguauuuacaauuccugagcuagacauaaacguucuccaaggccccaccagaguagcuagauacagaguguugauuggugcauucacagacccugagcuagacacagggugcugauugguguauuuacaaucccugagcuagauguaaagguucuccacgucuccacccgacucaggagcccagcuggcuucacccaguggaucccgcaccugggcugcagguggagcugccugccagucccgugccgugcgcccgcacuccucagcccuuggguggucgaugggacugggcaccguggagcaggggguggcacucauagaggaggcuggggccgcacaggagcccacggaggaggugggaggcucaggcauggcgggcugcaggucuggagcccugccccgggggaaggcagcuaaggcccggugagaaaucgagcgcggcgccggugggcuggcacugcugggggaaccaguacacccuccgcagccgcuggcccgggugcuaagccccucauugcccggggccggcagggccggcuggcugcuccgagugcggggcccgccgagcccacgcccacccggaacuccagcuggcccgcaagcgcccgcgcagccccgguucccgcucgcgccucucccuccacaccucccugcaagcugagggagccggcuccggccuuggccagcccagaaaggggcucccacagugcagcagugggcagaagggcuccucaagugcccccaaagugggagcccaggcagaggaggcgcggagaaugagcgagggcugugaggacugccagcauacugucaccucucauuacuucucauggccccaaagggugaggguaggggagauggggaaggaaaacucuuugugccugaauuccaggccuaccccuugauucugauuaaaaccaaauuccuuccagccacccaaauccaaacucuggggcuuucuggauuccacucccuuuuucaucuuccugggcacagagccccaggucugucaccaugagcugccucugcuccauagcuuccaugugcaaucuccgaacccaccaucgucugucaagcuucaaguccccuaccagcucuguuccccauacaacuuccuacuguaaccuacucuaaaaccuuaucuaaaguuuuagucuuacuuuuuuucugacuuuuggcuaucaccucuuguaaacucaacaucucucccaaguaccauucuuagcauaaauuuccaaaaccaaucacauuucauuacucucugaggaugggguaaggcucuaucucaugauuuugaagcaaagccaauauccugccuugucaaauuaucaaugggauuuucacuucuuuucugggagccccccacuuaucaccucuggguguaugugaaauaaacuauuucuccuguuaacuuguccuuuguaaguauaauucacaggcuccaaucacugacccuaacuaagaagguagaggaaaaguuuuuuuuccuucuucuaugcauagcuuacagugugcugcauacaguacaugcuaaauaauuuuugaggagauaaaauuauuucauuuagucaaucuugaucucaguuauguccagacuaaguggaaauccaaaaacauuuaguuaauuuuagcaggugaauggucaaauuagauaauacagacacugcaaaugaauucaguuuugguauuuugcugcuguaucugggauauuaccugaaacuaccaaccccaaagaagugguuagaugcaggagcuuauguauuaucuuaacaaagaguggugagguguggagaagagacuagacaaaugaaugguguugggccucugagguggggauaaguuguggaagguaauuauaaacuauaugguaaauaagguuuauuuugcaguuugaaguccucuuagguaauaaaaggcaucuccagaugaggggagauuuacaaauugucuauauaaauacaaauuucauuuacaaauguaaauuuccuuuacaaaaggaaaauuucugcccugauuuuaggcaaaaaggugaggaagcagagaauuauuuuugaauggcuacugcuuaaagaguugccugcgugagguuugguggcaagaagcagaagucagagccugugguuccuguugcucuucggcgguaugaaagagagaagaaggcgugcuucauuauaugaagcuuugcuccuaagguacaacucuuguagaccucccggacucacccaauuuccucauaggcuuuugcauuaucuuaaaagauguuucccuuaguaauauggaggagacaaaaucaauaaugugcaauacauuuaaucaacacgaaaaccugauucuaucaggagaacagauuaaaggagucuugcuuagacuccaggguaauugacaguuuuucugccuuauauguggaaugauuauaacaaguuguaauucagauaaugaacuucuuaaugcaggaaguucuucauucaggaaauagaaguuggugaaauugaaacaaauuuauuaaguaaauaaagggaaaagcacaaaauacuuaguggcuagaguauuaucaauuguaaagaagauuuggaauagaacaguuagggagcuauaauucuucaguuuuuauacuguucuaccacucuaguauguugcuauaauucucugaauuaauuuuuuuaaaaauacaacagcugucuggagaaaccaauuugaucucacuuuuauuuuauuuuuuaaaugcauuugauuauguauauuugagguuuacaacauaguguuaugggauacauauaguaguaaaaugguuacuauagugaagcagacuaacauaucuaucaucucacauaguuacuuuuuugugacaagaacagcuaaaaucuacuuauuuaauaaaaaucuccaauacaguauaauuuuacuaacuuuauuacucauguuguacauuggcucucuaaacugcuuugugcugcuauuuugaucgcuugaccuacauugcccccauuuccuuucccucccacccugcuccacauccccacccccaucccacccaugguaaccacuguuuuguucucuguaucuguguauuugagcucuuuuuaaauauguauauauucuacauaaaggugagauuauauaauauuuuucuuucugugucugguuucuuucacuuagcauaauguccuccaggucauauugugguaaauggcagaaucuccuuuuuaagguugaauaauauucauauauauauauauaccauguuuucauuaucuguuuauccacugaugaacauuuagguuguuuccauaucuuagcuauugugaauaaugcugcaaugaaugugagagagcagauaucuuuacaagguagugacuucaucuucuuuggguguauacccagaagagggauugcugggccauauaauaauucuauuuuuaauaucuuuaggaacuuccacacuguuuugcauaagggcuguaccagucuacauucccacuaauaguguacuaggguucccauuucucuaccuccuugccaacauuuguuaugucuugucuuuuuuauaauaaccauccuuacaggugugagguugauaucacauagcaguuuuaauuugcauuucccugaugauuaguaauauugaacauguuuucauauuccucuuggccauuuuuaugucucuuuagagaaaugucuguucagguccuuugcuuauguuuuaauuggguuguuuuucugcuauugaguuauaagagugcuuuacaaauuucugauauuaaccccuuaucagauaugugguuugcaauuguuuuccuaguccauagauugccuuuucauuuuaucaauuguuuccuuugcugugcaaaagauuuuugguuugauguaguaccauuuauuuauuuuuguuauuguugccugagcuuuuggugugauauccaaaaauucauugccaauaccaauguucaggaguuuuuccccuguguuuucuuucaggaguuuaaugguuucaggucuuaaauuuaggucuuuuauucaguuugaauuuauuuucauguaugguguaagauaaggguccaauuucacacuuuugauguaaaaaauccaguuuuaccagcacuguuuauugaagaaauuauucuuuccccauuauguccuuucugugcucuugucaaaagucaguugaucacaugugcuuagguuuauuucugugcucucuauucuguuccauuggucuauauuucuguuuuuaugccaguaccauacuguuuugauuacuauagcuuucuaauauaauuuugauucagaaacugugaugccuucaacuuuauuuuucuuucucagcauuucuuuuacuagucagaguuuuuugugauuccaugugaauuuuaguauuuuuuucuauuucugugaaaaaugccauuagacuuuugaugggaauuguguuaaaucuguauauugcuauagguaauaaggacauuuuaacagauuaauuuuucccacccaugaacacaggauaauuuuccauuuauuugugucuucuuccaucucuuucaucaugguuuuauaguuuucaguauacaagucuuucacucccuugguuaaauauauucuuagauguuuaauuuuuugcuauuauaaauaugauuguuuucuuaauuacuuuuuugguuaggucauuauuuguguauaaaaaugcuacugauuuuuuuuuucagguggagucuugcugcaucaccaaggcuggagugcacuggcacaaucucggcucacugcaaccuccuccucccagguucaaacaauucugucucagccucccaaguagcugggacuacaggugccugccaccacgccuggcugauuuuuguauuuuuaguagagacaggguuucaccuuguuggucaggcuggucucaaacuccuaaccucaagugauccacccgcgucggccucccaaagugcugagauuacaggcgugagccaccgugccccaccaaugcuacugauuuuuguauccugcaacuuuaccaaauucauuuuuuugguucuaaauguuuuuuguggaucuuugaggccuucuacauaaaggauaauaucucaaauagggauaauuuugcuucaucuuucugaauuuagaugccuuuuuuucuucucugauugcccuuguuaguacuucuaauacuacauugaauagaaguggugagagggggcaucccuguauuguacugaucuuauuagaaaagcuuucauuuguaccuguugauuaugaucuuagcugugagcuuuucauaaauggucccuauuauuuugaggaccuuuccuucuauaucuaaacuguuaagaguuuguaucaagaaaggauacugaauuuugucaaauaguuuuucugcaucaauugagagguucaugugguuuuucucuuuuagucuuuuaauagauguguuacauugauugacuugcaugccaugcauaaaucccacuuguacaccacagggaaaucccacuugguuccgauguauaaccuuccugauguguuguugaaucugguuugcuaauauuuuauugaagauuuuaguaucaaaguucaagacuuauuggccuguagguuuuuuuuacuugaaguaucuuugucuggcuuagguaucaaggugacacuggccucaugaaauauauuuggaaguauucccucuagcucuauuuuuuuuuuuggaagaguuuaagaaguauugguaauaauucuuuuuuaaauguuuugugaacuucuucucugaagucaucugguucagugcuuuucauugcuggaagguguuuaauuacuuuaauaucuuuguuauugguuuguucgagcuuucuauuucuuuuugagucaauuuuaguagguuauauuuuucuaggaauguauucaucucuucuagguuauccacauuguugacauauaauuuuucauaauaauccuuuaugaucuuuuuuauuucugaggcaucuguuguaaugucuccauuuuuauuucuaauuuuauuuauuugagucuucucucuuuuuuucuuagucuaauuaaggguuugucaauuuuguuuuuuuccucaaagaaucaacucuugguuuuauugauuuuuuuucuaugguuuuucuguucuuuauuugauuuauuucugaucuuuauuauuuucuucugcuaacuuuggguuuguuuuuagcuucuucaaauauaaugucaggcuauuuauuugggaucuuucuucuuuucuaauauaggcguuuugaguuuaguuuguucuuuuucuagcuucucaagguauaauguuaggcuauuuauuugguaucuuucuucuuuuuaauuuuuaauuaauuuauuauuuuauaaagacagugucucauguguaauccacgucagugaugaccaugagugccucagaggccuaggcugcaggaguuucuggcagcagugauggcaagguagauuuugugaauuccuagugguaagggauccuccuguucuuauuuuccccaauaguggagagacuuggaugaggggaucccucuuggccuugggucugacaugagccacaggcagccacagcagugcuguguuccagggcacaagugcucagaguggcuauggagcugaaguccugagcugaucccaaccagggagacgguaugacagaggcaagguguucugcucccuucucgauguggccaucuugaguuucugcacccugcaggguuucugccacacccuugcuaugcuccagcacucucuuuuagucauucggguugaaauguaguuguuuguucauuguuuuaauccaucuuuugaaggagagugauagucgaccaucucacugacaucaauuugaccucuguuuuuaaacuuuucuccaagauuuagcuacaagcuaaauuuaauugcauaaacuggucacagccuacauaauggacaaggcuuauauuuaccuucauagcaccauauuuuccagucuucugggacuggccucccucacuuccuauaaggaaaaauaaaacugggcuucccugcauuuugaugggucuauguauucuacuggucuggcucuccccuugaccacagggaggcccaugacuaaggcccagguaauuggaguaacucccaauggcucuaucaguugguccgggagugagcaccugccuaaagguaagccuuucugagccuuucuuuucuggagauuucccaaaugaagcuggaaaaaggagguuucuuuccuuuggcauugcuaagccuucccccaggaauugccuuguaacuuuggagcugccuacagccaucuccauucacaaagucauucgaagugauggagaaugagugaucgcaacaacagaagaaagauuuaaggcagagaaauggaaagacagucgugaugcuuccagcucugcauccaaaugacucagaagcccaccccaucucuuccucuccgauuauaacagccaccaaauuccccuuugaggguaaacuuauuugaggucagaaugcauucugaccaauacaccuauauauccaacaggauuggcaagcaaacuaugguacagucauagagucaaaauuguauggccauuaaaacgaucuuaccaaaguauaguuuucaauaaaaguuacaugaacagauaguaugcaaagaugaucugauauauuaagugagaaaagcuaguuacaaggcaauauucauuguauuaucuaauuuuguuaaaaauaguuuaauaacuagagacaauaaaauuuuaauggcuuuuuucuggaugguggaauuacacauaauuuuuuauauuuuauaauuuuuacuuuuaugauaagaaaagcaaugcuaaaaaccaagccuuuggccuaaucuuuuuauaggccuauguacaaauuaaaacuuaaucgcccacucauucauuugaauuuuaccaugccccuuucuuucuaaauaaguuuccuuuaacauggugacacaucaucccuuuccuuuuucaagcaucggcacuuuaaaagaugacauuuauaaggauaguaaauuaucaacaccuuccgucagcauaguuuauggcuuuuuagcuaguguaggaguucacaaaagaaacauuuucaucuaaaugaagucacucauuuagaaguaacuuucuaauuauuuucuccaugguaacacauauaacacauauaaaauaugaaaaaaauauguuuauucaaguuuuuuucucuuucauaacuauuucaaaaagccuuaaguguguuuuauaccuccuuaaaaauuucacccuguagaugggguucauuuuaacacuaaagucuggggcuuugcaccaauaaccugacucuauuacugcauugcauuccugaugaaacgcacuaagaguuuaaaguuucuuuauuaaaauuuuuucucaagaaaaugacucugagcuuuggaaagcacuucuaaaauaaugucauaugaaaagugaaccuuuuauuagaccucagaccacagaagaaucccauggaauuuuuucuaauauaauuaaccccuucauucgagaacauaagagcuggaguaugguuuaauagguagauuuagaggcuucugugcuuccaguaauccuccuuucaucaaaacaauggcuauaauuaauauuuaugauuuugccuuucuccucaaaggacuuuacaaauuguuaccacuuacuaaugacacuuacuaaugaaguacuuacugcucaguccaaaagagaaauuuacagucuucucaaguuuguuccacaaugauguggcuacaaaggaggguugguugugaguugauggauucaacuccccauuaccaaaagaaugagucaggaaugggaaaccaaucagucaguuccaaacugauuccccaaaguuuguguggcaggaucacugaggaucacuguuuugauuuguauuguuuuauucaggaucucccacuaugauguccuauagggguagguaaauuacagcugagggccuguggccucaaccuaauuuuauagcuacccuucucccuccaccucuccuaucccacccacagugaguuacuuuuacauuuucaaaugauuguuuagaggacagaagaagaauaugugacagagacuguaugugaccugcaaagccccaaguauuuauuaucugguucuuuagcgaauaaguuuacuccucccugaaaaucuaaggcacaauaagaaaagucgaacuguaaagcuguugcaauuccagcuauaaacauugucuaacauucaugaaagugucauuuagaaacuuggacuuaguguacagagauaaauauacuuuguggaagcacauuucaggugucagcuuuuuuuggagucagcacauuacucuggacugacaggauauagaccuaaaaagaccaaguucauguaccaacaugcauauaggaaacacuauacacacacaggauauucaucuacaacuuggagcuaacaucaaauaggcuuguuggacuuuagcaccacucagcaauaguacugaaagaaaagaauaaaaaggaagagaaacccagcucuuggugcacaacaauuugggaagaccuacaggcaagacugagcccauucaggccaaacagagucagcacaauagcagcaugacugucccacuguauaccauuugcauagacuucuacuuaguuuuaguuuuaucagcaauuugucuguuauuuauaagccauaccucuucuuagcaacaacaaaaaagguaacauuauuagauucccaauauauuagcaacaaaagcuacuuuuugugugagacacuguccuaaacuugcuacauauaucaugcccuuugagccuccaguaagacagacauugcucuccucauuuuacaagggcucauaguggcacgccccacauaauggaagccaucugaaguaagguuagugaggcucaugggaacagccucugguucaugucagccuuucugccaaguucauuacugaacgcagaucccgugugacagacuuuuccaucaaaaauccagaauccuauuggaaaaugaaucagauacaauucaaaaauuggucuuuguugucccuaucuuuggaagggguaguuaaaaacuaaccacaaaaauguac

SEQ ID NO: 13607 - RNA, 1120 nt, Homo sapiens
ugaagccauuggccuauuucauguucuuuacaaauuuaaaaaauauauauuuuauuuguauguaugcaauuuuugguauaugggauguaaaaaggaaggaaauugauaaauaaaugaguaagaaaaagaaaauucagccugcccaagucauucauaaaucuucagaaugagugggauucaagcaaucugacccauguuuggucaugguaaucuuaacgcaccuugcuaaguuauaagaugcacagcuuaauuaucuuucagcuggaugaugguucugagacugagguuucuguauucauguauucauaugaggugauuguggagcuucucuuuacaagaacccagcaguguaguauaagcucuuuuuuuuuuuuuuuuuuuuuguaaaaagccuuacuccuucuucuucucccagcagguuuugauggcugcauugcuucuaugugguaugguggagaaagucuuccuuucagcgggaagcauagcuuggccuccaucucaaaaacagaucccucagugaagauuggcugccguggcccgaacauuugugccagcaaccccugcuggggugauuugcugugcauuaaucagugguaugccuacaggugugucccuccuggggacugugccucccacccgugccagaaugguggcagcugugagccaggccugcacuccggcuucaccuguagcugcccagacucgcacacgggaaggaccugugagauggugguggccugucuuggcguccucuguccucaggggaaggugugcaaagcuggaaguccugcggggcaugucuguguucugagucagggcccugaagagaucucucugccuuugugggcugugccugccaucgugggcagcugcgcaaccgucuuggcccuccugguccuuagccugauccuguguaaccagugcagggggaagaaggccaaaaaucccaaagaggagaagaaaccgaaggagaagaagaaaaagggaagugagaacguugcuuuugaugacccugacaauaucccucccuauggggaugacaugacugugaggaagcagccugaagggaacccaaaaccagauaucauugaaagggaaaaccccuaccuuaucuaugaug

SEQ ID NO: 13608 - RNA, 11852 nt, Homo sapiens
aaggauucugaaagaaaugaagucagcccucagaaaugaaguugacugccugcuggcuuucuguugacuggcccggagcuguacugcaagacccuugugagcuucccuagucuaagaguaggaugucugcugaagucauccaucagguugaagaagcacuugauacagaugagaaggagaugcugcucuuuuugugccgggauguugcuauagaugugguuccaccuaaugucagggaccuucuggauauuuuacgggaaagagguaagcugucugucggggacuuggcugaacugcucuacagagugaggcgauuugaccugcucaaacguaucuugaagauggacagaaaagcuguggagacccaccugcucaggaacccucaccuuguuucggacuauagguaauucaucaacucuuccugaggcugggugggugggagggagugaagugucucagacucuacugaauggcagaaacgaggauaauaagaagugcagccacuuuacugucucugcccacuuauccaacugccagaugaugucacuucauuccugugagcccuuuaaauucuugaaacuuguuuucuugcuuucuuuuucuuucuuucuuuuuuuuuuuuuuuuuuuuuuuuuugagacagagucucacccuguugcccaggcuggagugcaguggcgugaucuuggcucacugcaaccuccgccuucuggguucaagcgauucuccugccucagccucccaaguacuugggacuacaggcgugcgccaccaugccuggcuaauuuuuuuuuguauuuuuaguggagacgggguuucaccauguuggccaggcuggucuugaacuccugaccucaagugauccaccugccuuggcuucccaaaaugcugggauaacaggcaugagccauugccuccagcugaaacaugcuuucucaaaggaauugggaucauaugcagguagaagggcagcugguauguguuugccugaaggauagaaugacaagacgugaagaaagauaggaaugacuaagagcuagucauucuugccagccucugacagugugagaucugcagcaguguuuacuaguucauuuucugugaagucaguccuugauaauuugugguacaaagaaaggaaauaacaagucugacaguaaucuuccuaccuuuguagagacuccaucaucccuucugaaucccuguuggcccuacccugcugaggaaguuuaucagggugggcucccuuccugcacuuccugcgcuuggagacauuggagagcccacauugaaaaucucuucaguuaaccacauuuaagucccuucaguccaaagaggaaauggccacuggagucugcuuuaguucccacaagcuuuggguugcuccuuccuccuguucacauguuaaugucuuuagagguucagaggggcauggaagcuacugagagacugacuuccuggggaaaggaagauaacuuguaaccuuaaguugguguuuucuuuuuuuuuuugagacaaagucucgcucugcagcccaggcuggagugcaguggugcgaucuuggcucacuguaaccucugcuucuggguucaagugauucuccugccuuagccuccugaguagcugggauuacaggcacgcaccacuaugucuggcuaauuauuguauuuuuacuagaaacaggguuuugccauguuggccaggcuggucuugaacucuuagccucaagugaucugcccuccuuggccucuuaaagugcugggauuauaggugugagccaccaugcccagccgguguuuuuucucucgaccaccagccuuuuauuauguugauaauguguauuuggagaugauaauuauuaucaagaacuauacuaaagagagcugaaagcagugugggcuuuggaaaguauaugagauuugaacuuggaaagccuguuuuuuugguuuuuguuuuuuuguuuguuuguuuguuuuugagacagggucuugcucugucauccaggcuggagugcaguggcaugaucauagcucauuguagcuggaagaccuguuucaagccucagaucuaccaauuaugggccaggcaggcugggccaaucacuaaccuuguugggccucuguuuuccuacuuguaaagcgaaaaauaauaauaccugacuuuacaagguuguugugagcaucaguuguaauaauuuacuaugugaaguacuuuuuaaacugugaagcacucuacagauagaagggauuauuaucauuguuauuauuauuauuuuuuuaaucuuccaccuauucagccaucaguuuuaaugucaguaaucuucagacuuuccgggaggcaccaacugaguuucagugaauagggcaaucucuccauuucccauuuccuugcuaugaugaguggagauucuucaggcccucugggaaggguugcgggggcaguugaagaggagugcuagauuuauuuauucaucuggugagugggcuucauuguguauuggugcuaaguguuuugguaagcucuaggacaaaaugaaaagucugccauccucaagaaucugagagccuaacugggaaaauggccuugaugacaaugucaugguaacaauacuaaccacaggguguccuuaggagccccagaaaagugugguuguugguucucaaagucuauuuccuagggggggaaaaauauauauauauauauauauauauaguguuagcuccagccaccagugagucaggagaggcuuucuaggcaaagacaucuaaguucagaauccuugugauccagaugccuguacccuuugaguucagaggugggccaggguaucucagguauuucuuuccuuuagcaucuugcaauucaaaauaugguccuugaaucaacaucaccugagagcuuguuaaacagagaaggcuacuucaaauucuauuucugucuuuuauguuagucauuuggguucuuaagucauuucacuguaaccucugggggagcuaggggauucuuuaaggaaguuuccauucucugaguuguuuucagaaacuguuaguuggcaaaggauguaccaucuccuauuaaacgggcaaggacaaguucccuuuucugaggucccuuaagaucucuuccuggggugaucuaggcuugcuguuuuaugagggagggacauauuuacacaggggcaagaacuagucuuuuaauccauuguugcauaggggaggcgugggcacuuggaguugucuuaggacugaugucugaauuaacuaaaugaacuugucugguuugcagagugcugauggcagagauuggugaggauuuggauaaaucugauguguccucauuaauuuuccucaugaaggauuacaugggccgaggcaagauaagcaaggagaaggugaguuuucuucuuuugguucauggccccaggagccuaucagaagugggagcuacucuuguugauacagagagagggaagcaggcagucugccgccacuauagugggagucagacaucucagguggcuuuuaaacaacaugaaugggaagagaauugguuuaugaauugaagaaauaggauuauaacaucuucugguguggucuuggauguuucuuucauccuuggauuuuauccuuguuucuguaaaauucauaggucuggcucauauguguuucccucccugguuugaugggguuguggggaagacaucccaucugcuugugcugggggaaaacaggaaggaggugcuaguccacuauaguaucacucuccuacugccaucuauuucuccucagcugacucaaggucauuguggggucuaggcugcauguaggagugggguggggggagguucuugugacugguguaucugggaaaugguaaaaguagagauuuagaguugaaaaccaggaggccgggcgcaguggcucaugccuguaaucccagcacuuuggggggccaagguggguggaucacgaggucaggagaucgagaccaaccuggcuaacacggugaaacccuaucucuacuaaaaauacaaaaaaaguagccgggugugguggcgggcgccuguagucccaguuacucgggaggcugaggcaagagaauggugugaagcugggaggcagagcuugcggugagcugagauggcgccacugcacuccagccugggugacagcaagacuccaucucaaaaaaaaaaaaaaaaaaaaaaaaugaagaaaagaagaccagguaguggugaagaucucggggaugucaugauugcuagaaaaauauuuaaaauccauggccaggcacgguggcucacgccuguaauccuagcacuuugggagacugaggugggcagaucaccugaggucaagaguuugagaccaaccuggccaaccuggugaaacuccgucucuacuaaaaauacaaaaaauuagccgggcguggugguaggcaccuauaaucccagcuacaggaggugaaggcaggagaaucacuugaacccaggaggcggagguugcagugagucgagauugcaccauugcacuccagccugggcgacggagcaagacucugucucaaaaaaaaaaauuuuuuuuaacuccaguuggccuagcacaauggcucaugggcacaguggcucaugcuuguaaucccagcacuuugggaggcugagccgggcagaucacuugaggucaggaguucaagaccagccuggccaacauggcaaaaccccaucucuacuaaaaguacaaaaauuagcugggcguaguggugggcgccuguaaucccagcuacuugggaggcugaggcaggagaauugcuagaacccaggaggcagagguugcaguaagccaagauugugcuauugcacuccagccugggcuauagagccagacuccaucucaaaaauuaaaauaaaauaaaauaaaauaaaauaaaauaaaauaaaauaaaaaaauauaaaauaaaauaacauucuaguuggcccuacaugguacuguugaccuaaggauaggccaggaaauguuugagaaccuauuguuucuaaaauaugacaauagguccucaaaauaggcaggccagugccugccuguaacgauucagauaagucauugcuugagaauuuccucauguuccuaaugauuauaguuuuguuucuuaagucccaucaaaugcaaaaugggaaggaaaaugaaacuagaacucccuuuuugguuucuccuaguaauugucucucccagccauuuauauauaucuaaauuaugauuauuauuuucaaaaauaaagauagcacuucaguaacuaaauguuaaaugcaaaggaaauagaucccaaagcaaugccuguuucugaaauaucguucguucauaaucacuguggcccaagguaaacgaauagcagaauacucaaaccuuguuguaauuucacuuuuuuauaauccccugagucagaacgucagaaugaguuggaaggcccaauauugauucaaauauuuuggaaacuuuaaaacuauaacaugugauuuuucucauaaagucuuuccccagcuaccuuucuucuccuuuuucagagaagcccuuagaguuuuucacuaugacaccagccuggccuuuuggaaaauaauaaacuuaggaggauugucuuuucagcccugcucuuucacgguccuucucaaugacacaacauggcacacgugucucucugcaaccaaggagcagauugaugaccaaaagacuuaccaccaccucuguucugaguaaaaaucaggagucuaaguugcucaugacagagaugucugguuuaagaucacugaaggucacugaaagggcucaucuugucacauuuucuuacugcuauaaaucacauggacugagguuugcauuuggggcuuauuagucagcucuauuuuuuuuuuuugagacagggucucgcucugcugcccaggcuggagugccguggugcaaucacugcucacugccuugaccucugaguucaagugauccuccaccucugccuccugaguagcugggaccacaggugugugccaacacacucagcuuauuuuuuuuauuuuuuguagagaugggggucucacuauuuugcucaggcuggucucaaacucuugggcucaagcagucuuccugccucagccucccaaagugcugggauuacagguaugaacuucugcaccuggccuagcuagcucuauugacauuuguuuuuuguuggugguucucuuagaguuucuuggaccuugugguugaguuggagaaacuaaaucugguugccccagaucaacuggauuuauuagaaaaaugccuaaagaacauccacagaauagaccugaagacaaaaauccagaaguacaagcagucugguaagaauuuuggccucucaguggucuaggggaaguacucugugcaugggggugggcaucaugacugauaaauauucauuuguuggauagguggauggaauggaaccuggaugaccaaagccuccuuuagcuuguggcuagaaaucgcgucccuuuauauucuucauaucccagaucugccaacuccauugcccuguauauucaugaucucugcaaaaugcugccaagcaguucuuaacauuucagucuucaagaaagaaucugggaucugcacaggcuggcagagcuauggacauucagggguuuugcauguaugcugaacccuacugccuugcucugguauuuggccucacaaccacuguccaacuucgggugaugucacuugggucucauaccuuccuugcaugugucccaaguuucacaaaaccuccuuauggaaaagagcacauucgauuucuuccuugauaaaagggaccagauucacauuggccuucugcuuuacuugcauuccucauugucuuuuagacucagccucagcuugggcuuuguuagcaaguucacugccaccauagcaucacagccuaaagggcauggcugagacucauugaucuauagagcacucuuuuaccccaacauacucuaaaugacugaucaaagaucaaaaacagaagagcauuuauacuccauucuuguuuuuugagaccugcuugauuuauuccgauuauuuaacacacagggacgcaacagugaucccaaaguguguaaaguuaaagccuucaacugcagcugaggagagggcaggaauggggacgguggugagucaggaaugacaggcaggcagccaugaccagggcagccuccuccccagggccagggacuggggaguggccuaaggagcaggaccuaaggguagcccagagcuggggaagggggcagagaccuccccuuggccuaggucuggagcucagaagugccacaugccugagggggcagcggccugggaagggccagaggcagggucaggagagcaccauuuccuggggggcuggggacagggaggugcccuauaggagaagccaggaggggccgucugccccugaggugggggcugggcuggagcaggcugcagcaagaaagaccugaggcaggcacagggccugagagcccagcugccuggguucaggggggcucccagggcagccuggcccagggagcaguccugacucugcaggggaugcccagcaaggggggcugcagaccccucagagccuccccuccucucucccuggaaaggagcuggggaacccauagugcaaaucuguggaccacucaguuauggagggaggcugugccugaagguggacacuggggugcacucccuccaccaucucgcccugcaccgcuguccucaguacagccacuucucguaagagugcaggccauggaugccaccgucgaucugggcugacauggucugcuucucaaacuugagcuccccugaguacaucauggaccgaaggacagacaggcugugggccccgauauccuggcagccaugcuggaugcccacuaugagguagggcacgaacuucugaauggacccuuuguccuggauggagcccaagacauccugcgugaucuucgccuuauccccgucguugaaguauuguuucuggcugcugcugcucuucuccauggcauccagugagcccaugcccugguacuucuugagcugcauuccgucugagaagaagcacucgccgggggccuccaugguggcggccagcagggagcccaucaucacuguggaggcuccuagggccagggccuugaccacaugccccauggucuggaugccaccaucggcuaugaugggcacaccaaaguucuggguaugcuuggccaccuuguacacagcagugcccuggggcugacugcaggcuaucacuuccugguugauguagauggagccgcgcaguccaugccccugcccagcccauccacaccagcgucaaucagguuguuggccugggcugcugucaccacguuccccccaaucaccuggaggugggguuacuuuuguuugauguaaugcaccauggcgaucugauacaccgaguucccuugggacgaguccaagccuaugacauugacgccuaccugggugagcagguccaggugguauuugucauccucauggguacccacagcugccccgcccagcagcugcucaugggaauccuuggaggccacaggguagucucgguucuucagcgcggugcaggugauaauggccaccagcucaucgcgaucauugacgauaggcagcuuccuuucuuacuaagcugcaggaucucauuugccucuuucaaccucacacugcuggagccaccacuagcuugauccuuggcaucaucaccucacugaggaggguggugugguccuucucagcaagaaagucgaugucucgggaggugacgaugcccaccagcuugcugcccaugguacccgucucagugauggggaugccagagaagccaugacgcaucuuggccuccaacacaucacccacagugugcaaggggcucagcaccacggggugugugauaaagcccgguucaaacuucuugaccuucugcaccucacuggccuggaacucuggggugcaguuguggugaaugaaaccaguaccucccaucagagccaucacgauggccaggucggccucugucacaguguccaugggggaggagaucagcggcgucuucagagugaccauugggucagggcugaggucagguccaccucaucagcuaugaagucuaugaauccugggagaaucaagaagucguuguaggugagucccuggucacuggcgaagagcugcugcacgguguggggaaaagaaagagagaucagauuguuacugugucuguguagaaagaaguagacauaggagacuccauuuuguucuguacuaagaaaaauucuucugccucgagaugcuguuaaucuguaaccuuacccccaacccugugcucccugaaacaugugcuaugucaacucaggguuaaguggauuaagggcugugcaagaugugcuuuguuaaacagaugcuugaaggcagcgugcucguuaagagucaucaccacucccuaaucucaaguacccagggacacaaacacugcggaaggccgcagggaccucugccuaggaaagccagguauuguccaagguuucuccccaugugauagucugaaauauggccucaugggaagggaaagaccugaccgucccccagcccgacacccauaaagggucugugcugaggaggauuaguaaaagaggaaggaacgccuguuugcaguugagagaagaggaaggcaucugucuccugccagucccugggcaauggaaugucucgguguaaaaccugauuguauguuccaucugcugagauaggggaaaaccgccuuagggcuggaggugggacaugcgggcagcacuacugcucuuuaagucauugagauguuuauguguaugcauaucugaagcacagcacuuaauucuuuaccuuguucuugaugcagagaccuuuguucacguguuuaucugcugaccuucucuccacuauuauucuaugacccugccacaccccccucuccgagaaacaccuaaaaaugaucaauaaauacuaagggaacuaagaggccggcgggauccuccguaugcugaacgccgguccccugggcccccuuuuuucuuucucuauacuuugcgucugugucuuucuuuuccaagucucucguuccaccuaacgagaaaaacccacagguguggaggggcaacccaccccuucagcgcagugaacccguccucgaccacguagccggugcugcugcugauagguagucccucaugcugccgcgagaccccgcgacccgacauaaacgcugcagcugcugcgacgcggaggcgcgccgcugccacgcugcagccaggcgccgggugggcugggugggcugggggcgggggcugcggcagcggcggggcgggccagggcgcccuauacuccauucuucaugauguuuggucgaagagucaucugaaauuuugaauucaguaagguggcuagaaaguuuaggguauuuugaaagauggugauugaccuuggacugaaccacuauugaagauuuauuugauaauaauuuguaaguuuuaacucaguaccucccuucugcuuuuauaguucaaggagcagggacaaguuacaggaauguucuccaagcagcaauccaaaagagucucaaggauccuucaaauaacuucagggugagucuggagaaaacauauggaaucccagcaugaaaccguuucagaguucuaauaaaaauaugcauauucucacagcauguacuuuauuuaauaucugaaaaaauugugauagaaauguguauuuguuuuaaaaacguguaacuucuuauauuucaaagcuaauacauguucauugagauauuuggagacuauagagaaagauaaaagaaaauaaaucaccuauauuccacuauccaaagacaaccacuguuaguauuuugguauauuuccuucuagacucuuuuuuauguggguuugcaucuguaucuguauguauguauauauauauauauauacauacauacauacauacaguuggacaauuggacauuuuuuucacuguucauuuauucacuugaaauuguaacuuaaaaaaagaaaauguaacuuuaaaaauaaaaauagaugcaccaugccuauggaaaaaaauuuaaauguacuacaagagguuuuaaaaguauuuuuuugcccgggugcgguggcucaugcguguaaucccagcacuuugggaggccgagccggaaggaucaccugaggucaggaguucgagacuggccuggccaacauggugaaacuccaucucuacuaaaaaauacaaaaauuagccagguaugguggcaggugccuauaaucccagcuacuugggaggcugaggcaggagaaucauaugaacccaggaaguggagguugcaguagccaaaucgcgccauuguacuccagccugggugacaagagcaaaacucugucucaaaaaaaauguuuucuuccuaccccuauaauacugaccuccaauuauuuuuccuaaaggcagcuguugugaacuaguucauucuguaacuauccagagauagucuacacauauauuucauuuuugcuuuuuucucuucuacagaugauaacacccuaugcccauuguccugaucugaaaauucuuggaaauuguuccaugugauuaacauggaacugccucuacuuaaucauucugaaugauuaaaucguuucauuuucuaaauguguuauaauguguuuagcccuuucuuguugcuguauguuuagaugcuuuccaaucuuuuguuacuacuaauaaugcuauaaaauaaauauccuuguacuu

SEQ ID NO: 13609 - RNA, 9227 nt, Homo sapiens
uggagcucuauguuuuccugguggcauuuaaggcuuaagagcuggauagagguuuccaaguaguuacugaguguggugggcagaauaauggccccccagagaugucguauccaaauccuuagaaccugugaauauguuagguuacguggcaaaggggauuuaagguucagauaaagucaauguugcuaaucagcugaccuugagauugggaaguuauccuggauugucugggugugcccaguguaaucacaauggucuuuaaaagugaaagagggaggcagaagaaagugugauaguauagggauguaaagaagacucaaccagcccuugcugguuuugaagcuggaagagggucgugagccaaggaauaagggcagccucuaaaaagcuggaaaagaucagaaaaugguucucaccuacagucuccagaaaggaacaccgucuggccaacaccuugaucuuagcccagugagacucauuucuaccuucugacuuccagaaguuuaagguaaucaacuuuuguuguuuuaagccacugaguuaauggcaauuuguuacaacagccauagcaagcuaguauaccgagucucauucuuacccuuaugagaccuuccacaauuucaucccauccaacccacccagcaaugucuucugcuugggucagaucaguuuccucccuccuuccagauacauuaugcucauucccaccuccuaguuguucucccuucuguggguuucucuguugggaaagaauuucucccuccugcuaguauaaaucuguguggacaugguuucuccgucccauaaacugcuagaccaaccuugaucacccaaacucuucaggugaucagauguuaaaauauuucaaucaaaauggacuaaauuucuaacgugggcuauaacugaugucaagaagaugaggaggauuuaaaggcuuacuuuaauagacauacacauugacuaguugaggaaauauagacaaaagcaguuucaaaauaguaugcuguaugcuagaacugaaauguguuuaggguacuggaggaaggaagagaaaggaugccugauugccuaaauuggggcaguugugagggucacagauuagacucagguaaaaccuuucagagaagaggauuccuggguugccuuaugaauggugaggaguuugugaggcaacacaaggaugggaaaggcuacuucaggcagagaaaacagcuaguucaaaggagagagguguaagguguguuuuaugcaggaacuacaaguuguuuggcauaacaauaguggguuaagaagaaagggacaagaaauuagguuagaaagagauagaaggcagauagcaaaugguuuucuaggucaggcuaagugguuuguagauagaaggauuuaagcgauaacaugauuugcauuuugggaaaauuccucugauugcaacagggacaauggauaugaaaggguugaggcuacaggcagagagagaacuucugcgaggcuguggucuagagggggaaucaauaaggccugaacuacggcauugauaggagaucaggaguggggaauuggcacgagaaauagaagggagaaucaacaguaaagaggccauggagugaguggugguacccacucuuugggauaggaaaauugacuucaugaggaaauagguauuuaguuaaauguugaauuuaaaguacucacagaguguaaagauggauaccgcccagcacccaguugguaucaacuucaggaaaagcauuuaggaucuagauaauuuuggaaucauucguauauagguugagugugcaagaagagaagaagggagaaccauguaaauaugugggaugagaaaaaaugguucaggaagcuugaggagacccaggagauaauggugucccagugucuuaguuuggccugcuauaacaaaaauagcauagacaggugacuuccacuacagaauuuauuucucacaguuugggagccugggaaaucuaagaucaaagugcuggcagauauagugucuggugaggacccucuuccuggcuugcagauggcagucuucucguuguauccuuaaguggcagaaagagagagaaagcugcucuuuugugucuuuuuaugaaggcacuaauuccauugaggagggcuuugcccucaugaacuaaucaccuccaaaaguccucaccuccuaauaccaucaccuggggggguuaggauuucaacauaugaauuuuggggggacauaaacuuucuguccauaauacgcaggaacagagggaggagagugugacaaggagaaugcgacagcauggaaagcuacugagagaucagguguaacgacagacauuuuuguuguauuugugugaccuuguugcaagaguuucauugaaguaugugagugagcaucagagguugagagugaauaagaggugaggaagugggaaaacccauggugaccgcacuuccaagaagcugggcugugggaagucaaagguggagagcaauguccaaguuaagagagaguucaacagucucugggaagugcugagcgggaacagccuuugagaagacgcuauuaaauauacaggagagagauagguagagagagaggaaggaggaauuguuauugggaaaagaagacuaauaaucuaguauagguagagagucuagcuucaaugaguggaggauuccuuuuaacugagaugugaugcagguuaguuuauagguuguggaguggaaacuggauauaacaagcugguugacaggauucacaaucaguagccaccauauaggaauugugggucauuuuuuaaggggccaggguuuggggaggaggcuuggcagcgaagacaagcuuuaggauuugcccauggaacugaauugggaacuggagucuaaaaagucaaggaauuuucuguuuuggguguuggauggguauuucacauggauguuuauuuugcccaaacugacgucaguauuagaguggagaggaacuuggugagucaggcgaugaagcucucaguaagugcacucagguggugauuuuggucaccucuguaaaaacucagcuuuacucccuguaaggaauugacggaagccaacccugacaguguaacaaagcucaucugcugguaacagugcuuuauccgacaacagcgaggcgauuaugggaaggaauggaggaauguuguaugugauuucaaaauuggcuuauaagauaugaacucugaauuucuugugccuuuccaggaagaaaaaaaauaucaauauagauaauuucuaccuguuggcugcugcaccaaaaacucgcuuaaccucaaugauaauuccuauuuguuggagccaagagaguagcauuuuugaaagacugaauuauugaagauaagauugagaucauuguuccaaggggaucaaaagagauaaaagucuuucacuucaugaacucuguguucucuucuuauggcugcuguaauuauguuggcuggaaauaacaaaaguuuauucucuuacaguuuugggccagaaguccaaaaucaaggugucagcaggguccugcuccuucugaaggcucuaggggggaguccugccuuaugucugccagcuuucggugggacuagguguccuuugacuuguggcugauagcucuaaacucugccugccucuucacagggacuucccugugcuugugucuucuccuuuucuguauaaggacacuggugauuggauuuaggacccaccuggauaauccagggugagcucaccucaagauccuuaacuuaauuauggcugcaaagacccuacuuacaaguaagucacucacagguucugguugggcacaucuuuugggugggaccaacauucaacucacuacaaagcccaaaagauuuaaaaauuuguaucagugaaccugauaaccucuccaaagauauauauauauauuuacuucagagugccuuguccuuucccauaaagcaguguaggguacccauugcucaguaacuagguuuuggguugguauagaauuauguagaguccaugcugagaaaacagguguuguuuuagaugacaguaauucagcaaugucuaacuucauugauaacagacuuaaucuacugauuugggucgaccccuugcauuuagggagccaaagggaaaaaucuuacagggugaaaauaucuacaucuaaggccucugcuucauguauagccuaaacauaugcucuaaaucugagaaaaguuuuaagaucuuugcuuugccuuggaaacuauagcuggcaagaucuagcaaaacuuacagaauagaaauuccagcaggaccuacagaacagaucuggagcccuggcaaugcuuuucagggggcacuaauauaguuuggucaaugcagcgguccccaaaucauucuguaugcaggcagaucaaagauugacaugugcaaaugaagugauucugacaacauuaacaugcugauugcagcuaagugcacugcuuguucaacaguucuucaguagacuaaaaaauauuuaauugaaguaaugagaaaccaaaaacauuucuuauucaugauauuauacaaauauguuccgcacgccuucagcuaauaguucuguauuugugauucucaaauaucucugucucuagucauuaauucucauuuguacuucugucucaaauugaaaacugcuuacaggacauuucuaaucagaaguucugccaucaagucaguauuuacauuuucaaaacuaaguuaauauuaucuaagaaccccggcaaucuuuccccaaaucuuaguuucuguuauugaugacaucuguuauugauauuauagucgcugagacuucccaauuugagagcaaguuauagcagaaaaaaagucuggaauaaguguuaggauuugagaguuuaguuuaaauuuugcugcucauauuuucauaauuuugguuaauucacauaaccuuugggaucuguuuucugaugugcaaagugaagagccugagcuggcagcuggaugacuuauacauguauuuagcaaacuuguuuucugugucaguaggucguuuacagagccaggugugggaauucaguguuuacugggccugguuccgauccuaacaugguggaccuguucucugcuaaagcucuccugcaucaaucuuucacugaacuccacugauucugcuuuggcccuuccuucucucucccgcugcuggcccuucagucaagaauggggggcacugcagagccaccaucuggcuccagcuccacacugaguugugcugcacaggguacucucaucaggucgcuuuucucuucaaggaucugaugcuugcagcugggugcagugacuuauaccuauaaucccagcacuaagcucaggaguucaagacuggccugggcaacaugucuccaccaaaaauacaaaauauuacccaggccuaguggugcacaccuguggucccagcuacucgggagguagaggugcaagaaucacuugagcccuggagguggaggcugcagugagccaagauugcaccacugcacuccagccugggugagagugagaccccccacaacaaccaucucaauuaaaaaaaaaaaaaaucuggugcuuccuauugccccuuguaagugaugucccaguuuagacuguugucaaggguccucuguaaacuguccuugucuucaugucuuauuuuaucucuauuuugcucuaugaaaccccuccuuaguuggguaacucuccuuauucuuccccucaagucuaccugucugcacuuacugagucucccuccugagguacuuuccccccaccucaccuccugacuaaccccaaucaaugaaagccacagauuccugaggaagguuuccccagaacccacaggccaccauccucaccccugggccuaucgcauauuuugcauauuuuggacauuugauuacagaguauuauagcauccuuacauguuaaacaucuuguaacuuugauauguuucagaacucuuaggucuuucguagccuagcccaggcccagaaaccugagaguagagguuaagacugaacccccuaagucaggcuuccugaguccuuaacauggcuucaucuuuuccuagcugugugacuguggcaauuuacuuauccucucugaacuuccuuuuccuuacuugcacaauugagacaacaauauugccugccccaguuacucacuaguucacaugaauaguuauuaguuauuuaguuaauacgaguaaaguguuuaagacagauuuugguauguagugagugauuaagaaguguuaguuacugcuguuucauuggauuaguguaagaauuaaacaagauaauucauuaaaaaacccucaguguaguaccuggccuguaguaagaauucaauauuuuauuuaacaguugaugaggcuugggggaaagaaaaugaccauagucauuguauuaguccauuuucaugcugcugauaaagacauaccccagacugggaagaaaaacaggcuuaauuggauuuacaguuccauguggcuggggaggccucagaaucauggcgggaggcaaaacgcacuucuuacuuggcugcggcaagagaaaaggaggaagaagcaaaagcagaaagcccugauaaacccaucagaucucgugagacuuauucacuaucaugagaauagcacaggaaagacaggccccaugauucaauuaccucccaaugggucccucccacaacacaugggaaugcugggagauauaauucacguugagauuuggguagggacacagcugaaccauaucauuccaccccgaccccuccaaaucucauguccucacauuucaaaaccaaucaugccuucccaauagucccucaaagucuuaacucauuucagcauuaacccaaaaguccacaguccaaagugucaucugagacaaggcaagucccuuccacuuaugagccuguaaaaucaaaagcaagcuaguuacuuccuagauacaaaggggguacaggcauuggguaaauacagcuguuccaaaugggagaaauuggccagaacaaagggguuacagggcccaugcaugucugaaauccagcagggcacucaaauuuuaaagcuccacaagaaucuucuuugacuccagaucucacauccaggucaugcugaugcaagagguggguucccauggucuugggcaccucuacuccuguggcuuugcaagguacagccccccuccuggcugcuuucacaggcugauguugagugucuguggcuuuuccaggugcauggugcaagcugucgguggaucuaccauucuggggucuggaggacggugacccucuucucauagcuacacuagacagugccccagaaaggacucuguguggggcuccgaccccacauuucccuuccacagugccuagcagagguucuccaugagggccugcccuugcagcaaacuuuuucugggcauccaggcauuuccuuacaucuucugaaaucaugguggagguucccaaaccucaauucuugacuucuguggacccgcaggcucaacaccacauggaagcugccaaggcuuagggcuuccacccucugaagccacaucccgaacuguacauuggccccuuucagccgugguuggagcaucugggacacaggguaccacgucccuaggccacauauagcauggggacccugggcccaacccacaaaaaccacuuuuuccuccuggaccuccaggccugugaugggagaggcugcugugaaggucucugacauggccuggagacauuuuccccguggucuuggggauuaacauuaggcuucuugcuacuuacgcaaauuucugcagccagcuugaauuucucaucaaaaauguauuuuucuuuucuacugcaucgccaggcugcacauuuucugaacuuuuaugcucuguuuuaaaauggaaugcuuuuaacagcacccaagucaccuuuugaaugcuuugcugcuuagaaauuucuucugccagauacccuaaaucaucucucucaaguucaaaguuccacaaaucucuagggcaggggcaaaaugccgccagucucuuugcuaaaacauaacaagagucaccuuugcuccauuucccaacaagauacucaucuccaucugagaccaccucagccuggaccuuauuguucauaucacuaucagcauuuuugucaaagccauucagcaagucucuaggagguuccaaacuuucccacauuuuucuaucuucuucugagcccuccaaauuguuccaaccucugccuguuacccaguuccaaagucacuuccacauuuucggguaucuuuucagcaaugucccacucuacugguaccaauuuacuguauuaguccauuuucaugcugcugauaaagaccuagcccagacugggaagaaaaagagguuuaauuggauuuaacaguuccacauggcuggggaggccucagaaucaugacaggaggcaaaaggcacuucuuacauugcaguggcaagagaacaggaggaauaagcaaaagcggaaaccccugauaaacccaucagaacucaugagacuuauucacuaucacgaaaauagcaugggaaagaucggcccccaugauucaauuaccucccaaugggucccucccacaacacaugagaauucugggagauacaauucaaguugagauuuggguggggacacaaccaaacaauaucagucauaauuauugucaaauaauuaaaaucugugaguuagcauuauaaugaucucuauuuuuuuuuuaaggugaggaaacugagguuaagagagguuaaguaacuugaugggucacauacuuagaaacugaguggagcagauuaaacacccaggaagccugacugcagaaucuguaccuuuuaaaccauuauuccuaugcuuuggucccagacuaggcagugugggggaaauuuugaucugcuggugaaaacaaacauggaauuugggcucacauaauccagguucccauccugucuuuaccacccaccugggcaggauauuuaauccuucagcgguuacauuuccuuaucugugagauggggacaguaauaccucccuuguaugacugugaugggaauuaaagaggcaacauuaaguaaagcucccagcacaaggccuggacuuuaguagguauuuaauacauuuuagacuucuuucucuccucuuucaaaauuugagcugaaaacaauaucuuuuagugc

SEQ ID NO: 13610 - RNA, 79096 nt, Homo sapiens
acagcaucaaucuucucagaaguuuccaaggacuccagauaugcagggaacuggacaccaagcucacgugaggaaggaaucaaagugaaugaaacauugaucuugaaguuaguaaaaugcaguaagugaggaaaauaucuguguucuugugaaagaguugauuucucaacuuugggguucuguauaaaaaugacuaauauucaucaagcauuggcuuucuacuuagaacagaguguuuauaugaauuaacuuauguaaucaucacaucagucuuaugaugcaggcacuguucuuacugcacccaccuuuuuucuuauauagacagagagguaaguaaccucccagagucacagaauguuagagugacuuugaccgcguuuauguagucucaugccugagcucacacucuugugccucccagggacuuuagcaaucaccuaacucugauuugcuucccuccccuccuuaccccagcuuucucccucacucccuauucuaaacaauuaagagugaacucaagagcauccaaggaccuguguaguugccuugaaauaccccaaauauuugugugucuuaggaaugacaaaucccugguaaucauuacaauaaugaugugguauuauuaugaaguauuucauuaguacuuauucaaugguguuucuaacauuguaugguuaaguaucaccucaagagugaagaauaauaauugaugauaaugaucacgggaagcugauauuuuaacuuuugguucaaaaagccuuuacuuuggagaaccagagaccaaugaugaaaugugauguuccaauuacagggcugaaaccacagguaucugaaaugcaguggaaaaaaacaaugagaaugugagggcccuagguaacaugaagcgauuggucucgcuguugggcauaaugaacuccuaccugcacucagugccacaugaugcagaguuuauggugccucugagacuguucguaaagagaggcguugugugggacugauaacagcucugcucaaggacagcaaugaugucugccacauccuuggaguugggaauuaccuggccucguuaccuccuccccacuccuccccaccccaggaaucuggaugcucaaggcuugacuauuuccuccauucuccccucacucaagccccguguucagaagcaaucagauaaacucauucauucugaaaaguuuaaugugugacucuuccaaggacaguuuguuuuaacagaaaaucaaguuucagaacaaauguccaacaggucccaaauuuaacucacuauacucaagagugugaaaaucaaaaaaguaaauuuuuguuucccaugaaagaucuaaucuuaacucucuggccuucccacacugggugcuaugaagaaaaacuccuaaaauugcuauuuaaagccaucucagucuuuucuaucuuaagauagucuuaauuggagcaaucaucuaaucacuuacaauuuaccucuuuuaguuuucuguuguugcaaaaaaaaaacaaaaacaaaaacaaaaaagcacacauacuuaguggcuugaaacaacaugaauuuauuaucuuauccuucuauaguucagaaguccaaaaugggucucuuuaggcuaaaaucagaugucagcagggcuaugucucuuucuggaggcucuaggggauaauccauuucugugcacuguccagauuccagaggccccucauauuccuugguuuaugguccuuuccugcaucuucaaaaccagcaacaguguguagaguucucacaucucuccucucugaacggacucuuccacauuuaaggacucuugugauuauacugagucuacccggacaauccagguuagucuccuuauuuuaaagucagcugauuagcaaucuuaacuccaucaauuaccuuuuuuuuuuuuuuuuuuuuuugagacagggucucuuuguaucacccaggcuggaguacagugguaccuggcuaauuuuuuguagagacaggguuucaccauguugcccaggcugauccuaaacuccugggcuuaagagauccucccacuucagccucccacagugggauuacaggcaagagucacugugcuuggcuuuccaucagcaauuuuaauugcccuuuaucccguaugguaauuuuucacagguuauagguauuaggauguggacauauuuggaggucaugacucugccuaccacaccagcuuuucuaacuucuuucuuccccuccugcugcuccuucucaaaauagugcauggguacaugaagguagaggagagagggccucagacucaacgguuguuuguucucuggauccuugcugguuucuacuacugcgaugggcuuauuucugguugggcuggaucccacugaugaaaucugugacagaugaauuuuuguuuauuauaauuacuuuacgcuacauaacuaaccaccucaaaacuuaguggguuaaacgaucauuuugacaaugaaaacaauuacaucucaugauuuuguggauugacugggcucugcugggcaaauuuucuguuccacaagauggaguggaugucacucauauggcuguauucagcugggagcuugccuggggcuagaacauccaagcuggaccccuccagggucuuuuuccucacauccucuuaccauucaggaguguaaccuguuucuucacaucacaguaacuggcuuccaagagaacaaaaguaaaaucugccaggcuauguccucaaaccaacauaacaucacuucugccacaaucuuuuggucaaaacaaggugcagugucagccagauucaaggggaaggaaaacagacuccuugucuucauacaucuagguagaagaggaaaugguagcagcuguauuugcgggcaaacugccagauaaccuguuucaaucuuagcuuggucaggccugaggcacugacuuugugacaccugagugucagucacuucccuagccuagguggcgugcccugcagcccuaugcccaagucucuuuccuucucucauggcaaacucaggccagccucauuaucuacguucugcagccccagaacuggcaggaacuccugggcacuuuggguguucaggcugcugaaggaagcuuaggaaugccaacuuagucuucuccaguuggagacugugcugugccaccauuuuuauucugcucaugaggcuucuugguccaguggagccaccaagcgugguggucuccuccagcaguuacagugggagauacagcuugccugcuaaugagcuacaggaaucauggauuuccugguuagaagaguggaguauaaacucucuccgcuuuuggauuucuccucaacccaucucauugcucuuuccuccaggauuuugucccagaaggucagaucagaacauccaugcuaacugcuuaauuuucauaguuuuccgagacaaaaggaccuuuuuccccugccccuuucuaccugauagaggcuuuucucagguuauaacuccuuuuuaaaagguagcauuugucugguccauuaagcugcuggggaugauaaugggagacgagggggauuacaaauaaaauaguuuaauguuuucaaaauauaccauccucauaaagaaacaaaucucuaauuaggacauuuaaauaucagucguucaggcugguggacugaaggcucugucucgggucucacugcacuagggcugcagcagccacuucucuuugaagauggcuauugccaguuaagaccuuccaggaagccaaggcaugaaaggaagcacagagcccugccaugugccccaccuucauguucugcucaccaccaagcacacccaugcccacccgcacacucuggaagucccuaucaccugggccuuccagaaaccagucaccucuccugcucaugguuccugggucuucccucccuuucagacaacagaggucccagcucuauucaugcuguccaauaagcugggaucaagcauauguugucaggaccugaaaguagagauacaacuuaccugugaguuacauaagggauacuuucccaaugauucuaccccuuuaccuuuguuagagugguugaaaaacacgugauuuuagauuugcaguguauucaacuaugguuauacccauuguacagugauauguauuucucaugacaauccugcuucauuuggaaauaauaagucaaaaugacugaugugaaauaucauuugccacagcacauuugucauucuagggaguucuagacuuuaugacauuaaacacuaagaaaaaucugggugcaguggcucacgccuguaaucccagcacuuuggaaggcugagguggaugaaucaccugagguaaggaguuugagaccagccuggccaacacagugaaacccugucucuacuaaaaauacaaaaauuaaccaggcguggucgugggcaccuguaaucacagcuacucgagaggcugaggcaggagaaucucuugaacucggaagacggagguugcagugagccgagaucgugccauugcacuccagccugggugacaagagugaaacuccacuucaaaaaaaaaaaaaaaaaaaaaagagcuggaaagaaaagaaaagaaaacacuaaaaaaaaaaaaaaaaagaagaagaagaauaagacaaguccacagagcuuagaccuagaaaauacacugauguuauaaaauuucuggacuguuagaacugacccuacaugcuuuauacaaaacuuauacagccuuacuuccaacaagaugguuuugaguuagaaggcucaagaaucauauuuuaugacacuucaguucuccuggggccugcagacaaguuggggauaccuagauguguagugcaugcaguuuucacacccaggugggauaagaggaccagaagcuaguaauaacuggauccacaucaaacucagaauggaaaccuaggagagagccagaacccaaggugagaguccagagaauuuuguccaccagcacauaucugcuuugaauucuacuuagccaagaagaggcaacauaacacucuggcaagaauucuggaccaggagucagaguaccuggguuuguuccaagccuugguucugacacugacuacucaugugaguaugggugacucgauaucuuccaagcaucauucuccuugggagaaugagggagguuggacugcggguacuucaugguuaaaguccuccucuaauaauaugcccacaauaacuauacacuagugagaaggaauagaagagaugaggucauacuaaauccuguucacacuaguugagaucucugagguguugagaucucugaggugccaaaugagaaauagucacaagaguccauugagauccaaauaucugcuuucuugcugaaaaaugcugaaagggagaauaggucuauggcugaaaucaaggccuuucuccuuugccugaagucgauuucuugagacccauagaaagagccacauuggaucugccaagcacacacucaggcagcugaauggagguagauauucugcuucucacugugugacccaccagaccauaugggauaccacauggaagcuggagcuaaggggcagcuuggcuuguaggcaggcagcccuaaagagaaagcccagaggagcugagcuauuucaguacuuuucuauaucaccaaucagauuagucucuccuuaucuuguggugucuuagccugcucaggcugcuauaacaaaauaccauuaaauuggguugcuuauaaacaacggaaauucauuucacacuguucuggaggcugggaaguccaagaucaaggcacuagcagacucgguguuugguaaaggcccguuugcuggucuacagauggugacuucuggcugagccaucacaugguggaaggggugaaaaaaagaagucccuugagccuauucuaauaagagcauuaaucucauucaugugggcuuugcccucaugaccuaaucaccuucccaaaggucccaucuccuaauaucauugccuuagggucaggacuuuaacaggguuuagaguuuuagacucguuuggaccauagcauuugggaaaaaaugaagaaggggauuauaagaaagggcauagguaaacuuuacaauaauucuggaaggcagaaauucucauuuuggaagccaaaacucuccaauguuggagguaagaaaaaaugguuuuccugacaagugcuucuuccauucuugaauucuagggauguguaaaggaacagaguacaugacaagcaggaagcaugggauagaaaauggaaguugggaaaugugcugucaauaccagccccaaacuaauuaaagagcaguuucuagauuucccagcccuccccacgcucauauacuuggugagaaguggaaaguucauaaaaauuauugaaaaaguuuuggcugggcaugguggcucaugccuguaaucccagcacuuuuagaggccgaggcgggcugaucacuugaggucagaaguucgagaccagccuggccaacauggcaagaccuggucucuacuaaagaugcaaaaauuagccaggcgugguggugugugccuguagucccagcuacucuggagucugaggcaggauaaucacuugaacccaggagguggagguugcagugagcugagauugcaccacugcacucuggcuugggcaacagagugagacuucgucucaaaaaauaaauaaauaaauaaaauaaaaauaaacaauuaauaauugggccgggugcgguggcuagcgccuguaaucccaguacuuugggaggccgcagcaggcagaucacgagaucgggagaucgagaccauccuggcuaacacagugaaaccccaucucuacuaaaaacacaaaaaaaauuagccuggcgucguggcggacaccuguagucccagcuacucgggaggcugaggcaggagaauggcuugaacccaggagguggagcuugcagugagaggagauccuacuacugcacuccaggcugggcgacugagcaggacucugucucaaaaaauaaauaaauaaauagauaaauaaauaaaugaauaaauauuauuggaaaaguuuuguuauacagggccuuaguuaaaagcaaccaauauccaaaggauaauaucccaaaugagacagauugugaagaagggagaaaaugaaaauggucaauauuuauuaguaucuucccuguguuaggaacuaaacugggugcuuuacauacaugaauuaacgcuugcaaugaguuaacccuugcagugacauuaacccuaauauaaugcuugcagugaguuccuuauagagauaaauacuaaagcucagagagguuaagaaaauuucaaagaucauguaguuaccaugagacagaaacaggccuagaacuuaagucuuacaccaaagucaguacuuuuuaaaaaauaauccauguugcaucuagaaauacuuuuauccaauguaaaaaucccauauaguacagggcugguauuuggagaguguuagacuauguuagauaacugauagaaacauuuugaaacuuaauaaaaucaccaagagaauauuauaguacacaggucugucacucaguucuaugacccuugaauuagagagcagggugcuggaugccuguaaccugggauacaacuaaacuagaccuguuggaugauguacuagacaaggugguaugaagggcugaagaaccacuaauugugcucuacacagaaaccaauaugcuagccuuucaugaauuaaaaauauuagaugugauaagcugggaugacaguacuuaugccauguggggaggacaaugguaagaauagaggaagauuaggaguucaagacguaggcuagcuaaagagggacccucuauggaggcugauauaaagccugaaauugcugaacaaagaggacaaaaggccaauccaguacuugcugaguugcugaguagaggggcaaaaugauuaaugauaauaucuggcccuaggcaaauguggacuaaaagcagaggaggucacugaaugcugacagauguuuaaaaaaaaaaaaacaccaugaagaagucacaucaacgucuauuuccuaauuugaacaaaguacuguucuacucuccauuugcugaacaaugcuucuuuucugucuuuggaaauaauuguuguguuguagucuuagcauacauuauaaugccaaaugaauaugccuaaauuaauaccucaccaaucuguaucgucagaaagcgaggagucacaaagcaucgaguuuuccagugaacugaagcuuagacaguauaagcaccaaacuuuuauaagcuuuagccauuuucauggaaaucguaauaaaaugaauuauauucuucucagccucauuaaacagcguauacugaacaucauuuaacguguucuugauggcucugaguccuugcugugaacgucagcuauacuauuagguagugguucaagaugcccucugggguuggugaaauagacagggcuucuguguguguccacugcaaucuuuccuggacccagaggugggaaugggcuucccugcugguaccaucugauagcuucuccucucagccccagguccacgugugugcugguuucuagucuuucugcuuuaaccaaaagcacuccuaauauauuaucuguagcuuuuauaugaaauaauagcugcuguggaaaccaaaucaccaaacuuuuuguuuguuuguuuguuuguuuguuuguuuugguaggacaggggcugacucugucacccagacuggacugcaguagugccaucauggcucacugcagucucaaacuccugggcucaaaaaauccuccugcaucacccucccgaguagcugggacuacaggcacacaccaucaugccccgcuuauuuuuguuguuguuguagagauggggucucauuauguuguccaggcuagucucaaacuccuggccucagcaauccucccaccucagccucccaaugugcugggauugagccaccaugcccagcaccaaacauuaaaaaacugucaccauauucauauagaauucucuaucagcagguuauaauaugaacacagagaaaugacccugugcuugugccauaaauaaauuacauagacuuuuugacagggaacuccuugauguugaaacuuuuugacauugguacuuaucuacaaucacagcugcauucugaauacuuaaugauuuuuagggucugauuacaggguagauaggauauuauugguauuugcaauuuuuguuguccuuguuuucuaagaugaugucacccagcagucuuuuucuuuuuuuuuuuuuuuuuuuuuuugagacggagucucgcucugucacccaggcuggagugcaguggugcgaucucggcucacugcaaguucccgccucccagguucuggccauucuccugccucagccucccgaguagcugggacuacaggcgcccaccaccaugccuggcuaauuuuuuguacuuuuagucgagacgggguuucaccguguuagccaggauggucucaaucuccugaccuugugaugugccgccucggccucccaaaguguugggauuacaggcgugagccaccacgcccggccacccagcacucuugucucauaucauuacuucagaaguguguccagagaauaggcaccagagaaagaaaucucauuguaucacaucuuuuguuguguaacaaacuacccuaaaagguaguggcuuaugauaacaaacauuuauuguuuguuucucaccauucuguggcucgcuggacaauuuuccuaaucugaguagguucaacuagggcucaacucacucacaugucuggggucuuagcuggaagagcugagccuucuucccaugcuccccaggccaucucucuguagcagacaagccuaaauuuguucacaaaguggacaagagaaggugaacaccauuaugcaagcacuuuuuaagccucuacuacgucacguuuguuaaugucccagcagccaaagcaaagucaugugaccaaaucuaaguucaagggagaaauagacuccauaucuugaugggaggggcuacaaagucacagugcaaaggaacauaaacacacggaaggauuuugcacucauuuugcaaucuaccacauucauauucauaguacuuaugucauggcucagcaagggccccacaugggaacuccuggcuccaccacucauuugagacgcugaacuaaugcucuuuuuccuaccaccaucagaacucuugaaagaguuguuuuucucauccccuccacuuccuugcccuagauucauuucuuaauucuugcaagcugguuucggcagcaacuauucuaguaacuagguuaacuagcaacuucccaaucaucgauuacauuuucucagucuuuaucuaccuugaauguuuuguaguuguuaacacaaccuuuauggaaauucacuucuuacaguuucuauuauaaguaaauaagaaaauacaaguaauuuuauuccaguucauugacugauuuucuauuuucuuuucagggcucucuucuuccuuccacgauuaaguguagggcucuguccucacccuuuucuuucuuacgugaucuccauaaacucauucacuuuuacagcuucauuacaaacuucgagguaaaugaucucacaaucuguauccucaguuccuaaauuucuucucaaauuuuggcuucauuuuugaaauggcccacuaacuguuuccacccaaauguuuuauguauaguuccucugaaaucuauuuuggcuggaaacaaagauagugcuggucacuguauaaugcucuuucagccuggucauuugauucuacauuuuccuacagcuaaaagaggcuggggguggugaagggagguagugacggguuaauuaacauuugcugaaugccuacugugugcaagucacuguggucucucuuagcugacagaggacaccuucuauauuacuuugaaauaguacauaaaagggccaaucagaugcugauaugcaaucuacaaggauagcauugcagacagccacugauaucccagugacaauugcaauaacaccaaaggaaaugcggcuguagacaucucuguuuguuguaauaaauaagagguaucugacagccucaaaugacuuucaaagaguuucugcuaaagguaucuuaggguuugcaaaaaagaaacauucuucccuuaagaagagucugguuucuggggagaauagaucacaaaauaaaauugcaguucuccuuuucucuccccgguaaaagagcuuagagacuucuaggauccaaacuaggcuacugauaacauucugucuguucuaugaguagauucucucaaugaaagucaaauuucuguugaucauaagauggacauccuuacauuuauugccugugccaaauuccuugauugaacuauacugauagacuauagugauuauagugauuauacugacaguagcagagcuguauauauuuguagcgguaccucccaccauggugccacucuucugagggaacucugauaagcauuauuaaucaagucauuaaccuugauguggaucagauucugaaguuaauaagaaagaacacugaugaccugagaauauguucuaaaacuaugauuuccaggauaauuuauuaaaguguagcugugucuuucuuuaaaaauauaaaagugaccaggugcaguggcucaagccuguaaucccagcacuuugggaggccaaggugggcagaucacacggucaggaguuggagaccagccugacuaacauggugaaaccccaucucuacuaaaaauacaaaaauuagucaggugugguggugcgcaccuauaacacugagaggugacagcaugcuggcagcccucgcagcccucacucacucuccgcgccuccucugccugggcucccacuuuggcggcacuugaggagcccuucagcccacggcugcacugugggagccccuuucugggcuggccgaggccggagccggcucccucagcuugcagggagguguggagggagaggcgcaggcgggaacuggggcugcgcgcagugcuugugggccagcgugaguuccgggugggcaugggcuuggcgggccccacauucagagcugccagcccgccccgcugcccccgggcagugaggggcuuagcaccugggccagcagcugcugugcucaaccucuugccaggccuuagcugccuucccgcggggcagggcucgggaccugcagccugccaugccugagccucccccgccacagugggcuccugugcagccccagccucgcugacgagcgcugcccccugcuccauggcgcccagucccaucaaccacccgagggcugaggagugccggcgcauggcgcgggacuggcaggcagcuccacuucuggccucugugcgggauccacugggugaagccagcuggacuccugaguuugguggggacuuggagaaccuuuaugucuagcuaagguauuguaaauacaccaaucggcacucuguaucuagcucaacguuuguaaacacaccaaucagcacccugugucuagcucaggguuugugaauguaccaaucgacagucuguaucuagcuaauuuaguggggaccuggagaacuuuugugucuagcucagggauuauaaacacaucaaucagcacccugucaaaauggaccaaucagcucucuguaaaacagaccaaucggcucucuguaaaauggaccaaucagcagaauguggguggggccagauaagagaauaaaagcaggcugcgugagccagcaguggcaaccagcucggguucccucccacaguguggaagcuuuguucuuucgcccuuuauaacaaauuuuguugcugcucacuguuuggguccacacugccuuuaugagcuguaacacucacugcgaaggucugcagcuucacuccugaagccaucuagaccacgaacccaccaagaggaacgagcaacucuagacgcgcucccuuaagagcuguaacgcucacugcgaaggucugcagcuucagucuugaagcuagcgagaccacaaacccaccaggaggaagaaacuccgaacacauccgaacaucagaaggaacaaacgccggacacgcggccuuuaagaacuguuaacacucaccgugaggguccgcggcuucauucgugaagucagugagaccuaaaacccaccaauuccggacacaauaccagcuacucaggaggcugaggcaggauuauugcuugcaccggggaggcagagguugcagugagccaagaucgugugguugcacuccagacugagugacagagcgagacuccgucucaaaaaaaaaaaaaaaaaauauauauauauauauauauauguguaguauguauauauauauaaaauaaaacuauuccuuuuuucuguuuucuuuuuuuuuucgagacagagucucgcucugucacccaggcuggagugcaguggcgcgaucuugucucacugcaaccuccgccuccuggguucaugccagucuccugccucagccucccgaguagcugggacuacaggugcccgcuaucgugcccagcuaauuuuuuguuuauuuuuaguagagacgggguuucaccauguuagccaggauggucucgaucuccugaccuugugauaugccugccugggccucccaaagugcugggguuacaggcgugagccaccgcgccuggccuaucucuguuuuauuuucauaucaauaauggacauagaaguuucccaaucccaaaauggaacauggugugauagaaugcaggcuaguaagaaugaaugaaacaccacucuaagaagaagcaaccuacuacuagguuuccauauggcuuaaauuauauuaguuaaacucuuuuugucuuaaauggguuggauaagaauuugugaaugcuccugauucuuuuuuuuuuccuccuuuuugguuuguuuguauuacuauaaauauuucuuuucuuuucuuuucuuuuuuuuugagacggaguuuugcucuuguugcccacgcuggagugcaguagcgcaaucucggcucacugcaagcuccgccuccuagguucaagugauucuccagccucagccucccgaguagcugggauuacaggugucugucaccacgccuggcuaauuuuuuguauuuuuaguagagaccggguuucaccauguuggcgaggcuggucaccaacuccugaccucaggugauccacccgccucagccucccaaagugcugggauuacaagcgugagccaccgugcccggccaccauaaauauucuuguaaagcaauugugacuuuucucauugaccauguugucuggggauucauucuagaaaacugcuguuuaaauauuguguauuggguaugaauuauccuguauuguucaugacucugacuacauugucuuucuuauuggcaaugacuguaagcaccauuguuagugaauuuggcuaacagcauuugaagcagaugagauuuuagcucacgccuugauagcugcauuggcucagucuaagcuaaagccuuauuuucauuaaagggagcagacaugcugaggaagaaggugcuauuuuuacauagggacuuuuucuacugaaaccacaugagaacacuaugcuguuaaaaugaucucaagcaugcugaguuagcugaagaaacaauaugcauguugccaaaaucaaagcaguacuauucugagccuccucucuaagguccucuagcucuccuugguggucaugaugaagggaguaggagaggagcuggugagaauguguaaauuacagguaagugaaggucacuuccaguuaccuagaagagauuauucaaauucuugguuauuugguuauugacaucaaccacugagauauaagaaguuuuauuaauuauauauuugcaugucacugacauuuguuaaguaauugcuuuuauucuauauauauauauuuaaaguaaaaccagcauaaaacaguauuaagacuaacuuuaaaaaugucagaaacaggccacgugcaguugcucacaccuguaaucccaguacucugggaggccaaguuagggggaucacgcccacccaggaauuucaagccagcaugggcaacagaacaagacuuugucuauuuuaaaaauaaaauauauuuuauaaaaacaaacaaaaaaccaaaaaaaguuagaaacagaaaauuuuggcagaagcccuccaacuccaguuaaaacaaacaaacaaacaaacaaacaaaaacuauuagucuuucucuuuuucuuucucuuuuagagacagagucucacucugucacccaggcuggaguacaguggugugaucguagcucacugcagccucgaacuccuggacucaaaugauccuccugccucagccuaggacuacaggcacacgccagcacauccggcuacguuuuuugauuauucguuuguuuguuuguuuguaggaacagggcccugcuauguugcccaggcuggucuugaacuccuagccucaagcaguccucccuccuuggccucccaagguguugggauuacaggcauaaaccaccaugcccauccuaaaugcuauuauuaucagaauuugucaugauugcagacugccaugauuaaauauuauuauuauuuaauaauaaauuuaauauaauaaauaaauauuaaauauaugacagguacuaucuuaagcauuuuacaaaauuauuucauuaguucucacaauaauauugcaaaacaguucuuaucuucauuuacagaaaacagugcuuccuuugugcuccugauaauaacugucaugcuauaaauuauacucagguagaaaguaaccgagaugggauucaagcauaaguacaaauauaugaguaucuaucuccaaagcccguguucuuucaccaggucaugcagcaucucugaggaugacacauacaguuaauaaggaaacugcacauauagauuccucuaacauagagcuuuucauucuucacucuccuccucccaauccaucuucaaaacaguauaaaugaaaacaaguuaaaacacaccaaaaacagaaaaauaaaagucuucucucuuggugaucuucaauugcuacggguaaaucaccauaaaauuuaguuucucuuguccucaaaaacuggaagauucucuccucacacagcagaauuugaaucaacuccuuguuuauuuuacucacagacagguuuacuuaacagaaaaaaguaguuggagaagcucuugaacagauagagauguuaauauauaggagcucacaucaccucuccucuucuaucuauaagauggaauuccuuuuguggccaaaguuacuucccagacuugagugcagauucauggauuugggcaaggagagcaccauagcugcuugauugggaaagccagagguuacagccacacagaagugaauggcucuggaauaugacaaaagacaggaggauguuaccaaaguuaguaugcccuggauuugaggaaaaauugggggaguuuggagaaagaggaaaugaaagauuuagggagcagcuggaacauauauaggaaauggagaguuauggaaagaaaauuuuaaaacauuuacugaguguuauuaauauuaccccaacuccugagucauuuuccuuaaaaaucuacaaaaagggucaggugcuguggcucacaccuguaaucccaacacuuuggaaggcugaggcaggcggaucaccugaggucgggaguucgagaccagccugaccaacauggagaaaccccaucucuacuaaaaauacaaaauuagcugcccauggugacacaugccuguaaucccagcuacucuggaggcugaggcaggagaaucacuugaacccgggagguggagguuguggugagcuaagaucaugccauugcacuccagccugggcaacaagagcaaaacuccgucucaaaaaaaaaaaaaaaaaauucuacagaaagguguuaacuaauguucagcaacuuuuggagacuggacuaguguuuuuuugcuaagauggagccacaagguggauggacuuuacauggguuguacucucaagaaugauagauuuugaaaauguuugcaaagacaucaguguuggggcucagaaaaugauaccccaaaguauggugcuuugauaugcugaguacuuugaaccaaagaaucagcuucacgccaggcgcgguggcucacgccuguaaucccagcacuuugggaggcccaggcgggcggaucacaaggucaggagaucaagaccauccuggcuaacauggugaaaccccgucucuacuaaaaauacaaaaaaaaauuagccaggcgugguggcaggugccuguaguucagcuacucaggaggcugaggcaggagaauggcgugaacccaggagguggagguuucagugagccgagaccgcacuacugcacuccagccugggcgacagagcaagacuccgucucaaaaaaaaaaaaagaaaaaaucagcuucagaaccaaggucucuuugaucuucccucaucucccugucucuccaucucuguaucuccugaaaugcagggagggaaguucuuccagaaggaacauaauuguguggaucccucucccugaaauccacauuaaccagagauuaaccagcaggaaaagaaacuaaaagucuccaaaccgagauggacuuuuuaccuauucuucugaagguugcuauccuagagacuuuaucugcaucacaaaacaaccguuuuucacagugugguucuuccccuuacccuuccauugcuugagucaccccuuacccuuccauugcuugagucaccaccucccuuccaaaagccccagccccuauuucuuucuguaguucaaaugcagauuuaaguuucaaccaggcugggugcaguggcucacgucuguaauuccagcacuuugggaggccgaggaggguggaucgccugaggucagguguucaagaccagccuggccaacauagugaaaccccaucucuacuaaaaauacaaaaauuagcugugugugguagccugcaccuguaaucccagcuacucaggaggcugaggcaggaguauugcuugaaccugggagaugaagguugcagugagcugagaucaugccacugcaccccagccugggugacagagcaagacuccaucucaagaagaaaaaaaguuucaaccaucuggcccuucuuugaguguuuuacucugugggacccccuuguauaugcauguauuaauuuguaugccuuuuuuccuguuaaucugucuacugucaaauuuauugcauagacucaaauuaucaaaugucagagggugaaaggaaaggucccuuuuccccuauauuggaaaaaaaaaaaaagaaaagugauagauauaauguuggagccuggagugagauuuagggaauucuggccuuuuagcaaagagggaagccccgcggcauuuggcaagcucugcaccugugcagaaaggaguggauuccccuaccagaugaguaaacacuugccccagcaaauccucgugacagugggcaugguggaaggugggggaaagccuucugcuuucuaggaggaccuucucucugggccuuccuuuguggcaagagaaagaaaauaacuguuaucaacauuucucuaggacauaccaaucugugauaaaaauaaagucaugauaacauugacaaaacaauauuucacuggcccauucuucaccacugugcagaaaacccacccccucucaaauucucauuugguuuagcuagaugucuuuauuuauuuaauuucuuuuauuuauuuuuuuugagacggaguaucgcugugucucucaggcuggaguguaguggugucaucucggcucacugcaaccucugccucccggauucaagugauucuucugccucagacucccaaguagcugggacuacaggcacuuuccacuaugcccagcuaauuuuuguauuuuuaguagagacgagguuucaccauguuggucaagcuggucuugaauuccugaccuugugauccacccgccucagccucccaaagugcugggauuacaggggugagccaccauaccaggccuagaugucuuuaaaguguuguuuucucaggcugggugugguggcucacgccuguaaucccagcacuuugggaagccgaggcguguggaucacuugaggucaggaguucgagaccagccuacccaacauggugaaacccugucucuacuaaaaauacaaaaauuagcuggguguggugcugggugacuguaaucccagcuacuugggaggcugagguaggagaauugcuugaaccugggaggugaaggcugcagugagccgagauugcaccuuugcacuccagccuggagcgaaacucugucucgaaaagauaaaauaaauaaauaaaugaauaaauaaaguauuguuuucucuaaggucuuguagaaucccuuuuagccuccacugccaccaccauucuacuacuguccaacucugggucccuguggugggguuuauugcuaaagucaucuaauguguaaaugguuuuaugaaaacugaucuucuuuacacacucaugcuuaacagguauuuaaaacagauuucuaaaucuaucuucauucauaguuaaucaaagaacauuuuugauugauuuuaauuucauaugaaguaacagauauaguuagggaaagucuuaaaaauaaggaugaguuuagcagagauuuauaaaaaaaugucauuucacaguaaaugccagaaauugcaauaaauucuaugucuuaguuucucugggauugauucuaauggcuuucaagcaucuccacagucacauauuucccacuaaaagaucuccagaaaauuuggccaggcacgguggcuaaugccuauaaucccagcacucugggaggcaaaggugggcagaucaugaggucaaaagaucaagaccauccuggcuaacauggugaaaccccaucucuacuaaaaauacaaaaauuagcugggcaugguggcacaugccuguagucccagcuacuugggaggcugagguaggagaauugcuugaaccugggaggcggagguugcagugagccgagaucgugccauugcacuccacccugggcaacagagcgagacuuugucucaaaauaaaacaaaacaaaacagaaaauucaucauagauuuauuucauauuuggugaaaaaaaauuuuuuuuuuuugagacagggucuugcuccaucucccaggcuaacgugcaguggcgugaucucagcucacugcaaccacuacaaccuccccuuggcucaagcaauccucuugccucaaccuccuaaguagcugggacuacaugcgaacaccaccaugccugcuuaauuuuuguauuuuuuuguagauacgacguuucacaauguuguccaggcuggucuugaacuccugggcucaagugauccacccgccucagccucccaaagugcuaggauuacaggcaugagccaccaugccuggcgugaaaaauuuuaaaguuuuucuucuuggcaaauauucaagaaaauggcugaauuaucacaaauauuggcauccucugauccacugcuuagagugagcauccagaucuuggugaaaaugacggggcuuccagcauuccccuuuucauuucucuggcaacagaaaaacaacauuuuuggucauuuugaaaguuuauaucuaccuaauaguuugaacuuucaucuguugguuauagucuaauaauauguaaaaauuuucuaguaacuaaugaguaaauuuuaauaaaaccacaauuucaguaaaagguauuuagcuaacugcuaaauugugucacugacaucauauuuuauuuucucgauuuauuuuuuauuuuuuuuuaauuaauuaauuuuuuuuuugagauagaguuuugcucuuguugcccaggcuggagugcaaugucacgaucuuggcucacugcagccucuaccacuggguucaagugauucuccugccucagccuccugaguagcugagauuacaaacauguggcaacacgcccggcuaauuuuguauuuuuuuuuuuuuuaguagagucgggguuucuccauguuggucaggcuggucucgaacuccggaccucaggugauccgccugccuuggccucucagagugcugggauuauagguguauaauaguuuuaaaacuaaaaaacuauuuuuaguuuuaaagcaaugaacaauugaaaaagaauaaauuuuuaaaguauucaaauucaguaaaauauuucacauauaaaccaaaauuugcaguuaacaaaaauacugcacaaauaaaaacaaagugguugcaucaaauggcagaauugaaguaacuuaaguccuauuucuuuaucuuuaaaauugcugugcuaucauuauuuauuacucaucacaauuuuaaaugcagaaauaugaaggaccacaggcaucagaggucuuacuauuaaaacagacuugugacacugagcccauguguguugaaggcuaacuggauaaaugggaguucuucaaauucauuucuaguagaauacaacguuuaugaaaggaaauguaauaaaaaugugcuaauuugaagcuuauuuauauauuaaaacucaacagaaacugcagcaauuguuuagauuuuagaccaacaaaagauuuuuuucagggaggacacuuuuaucagugacacuguuuagaauugcagagaauggugauaaugaaaagcagaccaacucuucguuggcguuauuauaguuuuuaauuucucuugacaagguucccccuuauugcccaugcugggggguggacugcucccugguuggcccuugauaagccacugguaagcugcauccuucagcguguuugccugaaggauuucugcaacaaggaaaugggagauaauuuugaaauuaaaaguuauaauaaauauuuaaguguauguaaaaucauuuuuuuaaagguggaggcuaagagaguaauuuagugauaaaaaaucaaaagagaauauuauuuucuccauuuuuaacauuuuaauuaugagccaaauuuuugugaagucuuuaaauauguauuauaagcacccuguggaagacaaaugcucccuuugagugucuaagcagcauucuccaguguaaaauugaauggguugguguagaauuaucuuuaaggcccuuucagaucuaacaaucugugauaucuauuauguuucuugugaaugaaagaacaaacugucuccccgcccuugcaccccacaguuuuccucucuuucccgaccucagggguuugccuggagaggagauuaaacccucacaucuuucuguaucccuguaaucucugcaauggaaagaugcaggggccuggacaaaguagcaaaggaaacagaaaacaaacuuuaaauacuaauguauuuuccgggucuuugugagccuaagggaguccauggagaggaggauggcucuggaauggaccccauuucuuaugcaguggaagaucucagggacggucugaggacaaagggaacugacaucguucugcauaaaaaugacaauugagagcuaucuccuuugugagaagaagcagcucugaaacgauuuugcacauggaaaaacaaauuuugacucuacuauuucugaaaauuaguuuuuguccuuggaaaauguguguguguaugugugugugcgugcaucuguuauugugcuaugcgaaagacacacacuggaggauacccugaagggaugugaaagugugucuucaccucacacuggcaaggaaaacuugaggugguucaaacucaggguggcaaagccuaccugcagcucuccgacugcaggugucaugaugcugcucuugacauaguaacuuacacuuuagaaaauguccugcgggagauugcuggguccuacugauugugcggaugccaggaagacagaggugacucccagguuaagaugagaaccuaguguaguuuucuuuucuuucucuuccucuuuuuuaaucuuccuucuccuaauuuuaaaaaauuaugacauacacaaaacaaaacagaauagaucaaugaaccucugaguucucaucaccacuucacaaacuuuggacaaacuuacauccccccaccaacccauccccugcccccacauaauuuuaaggaaaauucuaggcaucauaugauuucauuuuugacuaaaaaaugacuuuuacaugaccacaacauucuuaccucaccuaaaaaaaauuaauaguaauuccucaacaccauuguaggagacaagauaugccacuccaaaauaugucuuuuugucauaaggauuauuuugagaaauagcaggcacaagugaaacucuaaaaagaaaguagaaauuaccauuuucuuaggaaaaauuuacauuuauaaagcaaaucuccauuuguaagggugucuccucgguaucaggaagaggaggaugacaaaauuacagaaaaacucuugucaaugggaaagucacugacuuaaaucuucguaauaaaccuuacccuuguuuuucaugcuuuucucaguuaccuccccauaacuggucccaagagacuucuuucuuuguucagcagaggauaauagcuaagucugaauucagagacacuuaaauuuuuuuuggagagacaggaagguauacauauugcuaaacugauguuuguuuuuccuuuguuaaucucuuuuguuacaggggugcauuccaauuaagaacucagaaggguagaaaguuacuuuuccuccucuacaucaucaaguaucuugucaaugauugcauuuucaauuagcuuauaacugucuuuuuuucuuagacaggaucucacucuguugccagauuggggugcauuugcgccaucucagcucccuccagccucaaacucaugggcuuaaaugauccuccugccucagccucccagcaguugggacuacaggcaugcaccaccaugcccggcuaauuuuuaaauuuuuauuuuguagagacaggggucuuccuacuuugaugaggcuaguuuugaacuccuagccucgaacuauccuucugccuuggccucccaaaaugcugggauuacagagagggggcuacugugccuggccucuuuuuuuuuuuuuuuuuuuuuuuuuuuaacacauuuuguuguuguuugaaucaggauccaaauaagggucguacaaugugagugacugaucuuucuuaugucucuuuuaauuuauagguucccuuuccgucucuucucccccauuguggugaguuuucuuaaaggaggcuugcacugaggaaguauacauaaaaacagcacuaucuaauaauuauaaauguaguaauaacuacuugauacaacauaaacuuuuuaaucagcgcuaauaugaaguaauuuacacauguuaacucuuucauccucacaacaacucugugaguuagauucuauuguuucccaauuuugaaguugaggaacuggggauguuacugauggcaaauccuuaugggucuacagcaaccucaguucuugccuccucugaagaaagaauucaacugaggggcauaggccagaagaagagaccaaggcaaguuuuagagugggagugcaaguucauuaaaaagcuuuaggcugggcacggugguucaccuguaaucccagcacuuugagaggccaagguggguggaucaccugaggucgggaguuugagaccagccugaccaacauggagaaaccucgucucuacuaaaaauacaaaaauuagcugggcguguuggcuugaacccgggaggcagagguugcagugagcugagaucaugccaucgcacuccagccugggcaacaagagcaaaacuucgucuaagagaaaaaaaaaagcuuuagagcaggaguggaaagaaaggaaaguacccuuggaagagggucaaacaggcgaccugagaaaucaaguucaugguuugaccuuuugacuugggguuuuauacguuggcauacuucgagaucuuguguuucucuccccugauucuucccuuggggugggcuguccgcaugugcaguggcuugcuaguacuuaggaggggagcaugcacaguguguuuacuggaguuguaugcaugcucaccugaggcuuucuucccuuaccagccaaaugucccuaggaggucauauaccaguuaaacucuaccauuuugccucuuaguguacauaggugagcccacucacccaauuccugagaucuuauugucacagucuuguuguucaagguauccccgaaguucuuugucccacaaccaagaaaguuaaggaguguggacacgaagggugagguuagagcgagaguuuaaugagugaaagaagaaaacucuaccacggagagggagcccaaaagaggaauuccauuucacagcugaacacaaagucuuuuauaagaaaccaaagagggcugggcaucucauuugcauaagacaugaauuucugguagcuccaccccauccuccuagugggcaugugggcccuuaacuugaguuacuccauauugcuuuguuccccuuacugugcaugugucaggggauggaauuuuccauugaaagcaugucugggcaagucuccuguguagccuuucuuaucuacguggcuguggacaugucuuaggcaagcuccccugugcaaguucccuuaucugugcccacagcuugauuuuucaugcuguucuuuuguuugaaagaauuuugcugaggacucacccuaacugccugccugaccaguuucuuccuuccuccucucucauuaucgggaagcuauugaucaccaguuucagguuuuuccuaacuauugggagacugccuuucccuggcaccggcugugaccaauuacucacugcaagcuccaucuccuggguuccagcaauucugccucagccucccgaguagcugggauuacaggugcccaccaccacaccuggcugauuuuuguauuuuuaguagagaugagguuucaccauauuggccuggcuggucuugaacuccugaccucaaagaguuacacauauuaacucuuucauccucacaacagaucugugaguuagauucuacuguuucccaauuuugaaguugaggaacugggguuguuacugaccucaagugauccauccaccuuggccucccaaagugcagggauuacaggccaccgugcccagccacaauuauuauuuuagagagacaguuaacaacugccuggccaucaccugaugguugccugacauuccugguuggggguuguggggcccucucauacccuguucaugccugccuagcuaccuacuguaacaggugcacagagaaguucaguaacuugccauaugacacauaguuucuaaguggugugucaugauuugaauccagcucuuagucacacacugcuucuuaacagcuaauguuuaucuagcacuuacuagugccaggcacuauucuguguuuuauuugaguuaacucacuuaaacuucacgacauuccugugaagucaauaggaucaugguccccauuuuguagauggaagagucaauacacagaauugaagccuccucucuacccccugagauuacaguacaacuaacaaauaguggagccgagauuuaaaauccacaugguuuccugccacaaccugggcucuuaacguacuuugcuuucuuugagaguagcacauucucaaagagcuggaaaacuagguuaggaucuggagaaugucugaagagacucaauaugaaguuuaauuuuggagcuuuuccuaggauuauggggacagucaucuuuagcaaacagcuuacaaacuuucccuccuacauugcaguuuuuuucaguugagucugaccaacauggucuggagccuggacuccuuagugaguccccacugagacugaagagaaguuaguaacaccauguggacagaacuauauagauuuugggucaguuaggauguacuggacaggugugguggcucaugccugaaaucccagcacuuuaggaggccaaggcaggaggaucccuugagccuaagaguuggagaccagccugugcaacacagggaaacaccgucucuuuaaaaauaaaauaaaauaaaauaaaaaugccgggcgcaguggcucacgccuguaauugcagcacuuugggaggcugagguggguggaucaccugagguugggaguuugagaccagccugaccaacauggagaaaccccauuucuacuaaaaauaccaaaaauuagccaggcgugguggcgcaugccuauaaucccagcuacuagggaaggcugaggcaggagaaucgcucaaaccugggaggcagagguugcggugagcugaaaucgcaccauugcgcuccagccugggcaacaagagugaaacuccgucucaaaaaaaaaagaaaaggaaaaaaagaaaaaaaagaauguaauaagaagggucuguggaaacacagcuccaagacucgggagacucaucuuugucccaaaacuacagaaggaggcccuuacagggaaauggcagaggcugacauuuauauuacacuuuuugugcccucuuaguucaccuuuggaccucauuucuugcuucugcaguguacaagaggaaaaauaauuuuuucacuacccucuaagguuauuaacuaggacucccuguaacaaaagacagauuaacaaaagaaaaacaaacaaaguuuaauaacauguaugccuccuauauauaugggagauacugagggaacucucaaagaucaaaucuccaagaauaaaucucuagaguagaucucaaaggagcaguugaaacuuuaggcuuaaauauuaacauuuauugaaacaaagaaaggauguagggaaaaggccgguuaugguuagggugagauggucaggaaaaguaugauaaacaaggguaagguauguuaagcagauuuaagucagugccuucuccaucuaggagagccucuaaugauuuagucauccuucuccuccugauauagauugggagacacccuuaugaauggagauuuccuuuguaaauauaaauuugucuuacaaaaggguaacuucuacucuuguuuugagagcuucuccuaugucugugguuucucaaaauaaccagcugaaaauaauccuugugccaaaaaggcauauuuagggguggcauauucuggucuccuacaguuauauauugaauuggcaugcucugaaccccuucagcagacauuucaccauucagagccaaacuuuggaaaccaugcugucauucugaaccuuauucucuucuuaaguccguacuaaacaugaguucaagacauuuagaaaugacuuaacucucuucagcccuggaaaaccaguuagugcucagcugcaaggcugucuacgagagauaacacugcuucaaacaagaccaacucaaaacaucucuuuuucuuggugugaaagggaggaacugucaagucuauaauuuuauugcuaucccaucauugcauuuuacauucuuucauuguuuuucuucauuugucucuugcaguuugaguacuuguaaggauuuuuaugggcaagcaauggcuagacucauguccuuagaaacucugcauagucagccguagucuaggcaaaccucagucaugguuuuacauuacagcagauuagcugagagggagaucugccuacuuuggaggcuuguuugaguccuggaacuuggucuccuuuuacagauguuagaaaagucuggagccucccaggccaaaaaaaaaucauuaauguuuuuggaaggaauuaauauauauuuacuugagcuuggaauuguuaauagauaauuauuucaagggcccagcaagguggaucacuuugggaggcuaaggcgggugaacugcuugagcccaggaguuugagaacauccugggcaacauggcaaaaccccaccucuacuaaacauacaaaaaauuagcugggcaugguggugcaugccuguaguuccagcuacuaaggaugcugaggcggggggauugcuugacccugggaggucaaggcugcagugagccaugagagugucacugcacuccagccugggcaacagagagagacucuggcucaaaaaaaaaaaaaaaaaaaaaaaaaaagaaaagaaaagaaaagagaaaaaaaaaauaauuauuauuuuuaaauuaaaaucaugacuguccuacaaauauaaaauguacaagugccaaagauuuuauguaacuccuuuauuaaugagaaaaccaguaagaugucacaaguuuaaagaaaaaauuggaagaacagacacacacguauauaggcaaucacaaaggaugaaauaaaauugcuaauagcugcaaaacuuguuaauaggccaauaaaauguaauggcuggaaucaucuuuucuacaagggaaaaaucaaauggaucucuauuggacaaaauucauuugcaucucuauggauaaggaucauuugcaucacuauccguuuucuacaacuuacggaguuguaaaguagccuagucaaaggcagugaaaggcacagaccuuuauaaaaucagaaaagccccaagggucuucuagacaaggccuaucuuuucacugaaaggauauucaguaaucuuuugaccauuccaaagucuuucacaaucuuucugagagauuuguucuuauuuuucaaauacagcagccaggcaggacgauuuuguuaacagauuccuuaaaacaguaaugauguuuacagaagaucuccauuaagugguuaccacuuuccuacccuaucuccuuuuuuuuuccccuaauaugucuguuuguuucaaauuaucaucacggaagauuugguacuggaguaaugcagaaaauauuaauauuacauccaacaaagcuugacucaagaagagcuaauaaauuguugccauaucccuguuaacaggugguuuacuccuaauacuuucaaaccacuuacuaaaaguugacuaacuacucugccccacuuguugccugcaaaguagucucaaaaccaagcaaaccagggguuucucagcauacuuuauuuuuauuaaauaacauugacauuugcuauauccaacuguaaaauaaagacauuagccaauagauaguucauacgucuggaaaacucacuuucuuucucccuauuuuaaugacaaagaacauaauugggauaugaaacuuaaccccugaaguuuuacauguuaacccugauaucucuucccagacuccaggcucuagucacaacauguuuuuuccaugucuggcuccugacaugcuuggggcaguguuccaucuuccuggcucaaaacuucaacugugccagccaauaccuguuccuucccauucaucuggaucuucuuuuucauauuaagggaggagaccaccccucauauugucuuaugcccaauuucugccuccaaagaaagaaaaaguaaaaacuaaaaggaggaaaugaaauccacaagcagacagcccagcgccacacccugggccugguaguuaaagaucgaccccugaccuaaucgguuauguuaucuauagauuacggacauuguguagaaaagcacugugaaaaucccuauccuguuuuauuccgaucuaauuaccggugcaugcagcccccagucacguacccccugcuugcucaauugaucacaacccucucacgcgcacccccuuagaguugugagcccuuaaaagggacaggaauugcucauucggggagcucagcucuugagacaggagucuugcugaugccccuggccgaauaaaccccuuccuucuuuaacucggugucugaggaguuuugucuguggcuuguccugcugcaauaucaggagccagaaaauuucaggaucacaguguuagagccuccaggaauuucccuuggcuuaggggcaagggaucaugaccaccagcagucaaauauuaaaauccaugcccaguaggaaagauuauccaaacaaaacugagcaugagauauugaaauuucaaauagcagcauaggagcagacuaaugcaaagaauucucaaauuaaauuaugacaagacaccaucucucacacaaaaguggaaaauacuaaaauaaaauaaaaauacccaaugccaauuagggugugauuggguauauugguaaagcuguuuggcaaacguaauggcucuauaaucaagagccuuagaauuuuauacccccuugauccaacaaguccucuucugaggaauaauucagaauacaguaagccaaugaugagcuaucugaaaagaaaaccaagaaaaaaugcaauuuauaauagcaucacaaagaauaaaaugggaaaaacuuaaucaaggaggggaaggaucuguacacugaaaaccauaaaauacugaugaaacaaagaagaaacgaauguaaagauaucccauguuugugcauuauaagaacuaauauuguuuuguuguuguuguuguuguuguuuugagacggaguuuugcccuuguuguccaggcuggagugcaacagcgcgaucucggcucaccgcaaccuccgccucccggguucaagcgauucuccugccucagccuccugaguagcugggauuacaggcaugggccaccaccccggcuaauuuuuauguuuucuuaguagagacagggguuucuccauguuggucaggcugaucuugcacucccaaccucaggugauccaccugccucagccuccggaagugcugggauuacaggcgugagccaccgcgcccggcauauuguuaaaaugucugcacuaccugagaaauaaaaaugaauccuaagcucuucaaccaacugaacugcccccucuuggucaaagggauuucagagaggccgggcaugguggcucaugccuguaaucccaggacuuugggaggcugaggcgggcggaucacaaggucgggagaucgagaccauccuggccaacauggggaaacccugucucuacuaaaaaaauacaaaaauuagccgggcguggugguaggagccugcaaucccagcuacuggggaggguuaggcaggagaaucacuuguacccaggaggcauagguugcagagagccgagauugcgccacugcacuccaguguggugacagagcaagacuccgucucaaaaauaaaucaauaaaaaggugacuugagagaaaccauggaaacuuaguuuccagucagcuauaccuccuuauacccucuuucucacuaaccacaauauaggcuuucuucccuaagggcuaaugagaaauuagccaguucaaaggacucccugcaccacugguuucaaccaaccaccugaugcugucccucccuuuuguguuuucaacacaacaaauaaccaguauuccuuccugguaagaggccaccagccauggaguuguucuggccagucuacggaggaugugcagugaaaguuuucguguccucugcuucaucuuuugccaucaaaggcccaaaaacuacucucagaucaggcuaacaaaaccauuuuuugaacaugggacccacaaaggugcauaaaauucaauugugcaugcacauguuucuccuuucauaaauauucauaacucuuccuauagcuuauuaaauguguauauuuggcuaugccauucagcauaaauuccugucuuauucuucuaauucuugaagugcuagcuucugauuucuggcuggaggcuacacuucccagccugucggaaugggccacccuacaggcugcaauucuuuauguaagauaaagcucuccuuuccaaauuucugaaccucaugauucuuuaguugacauacccaaagugaucuauaguuucaauguaauagcuauugaaauuccaaugacauuuuucauaaaaguagaaaaaagucauucuaaaauacuuaauggaucaaaaaaagacccugaauagccaaagcaaucuuaagaaagaagaacaaaaagaagcaucacucuuuuugauuucaaauuauauuacaaagccuuaguaaucaaaauggcacgguacuggcauaaaaaugacacauagaccaguggaaccagaauagagagcccagaaauaaacccaaacauauaccaucaauugcuuuuugacaaagaugacaagaacacacaauggagaaagcacagucucuucaauaaagagugcugaggaaauuggauauacauaugcaaaagaaugaaauuggccguuuucuuacaccauacacaaaaaucaacccaaaaugaauuacaaaugaaaauguaagaccaaaagcuauaaaauuccuagaagaaaacauggagggaagcuccucgacauugaucuuggcaaugauuucauggauaugacaugaaaagcacaggcaacaaaagcaaaaauaaacaauuuggacuauaucaaacuaaaaagcaucugcauagcaaaggaaacagucaacaagaugaaaaggcaaccuguggauugguagaaaauauuugcaaaucauauagcugauaaaggccuaauauccaaaauauauaaggcacuuacauaacucaauagcaaaaacaaacaaauccaaaacaccaaaugaccugauuaaaaaaugggcaaaggccuugaguagacauuuuuccaaagaagacacauaaauagucaacaaguauaugaaaagguauucaacaucacuaguuaucagggaaaugcauaucaaaacugcaaugagguaggauggcuauuauuaaaaauacaagagauaacaaguguuggugaagacacggagaaaaggaaaugcuuauauauaguuggugggaaugcaaaauugguauacccauuauggaaaauaguauggaagugccucaaaaaauuaaaaauacaacuaucauaugauccagaaaucccucuucuggauauauaccuaaagggguugagucaguaccuuaaaaauauaucugugcucccauguucacugcagcauuauucacaaaaaccaagauguggaaacaaccaaagaguguccauugacagauaaaugaauaaggaaauugugauauauguauauauauacacaauagaauguuauucagccuuaagaaagaaggagcuccugucauuugcaacauggacauuaugcuaagugaaauaugacauacacacaaaaaaauacugcaugaucucauuuauauauggaaucuaaaaaaaugaauacauagaaacaaagaguugaaugguguuuaccagggguggagggggaauggaacaugaaagaggaugcugguaaaaggguacaaaguuguaguuauguaggaugaauaaccuaaagaucuaacauacuggaugaugacuauaguugacaacacuguauuguauacugaaaauuuccuaagaguugauuucagguguuaucaccacaccaauacucaaugugagaaguaugauauguuaauuugcuuggcuauuguaugagucuguuuucacacuguuauaaggaaauaccugagacuggguaauuuauaaaggaaagagguuuaauggacucucaguuccacauggcuggggaggccucaggaaacuuacgaucauggcagaaggugaaggggaagcacguggcagaaggugaaggggaagcaagcaccuucuuuacaaggcaucaggagagagaaaacaaaggaggaacuuccaaacacaugaaacuuuuggaucugcugggcgcaguggcuuacgccuauaauuccagcacuuugggaggcugaggcgggcagaucaccugaggucaggaguucgagaucagucugaccaacaaggagaaaccccaucucuacuaaaaauacaaaauuagccaggcaugguggcacaugccuguagucccagcuacucaggaggcugaggcaggagaaucacuugaaccucggagguggagguuguggugagcugagaucgugccauugcacuccagccugggcaacaagagcaaaacuccgucucaaaaacaaaaacaaacaaacaaacaaacaaaaccaucagaucuugugagaacucacuaucaugagaacagcaugggggaaacugcccccaugauccaaucaccuccuuaccucgacauguggggauugcaauucgagaugagauuuggguggggauacaaagccaaaccauaucaacuauaguaaucauuucacuauguauauguguaccaaaacauuauuuuguauaccuuaaauauauacaauaaaaauaagccaaaauauagugaaaaguuuaugcauaaaaagguuuauuccaucauuacuuauaaaaauuaaaaacaaccugaauucaagaaaaagauugauaaggaaauaguaguuugagcauauuuugaaauaagauguguauuuaauaguaugaaaaccuuaaaaaacacaggaaauuuugugaagagauuuuuuaaaauaguuuuuuuuuuuuuuuucgagacagucucccucugucgcccaggcuggagugcagugggcgcaaucuuggcucacugcaagcuccgccucccagguucacgccauucuccugccucagccucccaaguagcugggacuacaggcgcccgccacuaugcccagcuaauuuuucguauuuuuaguagagacaggguuucaccaugauagcgaggauggucucgaucuccugaccucaugauccgcccaccuuggccucccaaagcgcugggauuacagacgugagccaccgcgccuggccuaaaauaguuuuuauuguagaaaaauuuugaacaggccgggcgugguggcucacacuuguaaucccagcacuuaggccgaggcagguggaucacuugaggucaggaguucgagaccagcuuggccaacauggugaaacuccaucucuacuaaaaauacaaaaauuagcugggaguggugacacuuggcuguaaucccagcugcuccagaggcugaggcaggagaauugcuugaacccgggagguggagauugaaagaucgugccauagcacuccagccugggcaauagagugggacuuuagagaaaagaaaagaaaaauuugaaugauacgaaaguagagaaauuagcaugaugaacccucauguacccaucagccugcuuaccauuugucaacacagaguaaauucauuucaucucccccauucacucuuccacccagauuauuuugaagccaaucccagauacuguaucauuuuauaugaaaauguuucagcauguaucacuaagagauaagaauuacuuuuuuuaaaaaaaggugauaucauuugccaccuaaaaaauuaauaacuuacccaucagaaaauaaggcaucaaauacauauauauguauauuauauauacauguauacacacacaaauacacauacauguauucaaacaaauaaucacaauuacauuucucucaucaguuucuuugguccuauauaauuaauaauuguucugcugagucuugggucagcaaucugauuucacaaaguuagcagcuuacagaccaaaacaacgaauccuggacauccugacuuaguucccugguacagucugaaaguugucuaagggauaucagcucagaagcucguauucaggaguccauucuuugaaguaucaauaguuaagaguacccaguacaguccuuucugugaggcucuaagacuuuuuuguugaagaucugaucuauggcuuguaacuuauagcagagccuucaggcaagcaugugagagaagcagaaaggaccuggaagacggcauggcugugguuccuuuauuacaguaacgagcaauaucagaauggaagggaacaaaguugucugacgcaugagugucuuguaaggguuugaucaauguuucccuugaggguaaggacauauuauggauaaagacauugcaaaaucauuaggaccuuucuguaaaguguaggcugucugagcuauuuauguuaauugcauuguaccuauaaaacuuaaccaagggaaggcggggcaucccuucugauuagacaacuuuucccaagcuacucuuacaauguguugagcucuuuaaaaaaauaucaagccacucaacaaaccuaauuauuucuaucacucgcuuuuuccuaaguugaaagagcacaucuuugugauuucccagagguucucugggaguugccaagguaaucaaguguaaaaacauccugagaauuccauuuuuucugaauuuaagguguaaucuuaagaagcccaaagccacagauuuaacaagacauuugguccacaauuaagauagugucacgagugccugagaaaaaagaguguaguuaucuauucauuaaagcaucaauauaauauuuuuaaauaagcauagaaguagguaaaacaauuuuaaugaaucucagcucuuucagaugugagaagacuuuguucuuuaaaacguaauaauggacaugauaaaaucaacacaaagcacagaaaauuauucuggugcaguauaaaucucuucuacccggauggauuauucaaaaggugauaauaacuguuuauuaccccuuguuaagcgcuauaagaccaguuuaucauuuuaauagagagaaagccaaauucuauuuuugcaucaaaucaauauuuggcaauaauggauuccaaguuucuuuuuuaaaaaauuaucuuuugaauaagcccaucaaagcugaggaaauguugccaaauguuaacauauuuuauugcuucuuuucagacaagcaagacaaauaugguuuacuuuuugcaaaccuucuacaauuuucuacaucuauccauuuacguuuugucuuucccuaucuuauuucauguucuagaacagacacuuugccuuuagaccaaaacuacucacuuuuuccuugagaaaugaaaaaaauuacuucacuuuagaaacauuguuguacuucuuuacacuacugcuugcccuacugccacuaaugcuccugguauagucuuaauuacccauauuaacuauaacuguaaaucaauaacuagccucuguuucacagagaaaagugggagaugaguaauugguaauugaguuuuaaauacaguaaaagcaaaacugaacacauucauuaauaugauccaaagguaugcucccuguaauauaguaaaauaagaaacaaagacguauauaucuuuuuaaacuaugcuuaguaauuaauguuuuuguauucuauuauagaaauuaucuaggcaugcaaagguuauccauuaauuaacuugauuuaauauuaguccaagauuuugaaguuaacuugagguuauuaaaaauuauguuugagcugacauacuauagaacaugauugauuccuaaaacauugccaauauuguaauucaauuugguuacacacauaauuuuacauuuuucauaauccaugguguuaaacuauuuuaucaauaaacuaguauauaaaguucagaaggcaaaccuaggucuucuaaaaaaugaaauguacaaauauauuuaacgcacccaaaucaaagaaaaauacauuaauuuuuuucuaaaucaaaauuauaaacuagucugauuuagcuaaagauuuauuacaugcuaucuuaugugucauccauguguuauacauauguauauauacauacauguauauguauccauauauuauguauauauggauacauaaauaacauguauccauauauacaugugguauauauaauauaugauauuacauauauaauuacauauuuacauuaucauauaaaauguuucuaaguuggcauuuucugaaagaauuuuuauuaaaaagcuagaguauuaaaauuuuaguuuauuuuuuaggaauucuggaaauauuggauuaauguaagcacuuauuacucccuauaagucuauuagagcagaguucuuuuaauuuaauagaccuuguaaucuaauuuauuaacacccuccagagguaagaaagcauuucacacauacaaugagagauaaaagcuuuucucaauuacagaguuggguggcuucagcucuauaaccucagcuacaguucaggaguaaacaaauaaacaaaacucaccauuccaguuuucaaaggacuguuuuucuuucuaguaggcacaaaauauuuucucaauuaauuugaguucacaaguagauaaacagacaaaaaagacugacaacgcagauuagcuauuaucucuuccuugauagaaaauaggucccauuguccaccucccagaggucaccaaaugaucuaaucauaaaaccaaauuauccuuaauaaucagcuaugugcauaucagaauuauguacacacaaggccaucucuuaaccauggaaucaagacuggccuaggagucuugggucuagcucuagaaggggacaugaccauggccacaaauugcacaaggguacucuuuagauuaugcaguugagacuggccuagugguuugagacaugacguggacucacugugccugcuaucaguugugaaaagagacauaugggagcagauauaccagcucuccaaaguaagucuuuuuuuuuuuuugcagacggagucucgcucuguagcccaggcuggagcgcaguggcgugaucucggcucacugcaaccuccgccucccggguucacgccauucuccugccucagccucucaaguagcugggacuacaggcgcccgccaccacgcccggcuaauuuuuuuuuuuuguauuuuuaguagagacgggguuucaccauguuaggcaggauggucucaaucucccgaccucgugauccgcccgccucggccuuccaaagugccaagauuacaggcgugagccacugcacccagccuccaaagucuuaaugcaagcuuauccaacccgcagcccacaggccacauuuagcccaggauggcuuugaauguggcccaacacaaauucauaaacuuucuuaaaacaugagauuuuuuugugauuuuuucuuuuuuuucuuuuuuuguagcucaucagcugucauuguauuaguguauuuuaugggugcccaagacauuucuuccaaugugacccagggacgucaaaagauugaacacuccuguauguauagcauuugccuguuucugugguguaaauucccccauaauagcuauuuucaagcuacugcagaauugggaagagaugcauguauuugguccucaccagccaguauuaucugacuuaggacacaaaugugcuugaccauaaaaagugagucaaaacacacacagacuagcagacuuggccaagaaacagaaauagaaauaaaaccacaaaauaugaaaaaagaaggaaaaccugaaaaaaugcagaguuagcuauuugggauucacucuagaagacaaguaaagaugugccuggguuuaauuagacccugagguccacuuuucagggugcgcaguuuaguggcaauagcaggugaguccacuugaguaucucaauggguccuccuaaaugguaccaguacucaguacuucacaugacagcuuguuauauuugugaacaauuuuccuaguuagaaagcuuuucuucacacucagccaaaaaucuauuuucuuauaacuucuaaccagagggcuuagucaugcucuuaggaaaugcacaaaauaagucuaauccuucuuuuauucaauaaacuuucaauauucaguacaauuaucuuaagauuuuagagcuaguucaacucauucauuuuacagauuaaaaaacugagacccagagaaguuaaugacuuuccucaguucauacagccuugugauuugucacauuuaaugaaaucagagauaacacuuuaaaacugccauaacacauaauuccuguugaaucuuuguuccuuaguuccauuaauauuucaucuaacuuuuuuuuuuuucuucuuuucuuagagucuugcucuguugcccaggcuggagugcaguggugugucuguugcccaggcuggaguacaguggugcgaucucggcucacugcaaucuccaccucccgggcucaagcaauucuccugccucagccucccaaguagcugggacuacaggggcaugccaccacgccuggcuaauuuuuuguauuuuaguagagaagggguuucaccauguugcccaggcuggucucgaacuccugagcucaggcaauccacccaccuuggccucccaaagugcugggauuacaggcgugagccacugugcccagccccaucuaacauguuuuuaagaccucccauuuaguugcccucuucuuguaggucucuguuuggauaacauaauguuaaaagugaaaugcucagaaccuaaucaaaugcaacagaugucaacugauuagugaaagguacaauguguguuccaaauucugaauuaacauguguucugaaugaauguucugaauucuuaauuuuauuagccauuuggaugaccaucucgcuuuuuaaacucacgucuuugucaaauacaauuuucaaguuaaaagcaugacuuucauaguaauacagaaugaacacaagucaaaacuuuauucaacucauuaauuaauaaaauaauuagacaauaaagcugguuuuuaaaaauguuugaggagcugggacucauauaguccaucaaaaaaggcacauugcaaaaagauuuuuuuaaguuagagaaaaaacugaauagucuauagggcauaaaguauacuuugagguuaucucuuccaccagagagaaauguuuugcauuucucuaucaggugaaaaccugcaaguuaacaugugccuucacaaugucuggacuuuaaucaauaguuaauaacaaaguaaaacaaagcacacucuucuacaaauuuuuuuuaaaaaucucgaagcaggccugcuacacaaugcuuucaaugaaauugaaagcauacaacucucuuuugcuuuaucuuaaaauaucauagaacauuucuuaacauccuuuuuauuuuuuauaaucaugauuaacauauauuuuauuauuuuuuauuuacuuacuuauuuauuuuuuuuuuauguuuugagacagaguuucgcucuuguugcccaggcuggagugcaguggcgcucucucggcucacggcaaacuccgccucccagguucaagcaauucuccugccucagccucccuagcagcugggauuacaggcaugugccaccacgcccagcuaauuuuguauuuuuaguagagacaggguuucuccauauuggucaggauggucucaaacuccugaccucaggugaccugccugccucggccucccaaagugcugggauuacaggcaugagccaccgcgcccagccuuaacauauauuuuaaauauuucaaaucacaucucuaagucaagaauguaaauuuggauggcauacagauccaggcaacaucagcugucauccuaaacaguauuuacagaaucaauauauuuuuuauuaccuuugaaauuuguaccuuuuuuuuuuuuuuuuuuuuuuuuuugagacagagccuugcucuguugcccaggcuggaguucagugaugggaucucggcucacuacaaccucugccucccggguucaagugauucuccugccucagccuccugaguagcugggauuacaggcaugugccaccacauccugcuaauuuuuguguuuuuagcacagacaggguuucaccauguuggccaggcuggucuugaaugccuggccucaagugauccacccacgucggcuucccaaagugcugggauuauaggcgugagccaccauacccagccuuguacuuuuuuuuuuuuuuuaaaucuuuuauucuagguucagugauucauuugcagguucguuauauagguaaacuccugucauggguguuuguuuaacagaucauuuggucacccagguacuaagccuaguacucaauagguauuuuuucugauccucuccuuccucccacccuucacucucaauuaggccccagugucuguuguuccccucuuuguguccauguguucucaucauuuagcucccacuuauaaguggcaacaugcgguauuugguuuucuuguuccugcauuaguuugcuaaggaugaugaccuccagcuccauccauguuccugcaaaggacauggucuccuucuuuuuuauggcugcauaguguuccauggucuauauguaccacacuuucuuuauccagucugccaucgaugggcauuuagguugcuuccauaucuuugcuauugugaauagugcuggaauauacauacguguacauguguuuacgguagaaugauuuauauuccuuuggguauauacccaguaaugggauugcugggucaaaugguuguucuguuuuuagcucuuuauggaaucuccacacugcuuuccacaaugguuguaagggaggagaucaccccucauguugucuuacggucaauuuuuuccuucaaagaaagaaggaguaaaaacuaaaaggcagaaaugaaauccagaggcagacaguccggcgcugcacccugggccugguuaaagaucgaccccugaccuaaccaguuauguuaucuauagauuccagacguuguauggaaaagcacugugaaaaucccuguccuguuccguucugauuaccagugcaugcagccccuagucacauacccgcuguuuguucaauccaucacgacccuucacacguacccccuuacaguuguaaguccuuaaaagggacaggaguugcucacccggggagcucgguuuuuggagacaugagucuugccgaagcucccggccgaauaaagcccuuccuucuuuaacucggugucugagggguuuugucugcggcuuguccugcuacaguugaacuaacauacacucccaccaacaguguauaaauguuccuuuuacuccguaaccucaccugcaucuguuauuuuuugacuuuuuaauaauagccauucugacuggugugagaugauaucucauugugguuuugacuuguaguuuucuaaugaucauucucugaugcucucuaaugauuuaucuauugagcuuuugucauaugcuuguuggcuacauguaugucuucuuuugaaaagugucuguucauguccuuugcccacuuauuuuauuuuauuuuuuuuuuugagacagagucucucucugucccccaggcuggagugcaguggcacgaucuaggcucacugcaaccucugccuccuggguucaagcaauuuuccugccucagccuccugaguagcuaggauuacaggcaugcaccaccacacccagcuaauuuuuguauuuuuaguagagacaggguuucaacauguuggccaggcuggucucgaacuccuaaccucgugaucugcccgccuuggccucccaaagugcugggauuacaggugugagccaccacgcuuggccuguuuuuuuuuuuuucgagacagagucucacucuguugcccaggcuagagugcagugacgcaaucucggcucaccgcaaccucugccucccggguucaagcaauucuugcgccucagccuccccagucgcugggauuacagauaugcaucaccaugccuggcuaauuuuuauauuuuuaguagaggcaggguuucaccauguugaccaggcuggucuuaaacuccugaccucaagugaucugcccaccucagccucccaaagugcugggauuacagcgugagccaccguaccuggcccuuugccuacuuuuuaaugagguuguuuuaacaucuuguuaauuauaaaaccauuguuuggcuagucuucuauaaacuguuaaaaucucagaaaacugaacuuuacauuuauuuauaugaauuauuucuauauauuauuccaguuuaucuuccuucacaguauagaauucuuuucuguaauauccauaaguaggccaggugcugugacucauaucuguaaucccaacacuuugggaggcugaggcagguggaucacgaggucaggaguuagagaccagccuggccaagauggugaaaccccgucuacuaaaaauacaaaaauuagcugggcgcgguggugggggugccuguaaucccagcuacuugagaggcugaggcaggagaauugcuugaacccaggagguggagguuguggugagccgagauugugccacuguacuucagccugggcgacagagcaagacuccgucuaaaaaaaaaaaaaaauccauaaguaacauuccauguugaagaacgcucugcuucgcaaggagcucaauuuauuauuggaagcucuaguucuuaaugaggucuugcuuauacuggcagaaauauauacagcugcccuguaacuuuuacccacuggagaucuacauuaaggaauagacaaaccaggcagcagugugagcauuuaucaaaaaggggugcugaaaaaucacuaaaaucaauuguuaaauggugcuaguuaauacgucuccacacaucacaccucacauaacagagaaccaugcgaauuugucuugcugcauggaaauagcguuuuuaagggaaaauguaaaaacauauauuccucaucuacacuaagcuaucuuuguugaguauuuuugagaggcagauguguaaguagcacaaagcaacaaagagcuagucccccaauuucaacaccagcccacaggagucugaagauguggucauccgauguuccaaagcccaauuaugcagugcuguuuacuaggaauggguaguuuauuuuauuaucuaaacuguaaacccuuuauuaggcaauaccuuuuccauuuagacaauuguaaaauaaucuaagaugaaaauauaguaagcauuagauaaaagaaagaaguggccaggcgcaguggcucacgccuguaaucccagcacuuugggaggccgaggcgggcagaucacgaggucaggagauccagaccauccuggccaacauggugaaaccccgucucuucuaaaaauacaaaaaauuagccgggcgugguggcaggcgccuguagucccagcuacucaggaggcugaggcaggagaauggcgugaacccagagggcggagcuugcagugagccgaaaucgcaccacugcacuccagccugggcgacagggcgagacuccaucucaaaaaaaaaaaaaaaaaaagccgggcgcgguggcucacgccuguaaucccagcacuuugggaggccgaggugggcagaucaugaggucaggagaucaagagcauccuggugaacacggugaaaccccgucucuacuaaaaauacaaaaaauuagccgagcgugguggugggcaccuguagucccagcuacuggggaggcugaggcaggagaaugacgugaaccugggagcuggagcuugcagugagccgagaucgcgccacugcacuccagccugggugacagcaauaguacgucucaaaaaaaaaaaaaaaaaaaaaaaaaaaaaaaaacaaaagugugugacucuauaaaaguuagaugaaggaacuuuuaaauauaucuagacaggauuuuuaauaauauccauguaaguuaccucuacucuuaccuaguaaguguugcgugauauaaaaacuggaauuuuuuuuuuuuuuuuuuuuuuuugagauggagucucugucggcugggcuggagugcaguggcacagucucggcucaugcaaccucugccucccggguucaagcgauucuccugccucagccucccgaguagcugggauuacaggcgcccgccacuaggccuggcuaauuuuuuguauuuuuagcagagacaaguuuucaccauguuggccaggcuggucucgaacuccugaccucgugauuugccagccuuggccucccaaagugcugagauuacacccgugagccaccacgccaggccuaaaauuuuaacuuuuaaaaaauuuuucguggccaggcucgguggcucacgccuguaaucccagcccuuuggggggccaaggcgggcaaaucacgaggucaggaguucgagaccagccuggccaacauggugaaaccccgucucuacuaaaaguacaaaaaucagccaggcgugguagcacaugccugcaaucccagcuacuugggaagcugaggcaggagaauugcuugaaccugggagacagagguugcagugagccaagauugcgccacugcacuccagccugggugacagagcgagacuccgucucaaaaaaaaaaaaaguuaaaauuuuaauguuauguuuucacauguaauagauucuuuauuuugagcauaaaaagcugcauacauuuuauuagcagaaaaaaaauucuucugacucucgcuagagacauguuuaacaaauauugaagagauacaggcuugcauggcugccaaauuaugagcccacaugccuuacucuggcucugcugauugguuucaguucuaacaucuggagccaugcaaaauaaguuuaauccaguuuccauaugacugaccuucaaauacuugaaaacagccaccccauccucccggagccuuucuucucuucuccagauuaaauaagcacaccccuuguugggaaucgcuucgagauuugucauuuucaugauuaccuuccugcggaggcguucugguuugccaauguguccaagugugacucucaguaucgaacacaacauaacaaaugucugaugccacauuuauaacaggcagucaucuugcucaaccuguuuugccaacucugugguaaaauaacaagggaauuuaagggaaaauaacaucccacaucccuuuaauggaauggcuuagugucuuacauuuccuggaacaauuuaaaguuuuugccagccucagggguacccagucagaguccggucaagagacagaaaccacaacaguuauuugaagacaguggauuuaauauaaagaauuguuagcaagguauuaaguuguuuacuagguaauugagaggguaaagaggaauaugaaagcaucacagaguagugacuauaggaaguugcuagcaccuuguagcaacccugcauagcuuacccuguguagacaugaagacagauuaaaccuaugaggauuccauuaggggaaauaccuguguggaaggaaacggagggaggcugggagagcugccacagacugagaugcaaguauaaccuagggaaggaaaaaggggcuauaaaaucuaagaaaguuucaguaaagccauaggaaauucauugggccaaaguuguuggucagaggagugccaggucucccaggaaucugccucaguaccccgguguucucaguuagugggagcaggcccugggaaguguggccucagagcgaggucugcaguggagggguuucaaagagcaguaguuggggcccuuggucaauuacacuuaggguuaccuaaguguaauuagguaaccagauagaauguaggacacuauuacacuaucugguaauuaggauuaccagauagaauguaggacacucaguuaaauuuaaguuucagauaaacaacgaagaaauuuguaguauaaguuugucccaaauauugcauaguauauacauacaauaaaaaauuauuuguuguucaaauuuaacuguaauuuaauucauuauuuuuaucugcuaaauccagcaacccuaauuauacuccuuauaguugaaguucuaugagggacauucacuuggcuaccauacacuucuagggcuggaaagagccaggcaagauauuggaauuauuaaaacgucaaaacuuagagaaagcugaaacucaggcauguaaggaagaagcccccaccagcugggugcuaguggguggugaggcaggggugaagcugguucugcagguguuggaaaauuacaagguggauucagcugcugcuaugggaaggaacugcugcuucagggaggaagagguguugcuggagcaaagcucaccggaugcacaagaagacaggaagccaaacaagaagcaacgagaaaacagacaggaaggaucaagucccuucuuccucccacagccuagcagucucucugcacccacuguugacacagccuaaagggaagccacuggcaaagcagaauaucaaagacugggauuuaaaguugagaguaaaaacuuaguaacuggagggccgggcgcaguggcucacgccuguaaucccagcacuuugggaggccgagacgaguggaucaccugaggucaagaguucgagaccagccugaccaacauggagaaacccugucucuacuaaaaauacaaaauuagccagacgugguggcgcaugccuguaauuccagcuacucgggagccugagacaggagaaucgcuugaacccgggaggcagagguugccgugagccgagaucgccccauugcacuccagccugggcaacaagagcgaaacucugccuaaaaacaaacaaacaaacaaaaagaaaaagaaaaaacuuaguaacuggcacagauucaaaaaauuaccaaagaucccacccaguuaaugaaaugcugaaaaaugauuggccuuauauaauuucagcuugaccuaaaacuuacgaaauucaugguuugcuuguuugcagaaagaugcuauucaucaacucccauccaccauuucagauagauuacauuaacagccaacuucacaggaguugaacuugccuuugcuuucgaaauucucuugaaacaaaaaaugaguagagauuuccaaguucaucauuaaaauuggcaaaaggaggccaggugcaguggcucacgcauauaaucccagcacuuugggaagccgaggcaguuggaucaccugaggucagaagaucgagaccagccuggccaacauagcgaaaccccgucuauaccaaaauagauaaauuagcugagggcaguggcacaugccuguaaucccagcuauuugugaggcugaggcaggagaaucgcuucaacucaggagguggagguuauggugacccaagauugcgccacugcacuccagccugggugacagaagcaaaacuccgucucaaagcaaacaaacaaacaaacaaacaaacaaaaaagauuggcaaagggauaggaaaauauagugguuuugugcuauguaggaaagagcaguuaauucaaaagacuccaguaaaccuuaucaccaaaaagaaagauacuacuaaacccaggcugccagcagauucuaaucuccuagaaaaugggagacuuuaugagguauuacagaauguuaaggagaagaauaccucauacuugucuaugccuuacagcuuauaaagcauucucccagacauguccuguuuugagcucuguacacaacuauguauguggggcaggcauugggguggguguuacaggggaaugacagaccucaaucuaguauacaauaaguaacuuuugaaaauuuuuaagugaaaaggugauacacucagaucugugccauagaagauacuuuugucagagggcaaaagaugaggacuuaccagaaauucauuuaaggagcaagagguccuacaguaagcuaggaccuugagccacagcaaucggcaugcuuggaagcuuuuucuccaagacaaaaaaguauuucagaaaagauaaaagguauaaaauauuuaaagagaauagggggcuuguaccucuuguaccucacuuucaguuuucuuccuuucuuuuuauuauuauuauuauuuguugguguuccuauuucauacacauccgugcauucacaugcaaauaauacauaucaaccuuucaaauguguacagaugcaaggaaaaguagagauucugagcauuuuugguggaauuucugugauucaaaugaaugagaauaaaauguaaauagcuggggaaaaauaauuaucugauuguacauuaauuguuauuuucauuuagaggguuucaagaauagaacaguauccucugcuaauugcugccuguauucauuaucuauuauugcauaacaaauuuccccaaaacuuaguggcuuaaaacaacaauaaacauuuauuaucucugacaguuuuaugagucaggaguucuggagcagcuuaagugggugccuggggucucucaugggacuagaaucaagcuauuggcugaggcugcagucaucugaagguuugauccccuuucaagauggcucacacacgugacuuggauuugggggcagggcucagauuuucuccacauagacucucucagggcuacuugagugcucucaugaccuagcaacugacuuuccccggagcaagugaucuacuagagugagagccaggcagaaauaauccuuuuuauaaccuagcauuggcuauaacaugacaucacuucuaccauguucuauucauuagaagcaguucacuaaguccagcccacauucauucaaagggagaggaauuaggcuacagcuuuugaaggaggugugugucuuagucucuuccagcugcuauaauaaaauaccugagauuggguaauuuauaaagaauagaaauuuauuucucacaguucuggaggcuggaaaucuaaggucaaggcacuagcagguuggaugucugaugagggcccaaucucuucuucuaagauggugccuuguugcugggcacuuuggaggggaugaaugcuguguccucauguugcagaagaaauggaaaggcaaaaagggaccaacccauuccuucaaguucuauaaaggccuuaauccuauccaugaaagugaagcccucauggccuaaucaucuccuaaaagccccaccucuuaauacuguuacauugggaagcaaguuucaacauaaaauucggagaggauacgaacauucaaaucauagaagugugucuaagauuuugugaaucuauuuuuuuuaaaaaccacacuuucuuaacuuaaaaaauggguuuggguacuuugugcuccagauaaaauucccaacuuacugaacagcuucacagaaucagauguccuagggaacucccauucuuuggccaacaaaagcuugucaacuuacucugagaugucucagaguugugaaggcccacaauagucauaguuguguuuuuuguuuguuuguuuuuugagauggagucucacucugucacccacgcuggagugcaauggugcgaucucagcucaccacaaccuccgccgccuggguucaagcgauucuacugucuuaaccucccgaguagcugggauuacaggcacaugccaccacgccuggcuaauuuuuguauuuuuaguagagacggguuucuccauguuggccaggcuggucucgaacuccugaccucaggugaucugcccaccucggccucccaaagugcuggaauuacaggagugagccaccaugccuggcccauagauuuuuuuuuaagugucaaccuuguaauccaaagagaaaaaggaaccuaaaaguccaaaccacuguagcaucaucauucaaauuauuuuccuuggauaucaaaagaaagaacaauuuuugaaaguuaaguuucagugucagaggaaggaagaagcccuaacaaguucugaggagcauaaacugcaaauaauguaauuacaacaauuugauacuuauuagaaaucaggaaaaacaccuccuaccuagaaaacugaaacauuauuacagucaaacaagaaacuuuucuacauuuagccaagugaagaacaaaaaaguccucaagacuuuugagaaugcugccugggagaacaaaagaucaguacccuaauuacuuugguaacuuuccaucauaaucaguguggcaguuuguuuugcugcugcuucuccuuucccuuuuaaaugaucugcaacuugucugucuuuuagaucuaaaagauaggcaaccauuuucuucugucuguugcuuugauucuuggcuuaucagaauuucucuguaucugagcugaagucaggagucagcuucagagaacaaaucucaggaaguaaacaagucugcuaaaaaacaaaauaacaauuugcaaacagcagcacuauuaacaaggacccucaaacugguauccucuuaggagcagagugucuuaguccauuuucuuuugauaugacagaauaccacaaauugguaauuuauauauaaauucccuuuauauauaaaaggaagaaguuuauuuagcauaugguuuuggaggcugcgaauucccagaacauggugcuggcaucuggugagggccuucuugcuguaucaugguaugguggagagcaucacauggcaagagggcaggagcacgcgagcucagaucacucuucuccuuacaaagccaccagucccgccauggaggccccacccugaugacuucaucuaauucuuuuuuuuuuuuuuuuuugagauggagucuugcucugucacccaggcuggagugcaguggcaugaucucugcucacugcaagcucuaccuccuggguucaugccauucuccugccucagccuccugaguagcugggacuacaggcacccgccaccacgcccagcuaauuuuuuguauuuuuaguagagacgggguuuuaucauguuagccagcauggucuguaucuccugaccucgugaucagcccaccucggccuccuaaagugcugggauuacaggcgugagccacugcgccuggcccuuuuuuuuuuuuuuuuuuuuuugagacagaguuuugcucuuguugcucaaacuggagugcaaugguaugaucucagcucccagguucaggcgauucuccugcuucagccucccgaguagcugggauuacaggcaugugccaccacuccuggcuaauuuuguauuuuuaguagagacgagguuuuuccauguuggucaggcgggucucaaacuccugaccucaaguaaucugcccaccuuggccucccaaagugcugggauuacaggcaugagccacggcauccgaccaacuucaucuaauucuaauuaccucccaaaggcagcccuaucucuaaucaacauaagaauuugggaauuuaauuuccaacacauaaaaucuggaggacacauucaaaccauugcaaaggagaaacauaauauccaauggcuauugcuuuuuuaaaaacaaggagauaaauugucuaguguaauuaugggggaaaauuuaguaucuuuuggaccugaaaaggaaaaauaaaauguacuuagagaaaugcaaccaagauugccuaguauuggcaaaaaacccagaauaucuacuuuuaaaucauggaacuuggugacaaaggcacuauggugcuugguacaaucauaaaggacaaagucaaggacugggaaaacugaauauuaagaguguaagaacuuacaaguacugagggaucccagaggcauccuaucccacuuggccucuacacauucauuuguucuagaagaauaaagguagcauugauccaagucauacugaucuucugucucuccagauaagacugauuuauaaguuuacaccaucuguugggguuagugauguuauucucucuaauaccaguuaauaccucaaaaagggcucuguuuagcugagacaaacaguaacuucaaggaccuaaucauaaauuuuuugcaauuuucacuaugaagaaauucagacuucaucuugaucuaaaccagugugcuuucauuuguccccagacccucagggaucugucuucucacuuaugagacauucauucaccaccuccaauacacacacacacacacauacacacacacacuuuuuuuugagacagggucucauucugucacccagucugcagugcagaggcaacaucacagcucacugcagccucaaccuccuaagcucaagcgauccucccacuucagccuccagaguagcugagacuacaggcaugaaccaccaugccgagcuaauuuuuugcaauuuuugguagagacaggguuucgcuauguugccugggcucgucuugagcuccugggcccaagugauccacccaccuccaccucccaaagugcugggauuauaggcaugagccaccaugcccggccuuuucucuccauuuuaagucacucccccugccccccaacuaccauaauucuauuaaauacuucaagggaaauuuugaaguuggugucccugagccaaacuuuuagaagagguacuuuucccugugcuaacuucagccuuuucuuuguuaggucccuucacgcacuggaagggaaguuugauagcguuuuaaaagagugagaaacucaguguggaaagaaaaaaaaauaaaaaauaaaaacaagaaauguuagcuuucagaaaagcuauuucacaauacacugcaauaaccacaaaaaucgagaguuuugccuuacaacccuagguuuaccacugaaguauguaugaccucaagagagucaauuaacuuucugauucguaguuuccucaucucucaaaugagaaacuugaaccaguuacccuaagguauauuauaauucuaaaaugacacgauuuuauaucaacaugccccaaaaguuauugaccaugugauauuugacacuauuauuaaggccugccaaauuauauucuauguguggacaugauuccuucuaaaaccagaguaaaaaccauuccaaaaagauacuugagaaauaaucgggcaauuggggggcacccacauaacguuugguuguucaguuucauaacaguaccacucuuccccuccuacaaccaccacugcuguccguuucuacuucccucaaugcuuuuucacccuagacucuuaauaccucuccagggcuagaagucaccauuuucuucagagcagucccgauaguaucaccuguguacucugccuauuagaugguggagguagcaaaauaucuuacaugauaaaaguaaggaucaucuggugggagagguagagauugguuuuggacguauuuaguuagucccuuuugcuucucaaaauaaacaucuuugugcucaguuaaaagcuuuccaagauguucacaagggaagagggaauucuugccaaaaacuuaagcccagccagacagggauacuaaaauuuugcugccuguggaaacacguggccacgcaggacuuuggcauaaaaacagucaucugugcuuaaaugauggcaguguagacuucuggugguucagaggcuauguucagggcacccaggcacaguguacagggucugacaacuccauuggcaguucccauucaauuacaguucacagcacacucuugucuauuuacagaacuuacaacucggcaaaccuugguccuuaugguuggagggguaaagagaaacacuucucucacucuuuucacaguuuuaguucugcuuccaaaucuuaacaguugcaaaaugcuuuagaagaucuaggcccaagagcccaucugcaauuuuaguguugugaccuugggcaagacacuuaaccaucucugagccgcaacuuucuuguccauaaaauggugauaaugauccuuguucuacuuugcuuacaagaauguuguacagaucaauaaaauaacauaaauaaaaauacauuaaaaagugcuauguaaauacaagauuuuuaaauuaucaggugccuccucuucuucucugcucuuuccuuuaucucaucuguuucuguguccuuuaagcaucuucauggucuuuucuuaguccaaaauuccccaugugguuaaugcuuagcuucuuaaacacgggcuuuuuaucaaccaggcaaaucuauaccuauauaugaucuaccuaccuccccauucagagccaaucuauuaccuuuaguauagucucauucauuuccaguugcaugaauugaggacuuaaugucucuguguccuaggcuagggauacaaaauugaacgagcagauucagcccucgaggaacacaccauuagaucuaagcaucuuagaccagucaaauagguucaucaggucuacauaaguugcaguugaaccuucucucccuggaagagaacucugcuucuaugaguuuagguguaucuggacaguuuggggcagaaguugaacuuugaaguccuuuaaucccacuguucuggagaaggcaggcaacuauccaagccuccuugaaauuauuuuucacauuccuuuguugacuggccccauacuucccccucuuuuuuuccuaauucaauaucuuauuuaauguugagcuuuugcuaguguucaaguccauguuagacaaugagaauugguuccauuagcuuagcuaucaggucagagaaaugagaccaccuguagcaacaugacuuacuguuugcucuaguaaauucuugcccaggaagauaaacuuguagagcaauaaauaauuucacuguuugugucaggaaauuccugaaaaucaauuuauuugaaaguugcucaugugggcaaauggcccucuucucagggcaauaaauucacuuaccugggcaaauaguucucuuaucaaacaacuaugcacuuaucaagacuugcuuuaggacccucucauugcuguguccaucagaucuacaccugcugggugcgguggcucacauauguaaucccagcacuuugggaggcugaggaggguggaucaccugaggucaggaguuugagaccagccuggucaacauggugaaacccugucucuaugaaaaauacaaaaauuagcccggcaugguggugcacgccuguaaucccagcuacuugggaggcugaggcaggagaauggcuugaggggagguggagguugcaaugagccuagauugcaccacugcacuccauccugggugacagagccagacucugucucaaaaaaaagaaaaaaaaaaaaagaucacccuacacccuauguauuucugcuucugucuucccuuucugggauaauccuagaacucugucaaggugaugcucucccucauugcaggagguucaacaaacucagccgcacuugaucaacagauuauucugguggcuucuuggggaguuggcaguugacaacuuggugcaucauucaguaaagcaagggaaacagagggaaaaaaugucuuaaauuuaacauuugccauuucuuuaaaaagaccucuauagucaucaucaugugaaaaaucagaauuuuguuagaguuccuuauucuuuuuauaugauuuggaauagucuuuauuuugaauuacauaugaggugguacaccauaauuguuuuguuacuuggagcuucuaaaaggcuccauucacuccuggguuccuccaaagaucuuucuguuacaaauaacucccuuuucuacccauuauacuuuuuauauauguugaaaagugauuagcuaguuguguucacacuaaaguaauuggcuaauauucgaggaauuucacugaaagucugagaggggcuauguuggaguuaguucacuguucacacuaagcaaauuuggcuuguaaucuggcucucucaaccaguuuaaaaccuggaaguuuaucaaaaaugucacacauggaaaugagcacuuguggcacuuguuuaaauucaugaaauagcagucauuuuagagagaagagcuuggugagucagaagccaaucuuaccagcucagucugagcccugcugaaccuagcccauuuuuauaaaccuagaaaauugaugucuacauagcaaucaugauaguuaucaugauaucaugauaccaugacuuguauauuuucuaaaacuuuucaagccucagaggaaacauuugaguucaguauuuggcuuuuguugacuucuaaagacuaaggcugggcacaguggcuaugccuguaaucccagcaauuugggaggcugaggugggaggaucacuugagcccaggaguucaagaccagccuggguaacaaaggaagaccccagcucuacaaaaaauguaaaaauaaauaaauacauaaguaaaaauaaagacuuauaaccuucuuuguaaguaugcaucccaugguaaauugagucuuaauuuuucccucauggaugccuuuuauuuuagguuuauuucagaaaauccaaaggugguuacuauuuuaaauuugaguauuuugcaugcagaaauugagcacaggcuuguuuccuaagcagguaagcugggaacauuaucauaucauuucuugaguucugguguauucagcagagaccaagauguuuucaaauacauugugcuaauuuugacaauugugugaggugguauuaaucuccccauuuuaaagguggugaagccaaagcucagaauuuaaauauauuauuaaagacuuuggaaaaaagugguagagucaaaauauaaccuaggucuaccuaauuucaaagucugaucuuauuuuuaccuuaccacauugucacagacuuuaacuccuagccauuuuugaauuguuuuuaucuuuuaauucuaucauuaauaagcauuagugagugguaucauuuucaaagaauguauaaaagauuuuuaaagcagaaacaaaagcucaaauaauaucuuuauauacucacauguuaaucaagauccaggauauuauuuaaguaaacaaauagcuauccuaagauguaacuauuaaugaaacucuaauuaaugaauuugcucauuugucuucuuuauuugaagacauuacugcuucugauauaugcauauccuacaauguuauaggguaaaagagauaucucuuccucauccaucacuauguuccugguugaggccccuauaacaaaagacauuaacaacagaaaaacacacaaauguauuuaauaucuuauaccugacggggggggcuucauucauaaggaaaugaagacguaacaaagaaacuuguguauuuuuaugcuuagguuugaugaagaguagucaauuguggagaaauaucacuagaggacaaaaaaaaugaucuaauaauaauaaacugggggaucuuaguaaggccuguuuguucagauucucuucucugugucccugugucuucaaagauaaagauguuccuucccuccagcuaucaggagggcacuucucacaugagguucuuaugaccugcuucaggggagaaacgcccguaggucaaaaagugaccuuccuagguuuuaugaccuccuucagggagggggaggggcucggggaaggugagaguaaccugccugcuucugcuguucucaaauuccuucaucuuaaauauauuuaauaugccaaggcgccauauuuuggaauagcaugucuuaaaaccaaucaauguauuuauuuacuuauuuauuuugagauggagucuugcugugucacccaggcuggagugcaguggcgcaggcuugcucacugcaaccuccgucuccuggguucaagcaauuauccuaccucagccuccugaguagcugggauuagaggcaccugccacaacucccagcuaauuuuugcauuuuuaguagagacgggguuuuaccacauuggccgggcuggucucaaacuccugagcucagaugguccaccucccucccugccccaccgccucccaaagugcugggauuacaggcaugagccgcugugcccagcaaauuaauguauuuuuaaguauuucaccuuggacuuauuacauguguucuuuguuaaucuuauuaaaaaguugcuuuucuaaccuagaaauuuauuuuguaucccauuacaucuuauaaaaugaucaaauggccaaaacauuauuuuucaaaaauucacuuuauuaaguuaauauaauaugaaccugcagcauuuuuauuuagaagaaccaucccuaguauuacauauucaguacaucugcacuuucuuuuuuuuuuuuuuuuuugacacagucuugcacugucgcccggggcuggugugcagcggcgcaaucucggcuggcugcaaccucugccucucggguucaagcaauucuccugucucacccuccccaguagcagggauuacaggcacaugccaccacgcccagcuaauuuuuguauuuuuaguagagacaguguuucacuguguuggccaagcuggucuugaacuccugaccucguaaucugccugccucugccucccaaagugcugggauuacaggcgugagucaccaugcucggccugcacuuuuucuaacuaaagguucaagacacugaagacaugaaguuguauucgaccauuucuguuuuuaaaauguuauuuaacaaguuaugugagugaucggaagggcuucuuuucugcuguuuauuugcaucuuaugcuuuuccuuuuugcucugucuucuaucucauuucauuuuuacaccuucuuacuuuuaaggacauuuaucacacgcugcaaaugcugcuugugcaucucuauucuguuuaugagcaggauaaugucauuggcauuuuaauauuucacagcagcagcagucaugaccaaacguuccccucauugguuuuccuuuuuccuuucuaacucuuccucuuuauuuuuuguucuucuuaagccugaacaggguaccuauaugaaaucaaaagaaagcugucauuuaaaaagggaugacccuagccacuagggccuagcauucaggaaaaaaacaaauucguacccugacugcuccacaaguagcaagccagcauggauccuggacugugaggccagugaaacagacgcagcagcugggauggaagaggaguuucugauuggccugacuacuugagaaagguuacagggagugggaaaaaucugaccuuucucgaaaugaggaaugugccuggaggauuccccacacgaaacaaagaaugguucacucaucaccuguguguuuccauucuauauucagagcaaagcagugaucucuugguuauucugugacagguuucuucuacuguggcaaaaagccugaacugauggccuuccagauguguauuaaaacgauguuucugaaugggcaaaauaacauaacugcuguuuuaacucaggcauagcauaacagcuaagacaccuccaccagguucuucauuuauacacaggcacuucggucuuucucuuuuaucaucuucuuaccuuguaaacuuuaaaagucuccaugguaaaugugauagguggcauaaaggaaagcaaaggucuugaugagaguaacauaacauuuacaaauuacccuaaauuacugcuaauaauaguacuuuguauuugugaaauuuuaaaaaauauuucauaucgcuaucaaaacuauccauucauuugucaaugaauacuuacuggaaacuauguaccaggaccucugggugauggggaagagagcaauguucaagacaaauaagauugcuacucucauguaucucauauucuagaauggugugggauggagggagacaaacaauaaacaaguaaacaauaaaugaacagaacauauccagauaauggccagauauacgaagauaauaaaaugguauaauaaagaauggcucuggaggggugacuguuuuagauugaguggucacagagucucuguaaagagaaaauaggacagaauuucuuagaccuuguggagaaccuaaaccuaucuauuccaguguucuuagcuuagguaagaaaacacagguccugggaacuuaccagugagaaaacuaagaucaguagagguuaaagucuuacugucacaaacaaguauacagcuauucuacacagugccugggcagacguagaacuguaggcaauugcuuggucaucagacagcuccuuugugcauauuagaagacaagugccccuuucucagggaaaaugcccuugugcaaugcacaaccuacauaguuaauaauguacuauacguuuuacaauaucuaaaagggaggauuuugucuucaccacaaagaacugauaaacaucugacaugauagauaugauaauuaaccugauuugauuauuccacaugagcccacaaguauaugcaauuauuguuucucaauuaaaaauaaaauaaauauuuaaaaaagagaaaggaaguuuggaaguggauaguuugucagggacccaaccuacuuccaucuuuuguucugccauauuuaacuucuauugcuaagauaacauuacggcucaagauuauauacauauuuuagguagcacuaacaagagacaaaggagaugcauguccugccuuuaaggaacuucaaggaaguucuacaacacacuucgguuuacaugucauuggccagaauaagucaugugaccuuuugcaaaggcgacuggaacauguagucuguuaguuaaguggccacguguucagcuaaaaucagaguucugcuuuuaaaaagaagcagggcggggcgcgguggcucacgccuguaaucccagcacuuugggaggcugaggcggguggaucaccuggggucaggaguucgagaccagccugaccagcauggagaaaccccgucucuacugaaaaugcaaauuuagcugggggugguggcaugcgccugugaucccagcugcuccggaugcuggggcaggagaaucgcuugaacccaggaggcagagguugcaaugagccgagaucgcaccauugcacuccagccugggcaacaagagugaaacuccgucucaaaaaaauaaauaaauaaauaaauaaauaaauaaauaaauaaauaaaaagaaacagacaauggauauuggaagguagccaguagucccugucacaccauccagacccaggucaccugugucagaucuggggacaggaagugucaguuugugagaaaugaaaaagcuagucauuaagaguuauaauaucugggggcugacucuaccacuuacuagcccagugacuuuaagcaauuuacauauucucuuuuagauuuagauucuuuacucauuggaagaauaaagacacuaucuaauguuuaggguuucuugacgauuaagagguaauauuuauaagaaauaaagcaccuggccaggcgcgauggcucacaccuguaaucccagcacuuuggaaggccgagguggguggaaucaccugaggucaggaguuugagaccagucuggccaacauggugaaacccuguuucuacuaaaaauacaaaaaauuauccaagacugguggugcgugccuguaauccuagcuacuugggagacugaggcaggaaaaucgcuugaacucgggaggcagagguugcagugagccgagaucaugccauugcacuccagcuugggcaacaagacugaaacucugucucaaaaauaaauaaauaaauaaauaaauaaauaaauaaauaaauaaauaaagcauuuaacuauaucuagcacgugagaagcauuuaguaaauaugauuuuccuuuuuucuaucuguuauaaauaguuuucccagcucugccuacugcagcuuuuuuuuuuugacuccuuuuuuuuuuuaaaggucuuaagaugagccuguuuaucuucaucucucccuaucuccuucuucaacagucccaaacuaugugcacagaaagcagcuuaugcuccaggcacgguggcucacgccuauaaucccagcacuuugggaagccuaggcggauggaucacuugaggucaggaguucgagacaagccuggccaacuggugaaaccccgucucuacuaaaaauccaaaaaaaaaaaaaaaaauuagccaggugucauggugcaugccuguaaucccagcuaccuaggaggcugaggcaggagaaucacuugaacccgggagacgaagguugcagggagccaagaucacaccauugcauuccagccugggcaacaagagcgaaacuccaucucaaaagaaaaaaaaagcaagcugcuuaugccucaaaauuccugucacaaugaggcugaguagggaaggucauuucuggaugguucaaacaugaacuagacaaaugccccuuuuggggugggacagccaaaggacugguaaauuacaaggcugccaugaaggcaugguugcagccugugaucuuacggguuguguccugcacagagcaccagauucagggauagagcaagggcugacaucuaggcugaaauccuuuugcaacaacuuggggggaaaaaagagcuuuuuuucuaacaggucuaaagggucaauuccuaugccugcaggggcccauuuuucuaaauuccacaaaggaaacuucccugcuggcuucccuacaggcaguguccccagugcccugucagaacagguccaaacuucagucauucugcuuucuucagugcccuggccaccuuccccaguccacgugccaucaacaaacacaggauauagaucugcuuguucaguguguaccuuucucugcgccuccauuaccugagucaugaguaugcauaguggucacuuggcuccaacauuuuuuuuuuucuuugaaaaaggaaaagacaaaacuuuguggcuuaaaaguagaagugucaagaugguguuacaauuauagcaccaaagucuggagaaaugccucagacauggaaagcauuaaaauauagaaagcuaguuuucuaaaauaguuuuauggcacugauguaaaugguuuggauuuuuccccuuuaaaguuuauuuuacuuuuuucuucuucugauuguaaucagucaucuaaaagacaacuggaagaagccuuugagaacagucguuuuuaaaugaugagcuaucaaaaugacuuugggaagaaaaaaaaaaggaaccuacaagugcaaugacccagaaaguagcuacacguauguaaggagguauaaagcuccagugcuuagguucaaggccauuucuuuuugcuuaaaggcuugaaaacagagaagaaaaaauuccacgaccccaaacaacaguaacauaaaaaaacugucacccaaagucuuucuucccagaggaaaaaugucaaggauauuucuaaguuaauuggacacaccauuagaagugacggucuguuuuagauguugccccucugaaagccuuuuggguugauaucacuaaaccacucucuucaugaagauauuuuauuuccaacuaaacuguguaguaaaucauauauuauuuuuaauuuuuaaaguucuuagagcaaauuauuuugagcuaccaacucuguugggucuucugcucuagaugauccuuaaugugagaagucacauaauccugaauccugaaacacucuuuuuuuuuuuuuuuuuuuugagacagaguuucacucuuauugccccaggcuggagugcaguggcaccaucugggcucacugcaaccuccaccucccugguucaagugauucuccugccucagccucgugaguagcugggauuacaagcacccgccaccaugcccagcuaaucugaaacacucuugaagucuacuuggcuaagcauuuggucaguguuuuuuuguuuaguugguuuugggguuuuuuggguuuuuuuuuuuuuuuuuugagacggaguuucacucugucccaggcuggagugcaauggcaugaucuuggcucacugcaaccuccgccucccggguucaggcgauucuccugccucagccuccugaguagcugggauuacaggugugcaccaccacaccuggcuaauuuuuguauuuuuaguagagaugggguuucaccauguuggucaggcuggucucgaacuccugaccuugugauccgcccaccucggccucucaaagugcugagauuacaggugugagccaccaugcccggccggugguuuugggguuuuuuuugagauggggucuugcuauguagcccaggcuggagucaguggugugaucuuggcucacugcagccucaaccuccugggcucaagcaauccuuccaccucagccuccugaauagcuaggacuacaggcgugugccccaacacccagguaauuuuuguaaacuuuuggagagacaaggucuuuuuauauugcccaggcuggucucaaacuucuggccugaaacgauccucaugugucagccucccuaaguguugggauuacaggagugagucauugugcccggcucuuguguucauaguuucaugaagaacuugugauuuuuuuuuugucagauuccaccaucuucucauuauauuaaugaaugccacccacaaugaaaaauuaacauuuucggaacuagagagaguaaaauaagguaagauacuaauauuguuggccauuuuuugacuauauaucagcaccugcagcauaugccauagcaguucccauuucauguaaauauagccucaaaaagugcucuuuuuugucccacgccuacagugcaaaaagauaaaagucaaaaacuuuaguuuaaaguucacuuuuuuaaguuuauguaaccaacuugugacagcuaauauuauaaccagagauaacucaagaaagccuaguuaugguauacuggaaaaagaauagcagauaacuguggaaugcaccaucagugauaaaugacucuuuaagcaaaagugucaggcaguucaaaaagcaaaaaggcaagcuguaaacagcaguaggcagagggcagucuuaauaugcaugcuguuguuugaggggccugcagagcaucaaucuuuucaguuacaauuugcagauacauaauacagaaaaccucuaugauaaaaccuucuggaaaggaaaauugacauguguacaaacagaaagauuucaaugacaccccaaaauauacuaaugugaauggugcagcauuaaguucuguaggaaaaacaauuguccucagaaaucauccauucauucauucauuuagcaaagauuuauuggauaucuacuaaguaccaggcacugauagguccugggaccacacagauaaagaaaauauggucccugcaccauaaaucucagguuuuauuaaaacaagugccaucuacauauacucaaaugcauucauaugugcaacaaaagguagcacaagaauuucauaagaaaagcugggagcuguggccugugccuguaaucccaugcuacuugggagguagugugggagaaugccugagccugggaguuuaaggcugcagugagcuaugaugacaccgcugcacucaguccugggcaacagagugagauccugucucuaaaaaagaaauuaaaauuaaauuaaaguuaaaaaaaaaaaaagaauuuuguaacagcccuauuuauaauuccccaaacaggaaacaaccgaaauguccaucaacaggagacuggauaaugggagagucauacaaugaaauacuauuuagcaaugaaaauaaaagcaauugcagccacauaaaugaauuuuacaauguuaguagauauaaaauuuuacaaagaagguagauauaaaaauaucauauugcauuauuccauuuauauaagguuuaaaaguggcaaaaugaauuugauagagcacacgauaaggcuuagaguggagaugaggggguaguaacuggucaguguacagagggcacugcugggcaguuuuguuuucugaccugggugguggauacacaguuaugaucacuuuguaaaaauuuauugaucuacacacaugcauauucagcauuuaucuuacauuucuguuaaaaagcacauugaaaaauaaaugccagcucuuuuaagcaauauauuucaauguauguuaauuguugggaguguuucaagaacgaauuuuuggccuuucugugacuugccucaauuuucuugugcuuggacucuauccagaggaaaguggaugcuugaagauacagcauuggaaauaucauuaaagaucuuuaauaauuuucuuccaauuuugaaaaaaaucaaccacauuuuggucuacucaucguuuaacagcagcucuaaaauguuaagaauucugcuaagaacuuacccuaacagcaaauucauauacaaaaauuuugcuaauuuuucaaaaucaaguucagaucuuaaguuaaauuguuauuugacauuugcuuucuacauauuaaaaaccuaccaagagguuuuugucagcggagugaauucugagagaaaucuaacgugggcacaaagaaguuacagccccaccaaauacuguuuuguuuuuauauuugagugccuaccugccaauuacuguuuauuagcuuuugcucaugugggcagaugcccuugauaaaaccaaaauuuguuauugaacaaagucaaauucuccagguagguacaauguuggagacagccacauaauucauaucugcccagggcuaggaccuugaguugacaaauuuugccaaccuuaacuaguaaagcuuagauuugcuaccaggccuuuucaccuagaaguccaugaccauguucucagaaugaaauguacuuucaugggcauucuggagguacaagaacuacucuguuucauuuguauucuaagcggccaggcuugaggacucaugcagucuuuaauuuauaaauagcauuuuauaaagcacagaauuccaagagguagaaaauguuguguuacagaaauggugaauaaguagaaaguaaauaguccuucagcaauagugaauuuugacaggaaaacaaugcuagcauaagccuauccuacauagugacugccuguguucuuuaagugcuacuauuguauuuuguuugauuuaaaauagaaugaaaaauucucagccuguaagucccaagaagcagacugacugacaucaguagcauaugccccagaaugaaccaaagcagacauuaaaaauauauuuaauugugaaaaauuccaaacguacacaaaaguggagagaaugugccaauuacccaguuucaacaaaaaugaacauucuaucaaucuugcuucaucuaucccuuccaccuauaccuauuuccuuccuuuauuucuuuuuacuuccucccuccuuccuucucuuccccuuccuuuuucuuuucuucuuucuugcuuccuuuuccugaaaauuuuauuuuuauuuuuauuuauuauuauuauuuuuuuuuuuugagauggagucucgcucugucaccaggcuggagugcagugacacgaugucggcucacugcaaccuccgucuccaggguucaagcgauucuccugccucagccuccugaguagcugggauuacaggcgcgcgccaccacgcccggcuaauuuuuguauuuuuaguagagacgggguuucgccauguuggccacgcuggucucgaacuccugaccucaggugauccacccgccucggccucccaaagugcugggauuacaggcgugagccacagcgcccggcuccugaaaauuuuaaaagaaagucucagacaucauguaauuuccuuuguaaauacuuuaguaaacaccucuaauuuuuuuuuuuuuuuuuagacagaugucucccucugucgcccaggcuagagugcaauggcaccaucacagcucauacagccuugaucucccuggcuuaaacgaccuucugccucagcuucccaaguagcugggaccacagacacgugccgccacacccagcuaauuuuuuuuuuuuaauauucuuguaaagauggggucuccuuguguugcacaggcucaucugucacuuuuuuaugcagaaauuuguuauagaaacuggcucugcugggcacgguggcucacaccuguaaucccagcacuuugggaggcugaggcggaagaaucacuagaggucaggaguucgagaccagccuggccaacauagccaaacucugucucuacuaagaaugcaaaaguagcugggugugguggugcgugacuguagucccagcuacucaggaggcugaggcaggagaauugcuuaagcccaggaggcaggaguuguagccagcuaagauggcaccacugcacuccagccugagugacagagugagacccugccucaaaaaagaaaggaaaagaaaagaagaaagaaagagagaaagggagaaagaaagggagaaagagagagagagagagagagaaagagagggaggaagggaagaaggaagggagggagggagggagggagggagggagggagggagggagggagggaaaaagaaacuggcucauuuuuuccuguaagauguuuuauuuugcauagggcagacugucuccuugugguuauuucacuuguuccucuauccuccauaagcggugguuaaaucuagacauugauuagauuagauuugauucauucauuuuuuuuuuuuuaaccaucguggccauuuuaggccucaauuugcugucauuuaaaaugcuuuuggacuuggcauaauucccugcuguauauuuuuguuguuguuguuuuuaguuauuauuuaauaugguacuuuauucuguuaguggccuuuuguaaccgcccgauggguucaccuuguccucugccuagacagagcugauuuaucaagacaggggaauugcaauagagaaagaguaauuuggccggugggguggcucaugccuguaaucccagcacuuugggaggccaacgagggcguaucaccugaggucaggaguuugagaccagucuggccaacauggugaaaccccaucuuuacuaaaaauacaaaaaaaaaaaaaaaacaaaauagaugggcauggugacaugugcaguuguagcuauucaggagacugaggcaggagaaucucuugaaccugggagguggagguuacaguaagccaagauagccccacugcacuccagccuggggggacagagcgagacucugucucaauaaauaaauaaauaaauaaauaaauaaauaaauaaauaaauaaaguaauucacgcagagcuggcugugcaggagaccagaguuuuauuauuaugcaagucaaucuccccgaaaacuuggagaucagaguuuuuaaggauaauuugguggggggcagggggcagugaaucaggaguguugauugguuggcucagggaugaaaucauagggaguugaaguuuuuuucuuaugcugacucagcuucugaggggaggccacagaacugguuggcagguccaggugggaccauccaguuguuagaaaugcaaaaaccugaaaagacaucucaaaaggcagaucugagguucacaauagugauguuaccuuuaagagaaguuggggaaguugugaaucuuaugaccuccggaauaauggcugguaauauuuaggauuccagcccuucucauucuaacuuggguggcugguggccuuucauucauuuuacaagaacagucuagcuuuugggaagggcucuuguuauuuaaacuguaaacuaaauuccuucccaaggcuaguuuggccuauacccagaaaugaacaaggacaguuuagagguuagaagcaagauggaguugguuagcucagguaucuuucagugucauaauuuccuuaguuauaguuuuggaaaggcgguuucacucuuauuccgugaauggacacucagccucuuaucagcagagcugggaagagaaccuaaaucuuuccaagucuuaugcugugcccuaucuaucacagaaugcuucuggaaggagaagaagagcucccuuuuuguauuucucacauccaccauaaucuuuugaaauuagaacccugcagcagucuuggaaaaaguaccauuccacucuucccagucaaggacucauaaaacccaccguaaggacaauguuaauauuacuguugcaguugaaaauuuucuuuaccaucagcaauuacuuuuacaguauuuugaacaaaauugaaugcugggucagagaaaacaaauuccuagggauugacgaucaucaaugauaauucuuuccauuuccuagugucuaauuuuuucagaucagcuugucauauauucauugugacuaucuuaauuauuguaagccucacuaguauuaaaauucuuuuuucccaagacuggcaaauagaaucuaaaucuuuccaagucuuauccggggcccuuuccaucacagaaugcuuccggaaggagaagagcuccauuuuccuauuucuuauaucaauuacugaucauugaugaugauuauugaaaauuguuaacguuagauaauguaaaccagaaaguaucugaaacaggacucaaucaguauagaaaguuauuuugucaagguuaaggacacaucugugacacagccucacaaggucaugaggacacacaucugaggugguugagguacagcuugcuguuauacauuuuaaagagacaugagacaucaaucaauauacguaagauguacauugguuccauccaguaaggcgggacaacuuagugggguggugcuuccagaucauaaguagguaaaagacaaaagguugcauucuuuugaguccuugaucagccuuccacugaaugcacaauuuagucugccucggugaaucugcauuuuuacaaaauagggcagagaaagcaaucagauaagccuuugucucaggugagccuuagaaggaugacuuugaguucugccuguuuuguccacaaggaauuuccuugugggcaaauugugcgggagguauguagcuuuuuaucgugguagcuaucuuauuuaggaauaaaaugggaagcagguuugccugacauaguucgcagccugacuuuuccuuuggccuagugauuuugggguccugaaauuuauuuuccuuucacaauaauaaguaauaggguuugcuauaauaaucccucuuuuaaaaugaaauaagauaggcuggucgcgguggcucaugccuguaaucccagcacuuugggaggccaaggaggguggaucacaaggucaggagaucgagaccauccuggcuaacacgaugaaaccccgucucuacuaaaaauacaaaaaauuagcugggugugguggcaggcgccuguggucccagcugcuuaggaggcugaggcaggagaaucauuugaacccgggaggcggagguuccagugagcugagaucaggccacugcacuccagccugggcgacagagugagacuccgucucaaaaaaauaaauaaaauaaaauaaaauaaaauaaaauaaaauaaaauaauaaaauugaaaauuauuauuuucuucucucaucaugccuaaaaucagguguccaaaagauaacaaaaucuuaagucagguugucauauugacacagaggguuuggaagcugucuuuugacucaaacaagcuuaggccucuucuguugcagaaacaccacuguauucauugcuauuuauuacaacugaacucuguuacugugauuuuagccuugucuccacgggaacccauuuauuuauuuauuuuguaaauaucuguauucuguugaaggaagcccauuuauuagcaaaagcuguuacacacuuuauuuucaaaaauacccaguguuuugaaaagacucccaaguuguguuuuccucuacucucauaccaccaccacaacaaucaucaacacagaagacuucggugaccaaacguggggauuuuuccccacaugccaagcagugaacaccagcuggguguccuccaauuaaauuccacacugucgccgggcgugguggcucaugccuguaaucccagcacuuugggaggccgagguuggcggaucaccugaggucaggaguucgagaccagccugaccaacauggagaaaccccgucucuacuaaaaauacaaaaaaaaauuagccaggcaugauggcgcaugccuguaaucacagccacucgggaggcugaagcaggagaauugcuugaaccugggacgcggagguuguggugagccgagaucgugccauugcacuccagccugggcaacaagagcagaacuccaucucaaaauaaauaaauaaauaaauaaauaaauuccacagucuacccagagacagugucagaucccauaaggugagguuuuaguccccaaaacugccccuaaccccaaacaccagucguuaagucagggccucuggaacuucugacccauuggcuucaaauugggauucccaaaacccccuccucggguuugauuaauuugcgggggcagcucacaaaacucagggaaauuaauuauucuauuauguuuacugguuuauuauaaaggauauuaccaaggauacagauaaggagaugcauaaggcaagauauggggaaagaggcuuccaugcccucccugggcgcaggacacuccaggaagcuccaugaguucaccuaucuggaagcucccgaacccaguccucuuggguuuuuauggaagucuaaugaugucagcauuucuucccccaguguauaaggcgggacggcucuagugggggucuuaagacucacaaucagaaaggcgggaaagaugagaguccugccuuggggcaggugaaaggagagcaggaggucagaggccuuccccuaaggccuaacaugcccaacaugauaacaaaauacucuaacaggggcuaugggaguuaugagccaggagcgguggacaaaaaacauuauauaauaccuauuuauguguauauaccauuauauauuauauauaugcauauauaacauugcauaucauauuauuauauaauuauacacaauaccaauuaauuuauauuuuuaguauuacuaauuaauaauauuuauuauugauuuauauuauuaucuauuaauauuauuauauaauuauauacuauuaauauauuauauauauauaaaaucuccuggccccaagcgauccucccaugucaguauuucaaguagcuggcacuacaggcuugaaccaccacaccaggcuaauuuuguuuauuuuuuuauagagacaaggucacacugucuugcccaggcuggucucaauacauguaauauaauauauaauauacauauuauauccauauauaugcacacauaaaauaacaccacagccaguagugaauaugaagucaauauuguucuagaucagggagauuauugcaucccccaauugcugagggaagauuacaaggcacuugucugagacuugcaugguucuacugaagugaagcaguagaacucaucaggcacauuuuuucaaaugaaaagaaauguggcauuaugcaugcaauuauggaccuuuaaagauaaauaagccuuagagaagcaucagagcuucucaacugaaauuaaagauccuuaagauagauauggaaagaaauucuccaaugccauccccuuaagcguagcugaauuucagugaagaguaauucaagaaguaaaaaacuaaguauggguuaucaaauguuucuuauccaaagacuuuucuuggauuuugggauuuucuucuacuucuuuuuuuguuuuuguuuuuaacucuuauuuuauaugguauuuuauucucuucaaaagugaucucuucaaaaucauguagcuuuauccuggguggguuuggggcaaaucucagcuucucuugaaucuccucaggccuuuuaaaucagguucagcaucuguauuuuuaauauuaaauugcauacauuaaauuccauuauaacuaguauauuggcauuuuuuacuuguuuuauuucaauacuauuaugcuauagugaauguugagcuagaagucagucucauuuuaaaaggaguaaauaaaacauugauaacuuagauguaagcuucuuacuguguuugaguuuugaagugaagaaaaagugagcaaguuaaaggaaaauggcuacuugcauauuagaugaaaaauuacaaagugcuaaaacagcucaucucuccucucugucuucucccauacaguauuaauggcaucugaucacgaacuugugcuaguaaaaagucugucuuuccugaguagagaccauaguaaauaagcauugucuaggauuagugauucugaccagugcagcaaacacuuggaucuguugaaagauggaaauuguuugaaagauucuccccagggccugaaagcuugaaggcaugaguaacuccucccuucuuaggcccaguuccaaggcgcaaggcuauuugugccagcagccugcgccagcaagauagcagaagcaggaagagagccgguuagaagacauguacccugcugcaagacaccuaucccugaagaucgagagaguccaucccgguaccacaaggcaguuacgacagacugggacacuuccuguuuacaggaagcuauaaaaccccucccccguccucauuuggggcugacgccauuuuaggccucagccuaccugcacccaggcgcucauuaaaacagcauguugcuucacucugccugguguugucugucggugcacuuucgggguucgaaccgauauaagaaccuuacaaauagaacuuuuuuuuuuugagacagggucucaacucugucacccagccuggagugcaguggcaagaccauagcuuauugcaacuucaaccggcuggucugaagcaguccucccaucucagucucucaaguagcuggcacuacaggugcauaccaccaggccaggcuaauuuuacuuauuuauuguagacaugaagucucacugacuugcacaggcuggucucgaauaccuggacucaaaugauccuccuaccucagccucccaaaacgcugggauuacaggggugagccacagcgccuggccuaaauucuuccuguauuugcuuggugaaagaacuaaacuuucccagcauuuuuacuuaaaugaacagaaguuugcuagaauuggauguucaggaauuuguuuuguauuuagacaagaguuuaugacacuggcuuaccucaaaaauauauuuuaugguauuaaaacauauuaagauuuagaagcauuuuaacaaauucuuacaacuacugaucagaaauuaucaugacaguuaauauuuaugcuucccucuguuuucaguuucauccaaugcuucuaauuuaacuacugcauggcauguuucagaaaaaauugaacaaauaaaaaauuuguauuccauuggcuuagauuuaaauuuuauaucuauuuuaucuucauacauguuaugauuuucaauacacaguagcagaaaacucagguugauuuuuccugcgcaaaacgaaaaauugaagauugcacaaaucaguuuuccugaaguguaaguaacugcaaucuuaaagcaguugaaugcucugcuauagaaaacuagcauguguauguguauacacacauauauauguauauaaaucuauauauugaaauauuugccuuaguaaaaucauugggaucucuaagaaugguaucgaauggaaagucugggaauucuuaucaggaauccucauaaacucaagcccuggugaauaaaaauaauagaaugaaggccaggaguggugccuuacaccugaaaucccagcacuuugggcggccaaggcgggcagaucgauugagcccaggaguucaagaccagccugggcaacauugcaaaauccugucucuacaaaaaauacaaaaacuagcugggucugguggugugggccuuuugucccaguuacuugggaggcugaggugggaagacugcuugagccggggaagucaaggcuacagugagccguguucgugccacugcauuauagccuggaugaaagagcaagacuuugucuccaaaauuuaaaaaagaaaccaaaaaaauaauaaaaaaguauagagaauuguuuccuaauaucaucaaagaacagaggcuaggaagggaaaauagcaaggcaauuuuauauauauauuauauauguauuucaagaagcaauagauauuuuaaggauuaacuaaaaucuuuauagucuucgcaagguauauuuuauuauuucuuuauuuugcacuaaaacucuuaaaaguauagaagacgaauugcagaaaaggaauccagcaaaauggaaauauuuauguccuacccuaaaggaggaacuauaagugguagagcaggugguaacagcuguagaaaagaggcccucuagacaaauccuaagggguuuuggaaggaagaaagagauguuggccugagaccugagaugaaaaaacuaaugaagcugguauggagcuuuaacuagccugaggccuaauugcuuccucaauaggugauggauuuagggcagcaguccucagcacuggcugcacaucacaauaaccuaugaagcuuuugcaaaguuuccaugcuagggcgaaacucucuugagaguaagguauaaccggaucgaggugggaugagggccugggccugagcauuuuaaaacauugccaggaauuucugugcuuucaggauuuagaaccacugagguaagguuuuucucacuugauauguuuauuuuugcaaguucagcaucugaagauguuucuuuugaauuuauuaugugcaauuacuauauccugcuguuaggugaguaaugaucccauuaguucuuugggccacggucuagccaggcuuaaaguaugagaaacagagaaaaacaguagcacacucaaauuuuuuaagaaaaaa

SEQ ID NO: 13611 - RNA, 73348 nt, Homo sapiens
cuuaaaauguauugcaaaauguacagcauuuauucacauacagacaaaaaggcacaauucuacuaaauaguucaacaaaaaaauacagcuguccucaacuaguuuuauaaauacuuucaaaaaggggguagaaauaaauacaggauugggucauguaauauaaaauagucaucucuacauauacuuuaauuugauuuuuaacucuucaugcaccuuuuuuuuuuuuucaauuuuagcugaauggacaccaagcuaggcacauagugaaaaauccucuguacaagguuacaaauguaaugacaaguuuguccauuucaaaauaagauuuguacacaacacauaaaacccuucauuuagaucuuguguuuauaaccuaacaaaugacauuccaggcaacuuuacaaaaguuuaacuagccuacauuuugacauaauacauuaaucauaaucaaagauauuucuuggucaggaugcacaaggaaagauaaagcuuaaaaaaaacaaaugcaaaugguuccauacuaauagaacgcaaguggguguuugggcugguugcugcuuauggccaccucauagagaguucccagcaugacaugaaacuaacucacaaagcuaucauuauacugucagagaaaccgugcucuauccauuugcauuucgaagcaggaauaaaaagugugggcuuuuuauuuuuguguguuuuguuuuuguguggguuuuuuuuaauauuuuuuguuuuguuuuuguuuuguuuuuuuugguucagcauaacuuggaacauuugaaagcuuuucaaccuaaauguggggaaaaaacagguaaggcauuauuuuugcacaaaacuagcauuccuaauagugcaaaugaaucugauaccucuuaaaauggugagaggucauacacuuacuagauuaauuuagauuuucuuucuauggcuugacaaauuaucccucuauaaauucuacucucacccagagcuguugcuguaaucaaaagauaacuguagauaaaguccaaccuucuccuguauccagcaaaagguuuuugcucauaugcaaaaaaaaucuaauuuuuaaauuauccuacaagugaauauacaacuuggauucauaagaaccuucuauuaucugcagcaacaagcugaucuggacagcagucuuucaaaaugagccccauaacucaaaaauagucagucaaucuaaaaaccugcaucauucuucccccuccccugaauuagcuacuaaaauguccuugaaaaguuaagacuugguuugaaaaugucguacauacaauggggauguaucagaucuacuauuugaucaucugauaaaacuugcauagcaagaugggauucaauaagccuuuuuuguuguugacaaucaucuggaagacuugaaaguuaacugcagaacuccucaaagcauuauucauuaaguaucauaaugucccugccauauggaaacagauguauaaaugaaucaggaaucugaauacugguauuaacaaacuaaggagaauuuaggggaagucgggcuuguuccaaaggcccauaauucuguaucucauugcuauuuaaacguuccuuccuuaaguuugauucacaaccacauugaauuccaaagaaaauuaacaggaccuaaacacuauccacugucuuaauacauacgcacuauggggagugcaaaaacaaaacauuguacucaaauuuaaugcuaaauuuauuauugcugauaacuuaauaguuauugccauuugcaauuagaaaguccaaguuacaaauuagaguuuagaacucugacuacagaaaaccuauucaaggguacacuucagucucuuuccuguauaaccuuggucaauaguaagagcuuaucgcaacuuauugccuuucuauuguuuuuaaaauauaaccuauuucgcuuuuuucucuuuuuuucuuuuuucuuuuuuuuuucuuuuuuucuuuuuuuuuuuuuuuuccuuuuucuuaaggaauccauucauguuggaagcccagauucccuaacauaugcacuagugguuggcucugggaaguaacagucaccagagucuggaaguucuucgcuugaacuugaguagccacuguacuauuggaagccagauggccagguauuggcaauggccagggaaaucccaagcuggcucaagagccagugguuagggaagaagaaggucaaguggacugguaaaaauucuacuucaacugcccuuauucauagauacaacuuuccuaacagucucacucuccaccagucccauauccacaacccacucacaggcuucaagcagcaggaccuugccauauuacccuaaaucuccauauugcagcagcucuacccuguccccucagcuucuucaauaaugaccuuuuuuaaaauucucuucccugacugcuauauuuacacauaaauuucuuaguguuacugaagcuucagagcugcugccuauaugcuauaaugcaacaaaaauagccuugagggccaaauauaaauaugauuucaagaucuaccacaguccuagaaaauaaacuuuaugggcugugaaugguaccaugaggguuucucaagaaccauaucugguucccuauauucagguaaccaugaguuugugcuuugggaagaaugcagagggcuauaaaaauucaugaggcuuauuuaagccuugccuucuuuaaaacauuucauuuuuauuuuaguguucaguucggguucuagucuuagcagugucuuaugguuacaaucuacucuucuguuuccucaacaaguugcaaauaacacaaacuucucacaaaaaugauuuaaaaaugacucuggaaaaaaauuaaucugaauugcaaguaaauguguuuguguagcucaggauuaauggguuucugcuucucccccacaucagagcucuccucuagcaaacccaaugacgagcccaaagggcuuccgcaucaucucuguugcaucaagaagccaagaugcuucuccugauaaugucuguccuucugcugauagugcugcugguguguauacauuucuuuucugaugccucacucucugagucacucauuuccacaucggggacauacccgucauucucauugucggauuuuaauuugcuuuuugcccuuuccuuggcuggaacucggccuaagcccaaauauggguagucugagugcugguggcaggccccaucgugggccucucccugcugcugccguucccccuucuuuggaauccggaauccuccccaguuuuucacugggcuggcagguguuguaggcacuuugacugcagucugauuauaguuuacuuugauuagggagccauugcacuugggcacuaucuccuuccuugugccaggugcugacugccccacuccaggggagguggcagcucuuguguuguccagaugccucugggacacaucuguggaccugagaggcuugugacucuguuuaaaagauuuguccuuuaagucuccuuuaaugagaucacaaugaaaacgauugucucuucuuuucccauggucuggcaucaccacaccauuuuucuguugugcugauaugagacgugcuucugcaaaggucuuuucuaaacccaaaaagcucucugggaccaccauccccucccuucuaccacacaggucuggcugcuucagcaggguuuugccuucacuuccagggcuauucugcaaaggaucucgcuuauggggcuuuuucagcgaaugaaccaaggaaguacccauuuguuuucugaagaaugcagaaugccacuucaaguccucuaucuugggagcaucagggccaacagaaggacuguuaaacaaaagcauguuuuccagugaggaggaggagcaggaagaaggcacaccuauaaacauaaaaccacaaauaaagaaaaauuacagcagaagcaaauccaaaagaauaaaauucuacacccuuaguguggcccaauugaugugaacuccccacccaacaacacaacacuuacaccaccaaguuuguacaaauuugguuuuuauagugaagagaugaccugccuugagaaucuccauucaaucugcagacucaauaugccacauuuucuaaaacagcugaagcucacauaauuuuucauaaaacuagaccuccuccaaacaaaauaacugaucugauuuucagagcggacuccaugcagaacucaucagguggcugauggcugccucugcucccucuaccugguuacagagcagcaccugcgccgcgcuccuccacgguccagucuucugccucccguacgagacugagaggacccaaaaagcagggcucggggcuuguaaguuucucuaugugucuguacccucacagggcuauuacgaggacaaguacauguaaacaugugaaugaauaaaggaaaugugugaaauaauucuugacacauaguaagcguuccaaaaauguucauuauuauuaugugcaaaauacauuugugggauucaacugaauugucauucaacuugaaguaaguuaaauugauguuuuucguauuuuuugaugcaaaucacagugacuaaauuccacagcaugaccuaguaagaguucacauuucacgaaauaauauuaacccucaucauuugauaauguacucugacauuuccuauuauacuuuacuuguuuuuaauacuggucaugacccacugaauucaucucacaacccacuaaugaguuguuaccccuagcaggugaauucauaacacauuaguguuugucauaaagaccaugauucuacaacagccucaagaucaucuagaaagagcaguucucauguuuucugucucccauaagauaugagccaccaagaaaacaagguucagcccccagguuaugagacaggaggccauaugagaaccuagugcucaccagacacagacacugcaagcaaaugaaacauagcuagcgacucagaacacagagcugucaugaccacaggagguguuuuacaaccugcugguuuggaaaugcugcuuucucaagaaucaaucauuagaaucaaccuucacaucacacugcauauauuucuuuuacucaaucaccugccacaggaaaagagaaugguaagaagaggcuaacauuuucugaacucugauuucuaucuccuugacuguaauccaugucucuaaagagccuccaacucaugacccucccaccccccauaagcacuguugccacugaggacacucucagcaaaugacccuacccacucucagaaucacagaguuuaaaccauggacccuaaaugacauauaaaucaugaccaucugcucuacuucaggcaggagacagccuuuaggcaugaauaagaacacgacugaagccuaggacuggaaaaagaaaaaaagcacccuaaaggguuucaacugcauuacucaacagaauccuacaggaagauaaauguuuucaacugaucauaccuaugguucuuacaucagaaugaaaggaagauuuguuuuccuuuucugaaauaguaggacuucugaaugcagaucuacauuacagcucuguuaccacaaaauaacucccagacuuauuaagaauaucauucgcucacccaguaaaaaccucagccaugaaaugcaaaaaccugccugcaauauccaugagaaauaacucaaaugaaaccagaugaaaaugcucuuuacggcuuauuuuuacagggaaucacucauuacauaaugaccuaagaguugcagaaagcccuccaauggcacaacuccacaggcacaacuuguauuagugaucccagcucagcauuugcugcuguaggcucggugaucugcaccagacagucuuccaaggcaguuaaacagaucucauuuauuuguauucagguaggaaucaugaagagagagcucaccuuagggaaucugaaucgaccuacuuuuacauaugacacccuacuuagaaaauuuauuuuuaaaaucuuaacaauuaaacugcaaguuccagcuaaugauauacacuugauucaccuggaaaauacuuaaucuugggaagaaaauaucuaggauaucaacaaguuauugcauucaaacuauguaacacuucaagaacauuauuuaaaccucccuaaaccuuuuuuuauuucuucagaugaccgagcucccucuagucgcacauaauugguuagauaaaccagaauuuggauuucaacacaacagguuauaacaacuucuuuguucucugugcaccauaauaaucuagauggagugacaaaaagccacaaaugcacaaaaacaagagugaaucaacuaugauugcacaacgcaagcaccaagaauggugcagcuagaacuuuaaagggcaguccaaggcaggagagaggcugacuaucuuccaaugaaguccagucuaagaccuaccuguuccaugggucccuaauucugccugauccacacucagcagcucugcuucucugaaauccuuauacuaccuacuuuugggggcuuaugaucacagaauauagggcucaaaugcacuuaaggggucuugauucuaaaacaaacuuuaagaucaacggaaucucagagagguuaaacaaccugcccaacuugaucuuugcccuugaucucccaaguaacugauguguuguccagaguagaggaaguauauacccuaguuuucuuuuucuguuugccuagcccagggcaauauaaaauagaagacacuaaauaaauauuuggugcucaaucucagaaauagucaacaauccaucuacacaaaaaaaaucuacugugaacauuaucuaaaaauggacugugucuuaaguacagucuuaacauauauugaccauauuuaccauguuacagauagagcccaaggcugaauauaaaccuguuagguauccccaugauguguuuaccaaguacuguguaauauauaagucacuguuucauuuuagucucucaauuccaagagguagcuugcgauaucuccauuuugcacaugaagaaauuagggagacucaaaagacuuucauguguuugcucaguaagcagagaacacaggauuccacccauauuuauagagggcaaauucauagcuuuuucccuuaaacaugaugccucaaauuaaagacuuccuuuaaauaugaacgucuaugcuucuuaaauucuucuauaagaaaauuaagaaaugauuauuucuuccucaacaguguuaaagcuuacaaaccccugcccuauacuuugaccuaccagggcuuaaugcauaccugaaacucuuucuugcuccaaaagcuuaguguaaagauugaauaucuguuccuggacuuugcacacagaccguuuaaucuuuucccugcgggucaccauguaagugagguuccgaaccuagaauguagagaauaaagauucuaaguaagcaauacaguauaacaguacuuuggugcuuuuuaaauuucuuuaccuaagagaaauuacuccuacuagggccuugacagauacuugaaaucaauagguacuuuaaacauuuuauccaaucucugaucuccuuuugggcagauaagaaggauuccacauauagcccucaacauaggcagaagcaacaucgaagaggguuagggacccacaggagugggagggacaccuagagaacuccuacaaaaguccugccuccuccaucacaccuaacccaucccggcacagaggccauugguguccaagucaaaacuugcaaccucuugccagucgacuuugcuaauuauugcaucaauaucuucuauuacuuggauggccaauggcuuuaaagcaguucagaagccacuucugcacuuuaucaacuaucuucugaggcugaacuggguaaacauggggccaagggucaucaaaguggagcccccugcaccaggcccacuggaagaccaaaugguuaccaagaauccuaguaaaugucuuugucaacugcacacugaacucacugaaaggccuggaguuagcagguagcuuauguguugcuaugaggugugcgaaugccuaggaaauuuccagcuuugccaaugauuugcugguuagacaucuccaguccaguucucugcaucaucacuugaaaaacugguauugcccucucccgauucgcuuguaacugaaaagacccagugcuaagaguuggcucuacuuccuaucugaugugugacugcuuuggaucacauaacccuaaccuaugcucaguaaucaacauuuagauuuguuccccaccugucaucacucaauacacaaaacuuaaagaauuagucucuaaacuccccuaauccuucaguccuaaaaucuucuauuggucaaccugauuagauuacacggaccugcaaacacagaugucagacacagcacaccaaauacacaauuaaacccuucuucaggaauauguggacaagaccuccuaaguaaucucaguggcaggagugguagcaucuuuaucugaccacaucuuucccauuagcuccuacaggcaugccuucacuuuccuaaaaauaucccauuaugagcaaacucuuccccugacaccuuuauaauuuuuuccccauaaacucaauaaaguaguaucacccuacuuuaaguggaaaaaguccaaaggucaccaaccuuuucuuuuggcagugaggacagcaacaagcaucaacaagccuugugaagacacaaaagauuuugcacucugguguagagcguaaguguagacuaaacccuaauaauuccagcugugcugaaggcagucucauuugcaagaggacaugaagcauuaagagagacagaacacaggcuuucacauuugcauuaugguaauaucuccuggccuaaacaggaaaaugccaagucaggcuucuccugccccuaacaaauucacuuuacggaucuucccaucuuuuuuucucuaacaaucccuuaugucacuaacauuuccugucuuauuuuaaauuuaaagaauugagaauaaaaacacucucccugucucauaguaaauauuacauggaugucaaucagccuaguuaagguaguuucuucccuucucugacagcugcacacccucaauccaagaagcagguguccuuuauagaaauucucaccaacuugggaauggaaguggcuaacauccuccucucuucgauauuguuccacccaggggaaauuaagagugaagcucaagaacgaggggccagaccuagauccauagcagauucaaaacuucuaggaaacagaaccauuuuuacauuaacaaggaaucugacuccuggaaauaaaaaauggaaacaaauccugacaucuuaggagcagacagguugcucucauauucaaaucagacauguaauagaaauacuuacaucucucuuacuugaaauuauccuuaaaaauggaaaacggggaagccagggaauuugaacuuuguauauuauucaaauuuaauuuugguagcuuugaccacaccauggcugcuaaauagaaaaaucccacugcuauuccucaugaucucugaugggaaauaucuaaauguaaacccaaaaagcaaagggcaugguuuucaaucggaacaaaucagcccugaccaacuccacuuuauaguagugaggacucuaaaccugacuucccuuaugcauaaaguucccuauaggacaacgcucagcaaccuccaccugcagagcuggacugaugcucucccauccucaaaacacauccagcuugucccuucuuccugcacccguuccaccaagcucccuccccugcuuuaucuucucccaacugccugcaaggagguaucuuaaaaaacauuuaaaccaucuccaggugcacucucacaccaccuuaaaccugaucaucccuuuccccuaaagcaguguucccaaacagaaacaugggguacccacaaaacagaaccacccuuuggagguggggcccaugaaucugcauuccuaaguuucugggucagggacaacacccugagauacacugcucuaagacaucuaaaagugguuucaguguuuucuugaauccaaaacuguuugcagcacuaaaguugaacgugccuuuuguucaggggacacuguagccacuaccagauuuucaaaggugaccauuccacugagugacuacaggacugcccccaggacuuggccacuuuccauaacgcuagccagagugcagugguagcacgucuuuaucugaauaaauacucauuugcugaacucacauuuacugcaucuuuuaggggaaaggaaugagagugaaguggcagccuugggaaugacauggcuacccaccacaucagcaacugugucuucuuaaaguugugugcucccaagcccuccugaaaucuacuccugucaccuaacuuccagauccagaacugguacccagguaugcaaugccccgaggugugugucugaaggaagagcagucaccauaauuacucaguugucugcauuucuaaugauggcuacuuauuugucagucugagaaugaucauaugccuugauuguagucacagguauuaaaugauuuuugaggaucugcuauaaacugauauugugugaauuaaacagaaaacuaacuuacuugagaaaacaaguugguaguaaugauugguuuuuuauugucaccccugcccugauacacuuacuguuuauaauuacaaauaacugcaacucucugggcaaggcaaagauuucaauuguuuaaugccuucaccaucacaggcaucauggcaaauuuuggguagcguauuuuuuuucauuacaauaagcccauuuuaaacugagucuaaggcuggguacaguggcguaaucccaacacucugggaggccaagacagguagaucacuugaggucaggaguucaagaccaaccugaccaacauggugaaaccgucucuacuaaaaauacaaaaauuagccaggcaugguggcgcacgccuguaaucccagcuacucaugagaccgaggcaggagaaucacuugaacccgggaggcggaggcugcagugagccgagaucacgccacugcacuccagccugggcaacaaagugagacucugucuugaaaaaauaaaaauaaacugaauacaaauucuuuaaaguuccuuaggcuuuuuaauaaaguaaauguaaguaaugccacacacauacacacacaaauccugauuuauucccuguuucucauacaucguuggcauuguucuacuuaaacagcgacagugaugacuccaaaaaaaauguuuagaauuagaagugcauguuaaucugaguaacuuaaguacagaaaagaguuaguacaccacaagcauuuucuacacuuuuauuuuguggugauugugagacaaacacaguccaaacaauagacuucuuguccucccccucccaacaacuaucugacuccauagcucaugcaccccaauuacagcaggugucgggcuggcauaaaggcuucuuaccaggauuccaguuuauccuucucaauccuuuucucaucucuaacaaaaaugccacacauacauguaguugugagaggcaaagucuucuuuacacucaccaccagggggcguaugggagcacaaaagccucacaaaacugcuccaggauccugccucuuccagggccggaauccgcggccuucccaggaauccuaaccuggucugggaaggggcaucacaaauaagcuggcacucagucguguauuaaaaggaucucuaaugcucccuuuaagacuuucacuucuacgccaucucuaacagggccaugcaggucuccaugagaucaggcuuuuuugguccaguguuucccaggucuuucccuacacuguuucaggccacuuggguaccuuucagugcagacugcuucaggccagaaaaccucacucccaccucuuucacacuaaugaauuuaaucgguagccagcagccaggggaguugauguggaagaugcucuaagaagcauccccaauuagcaagccucagccagaaacuaccuacagggagcaggaggcccuagcgggaggcagcccacgccucauuauuccuguagcaggaagggacguccagacgggacuccagaggugauggaaagugggggaggcacaaaagcagcaaacagcagaaggaaaugccagcagcugaggcucggcagccaacagccacgacauucagcaaucucagugugacaaacaacacaucuguagcgugcugagcaugacuggggcuccucagacagaucugacaccccuguccaccaggaaucccacccauacccgcacacagacacacaacagagacauggauggacacgggcacgcgcacacacacacacacacacagccucagugaugacuuagcaccucacugccaggaguaucuucuguaacagauauaugcauguguacauacagcucaugcacacacaucagcacccacugccugcucugcuccaugacaguacugggaauuccccugugaauuacccaagaaacaaagugggggccagugagcagccgugcuuagcuuccuucauaagcccaucaccagcaccuagguguguuuccccggacugaacaagaaauuuucccaucucuggcccccuccauuagaaaugaaauccguucugguuuucuaaaucagucuguaaaccauccugagucaacuccuugggucauuuucuuggggcucauucacucuagcucuagaaugaaggaauggggguggggaagacacaccccauuugaucuuacaaaacaguaaagauuaaugggaaaguguuuuuaaaaaaaaaaaaaccacaaagaagcuccccacucaguagcaguuuugcacauauguacaaugaguuuaccagcccauaaauauuuuuaaccaacacaaccucaugcugugguguguacaagggucugagaguauaugacuggcuaucauuucuugcucugggcgagcguucgccucuuugcaucuucuucucuaagucacuauaaggugucagugucaaucauuacccucuccagguccugccgcaggugcgugaacagcugcagccuccuaaauaagacauccugcucccgcuuggcuagauuguccucuucaucuuucuuuggggugaucaggggcuuguugaaguugaccuuccucuucaacuuccaguacugguacaggaaauccacuacuuccucaggcagccgcagagcccuggcaacauccagcagguugacgaagguguagaacucauccuccaacugcugcagcuucugcuuacggacacucacccggugggccuccucccgguucugcucaaggcuggcaaagggcuccagcggauuccggggggaacacucaggggccccauucuccugugcagcccccuugccaagacucuccucggguuuccuaugugagcugugcuuugggcaauaggacuugaacuugacuucaucauucucugcuaagauggucuucaucuccaggccccggucaaaagcacaggucacauggaaggcugugcggcaguucuucacagagcacugucaagaacacacaaagaacaugagaauagaccauuauagagcaaugauggcagaaggccugcagugcuaggcaccccauguacacaugcacagagaagagccaugcuucaagcaugugccaugacaggaaaguuguacguggauuaacccugcaagauccugucauguuuuaaaagagguaaggcuuggaauuuuuuuuauagagaugaggucucccuauguugccuaaguuggucuccaacucuugggcaaaagagauccgcccaucucagccucccaaagugcugggauuacaggcgugagccacugcgcccagccaagucuuggaauuuaagggcccucuucaaaugaaagguuuaaucaaccaaacccuaacuuccucagaaaaguaacugcauccaaaucccaucuuggagcagacaugauuacacaaaugacauguguagagaaaggagguguggcacuaggaucauauucaaaagaaucuguacucaauaugcaaaguccacuuucaggcauuaacuuggguuuucuuacagauuugagcucuuuuggugcaaaccugaauaagaaccuccuugggaagaaugacuacuacucacaguuugaacauaaauccugacuccccagccaggaagagucccaacacgagugagaaaaugaacagugcacuuccuugaagcagcacgaaggagaaacugaauaaaaaccccaaaaaauaggagacaagaggaauccagcacaggaaagguagggaaaggucuucacacuugcgaagaagcuucaccagaugcauggagggcucugagcccugagaucggugcacgccgauccuggccacugaagagaggcaggagaaccgugaaagauccuucccaugcgucacagggaggucaacguagaggccagguaucagcaaccuaugcagaagaacacuuccccucucacugccuaaacagggccacaauuuagugccuuugauccagacaacaagccucuggucuagcaggagcaaagugauuaacuccuccuccacugaucuugcugagcaaaucccuagaaggugguuccucauggugacugaagccagucccugaaaagcagcacugcauugugugaagccaagugaucaccggggcaugccaggggcugcacagagcuguagaauccagcggcuucaagccaacugagaaguugaauucaacucauucaacagauccugaaucacaucaccaaggauggcagaggcuagagcugaggcuuucccccuaaucauuccaguauuuaagaggaaacucacugccaaccaggcuuucuuccauuacuaugaggucucuuuuacugagaagaggagaaaauccagcucccuucaccauuccacccuuacaaacacuucaaccacagagacugacauaaaucuguauuuucucuauaaauaaccucaauucuaagaaauguaugaaaucagcuuugguggcagaacacacacacaagcacgcacacauacacaccuggccacugucaugagaagacaaagugucuucccuuguagcacacagccaagugggaaguaaaagugggaacagaugacugagacacuaucuguguuuggcuuaaacuacacuuaacccaagcgcucuaacccuaaagagaaaugaacugcagcagaauauuuauacaggacuuuguaaaaacgccaaauggccuuccucuggguuuucccauucagguugacucagcaaacagauguuacagaaacguaaaccagagccuucacagcugcagacauuucagagaggaauucuuuuaauaaaaucaauccauucugugaagauaugaaaaaucaucagccuucuuuggccucuucuuuagauuaauguucugggaaaaagaggucaauggcaacaaaaaagucauuauaucaucucucuucaaaagggaaacaaagaucccauucgcccaccucuuuuaaacauuaauuauggaccagauuggcauacucaggcaagggcauaaauucuacgcucagaacaccggggaauguggucugcugcagccuguuuccugccagugcacacgugcauacacauacuuacacacucauacacaugcacacucacacauacacgcauacucacacacauacacauauacacgcaugcauacacacauacacaagcauacucacacgcauacacacauacacaugcauacucacaugcauacucaugugcauacucacgcacucacgcgcauacacacaugcauacauaugcacacaugcauacacacgcauacgcacucacgcaugcauacucacacacauacacauucacacacgcauacucaaauacgcauacaugcauacagcauacauaugcauaaccaaauacacaugcauacacacauacacauaaccacaugcacacucacacccccacacaugcacacauaugcaugcucacccacauacgcauacucacacacacacccauacacacacacucacacaugcauacacacacacacucaaguucaucagcucccugcccuuuucucuuccugcuccacucuuuccuccuccuuccccaauccaacucgggccagaggcguuugucauguauucacaugccaaaaauaucuccacuauuucaagguccccagccaaaucccaccagcugucucaugacccacccuccaaauauuucuguuauauuuuggauucuugaacacuagucaaagugauaaagaagaaaaguagaaccacuuggcuuguuaaaaaaauuuaaaaauagccaggcgcgguggcucaagccuguaaucccagcauuuugggaggccgagguggguggaucacgaggucaggaguucgagaccagccuggccaacauggugaaacccccaucucuacuaaaaauacaaaaaugagaauuagccgggcuugcuggugcgcgccuguaauccuagcuacuuaggaggcugaggcaggagaaucgccugaacccgggaggcggagguugcagugagccgagaugaugccacugcacuccagcuugggcgacagagugagacucugucucaaaaaaaaaaaaaaaaauuuuaaaaccaccuucccaaaaaguauuuaucagucaaaauacaaaccgacuuugccaaaugaggucauuucuuuaaaacccauggcugacaggaugaccaugcucucggagcuuaugucugugcugagcugcuuugagaaagaagccaucccaaaacagugccucugcucccagaauucaaugaggaaaccaaggaagaagagccuguggccugugcuaguacauccgagaagauccaaacuuaaccugaagggcccccaucagccacacagcacugcaggccucucuaauccugacugucuagaugucaauaaugugaggccuaaaaacgaacuucucaguagggucuuagaccacaugaaaaacagcaugccaucuauauucccuccuuaauuccccuaucucaugacauccuauacuugucuguaccuggauaugcaaaagcaggcaggcaacauguuuacacacaggugugcacgcacucuuucgcucacgcucacacacacacacacgugcaugcgcgccuggugccauaaagaaucagacauccaaaugaugccccaaugagaugacagcauacacaggaacuccucacagaugccccucuacccaggccguguucaaagagucucuguuuuuccaacugcaaaugcauuagcauguccccuugauuacuaacagaugugcgcacaccauggaaaccugcaaucucaggaggccgccacagaggugggccagggucugcagcuacacucagugacugcaggugggaggguggccaacucucaaaugccgugucaaggaacaucucacuaagacugcuaggagguguuggccuauggaaagaaguugcgaugcuagacuuugggcagaaaggguagcgagagacaaacugcaaccgccucacagcucaggggaacuucugaacuacccugugacugugaaagcuuggguucuaguuacaccggauacaguuagccuauuaaagguguguguacuggggcuggagucaccccuugggaaccucguccugcuuccuggauucuaguccccucuccaaacccuuggacaguucacagagccuucccucauccugcuccccaccacgcaggaaaggaaaaugaagccauucuuaggaagcuaauuaccuguauagaggccccaaacuucucauugcagaggcugcacacuagcgcccaccggcugcugggaaugugugacaccuuggugaugggcuccaucuucucugggcugccaaugcucaccuaaaggucggaaaacagcaagacaggguggcucaggucgucaaaggcugaacaugaaugucagaaacuaaaagauccauuacuuuccuacaucucuccuaccagacaguggcaaggggcacccacucaaagcaaacccuuacuuuaaaagccucagaacagccccagugacaacugagcucacagcccaguccccaucugacagacaucccugucugucaaaaacacuuagauaacugaguuuucacuucucaccggagcgucugaugacaaagagucauguaccaggacaaugccgucuauaaucucuagcucauaacaaauuggugaagacuaaaaauccaucuuaaaucgauucaaauagguugucaacaacaggguaaguaaauauaaccuguuuuuaaucucucgccaaaaaaaaccauuuucuucagucugaaacaugacuacauucaagaugggaaauuacaaagauaaauaagguaucaucucugcauucagccuggaucaccgaauuguaucccaucaauaccaaaccacgagacucagugcuaccaagacccgaaucaugaaaccucaauccaaaucauccucaaauaauauuccccaagaggaaaauguaccaaaaucacacccaaaacaugcuggaauuugaauagcaaauuauauucucacacugagcuaugcaaauuauauuagucaaggucugagacuagaaauaaauuagaccagaccugaaauuaaaaagguugaggcacaauaagaguuuaaauaaaaaucaccaaaguaugccuaagaguggugguuuuuuaaccaugguggugccucaacucaaguacagcuugccacacacaggauguacagcugauccuuggggaaugacacacccaggccacagcuguuuaagugcuacaggucugcuccugagagugagagucgcgaugggaaggcucacugugauggcugggugaccaccacuaacuuccagucccaagugacugcugcuuccagcuaacauuuccaugaaucuacauuccaugacaagaugagagugugcuuaagauucaguuuuuccucaaggaaaaagguagcaacuaaaagguaucuuuuuacucauagcugcaaugcugccuauuuaugcaugguucuccacccacccacuaaaucccaguuaaaagccaggaccuucugagcuaaggugcuauuaaaaaccaugcuugaccaggcacaguggcucacgcuuguaaucccaacacuuuggaaagccaaggaaagaggacugcuugaucccaggaguuugagaccagccaggucaacaaagugagauccccucacuacaaaaaauaaaaaauaagcugggccugguagcacaugccuauaaucucagcuacucaaaaggcugaggugggaggaucacuugagcccagcaggucaaggcugcagugagccaugauccagcucacugcacuccagccugggcgacagaguuaaacucugucuuaaaaaaaaguaaaaacaacaaaaaaagaaccacacguaccucagggauccacagagcacagcuaacguggacccacuugguuccgcuacgggugggcuucauagcuccacccuucuucggacacagcagacauuuuggcugaacccccagggcacauguccggcacagccagcugcccucugguaccuugaggauuccauaacaggccugugaugccacggcacaucccagaggaauagagagaaagagaaaauguuauuuuucccauuauaucuauucauuuuaaacacuuagaaagauuuuaacagaacuaccaccaaagcagagacgcucccacagcuuccuggcuacgaccgucuccccucgggaaaaugcccggcagccucacaggagcauuuaggaggugaauauguauucauaauagaggugagcucugcugacacaauacauauuuauuuagcagagggugguccuggaaacuacuugaggacagaaagguuuaaaugaaaucugcuuugcuguguugccgcagaaacccauccauaccaaguuucuaaauauugagcaguaaguccucaguaaguccucgaaacacuccacaggguuccgugagagaagcuauuucucuacuuuacugacagaggugggguggaauacagaguguggagaaaaagcauacagcagcugagagaaucucccaaagcugcugaaugagauggcaauggaacaggagagaagcaugcacacucccuaggcuaagcaaacuccauaccaacuagaucccagcacucucccagugaacaaaacagggcagaaaaaggagaccuucuacacaggaagaaugucgucuccuuagcugguauuuaaaacaaauucagccuuucagaaauggagacaaaaaaaacaauuuaaauuaaaaaauaaaacaaagccuguuuuguacaagauggcaaaauuaaacaagauggcauaaacugcagaaaucaaggcuauuacaacuaaaguaauuaagacaguucaaagacagaaaagguuaauguuaaauaacugaauaaauaaaaaccacgaugguaccaggagcauauucagagagcccuuuaaaaacccaacuguucagcacuuuauucauaaaugaccuggaagucaggaagucgagagucacaguagcauagcucuaauucuucagacagaaaaaacacagccacuaugcaaucugaauacccacgacgaugcaaagaggaaaccacaaggaugagaguugagcaaagaaaagucacacuucagauggaagccucagagugcuguuugggggccauaaauaagcuaccgucaacgcagacuuacuagaaaaaaauuuuuaauggaguuaagugacacuauaaagguuucaaaacacuaaaggucuguaucagacauucuacagccacaugugaaggaagaaauuuuuuuccuggaaaagcaggucuaaauuaauuuaggagauuacauaaaguaugccuuaaagauaagccaugaaggauuucucaaaggaaaaaugaaguaaauguugaggaaaagagaaaaggugauauggcagaaagaagagaaggugagaagggggcauccaaaagccuuaaguuacaacucugccacacguccaccgugagagcuugcacaagccugcccugacaucaguuaacucacugauaacacagggguugaccaguuuucaagcagaaagcuuuuacucaaaaaaauuuuucauggggaaaaaaauagcaaguaaagacaagaaaaagacugagaagucagccaaguaaauacaugaagcaccagcaaccaaaaaagcaacacuggucaucaggaugcucaugucacagaacaaagccaccacaggaauucucacuaccguaaggagacuucccagacagugugagauccagagcaacagacggcgaugacugaagcaggagucgcaggucucccuaucaaggagccaggacugggccacagcuggggaggucuucagacagagggaaagccuaggaggucacaaauuaugaagcaaaggguaaucaagaacuucauggagcaaacgugcuucuucuucccaagaagucaccaagcaccuauuccauacaagucuuucuuuuaaguuugcuuuaaaucucagcaucaacaggugaauuuaaagaaaguacuucaggauagccuuuuaaauccuaagaauauacgugggcacauguccccacccaaauccaaauuucuucauuacugcauuaaaaacuaaauaaaaaagaggcacugagauugucauaaacuuuuuaaguuaccuagcgcccauccuccugaaaucuaaggguuucccuuucuguggaugguagcaagcaaucaccaaaaccuacuguccuguuuuuuaagacaggaaaucgucuucaggaaaaggggcugcuuuccucuaacagcucagcuuauacccuaacacaugcucacaaauaugacggcaaauuguguccucuaaaagacauguugaaguccuaacuccaaauaucucaaaaugugaccuucuuuagauuuagaaguagucauugcagauguaauuauuuaagaugagcucacucugaaguagggugggucucuagucccauacgacugguacccuucuaagaagaccgccauguggaccgggcacggugccucacaccuguaaucccagcacuuuggaaggccaaggugggcggaucaugaggucaggaguucgagaccagccuggccaacauagugaaaccccaucucuagccaggugugguggcacacuccugcagucccagcuacucgggaggcggaggaggaagaaucacuugaacccaggaggcggagguugcagugagccaagaccacgccauugcacuccagccaucucaaaaaaaaaaaaaaagaagaccaccaugugaagacagagacacagggagaacacacaugaugaugaaggcagccgcgagccaaggaaugcccaagauugcccaaaucaccauaagcuacgaagaggcaaggaagggcucuccugcauguuucagaggaagcacagcacugccaccaccucaauucuggacuuuuaguuuccagaaccacaagacaauacauuuuuguuguuuuaagcacacacagucuguaguaauuugucuguuccacagggcagcuguaagaaacuaauacagcacacuaaccaccuuuucaaagguuuguuuucucaguguucuuaauaccuaaauuuaaguguuacaguaggacagagggggcucauacauucuuuuuaaguaaacuugacuuuuauggauaagaauaaaacacugugaagaaagacgauuuccacagagggugcuauccuucuggcugcaaaagcagaggauauauuucaaucacuguaagaaccuacuagggaaaaauaaagucuauagggcacauuucuuuaaaucguagaaacacagaccccauucggaggaagaauccuggacuccaggcauacacucccacagcagacaggcucaugccccagguuucuucuuucuggccucccugccccacauaccuggugcacacagauguugcauuugucacagaacaccaucucauugccguccucaccaucaggagacuggcagacaucacagacaacaucuucaucauauucgauccccaggccuuccucagucucuauggcaugauucauauugucguagcaucgcugcucaaauuccucuaggacccucuccaugguguauucaucuaguucaggcauuccugaaguuaaaaaugccacaaaacccauuuuaauaaauccauauuaauaaauauuacaaaauaguacugguuuauuuauacuuaaaaauaauguauaaugaauaaauaauuguacaauaaauaaauccaaucacuggccaggcgugguggcucacaucugagcccaagagcucaaggucagccugggcaauauaguggaaccccaucucuacaaaaaauaugaaaauuagccagacgugguggcacacaccuguagucccaacuacucaagagccugcggugggagaacugcuugagcccaggagguuggggcuauagugagccaugacugugccacugugauccaggcugagugacauaagaccgugucucaaucuaucaaucaaucaacccaucgaugcauccaucucugagggccccaaaauuuuuuauuaaaugcuuaucagauccuucuaagaaacaaucuucaaaggggagagucuuccaggaaacuguuauuuuccuauggucagguagugaagaugcaguguaguaaauggaaaagcaaaagguaaauuuuaaaaggauucaaggauauuaaauacauacauuguugaauaagucauuucauuauacucauuacacauaacaacuaacacguaagugacuucaaaaccaugacuucauauaaugguauggauguuuuuaaaaauuugccuuucuugguagguaaaacaguucucucaaaacagauuucacuuugggcacucaaauauuuuuaaaugguuuaucccuccucauccucuuacuucuacaagguugaaaaacauaguuaaccaaaugcaaaaaagacugaaacaccaggcgcgauggcucaugccuauaaucccaguacuuugcagguagaucauuugaggucaggaguucacgaccaaccuggccaauacggcgaaauccugucucuacuaaaaauacaaaaauuagccaggcaugguggcaggugccaauaaucccagcuacuugggaggcuggggcaggagaaucgcuugaacucaggagguagagguugcagucagccgagauugcaccccugcacuccagcaugggccacagagcgagacuucaucucaaaaaagaaagaaaaaaagaccaauaacagcuaagacaaacauauuuaagcaugcguuccguuuauguuauaaaauuacaaaauuaaucuugccaauguauucaacaguaucuucaaauauggauuagcccaguucuuauuauuuaaaccauucauaaaugcgaagagucuuugggcugaguccucugacuuaacacaggacaccuagauuccagucaaguguauuacacuggucuuuauaaugugcuuacaacacagcagaaacuguaucaucugugaagcuaaaauuuaguauucaauuccaaaagaucucugagaacuccugaacucaugccauaaaaccaccuuguggccugcuaauguuuuggccauuaauaccuaaagcaggaccaagaagaaggaagucuauuuugucuauaaaaacacuugaguaacugagcgaguagaagacaacaccaugcucagcucagucuacauuaucacucccauucaacagguggugagccuaauggcaggacaagcaucuacugcaagccacacccuaugcuacguucccuggaaagacgcaaaaggucuuggcccuucaaggcugugaaauccaccaugacaaaaaucuugugauuuuuuuuuuuuuuugagauggagucuggcucuguugcccaggugggaaugcaguggcacaaucccggcucaaggaaaccuccacccccucaagugacuugagaagaaucaccucaagugauucuucugccucagccuccugaguggcugggaccacagauacccaccacgacgccuagcuaauuuuuguauuuuuaguagagacgggguuucaccauguuugccaggcuggucuugaaguccugaccucaggugaucugcccaccuuggcuucccaaagugcugggauuacagacaugagccaacaagcccggccgaucuugugauuauuuacuauguccuagauuacaauacauggcccuugccaccaccuccccaccguguaccuacagcacaaaagcuaauuaauccucacaguuuuucacacugagcccagacuugacuccacugucuuguucaucaagacccucaaggcaacccuuagcaaucaggacuggcaugugagaugagaccuauacgccaucccagucucaacaccaugagaugcuccaacgucuacauacgcuaaaaugagcuugcagaaaagagguggagaagggcugggcacacagcuaaugucaggcuucacugaaggaaagccaggacagagauaaacggagggaaaaagaacuccagguuugcagcaugacauaaggaaaaucgcucaaguuaaaacacacaugaugugcuuggaaauggggagcaugccuggaagaguguucauuuagagaagcagcaaaccacggcuaaagaaggaauccgaauggcaucacaggaaaaaaacacuagagcagguaacugugggccaugcccuuuugucacuucguuucccuggacuucagcuuccuuaagguaagugaaugagggaguuagaucagagcggggaugggaaucccuggugccugagccgaggagccuugcuuccacucugaaaccaucucagcacaucugacacagccaaacaggcugagaucuaaggcagggcugcgauucucacugacuaaagcuaugauggagcugccugcaacuggcaauaaggagcuuucugcuacucaccuaccugccuaaaaugucucuauucaucauugguuaauaaaauaauagaauacauggucucucacccaucuccuuaaauucuucauuggucaguuccagccaugcagcauccaugucauugaggucauagcgacacacgcugucagccagcguccggauguccacauagcccaacucgggaggcucagagccugaugacacgauguacuucuugggccugaugaacaugagggauuucucuucagacacaacccuggauaauaaaaaaacaaggcagccagguuacccuuucagccacagacaaugaagugugccacaaggccccaaaugucuuccucuuccaacccuuagagccccaggucaucaccagaggcugaaaaccugaaugucacugcuaauaaaaccuuaacuagaaguuguuaaagccugcuaacaggcaauagauacaaaugaaaacacuguagaagccuucaaaaucugcuucccgggacccugcugugcccugcccaccaccucugaccacucuggccugcagccaacaccaaaacacacugacccauacauuucaagaguuagucauuaaaucacuuucccuuaaccagaccugcccaucccugcuggaggccauuagaaccagggcaccacacaggcagggcaggcgcagcagacucugagaaccagagggagaaacccgccaacccucacaccucacaaaaaaaaagagggagagagggaaaagaaaaucaggccuugggcuggggcaagguggcccaagccuguaaucccagcacuuugggaggccgaggcaggcggaucauuugaggucaggaguuugagaccagccuggccaacacagugaaaccccaucucuacuaaaaauacagaaauuagccagguaugauggcacacgccuguaaccccagcuacucgggaggcuggggcaggagaauugcuugaacccaggaggcggagguuguagugagccaagauugcaccacugcacuccagccugggcaacagagugagacugucucaaacgcaaacaaaaaaaaggaaauaagaccccggccauuaccaaaaaaucuaagaaacagagucccagccaagaaggggacugacucucccaacauauacccaugaucccaggaacaaaagcacaaguuucuccuccugguacugccacacaaucucucccgaccuuuaacaccuggaguggugccuuccaacucaccccacucaaaauaagacugcaugugcaagagcaaaucacucccgacuuggaaccaaaaaaaggccaucuuccuaaucacagaccccaggccucaacaaaguccuuccacauaugcauuuccacaguuuaaauuacugucaacaggcugcccagagucugucagaguaccuucaucacccuuauauuacgggagugauuuuaucuacgugacacugacauggacaaacugaagggauuuauuucuccuacucagccaagagcagggauccaacuugcucagggcuccaacuuuaauacagcuuguaaaacuuccacaagcuguauuaaugcucacuucuguccuggcuccccacugaaagugaagcauucagcaagugauuccuggacuggggcugccagugcugaaucaggugaugcugcaucucagacacaggcucugaggcagauaccuggucugccccgcagggccccaugaccacuccauuccacagguccagacucuagccugugggggccauccuggcacuccugacuggucaccuaaaccugaguaagacaggggcauuugucaccacuggauagacuccccagagaucccaaaaugacaacucaaauuugauaaucuuaagugcccaaaaaaagagacacaaagugggugagggccaggaagcaaguucaguaaugacucagcguggagaaagacacuauuucgcaaagcagcagccaacugaugauggcggagaagccaggugccggcugagcacagagggcacucaagccucccuccuaacaggacucuccagguggcacagaguggcacagugaggaaaugaguaaacuagcugcaaccugauugugaggagagucggcagggacucgacccugagggauccuuaaagauaagucaguaaauccagagaacguaccccaagaauaaugugaccagucaaaauaaaucccuccaaaacuccccucuccacaaacccuaacugacaggucuccuaacaccuguccuccuccaaaggcagaggcaaccgcaguaggcagagcagcugcccgcgcuaguucccaacaaagccagaugcuucucuccaggagagccacucuccagagcgaauacggagggcaggaaaagaggaugcagacgugugaacacccaaauuuuccuccccuagcccaucacuucccaggaugucuuggaauuugccuuccucucauaagaaagcagcaccuccccacagugguggcuguaauguuaaguuuggaggcucauggcccucaaaaccacuacccuguaugccugaaguauguugcuccugaauuucuauuuccacuugaggccucaugauauuuuaaugcuaacucagaaacugucucuucccacagaaauugucucuucucagaugccugcugucagggaagaagagcaaggguggguggagaggcuucuguccucagggcaucucuaccuggccacaggcugagggaugguccccgggcucacaggcaccuggaccccuuucucccauuccugucuccagggaucugccaacacauaguacucauccggauucagcugguaggagucaugcaacuucauggcagugaucaggucuguccuaaacaccuggaaaggaagagaaagggacacugacauuugauauuugcauucuuauucagagugcuggcagcugcaauguaaccauggagcugccauguaacaaggucacuguaucaacauagaacaagccugaccuauuacagaaaaacuuugccugacacgccuuuuaccucacucaggcaugggggguggcagugcugagggaacacugcccucucacucccucaguccauaguguccacaacaacgucaacaaaaacaacaaaaaaucuuguuguccgccucugaaaaaugucucucaguucaccaaaagggcugcugaaaacauguaccuggaaaucucugaagggagauacugcacucaagggugcucuagaaauauaacuccacuaaccauguaacaacuucaagccaaaacccagaaccaccagggacucaucuccuuuuuuuuuuuucugagauggaaucuugcucugucacccaggcuggagugcgguaacacagucuuggcucccugcaaccucugccucccagguucaagcuauccuccugccucagcacccccgaguagcugagauuacaggugcacgccaccacgcccagcuaauuuuuguguuuuuaguagaaacaggguuucaucauguuggccaggcuggucucaaaccauugaggucaggaccucaaaugaucuaccugccucggccacccaaagugcugggauuacaagcaugagccacugcuccuggccagggacucaccuucuauaaugagacugcccccacccaggcccuaccucccagggcaccaggguuuaugguaugguagcuggugaagucaaggucugggcuggccuagaaaaaucuggaagagaagcaaccacaggccacuggguugaugggccugcaaaaaacauguuugcacaccuucaccuggcaaaacuucuaccugggaagaguuauuuguggggaaaggaaauagagaaagucacuacccucuccccacucugccaaaaacaggcagauccaacagugccccucuaccgagagagcuccccaauuccuuaucacaggccaaaugaaggaaaccacaggaaaggcagccaucccagugccuaugccacugcagacuccugggccuguggcauucauccuuggucagugaggccugccccugggguggagcacaacaccgccucccagccagggcugcacagcuggcucccucucaagccucguccuuggcccacuggugucuaaggcugcauaagaaagcucugaccuugacaucaggaccagcccaaaguuguguuuggcaucgagcaagcuugcaucuguaagcugcccugucuguuuacacaagucacaaugcugaacucucuuuucucaggacagggaguucuuucuugugcuacuaagcacaguucacaucauacgccugcuaauagguccauauuuguuuuuccugguggcuuuucaggcuagugaucacuuuaauaaacuuccccauaauaaagucugaggcagugucugaauaaagaggccauuucuccugccugucauuuuccauacggacuauuccccaguaugccacucuucauuucuaaagaccuauuaacaagcaagaauuaggccaugcaccucccacaaaaaucacguguaauaccaggauccuucccuucaagcauagagccgcagaagcaggugcccagcccaguggacaccaacucccuggcccccaagagaaaaguacuuuaaaaccuaagagaugggccuauaccuucaagagccaaucagguaaaaacauauuccaacuaacugauauaaauaaaaaacaaaggaguuugccaaaaaagaaagaaaaucaaacugaagcaaugaaaugaaaaaaaggcagccugcuauuccuuugcucaaagacucagucaagaacugaaacaaaggcccucaaauggacgucaacucuggagucucugguagaguauguuagugccauacauauaguuuggacucaggguugagaaaaacaucuggaccaaaauguagggcugggacaaagccagcacagcaacccgugcugcugggcccccuucuccaugcuuggugucacugcuggaaguagguuucgaacuacaccacuggggaccagcccucgucacaccaggucacagcugcuaagucccccuuguauuccugugcugaaguaacaggaguuuagugugaacaucagaaagguauuuuggggguuacagacacagcacaaggaauuaagaaauaaagagcagcagagacacuccuuggcaaagaaaaggaagagagcacuaaagguucaaaggaaaaaaggccugaaauaaaguaaggggaagaaguggcuaccuucccaaguacauuugaucucaugcuaaagugccuccugggaugguuuuccacaauucuaaaggauguaaacuacuuccucauggaggaagcuauuccacaaccaaauaacuccuccacuccacagcagggcagccuucugacguucccuauuagagccugggaaguuccuccaaggaauaucugccuaugcauugccauuacaggaugaggcuguuugugaacucaucccauaagaagcagcacaaagcaaagcauucaaccaaagaaacucuuccuauaaccuucucacuugaaaacugugauaaaauaaaauguuuuucuucgaugauuuaaagccuagcaaaagucuuuagaauaaacagaccucaggucucauaaggaccccuaaacaaagaccagcagaaagaaaugcaccuaaaagcaacuuuagauagauagauaacaaaaguuagggagcagaggaaacauaagaugagaaacaaauugagaaagaauggggaaagccuucagcauaauccccuaaacaaaagucccagaguuuugcuuguugccaaauaagccacaaacccauggcuaaaacuaacuugaggcuggcagugacuuggcagcagcugaaccugcugauauccuggccagaggaagaaaaguuguugggagccagcgaagaugcaacaagaaaggaaaaaaagaauguaauuaauaauaauaacuaacauuuacugagcacuuuuuaugugccagcaacuauucacaugcuuugcauguauuagucuaugugaauuaacccacuuaauccucacaacaauccuaugagguagacacuuguguucuccccgucuuacagauuuggaaacuggagcacaaggauuugaauaauuugcccaggacugcacaaauagauaccacucaacuaggcauaugggauagcauauauucaugcacggucaggcaagcauucaagaaguaccucugaaggcuuucgaucuucaugucuggagcaggagcuucuccuaugcugggaucgggaauucugggaccaaguaguugacaggccuaaagaaacaaauauccaaauaagaaccauuagaaauugcaggggucacugaguguucucagggguuuucuuacccaaacucaucccaggcucaccucagcacugcaccaugagaccaccugugaugcccuccuggcucucacagagcucuuccacguccaucaguuauuuaacucucaccucucauaagcaggccuaaugugcucauucugugcagggaugcuguaucaaggaccacacccaacagaagagaggacuuuaagaacaccaugcagguguagucuucacccauaagccugcacugaagagguucaaagucucaugcugcuaaauacaaauugaaaaaauaucaggccagggguggcggcucacgccuguaaucccagcacuuugggaagccaaggcagguggaccaccugaggucaggaauucaagaccugccuggccaacuuggugaaaccccaccucuacuaaaacuacaaaaauuagcuucgcgugguggcaggcaccuguaaucccaccuacucggaaagccgaggcaggagaauugcuugaaccuaggaggcagaggcugaagugagccgagacugcgucacugcacuccagccugcgggacagagcaagacucugucaaaaaaaaaaaaagaaagaaagaaaagaaaagaaaaacaucuuacugaguuuucaggaagcuuucuaaaacacuguuuuaaaaaaagguuucacucuacaaggccuaaaaacuuagcaaucccuagacagggaaccucaggccuaugguguaguaaauagcuagcauagugccauaagaagagaggacgggagguaaacaaacuuagugaagacuaaggggccaauugccaaauaaccuuuaaaauuugcuccacuuucccaugaaaauuccaguuggcucuguucucugccuuucuuccaaaggggggucuacuccuaucaucuggccucccccagaacaugguaccuaacugcugccuaacagggucucccaacugcugccaagucugaucucuucucugcccugacacuucucagcaccaacaacuccauccugccugaaauacucccucagccucaguggcaauucucuuuccacucuguggguuccuccucuccauguaccccaucaacauggguuucuccugaacucuuugcucuuuucuugcuccaaauauucuccccgggggugcucacccauguccacagucuuacccagcacacccagaggaaccugccagaccuacauucccagacuaaccucccucccaagcuccagauccaguuucaccuucacauaagacaucaauccuaagguauuccuuagaucugucaacucagcauuauaaaaacugagcucaacauuuuacccaaaccuguucugccucuuacauuccuacuuugaugacuauuaccaccauuucuacuugacgucagaaaucuaagaguuguccuagacucuucucauucaggacacaaucaaugguaggucaauucaacuucccaauaauuccagcuccucuucuccaucucugccucugccuccuguuaauuuguuacaaagacaacuuaagugcaaaaccuuccauuugugggugccguacugcugccagagaucugaaacaacccuaacacccacauguaguauuuguccaacuuucugauaauucaccuccaccuccuauuuuuaauaaucaucaccccaauccugaacaccuacuguaccauuuuccagaaauuaacaaaauccagaaaaauaaaagccaaaaaagcuuaagguuaacugccauucugccagugaaaucauuugucacucagacaggaagcucuuaucucuacagauuccagagacaggaacagagaaucaaagcacccuuaagaccuuggggaccuuaagaaauagauucugcacauaagccuaucaucagauuugcgaugaccaagaccaaaugggauugccaugcuucccugacagggacaacaucggcacuacccuugagcaccaguucugaggcucauuacuaggucaacugacugcuguuccaccagcacaaucagcagaacuggagcuccugcugguggccccauggcauuucaguaaauguuuuagaaaauucuucuuuaaaaaaauacuaagugugccucuuuagacucuaaaugaacaagaauauuucacucccacacugaaagaaauauucugggcacacuggggugagcccaaccugcagaaguucuaaaucuggucauuacuggaaaaaaggaagacagacgccaaguuaggaaccuggagaugaagguggcuggguggcuccuagggucuauaaagaggccucucuuucucccucuuguccuggaggccauccuccagccgguccacagccugaaagaagagacgaggaaaagcacacgcagugucuggauggaauuaucagaaggucuggggaagggaagagaagcagaacaaaaagggaugguccuccucugcuuugaauuacuauggaaaagguuauaaaugauaaggaacaaagccagaaauuuagagaaucacuccacugcuauacuuuaaaaauuaacaugaaguagggagaagagggucuucagagucaaauacuuucaggguuaaagcagaaacaacaaauucauucauucucagguuuucugacccucuugucucuuccugaggaucugucaggaucccucccaaguaguuuccaagguucccaggaagcuugcagcuuugcuggcauagaacacaacccaaauaaugacacucauuugaaaacuuuuccuaggacugcuuucauaaauccugaaaauugcugucuaugccacauuugcuuuuaaaaacagauauacaaagaugcuacauacuugguauccaauaguaauaaccaagagaaacucuaguccacccaaaaauagucuguuccuuuuccucuuaauuuaccuaguguugauacaauacagaagaaggaaaagcaaaauuaauccuauuaaacucacuuugcagacagggaaagacugguaaagaaacuaaauuuaaauuaucacuggcauaaggaaugcucuuagcagcuuauuuagaaaagccaaaaaucagaaacaaccuaaacauccaccaacagacugugaaugaaaaaacucugguauauccauacaguggaacaccaucacaguggaacaccauccagcaauaaaaaggaaugagcuacugauacaugcaaacaugaauaaaugcugaaguaauucuccugagugaaagaagccagaccaaaaaaaaaagaguccauauuguauuauuccauuuacauacaacucuagaaaugcaaacuaaucuauagugacagaaaguagaucaguggaagacuagagaaaagugggagggaaggauuaucuugauuucaaugauuucauggguauaaacaugucaaaacguaucaaaguacacaauuuaaauauaugaggcucagaggcucacuguaugucaauuauuucucaauaaagcuauuaaacauuuaucacugagauaccauccacuaacaguaaggggaaaaaaauucuauuuuacuuuacacaaguggucuguauaaaaccuagacuuugcugaugaaccaagugagaaucugggaggggguugugaacccgagggaacugcucugccuuccaucuccaggagcagguauuugcuggugaucuauuccuucucauuuucuuguuguaccaaaaaguuaaucuaucaagagccacugguauaagacgcagaauuuacaacauagagcauagcuaaguuagucagugcugugcacacagcagauucucaauauuucuuugaaaaguagauaauuuuuuuuuaaaugucauuguugaggacagucaaucaugcuguaaccauugcuguaacccaugaacugaagguggcaggcacuaagaauuuacuccuguuucaccuaauagaagacaugcguuugagcucaaggaaaauaaagcaauaauacauuuaaagauagauuuguggagccacuguuuccugcuuggaaugcaccuacaucuacagaaacauucauggaaggccacaggcuagagacucaaagggagugucuugacauugcuacaccaacaccucucccuacagccaggcucuccccagacauucccaggaggucaggaagcuaccagaauauuauuaaaaucaaaacacuccuuuuuaauuaaaacaaaauuuauaaacacuuucuggaaaauauugggggugggacaguggggucaaaccagaaauuagaauauuuuaaauacuaaaaagaccaggagucagugauuuauacuacagcaaaacaucacgcacuuauuaaaaacagugugcuugcuauuguuaaaaaccgcgugguaagauuacacuggguugguuugcauuuuguuuguuuccagagugcugauauuuaaugacaaacuaauuuaagcacaugacgaguaaaauuuuguuuuacuuucuuuucgcuuucaggaaaggaguuaggaacucuaaaaaucugcuaauaaugucuaaaaguauuuuacugccauucacaagguaaaauuauuaccuaaaguuaaguucacuuuacugacaaauuuaaaggacuuaaaauucuugacauacacuguuaaaaacaauucuauauuacauuaccucauguuaaacaugggaaagacugaguggggaaaaacauugucuuguuuuuaauauccccaacuuccauuaaaacagaauccuuuggguuaauauaaaguuauaaaaggcacagaguuuguagcaccaugagcauggacccugcccgggcacaacguuccuucagguccuauuauacagacaucuccaacacucacuccccuuugaaauauuaaaaauagccaugcugucuugcccuagaucuaaaauaaggaaaaccugaagaguaaaucuaacacauacugcacacaccuuccacauuugguagcuggugugugauaagcuucucauguugugccaugcaugaaagguucagaaauuagaaugaauggcagucuucguguuugcugcaccacaaaaugcaaacuaugaaagaaccuugccacugaucaaacagcggucauccugucucagucacugcucuggacacuaaauaauaugcugguaucugucuuuagggguguuaaaccagcuuaacaaaguaagaugcuuaaaacuggcaaguaucgaguccagcagucuggugucacagcaagggcacacagaccugacaaacgcaucuaugaguuacuuaaaagccaagcuagccuuguacuagacuaaagcaaugcuguguuaauucccaucucaaauuagggaaauuuaaucuaguuacuguuuauuuguuuuagcggcaugacagaagacaagcaucugauauaacugucauuuagaccagaggcugacccuauaccuaccauaguuuuuuaccccagcguagcccagcucuacagccaaacucacuuccacuuccaacaaacaaaggcaucauacauacauucaaagaacuggcccagaaauguuucaacauacuuaaauacacuuaggccuucaaccaacugacacacaaacauuugacacucacccaccauuucugcugagguccaaguacaagucagugggaaaauuacuaauuuucaauuucagcuggcuuccuuucugcccauuccuuaucacaggugauggggcagagccuggcucugauaggugggaagacagacugcuuccacccuagcucaggugcagaaacagggagaccagagagggcccacauggagccuggcuccagaccuucuucccaaagaaagucaacaaaucucugaaauuuaaggaagucagacaagaauaagaaguccugcucuauaacuuuaggaaaaucuuaacaguaugagcacacuucuaucauucuuugugaaguaaggaaugagaccaaucucccuuuggaccuuugagagacaccaaaguuuaagaacaaccaaaaccaacaaaaacaccauuugcuacauauauauaaagaugcugaucauacucagggggcugaugcaggaaaaucacuuuaaccugggaggcggagguugcagugagcugugagcugagcgggcaaugagcugagaucaugccacuguacuccagccugggcaacaaagcgaggcuccaucucaaaaaaaaaaaaaaaaacagugcugaucagagcuacuauuugccugagauaaacaauaauauauaauuccugauaaaaacaagguuacuugauguuuaaauuagccucuacagguuuacugaagauaacaugguauguccuuuagguuuuagaaacauaguugccucuugaacaacacggguuuuaacugcccaguucacuuacgugagaauuuucucucugccaccccuaagacagcaagacccacgccuucucuuccuccuucuccucuucuaccuacucaacaugaagacgaaguugaagaccuuuaugauuaucuacuuucacucaaugaauaguauauuuuauauauauacauauauauuuccucuucuuuaugauguuaauauuuucucuagcuuacuuuauuguaaaaauacaguauauaauacauaugacauauaaaauauguugauuuauguuauuaguaaggcuuccgguuaacaguaggcuauuauuaguuaaauuuuugggagucaaaaguuauacaaagaauuuugauuugcaggguagggggaguuguucaaggaucaacuguacugaaaguaguuaguggacccuauucccacaugugccaaaucccuaaggacaggauccugggcuggaaagcagaaaauuaaggacuuguuucccuuggccaugcucuggcgcaaugcguaacuucagagacuggcugagccacccagucccagaagcccagcaacugcagacgcugccugcaaacaccccaacauuauuccauccaacugcagggcugggccuccagggcaccuggagaaaggcuucaacuaugacugcagcuguauaagggcuugcaccuggcacagaaaaugccuguccguccccaacuguaaauaccacacugguauuccucuggaccaggccagaaaacaaggcaaagggcuccagaccagaggccagcaagucccagccauggcuguggcucgugcugcagccccaugcugacgucugcagcugccucuccuucacuuggacauggugugcacugggcugggaagugcugccaaaauucugucaggccugcaggcuggagaggcugagguguggccacugcauagacccuaucuuucuuguaagcagaacuuuccaaaugcacaggcccggcugaaggaaggcagaguaugggcaguuaacccagguagggcucauuuuguggaccugaaagcagggacagcaggcacaccccaugacgcaggccacccaguuauauacaaaaggaaggcuccagugcaaaugagugaguugguggcagaggcugugaaccagcugccuucagaggggauggaaagggguguguuccauggcaaugaguaugugcaucuuuuuauaagccuggcauuucagggguucuuaaugagaacucugcguuuaccacuaccaucauccaccuuaucaaaucauugagcguggacagacagcauggcuguaaagcaucaauauauacuuuauauugaaccagcuguaugacaaaaggacagccaaccuucuacuagcaacuaucauuccucuccuccaccaccagauuuccauguuuagccuaggcuaacccuuugauaaccuauaaauauuuaccuuaauucuccauccccagcuucuugacggaggccaguacagacuugugaguugacagacacacuuuugguggggacuguggacacucucuuccuccuuccuaaccagaguucuagguggaauuuuuuuuuuuuuuuaaaauagagauggguucucgcuuuguugcccaggcuggucuccaauuccugggcucaagcaauccucccagcucagccucccuaagugucaggauuacagucaugagccaccaugcccauccugaacauauauauuuuagaugaaauauuuggccaggcgugguggcucacgccuguaaucccagcacuuugggaggcagaaggugggcagaucaugaggucaggagaucaagaccauccuggcuaacaugaugaaacccugucucuacuaaaaaauacaaaaaaguagccgggugcaguggcggacaccuguaguccuagcuacucggaggcugaggcagcagaauggugugaacccaggaggcagagcuugcagugagccgagaucaugccacuguacuccagccugggcgacagagcaaagacuccaucucaaaaaaaaaaaaaaaaaaaaagaaauauuuggucuucuagggcuuuuaugggcugaauuguacccccauccccaaaugcguacuuugaagcccuaaccuccaaucucagaaugugacuauauuuggagacagggccuugaaaggggugacugaguuaaaaugaggcuauuagggugggccauaauccaauuuagucacacugaggcacaccagcgaugccugugcaaaggaaaggccaaguaagaacacgugagaagaaguccaucugcaaaccacgagaggccucagaagaaaccacaccugccaguaccuuggacuuccagucuccagaacugugagaaaacaaauuucuguagcuuuaaacuaccgggggcugugguacuuuuuuguagcauccugagcugacuaauaugaggccuucugcgcuacuaagacccucuggacaacugaaagggacuaaacuaagccaagguccagaacuacacuguccaacacaguggacacuagccacaugugucuucaaauuuuuuaauucauuaaaauuaaguaaaaguuuaaaauucaguuccucaguugcacuagauuaggacauucucauccuaugggacaaugcuaguccagaaaagagaaggcucuaaaucugagagaacauccaggagaaacuuuucuaacacagcucucccaaagaagagaggcagugacgagagcagacagagugagcauacaccugaugcucaaugccaagaaaaauauuuaaauagggcucuuaagcuuuuauugggcauuaucuuuauauggagguaauucaccaagcagucuucugacuaauucucacccuaaaagcaagaauuuuuuuucgagacggagucucgcucugucgccaggcuggaguacaggggccacgaucucggcucacugcaaccuccgucuccuggguucaagugauucuccugccucagccucccgaguagcuggacuacaggcacacaccaucaugcccagcuaauuuuuaguagagaugggguuucaccauguuggccaggauggucucaaucucuugaccuugugauccacccaccucggccucccaaagugcuggggaauacaggcgugagccaccaggccaggcaagacuauuuuuuuuaauuaauguaggacaaaauuauguacucaagcaaggagcauuuauagaguacuuauaacucacaaagacacuuugauaggcgccacacaggggcagagaagaaauucccaaugauguuuuugccucaaggaguaaaaugccuaaaacuauaaacguuagaaaacagguaggcaggguuaugaaacaacaagcgccucagaaguucagaagguggcaucccaaaggcucggacagguggcuuuaccugccugcacuuggaaacagaccuuuaauaccuuucucugaaauaagaggaaaggucuuucgcucuggagccccuacacccucucucaacuaguucacuucucuccugcugccaacaucagcagucaacccuaaaacucucaauuccuuagagguccucauugcaagcccuucacaccugacacucucccauaacggccaauucuccuccccaaaagccccgugccugugccugugccaagcacaccaaccgaaauaccacauugaguucuguuuuucauauuccugguccccucuucugaacaggguggcaccuacagcagcaaagccuugcuuucuaaugugcagcuuuuaacuugcugaaaacuuagagcacagaaaacugaaaauaacccuauuugccuaaaaaguauuucauccuuaaggaucuauacaacuuucaucuccucugcagguuucccugcccuccccuccucugaaucuguaucuguaucuguuuccacagugcaucaaaaagacaucucuauuacugcccugaugacuuucacaucagagcucuucuuacauaugucuaaagcagaguuccuugaaagcaggcccagcuccuuucccaucacacauucuuucaagguguccuggguuuaauuuguaauguaaaacauaagcuaacgggcuagagcucaggcacugugcuagguacaaaauuucccucuguuaucugaggggagcucuucucugaguagucuguuagcuucucaauacacagacacugugugauauuuauuuugacugccuggaagccaacuaacuucugguucucagcugcacugugaaaauaugaaguugccagagagcugagauacagacagcaguaguauucaauauagucacauuaaaaccaagugaagagcagggacuuucgaccuauuaagaaccuguacuuaauaauuuucacaucacacuaggcagucuucaaccuccccuuguauugaguugaaccaguuaaugauuaccuggcuuugauuaaguuccccuuucauaaagcgcaacugcgaaguaccauaaaugauguuuaggaaaaccagacacaccagugacucuuggaacuggauuauuccucccaggauaacaaauaggaagccucaggaaugcuugccugcagucaaccuuacccaguaagaucugguuacagaccugcaguaucacacucagguacguuucuccaggcuuuggcuuucucugaccugccugacaugcaaagggccucagcaauuuaaagcauuacauuaaaaaaucauguuuuuaccccgacccaaacccugguaggcuccaagaacaacaaagcaggacuuacugccauugucgucagaauccucacugcugcugggaaggcgaccucguuucaugaucuccccgggaaacagcaggcagccugcaaagcaaugagacagcacuuaacccaagaugauaauacacaaucaucaaguugugcuucagauggcagcccaggauuuacagcaaacaaaagcaaacaaauggcuuuaaguagcauuugaauuguaaacaguaaaaagaccaaagauacauaauuaggugcaaucauuaacaaaccagguuaaaaaaggagggggagggguggagaagucacauaucaguaggucucccaaagaugccagguuucuuucuauauuccugugacauuauuacuauaacuacuccaggaaucuuuagcugacuggcagcaagcacugcagaaaaaaauccacagcaaugaacacuguacugugcuuccucacuacagacagauucauauuuuaugcguacaugugggggguggggugggguugugccuggaugugugaauauuuacacugcacugggcaugauuaugcuucucaggcaaauuuuacuaaaauaacccuaaaggcgaaagaaacaaaacaaaucggguaauggaaugcaaaugucuccuccagccaucucuaaccccacagagggaacaggaaggaaccacagacauuauacaauuuugauccagaccccucccuuucacauuaggaaacuaaagccaagaaagguuaagcagcaacuuccccaaggucacguugugggaauggagcuucuaauuccaaauccaacacuauuuccacuccacuucaccucagcucccuucaggacaaauagacccaaauccagccaaaauaagaagucaguuuguacaaagacccagcgcaccuggccaacuccucccagguagcugaugauaacagaauucuagcacuacccucaaguaugagaaaggcugcauuuagguaagaaggcagugaacugagacggaauggccaguaaugaacuuauacagauggucucgcgguuauauucacacagggcagcucucuaaacaaauacaaaaagcuuuuccaaauuaaaauuacugaucaaccugacaucuuuagggcacuggucugucaguucaaugaauccuaaaaaugaaagggagcuuuuucaagugagaaaaaguaugguaguccaucaccuaccuacccauccacccucucagaaaaguacaucccaaccuccuccucauugggaaucacaauauguaugaugugguguuaacaaugcaaauguggcugggcaugguggcucaccccuguaaucccagcacuuugggaagcaaagacgggaggaucacuugaggucaggaguuggagaccagccuggccaacauggugaaacuccgucucuacuaaaaauauaaaaauuagccgggcgugguggcaggugucuguaaucccagcuacuuaggaggcugaggcaggagaaucgcuugaacucaggaggcggagguugcagugagccgagaucacaccacugcacuccagccugggcgacagagacccugucucaacauacacacacacacauacacacaacaauagaaguggggcacauaggaaugguguggagaaaaaaauguggaaaaccgggcugggugugguggcucauaccuguaaucccugcacuuugggaggccgaggugggaggaucacgaggucagcaguucgagaccagccugaccaacacggugaaacccugccucuacuaaaaauacaaaaauuagccgugcgugguggcgcgcaucuguaaucccagcuacucaggaggcucaagcaggagaaucacuuaaacccgggaggcggagguuggaaugaguggagaucacaccacugcacuccagccuaugugacacagugagauucugucuugaaaaaaaaagaaaaauguggagaaccacugugauagaacaagaaagcaauuuuaaaaaaccaaagcuccacucuaaaaaggccuacaaaagagcagucaaaaaagccuaaacucccuuuuccuuugacuagucacuucacaauuuaucacccucuguuaaaauuguauauaagccuucaggucuaacucuucuuggguuuuuucucuucggugaagucuccuucccuuuacccacaucuggcacauaaaaauaucaacaucagugaaguuugccuuuucuccuguaaugucuuuugucauuuaauucagacucgcaugaacugaaccuaaaaaaguagaugaaaaguuuuuccuauacuacacuuaaaaaauggaucuacacaauucauccaaauauuuaggucccuaaucuauaauugcaauauuuuauauuuucuuccugagaaacucacccaguuaaaguuuuuguuuaucaauugauucuucaaaagccauuaaaaugauguaccaagagaaaggcugaacauaaguccugaucaguaugggucaugagcuauauuauggacacgcuuuacaagcugggguuucaugcuguaggcauagucaaguccuaaaacccacuccaucccuuuuccaaaagccccacucacccauaaccaggcaaucugcaacuuggccugggguaagcccacuccagcccucagguuccauaaccaagaaacaccagugguccacucccuauucaacuguuuucucugcccugugugugccaaaaacaccaacugcagacagguaagcucuccaaccuucuagagaaugcaccucuggguccccucaggauccagcaagagguaaaagggaaaagggaaaggcagaagaccacucacuccuaacagcuucagcuccccaaagccaacauuacaaaagagugcuaaaaaaaauuaguacuaggcuggucgcgguggcucacauguguaauccuagaacuuugggacgccagggcaggaggacugcuugaaccuaggaguugagaccggagugggcaacacagggagaccccuaucucuauaaaaaaauuuaaaaauuagauucaccuaacagaguagcuuuuaagaaucuuuuugaaucaaaaugcuuacuuuccagcuuucaaacacaacucccugaggaagcacuucaacagucacuaaauaaagaacgcaagcauuggccaaaauacaaugaugcaccuaaacacacauaaauacucucuuaagcaaaauuauucaaguaaaagaagaguaaaaauaguauuuucuuucuaaugaaauccauuuucauccgcugaagaucuugaguaaugaggguuugagagugcuguauuugcuucuccagggaacuuggcacaguauggggguuagugcucagcagaauuuccuccucuguggcucuaaaguacuuaaaccuugacaucaagcugauuuaucucacccaggaugacuuacuguaucagaaaaucaaaauacauguuacuaucuuucagcuacacaauacagugguuguaugcugcaaacaucugccccacuaaaagccagcaucugcaucaucaccuuuccugacucucagggcaauggcuaauuacuaaucuagacaguaguaggauaaguaauaaucaauuaaaauggcuacucacaacaccccaaaguagcaagaagauauaauggcacauaaugcagccgacaaacauuugaauaucucauauauuaggaggugcuggaugaaaauuacuaacccugaccucacagagcuucuggccuaguugggcagacaggaaaacaacggaaauucacuacuguuugugccugacagugguaaaugcggaguucuacaggaauacaaaagguggauaagagucagaggaggcugguaagacugagcugaguccugaagaacaaagaggagguagccagaaaaaggggcauguuuggggcagagcaccguacuuaccaacauauguguaacacagcauauuacucuggguagcaucuucauacacauccauucucaccuuauagccaauugccaagguuuacugauucauaauguuaugacucucugaaguccccauaugcccuguggguuugcccuucaacuacuuguaccuagaaagcuuuaaacaccuauucuccaaacuaugaucucuucccacuuccaauuauuaaaacaacaaauuaacuacaccccaugaggcaaccucaucaaaauacuauaugcagaucucucccuccauuccacauuacaaauaggucuaaguccaaaguguccagccaaaaaugaaguuuucugacuucucacagcuuuacucaggcaucuguucuagcaagccccaaaacccagagcuugcauugguugggccaggcuucuucccugaacacucugcuuacuuucaguucucauucucugcuaaugcugcuccuguugcuccuugcucccuauccuaaucccaccacuuuucuggggcucagcucaaagccacugaccacuccaacuccaaacacuuauauucuguacugcucaguucaacuuucuuccucuuuuagaacuuuuucaccuugcuuuucaaugcacuguuaccuuaauaguaucacugaaaaaaauuccucaugacacuuguuagaaaugguaaagcagauuuuacucaagggggaccauggugguagguacagggaacacugcaaugggaucuugcagagggggauggagauugaacccaacucagauuccaaaagagguggagauuuauaaccaaggaggaggguggggccgguggauaggagacugacuacuaaacagaaauaucaaggauaagggguuuauggcuaauuugauaggauuauucuugaagacaggccaggauaagauaggacagaguggucagauacccaggugaagaauuuucccuaaacugauuuuaacaggauuuuugcuucaacuggauucaacaauaauacaaagagaagcccaagguagugcccauucacgcggaggaccggaggagcgugacuaaaguuuuggucaaaggagucuuugucaguauucaaucaacuacugccuugcaucaugacuuaaauguuucaugugugugucucuaaagauuacaguaauuucuggagaacagauucucucaagucaaauaugaaauaaacauaacauagggccaggugcaguggcucaugccuguaaucucagcacuuugggaggccgaggcaggcauauuaucugcaugcaauagauagagaggagccacuaugugaagccuggaguucgagacaagccuggccaacaugggaaaaccccgucucuacugaaaaaaaaaaaaaaaacacaaaaauuagccaggcguggugaugcaugccuguagucccagcuacucaggaggcugaggcaggaaaaucacuugaacccaggagguggagguugcagugagcugagcgugugccacugcacuccagccugggugacaagaguaaacucuguuucaaaaaaaaagacauaacagagaagggggaccaugaugguagguauagggaacacugcaaugggaccuugcaguacgggacagagauugaauccaacucagacuggucagaaacaaggccucucagcguggcuacaauagaugcccucagaacucuggauccagucgacacggcucacccugacauucuguuuacauuuccucaaaacugaugcaaaguuauccagcuuaucggagccuggaguguccacuugccacgagaaacauaauagcuacagagacaaaagagcuaguuagugggcauuugggaguuugcccaaaaagaggaagacuaccuaggaaguuaaauuaaaaacagaacacugccuggaaaggccacuggccaaagacccuggcuggaccaguuacuuaacaauccucuggugucucuacuccacucacugcacgaagagaugcaccaagacaacugagcaucuguggcagcugccggagaaccaucuccucaggaaaugcaaacacaggcuuuacccacuggcccaaaccccuauuuagauuauaugcagauuacucucuccuuggaucccuucugucauguggguuaaaaugcaguacauuagcuaacauaauaauuugaggaaaauuuuaucaagguagacgucagagauacggugaacaagauauggaaugucugcacugcaggagcacacagucuaccuggaggaaacaucaaauaacuagacaaguggcuucagugugguaagugcuauaaaagucaccagauuacugcuuacaugcacaugagauagcaaggcaccugaaaaccuugaaauuuacauuccucugacugaaacugggaaaaaucugcaugcaauagauucagaggagccacuaugugaaggaacccaucccuaggguggcucaggaauuugagcgaacaaguucagugaccugggcguggucaugacugaugugaugauucuaagaaagaaugagaacgucauggacaaggagagaaggacuuuuacaaaagaauaagagggcugggcacaguggcucacgccuguaauccaggcacuuggggaggccgaggcaggcauaucacuugaggccaggaguuuaagaccagccuagcaacauggcgaaaccccgucucuacuaaaaacacaaaaaguuaaccagguuuggugguguauuccuguuguuccagcuacuugagaggcuaaggcaggagaaucgcuugaacccgggaggcagagguugcagugagucaagaucauaccacugcaccccagcccgggcaauauagcaagacucugucucgaaaaaagaaacaaaaaaagggaaagguaacuaagaauuugaggauguuuauucaaugcuauuccugggaaacaaggacugauuugaggaaaacaaacuguccaguuacuagaauuacuuacucucugugguggaacagggcccauuuaucaggccauaaacucuauagcuauaauaaggauuacaaccuagugauuuugucuuauggcucauaugcagaaaggcugguuucucucucaaaguaucaguuuuaucuacuguuuccauuuuuauuuauuucacucaagaaguucuagaagguacucaauuaaagaccgcuacauacuuuuauauaucacccaaugcaauacuauguauuaaaauaaccuacuggaugaaugccuuaguucccguacuguuaccuuauguucacuccacuuuauugaauuugagaugcuuuuacuuuaauaucuaauugaccuuuaacuggaauaacuucuccuguauucacuuuuaaauuuauugaugcccuuccauucugucaaauagcuaaaaucuaauaccuaaagguacuaaagaauguauuuucagaaaccagguggucuuauauaaaacuaaguauuuuaugagcuacuccuuucucuuuuauuuuauuuuuuuugaguuggagucucgcucugucaccuaggcuggagugcaauggcucacucagcucacugcaagcuccgccucccggguucacgcuauucuccugccucagccugggacuacaggcgccugccaacacgcccagcuaauauauauauauauuuuuuuguaauuuuaguagagacgggguuucaccguguuagccaggauggucucgaucuccugaccucaugauccgcccgccucggccucccaaagugcugggauuacaggcgugagccaccgcgcccugccacuccuuucuguuuaaguucacauaguucaaauuauuuuuuaaacacuagguaccugauaauuugauuccuaaauuacugaacauagaauacucccccaaaaagauacauuauauucuuaauaauuggucacuuuugucuucuauggaauauacaguucuaaauacccaaauauaaugaccuauaacuucacaauaaaaucuguccaccugccccuaaaugaaugugaaggaaacccagcugguuucuuaccucaguuuuuaaaguaaacauuaaucgcuuaaauaugaaguuuuccaacuggcaacauuaucuaauucauaugcucacagaaucuaaaaaugcuacuaugacuauaacucaaacacagauucucaauuuaacuaaaggguuauaucuagucaaaaauaaagucauacauuuaacugacaaauagcuuaacucuuaagcguuaauguuuuaaucuugucuaaauaucucaagcaaaaaaaugugcucuuuauaacgucauacaucaaaacuuauuuaaggaaaaugcuggcccaagcuaauacagaaccucuggaaggagguaaaacuuacaaauauucagcugacaaguuuacauuagcaauagccaccuccuccaaaagaaaaaaaauuaugauaacugaccacauaauaaauaacuauaauauuuacucuuaggagcauuacucauaaagcccauguacuauaauacauuaguucacuuuaaauucuuuauaaguuauuuuugaacucagauuuaaaaaccaagaaagcauuucucaagacuuuaaggaauuuuaaauuugagugguucugaaugaaucacaagcagcucucauuugccaauguauaaauaauccaaucacugcuuaugagcucuaaggcaaucuauuaaaccccuuccaggacucuguaauugcugacucaauuaagagucagcaacugaauaagagcagcuaugacaaaacauuccaaucauuuguacuuggaauguauuuuuuuaacuucccuugacaugggaguaaaugaauucacaaccaaacaaaaaaggcagucagucaccauggucuccaaucuugagcuuuuauccuuauuuccaucuacucagaauucuuuucuguuagaucuaaaugcucagauguggaaagaugcccaagacauauuaggggagaaaaacaggcuaacugcagggaaaaaacccaaaauauaagagcauuuauauauaauaggaggagagaaaauaccuacagcaauugcuuguauauucauagaacauuucugaaagaauauaaauguucauaguggucaucucugagaaaugugaccaaaggguuccaagacagacugaguugggaacuuuuccuccucuuuaugaccuuuaauaugauuuuaacuuuuuuuuuuuucuugagacggaguuucacucuuguugcccaggcuggagugcaauggugugaucucggcucaccgcaaccuccgccucccagguucaagcgauucuccugcuucagccucccuaguagcugggauuacaggcaugugccaccacgcccggcuaauuuuguauuuuuuuuuuuucacuagagacgggguuucuccauguuggucaggcuggucucgaacucugaccucaggugauccacccgccucggccucccaaagugcugggauuacaggcaugagccacugcaccuggccaugauuuuaacuuuuuacgaugauuguguacuacacuuauaauaguaaagauacuuuuuuuugagagacagagucuugcucugucacccagacuggagugcaggagcgugaucucugcuaagugcaaacuccgccucccggauucaagcgauucuccugccucagcuucccaaguaacugggacuagaggcgcacaccaccacacccggccaguaguaaagauuuauuucuucccugcucuucacuauauaaaagaccuggaagcacaacuucuugccccagugcaaagcaccagccuauaacuaacgagcaaccaucaauaaacuauguauaugccaccucuuuccugagaugcaguaucaaagaauugucuugcuuuaaaagaauaucugaugcaaaggugcagaagaaaaaaaagagaaaagguaauaaugccauaaaaugcuauuauccccuauuugcuugauuaggucaucacauacuucaaaagcuuaaguuuuugaaacagguaaaaacagccaacauuagaaggaggucacuuaaaauauaugcaauaauaauagaaaaaaacuaacccagacaagaaaauuaggguuuaaacuauacacaggcugggcaugguggcucaugccuguaaucccagcacuuugggaggccgaggcgggccagauuaccugaggucaggagcucgagaccagccuggccaacauggcgaaacccagucucuacuaaaaauacaaaaauuagccaggcaugguggcaggcaccuguaaucagguugguggucucaaaccuagcagcuacucuacucgggaggcugaggcaggagaaucgcuugaacccaggaggcggagguugcaguaagccgagaucgugccacuguacuccagccugggcaaaaagagugagauucccucucaaaaaaaaaaaaaaaaaagaagaagccauuucaacuccuuauccauuaucacaguaguacuacuuuggaaaaaauuuaaaaaggcuauguucaagagguagcuggcaauuaugccauuccuuccaccuauggcaaggcaugguugacaaauuaggucauucuuuuccacacccccaggcacauaucuucagaauccuccuuaacacagugcuaucaccaagagagauaaagcccauuugcccuauaugucuuauuccgcgucucaguuuucugacaauuuaucagggaaagcuagggucagauuaaucucuucagaauauacaaaaaugaaauguuuauuuuuuaaagcauuucacugaaaucaggaguuuguguuccauucugccuugggggucucugaaccagguacuaauuucuauaauacaaaccuacacacuucauaucaaacucuaaaagcucauuagacacuuuaggaaaaccaagugcuucugaaugaacgaagguaagaauaagcaugagaaaggauucuacaacccauuauuccauccuugguggaguaagccaauaaaugcuaaaugucuacaggguaauuuuaaaagauuuuuaaaugcucaaaccagauguucuuauacaggauauacaaaucagcuucugcagaaaccagacuccaccagcuaaugacaauuacacugugcacagauugaaaugcagcuguuuuucaggaacuuuguuccuugauuauacccgguugucagaaacuauccguuaccacuaacaauguuaagucaccaaaaauuuuuaaaguacuguuuuaaaaaaaaaaaagagagagacucccaauguuguauauuugaaaaccuagaugacacacuugacaaaaacaacauuuacacaaucauccaaguuacauaugaaaacaaacguuucaucacaauuguacaagccucguuauuaugaucauggaaaccuaaguuggucucaaaccuagaagcaaggucuagaaagcacucucugaggcugaagucucagucucacaacguagacucugccuacaagucucacaacacagauugugucuagaagaaaucuucccaaaagaaagccaggcgugguggcucacgccuguaaucccagcacuuugggagggugagguggguggaucacuugaggucaggaguucaagaccagccugaccaauauggugaaacccugccucuaccaaaaauacaaaaauuagccaggcaugguggcacaugccuguaaucccagcuacuugggaggcugaagcaggagaauugcaugaacccaggagauggagguugcagugagccaagaucaugccacugcacuccaaccugggugacaaagcaagacuccaucucaaaaaaaaaaagaaaucuucccaaaagaaacccauaaaaucauaauuaacugcagagcuagagaggauuucaaaaacaauuuaaaauaauuuaauccaccuuuccuacuuuuaaagaggaguacauggauuucugcauguuuaucaacuugcacaaacacacauaaguagaucuagugcaaaggcaguggaagaaccaaagaccaguuccccagguggguggaggggcacucuccuccugugccagccaccuccucccagauuccuggacuaugggcuucuuccuccuggauguacacugggauuuaaaaagaggucaugugaaugacuaaggccaugauacguuaucagagagcaaaaacugaaaauguaaucaaugaacaacagucuguuaacuugaaaacugaaacacagauucauggcaagauggucacaaaugccauucauuuugcauagugaagcacacaaaagguaaagcuggaagaaugugucagcaguuccuuaaacacuaccacaggaguaugaguucucccggagugguaggcauuaacuucugauugcugugacacauacacccuacuugacauuaucucccucuguaguggaacacaaucuuauaauacauauccucuuacacaggucuucuuagcuugacccccccggagggugugagagaugaccaagguauuuguucuuacacauuuuauccucaaaagggaucuaggaucagaaucccagcuacuccagaagcuaaggcaggagaacugccugagaccagaagguugcugagccgugaucgugccacugcacuacugccugagcagcagagagagccugccccccaaaaaaaaaaccaccauugcacuccagccugggcaaaaagagcgaaacaaaaacaacccacagcccucagcguagccaacuaccuccaaacaaacuucuaauuucaacuugcauuuucagguuccuagaagggagcucagccaccagcagaaacaaucaaguagcugcugugucuuacuauaaaucuggggaggccagggagugauggccaaagugggcagaaccuuugagcucaggaguucgagaacaaagaaacauagcaaaccccaucucuacaaaaaauacaaaaaacuagccaggccuggugugggaugccugcagucccagcuacuggggaggcugagaugggaggaucaagugagcccuggaauuuacaccacugcacuccagccuggacaacagggugagacccugucucaaaucaaucaaucaaccaaucaggggucaacagccuguuucuguaugguuuuugagcuaagagugauuuucacauauugaaaugguugaggguagagggccaaagaacauuucaugacauacaaaauucauaaaaauuuuacauuucuauauccauaaauaucacuuucacauucauuuugcccaugguugcucuggcacaacugcagacuugagcaguugcgacagaccauaugacccacaaaaccuaaaauauugacuaccuggcucuuuacagagaaaggcaacugaucuguccuauaaaucaaccgaucaguaguaugauguuuauaaaccaccauuaugcguguuuaguucaaugugaaucaauuaccaggugcuggacaagcaaccgaaagcuuacaaaauuaaggaucagacacaaucacuccuuaggaagucccuaacuauggccggccaugguggcucacguuucuaaucccaccacuuggggaggcugaggcgggugcaucaccugaggucaagaguucgagaccagccuggccaacauggugaaaccucgucucuacuaaaaauacaaaaauuagcagggcaugguggcacacgccuguaaucccagcuacucgggaggcugaggcaggagaauugcuugaacccaggagacagacguugcagugagcccagaucaugccacugcacuccauccugcauaacagagcaagacucuaucucaaaaaaaaaaaagaagucccuaacuagaauaaucaaaaggaaggcauugaggagaccucuaagcaacuuaaauaaaggccacaguaaaaccaguggguuuuucucaaaagaaaaccccugaggcuccuacuuggagccaguguacacaaguuuuaaaaacuucuaacaggcuucuuauuugauuuucaaguuaaugaccaauaagcagaaaaaucacuguucucaacaggcauuuuaacuacaauacaugguaacaguggcaguaaaaggaucacagagaaaucauaaaaagaagucaccagaauuuaaacacuuaaacuagaauccaaggaugugcuuaaggaaacacccauguuuucugggggagagcuuccauggguuucagugucaaguguccccaacuuaaaaaguuacaaccaccaacacucagccucuauauguuaagugcaucauggcauuuccacauggaaguaacugaugcucguaaagauuaugacaaagaguaaucaauaaaaaauuuaaauugcauuuaguguacuuugugcuaaauuaaagcaagccaugaaguucaaccucaagcaacuugcuaauaacauugcuauuucuuguuccuuacccugguuuaagugggaaacaaacaaacaaaaagauuauuuuaugccucaguguggacccacaccacugaaaucuucacuuaaaguaaguccuuauaaacucucauggaagaugccaugaauucucaaaauaauaaaaucuccugcacaggagacacuaaaugaucaauaguuuaaaauauuacuuccaccagccacacaggugcacacuuguaaucgcaguuaggaagccagggcgggaggacucagcucuggaguucaagacuagccugggcaaccugagcaacauagugaaaccucaucucucuaacaaaaaauacaaagagacagaugucaauugugagcgcuuucaaaguaauagaaaacuggccagucauggugguucacaccuguaaucuagcacuuugggaggccgagguaggugggucacuugaggucaggaguuugagaccagccuggccaacaugguaaaaccccgucucuacuaaaaauacaaaaauuagacagacacggcggcaugcgccugugaucccagcuacuccggaggcugacucacuugaacccacugcagugagccgagaucccaccacugcacuccacccugggugacagagcaagaacuugucucaaaaaaaaaaaaagagagagaaaauguaguuuacuucccucaacaaguaagcccaaaaaaaucuaagguuuuaaaaauuaacuuucuucaacugcucucuaucacauuauguccuaccucuaccugaagaacuaaaggcaaaaaguaaauacugaauucguuuuagaguaaccaaaauuuggucacugaacauuuacugugugcacaucguacacuaugggucuaagggauuaaacguaaaaauacauggccccuuuccuagugauaaaggcuuuccaguccaagucugguaaucuuuauguuugugcuuugaggugaggaaaggauccuuaauaaucauucaaguccugggcuaggaaaggccccaucauagccaaaguuuuuagcaucaauuucuuccauucuauuccaugacacccaaccuuaaacuuacaaauugucacuucuauguguaauuaaaaaggcccuccaaggucauuuucuugcauuuauuaggagagcagaguaacuugcuucaucagggcuaugaacugcaaaaaaagaaaaaauaaaaauaaugcauacacccucaugaucacaaaccaaaguuuucauaugagaaauacacuaggcaaaggacaauagacucaauagacucaacuaaaucucaacuucugagauauuacauuccacaaacauaaaaagaauuguccagauuguaaauacauggucauauaaagugcugcaaggacuugaaaacggagaaaacagauuuaagacuuuuaaggaaacaacuuaccugucucaggaauuaaaauacuuuccuaauuuaagauugcugauaccuucuaagaaaccagaaacuccaagcaaacccacccuucauguuuaaaaaaaaaaaaaaaguauuguugaauauggugccaauucucuaaaggcuuguacaagggaggaaauaaguuuaaacgugacguaacuuucaccguuuuaacaaucaagcuaaaccucuuaaugccaacccaaauaaaaagcaagguguguucgcuaauaugucauauuucccucuauaacuguuuuauaaaccucacaggaaaaccaguuuuauaaugcaaauucugacagaccauuaacuguaaugcuguaacaggugccccauaauacuaaaugacagggaagagcuucacaaacaagaaaguaaagcagcaagcagaacugugacagauuccuaugccuccucuucucugaccaaacccuaaagagacaggauguaaucuguauuugauaucuugauguuuacuguuccaaccaccucaguacugaaacacaaacaucugauaaaucuuuuuccaacaagucuguggaaaguaacaucaagcaagcagaugaucuccaaauuuaagauuuccaaauuacaauaaauaccauuuggauuuccugcuuuuuuaaaauccaggcaacuuuauuuccaaaggcuugccuccucagugucagauauucugucaaaaaguuacuuaagauugccgggcacgguggcucacgccuguaaccccagaacuuugggaggcugaggcgggcggaucacgaggucaggagaucgagaccauccuggcuaacacggugaaaccccgucuuaauaaaaauacaaaaaaauuagcugggcaugguggcgggugccuguagucccagcuacucuggaggcugaggcaggagaauggcgugaacccgcgaggcggagcuuacagggaggcggagcuuacagggaggcggagcuuacagggaggcggagcuuacagggagccgagaucgcaccccugcacuccagccugggugacagagcaagccuccgucucaaaaaaaaaaaaaaaaaguuacuuaagauuaaaaucgacuuaagggaaacaaccaaaugcaauaaaugguccuuuauuaggcagugguuuagacaaagcuucucuauuacagucuggggcuaaauggggaaaucuggacauguuacaguaauagauuauauuaaaacuaaccaagcuagcugacagaaaaaaaaaagguccucagagcugggugcgguggcucacgccuguaaucccagcacuuugggaggccgaggcagguggaucaccugaggucaggaguucaagaccagccugacaaacauggugaaaacccgucucuacuaaaaauacaaaaaauuagcugggcgugguggcgggagccuguaaucccagcuacucaggaggcugaggcaggagaaucgcuugaaccugggaggcauagguugcagugagaucccaccauugcacuccagccugggcaacaugagcaaaacuucaucucaaaaaaaaaaaaaaaagaaaaaauccuuacagaugguauauucauguaucucauuuuuauuaaaacacacaugcacaugcauagaaaauuaucugaaaaguaauacaguagucaucuauggaugguagcaauuuguuuuuauauuuguuuccuuguauuuucuaauuuucaaaaacguacauguaacacuacuuguguaauaacuuuuuaacagcuaaagucaaaaauuaauaucggucacgugccuacuauacguaagacgcaauggaaaucugcuuuuacucucaccuaguccuccaaguuuguuuuuuaggucaucuuucuucuccaacccccuaggcuaagcaacaaaacacauuuccucaaacuccaauagguuuucucccucuaguuucacccagacacacauacuuuucauugcugucccuguauagcuacucuuucaaccuggauaacuaauauaagcacagcacugguuuacaggcagaaaaccagucaagugaagcggggagaacuaagaagguggguuuuuuuuuuuucuuuuaaaugaacacauaucuaccuuuguuaaagcuaaaauauaugugcagccaacccaacuuuuacuaguaagcagucuguacucuuaaagguggaaucaaguucaaguucuaccuuacuuucagacacucccauuaucucugcuaaauagggaccaaaggaaauagcaggaaaccuaacacuuaaacagcuuaaaauuauauuuauucuacacauuaaaaugacaaugccaaguaaaagacacuuauagaaguauccaaacuuugaagaagacagcaaaauaccaagcagaaagucaucugauuuacaagugaccguaagcaggcugggcgugguggcucacgccuguaaucccagcacuuugagaggccggggcgggcggaucacgaggucaggaguucgagaccagccuggcuaauauggugaaaccccgucucuacuaaaaauacaaaaaaaaauuagccagccgugguggcacgcgccuguagucccagcuacucagggggcugaggcaggagaaucgcuugaacccaggaggcggagguugcagugagcuaagaucaugccacugcacuccagccugggugacagagcgaaagacucugucucaaggaacaaaaaaaaaaaaaaaaaaaagugaccguaaguaaaugagacuaagaucuuugggauaaaaggacaauaaaaauucuggguugcauguacuugcuaagaguguuacucacaaaacaucccauuuaacuccccccacguauguugcccaccuacaacaaauuauuacaucaaaaguguugacucaaugcaaguauggacauauugaaugcuuccuuucuccaccuuucuccaccugugauuaaaucuugaucaguugugauaugaucaaaaugcaacuuacuauaaaaucuguaaccacuggggagucacuaccuaaaucagcuuucagggaaauaauuucccucuaucuuaaaacuaguucauuagcuuugaaagguauuagccuugagcuacaaguagcaagagagcuagccuucauggcggguauuauaaaaaggaaaaauaguucaccuaauaaaaaaccuuugggaaagaacccccuaagcauucccauuaauggaaaccucagauccucuccuacuuuccuaaaaacguagcugucucaggucauucacugcagcugucauuuuacaaaagaaaauuuaaauucccucuuggccggggcaaauagagggcgacagccccucgccccugccgaaguaaggcagggcgccagcccucucguuacuagaaggcaagcuaaagcuccuuuuaaacggucuccggaugacgacgcauuccuaacggguuucgaaggcauguuuaaaucgcccgcuuuuuuguuugcucucagcauucaccggcgccgggacugcggccgcccccacccgcuuggggugggaaaccuggggccagcggagccuggcgcgggaggaauccuggggcgaggggagacccgggacgcgccaagccgggguugaggacucgagaauaaggagcucuagugggaggguggcggagugagaggggacgugagaaggcuaaggaucccagcaaggggggcaccccgggguugugggggagcucggccgccgccccgcagcggcgaacgcuccgcgcggcucccgccgcccgccggggaaugcgcagggccgcgguuccgcgcggcgccgaccccucccucucucccaauccuccuccuccuccuccucccgaggcgacagaaacaacagcgcgggaggaggggaaaguaacucccggcaccuccgccggaauuagccccggugcagugaugacaccuucucguggcgcaaccaagccccgcucccuccgcagcggcguccccgccgccgccgcccucuccauuugaaaguggccaccccccgccgcggcagcuccucccgccccgccgccgccagcugcaccaauccgcucggccccaguugcaaaucaaacgcucccucgcguccagaagccacuugcgccgcuggaaacggccgcgccgucccccuccccgagucccuccggggcggcaccuucgggcuggggcgggcgcgccggcgagaaacgguuuuaagaugggagcggcagcggcggcgaggagcuccgagcgggcucggcucccgcucccgcucccgcccccagacaguucuggaaacuguguaucaccucugucacaggaagccauccggcgaggaaggcggcgcggaaccaacaaacaaacgccugcggccgcccgccggaaccggcgcggggaccgcgucgggcuucgggccguucccggggcgggggcgcagcggccacccccgcgccgcgggcuuugugcggggcgggcgcggcgggccgggcguccccgcccccgcaaccccccaccccggcccgggcggcgcagcugggaccguuaggugacgcuccggccgcagcggagaagcagcgccucggccgccgcccgcccccauuuccacacugggccgccucuccucaaacaccagaggcgggcuacaaaaguuggccccggggccacccagcaccugcccacgugccgcggaggcucgcucccgagucucccccgguucccucccccgccgcccucggccgccaggucaccuauuaccggugggaggggagagaggcugcuauuuaaacgcccgcggaaguugaggcacccccacuggcgggugccgugcaccugccucccgccgccgcgcuccgccacuuugagcagcagccgcguccucagccccgccuccugcccgaaggcgggcgggggggagcgggaaggagguggaagggaucgaauuucuccagcaaaugggaccguuccgacaggauucgguuccccggucaacauuccacauuccaucccucucccgcauuugcaagccaaugccgagcaacccggaaagccugcuggcuaccgaacaacagcccccaacucgcaaacacagacucacaggcacaagacacgugcacugaagggcucugcaacuugcagucccgggguacacacuacacguucauuuaaggaagcaaggagaccaagagaccccacccccacaauuugcagauggugccaaagguugcaauuugcaauccccuuuaaguucacgauuaaucgguacuuugcucuaccaacgccaacuccuaccccauuucaucgauuaagggguuuuacacuuuacaagcagucgcgcuguaaguaaaagaucugaucacuggaagcccaguucggaagaaucuaauugccaaacugucccuccacccccacccccaccccccucucacugcccuugaauugaugcaaugaauauuuuggacauguggugacgcggugacaagagccagggcugcggccaccacacacagauguaccuacgcacaccuauguuuggacaaauacagucccaccacacacacggucucacacacucuggauucauauauguacgcgaaccugcguucugccauugccaucugucuaccaaguugcuacuaugcuuuccacuuucaugcagccuaaugcacuuuggcuuucuaaaaaaaaaaaaaaaaaaaaaaaaccuauaaacuaaagccaacuuaaacugggcuucugcuccuaaacgcguuuaauugaugauucaccugaaaaccgcauguucuucgcaaauccaaaagaagaaauagcucuaagucuucagccccccaaauuugaaaaaaaaaaucauaauaaaacuuacugauccaacauagaucaauucucaggauccaaaaaucauccucuccuccuccuccggcccccgccccggcaaugcccaaguuacuggugggauaguaacgcugcgcucagcggcugccucccucccuccucgcuacagaucgagaacccaaucuuuuggcgccauauuaaugacguauuauauuauuuccacuaggcagcgaccuucggcauuaaauuacucccgagaacucccgagcaaagcaacaaaaccaucaaauauggcugagccucucggcucguccugcagccgccgccgccgccgccgccgucgccgccgcgggaccgggacgcgcacacggacccacacgcggacacgcgcggacacacgcgcggcgcgcccaccccgcgcgccccccgcggcccgcgcgcguaccugcugcggagggguucggccgaggcgcugggcugggcgccgcucgcucgcucggagcugcaugaguucgggccgcggcgggcggggagccgggcgggccccugcucucgccggcgcgcacacaccgggcacucgcgcacggaggcacucucggucuggcguuuggcuuguuauggaggaaggacuaugugaaucaaacucauuucugggucacugcugccacaggggggagcacuuuaaucccuugccaaaacgagaggguggggacgggagggcggagggagcaugcggggagcccgcggcgcuggggcucggucccucguuaacucuucgcagcccuagccgcagccggcucagccugcgccagugggggcucgcaaagaacggcacuguucagcucuuagucucuuuccuuacuucacccaccuugugagccuagaaauucuugaggugucuccaagcaaguggguuuuuaaauuagccccuucaaacugcugucccaguuucaacucuugucugacaucuagaaauggauucuuucagaauaguuuaaaauuacguagauuaaaauauggcuauuaagaugugucauuugggugaaagguuuuauuuuuaggcugaguggcaaaauaguuguuuguaguaacaguuuuagggaguugcacauuaggaugacauuuuuaaauagagagaauccaauucugaauaacaucuuuaccuaaauuuguauggaagugaucauugcaaaugagcauuaauucauuagaagauauuauuuauaaauugacaccacuuuauguuacacauuacuacagaauuggacaucuucucccaaauaugaggagugagccuaaugcuaaaacuagaauugcagacuaguaucagaucagucaucggagauucauuuggggguauuuauguguaaaaaggagugguuacugauuuucugcagaagacaagcuugcuuuuucauauagagggcaacauacuucuuucauggauucaucuagggaaauagagggguauaugacauucaacuucaauaagaaaaaaguacggauuaaaaacucccauucaggccgggcgcgguggcucacgccuguaaucccagcacuuugggaggccuaggugggcggaucaccugaggucgggaguucaagaccagccugaccaacauggauaaacccugucucuacuaaaaaauacaaaauuagccgggcauggugguacaugccuguaaccccagcuacuggggaggcugaggcaggagaaucgcuugaacccgggagguggagguugugaugagccgauaaugcgccauugugguccagccugggcaauaagagcgaaacuccgucucaaauaaauaaauaaauaaauaggaacagugaucacuaauuacaaaauugaauaucgaacccaaaaggcauauguguccaccggaagaaucuuucugaauauaucagguuugauuucauguaaucccacaccagcccaacuacccacauccagacccacauccagaacguuauaaucugauaaaugcgacaaaacaaaacuaauugagccuuucaguuauuuuucagaaaacaaaguaagccaguggaaauccuaaguacuguauauguccucuccuguuucgcuaaugaagaguagaaagacucccugccaguccuauucauguguucacuuaauccuguucaaagcgaucacacauguaaagcacuguguuaacuaucauuauuacuauucuuaguauugcacuuguuauuguuauuuuuacugguucaccucgcacauacucucuguagaaguuaaaguacacaggcuuuguagccagacauggcuggaucuggcucuaucaguuagcaguuugugugccugugggauaaaagaacuuuaucugagccucaguuucuucccugguaauaaaauuaaguuaacagcuggccccuaaccugaaggguuguuaagaggaaucaggcaaccucauaacaguucaggaguagaggcccuggcaguaggagguuguccacucccucggccaucacucaacuccuucuugguuuucucuccaucaaaaauugcaacuuuucuaaauuccaaacagccuuacuucacgcauucauguuaagaaaauuuuugucgaccgggcgcgguggcucaugccuguaaucccagcacuuugggaggcagaggcgggcggaucacgaggucaggagauccagaccauccuggcuaacacggugaaaccccgucucuacuaaaaauacaaaaaauuagccgggugugguggcgggcgccuguagucccagcugcuggggaggcugaggcaggagaauggcgugaacccggcaggaggagcuugcagugugccgagaucacgccacugcacuguagccugggcgacagagcgagacucugucucaaaaaaaaaauuuuuuuaacucacauuugcugcuuacucuuuuauuugcuuuuucuaucaaaaacaucaggcaccaacgaaaguauugaauaaaauggaugacaaaaauaaagggauaaaauggcacacaaacuccccacacugacacauugaacaugagugaaggugccauguacagagucucaauuaugccguggcuucagaauacucauccacugaaacagugcuaugugcuauaaauagcccuggacaagaagucaggagacucccaccaacucccaauaugacucuuugggcuuuaguuuccccacugagaugauaggaaaaauaaugccuaaggccccuuucucuuuaacauucagucauuucugauuuucuuaccaaacuuagaaacgugaugauuauuugaagaaauggcggacaacuugaauccauaaggaacauguaaaaauauuuugucaucaaugaucagcaguuggcauuucuuaaauaauaggugucucuugccaucagaccacaaaggaaacuccuauacaaccuauuucuaaaaugggaaaggcaaugauaugguuugccuugcggcagcacagauaauacagccuagaauaagaaguacuaagcuggcaauuaggaaagcgaguuucugauuccacucugucacuuacugucuuaccuugccaaaucauuccggaucaucauuuccuagucucuggaauaguucuuuuuaauucacaccuuauuaucagagaugaaaagacauucaacaaaauagcuacaagguacucaguguaauagaaauaucaagauucuugucuuuccuguucguggugauaauuacaauucuauauauccuguacauucugcuguagucauaaacaguuuaauuauuuucuuccauaauaauggguuuuuaugaaauagaaauuuggauauuuauauucauauuccugauuuugaaaccagacuugauuaaaccucugaauguuuacuuagucauuucaucuacuucucuguagguaaagaauuauaaggccuugauaagagauucagaauuguucauauuugaaaugaagggaugcauacacuaaaguccuguauuaucucauuccuuuagggaaaugagcaagaaauucuuacuggcaaauaccacugucaguugguauacauuccaacgagauaauuuuuuuuuuuuucaagaucagggucucacucugccacccaggcuggaguucaguggucccaacauggcucagugcagccuccaccuccaggccucaagcaauucccccaccucagccuccaaaguagcugggaacacaggcaugaaccaccacaccugacuaauuuuucauauuuuuuguagagacaggauuucaccguguuucccagacuggucucaaacuccugagcucaagcgauccgcccuccucgcucucccaaagugcugggauaauaggcgugagccacugcgccugcacccagagagaagaauuuuuuuuuuuuuuacuguaaaagggcaaucuuggauaaaauggguuguauccuaaaaguuuauuugcauguacuuuaauuuuuuuggaauuuugugccaaaaaugucuuguuacuaaagagggcuuagauuguuguuuuuaaaaauaauucuaauaacuaaaugauaaaaaauaacuuuuuauuuuucaaccaggcgugguggcucacaccuguauucccagcacuuugggaggcugaggcggguggaucacuugaggucaggaguuugagaccagccugaucaauauagugaaaacccaucucuacuaaauauaaaaauucgcugggcgcgguggcucacgccuguaaucccagcacuuugggaggccaaggcaggcggaucacaaggucaagcguucaagaccagccuggccaacauggugaaaccccgucucuacuaaaaauacaaaaauuagcugggcgugguggugcauaccugucaucccagcuacuugguaagcugaggcagaagaauugcuugaacccgggaggcggaguuugcagugagcugagaucuugccgcucuacuccagccugggugacagaccgagacuccaucucaaaaaaaaaagaaaaaaaaaaaagaaauuacccaggcgugguggcgcaugccuguaaucccggcuacuugggaagcugaggcaggaaaaucgcuugacccaggaggcggaggcugcggugagccgagauugcaccauugcacugcagccugggcaaugagagcgaaacuccaucucaaaaaaauaauaauaauaacuuuuuauuaacuuuguugaguaauauuguaugagggagggauguaguucaaagaggaauaaggacauauaauucuuuuuuguuuuuuaacaccccuuguccuaauguaugguacauauaauucugaacaagaaaaguugagagccacagucaacaccuaucugaacuccgugacacaggagaugaaggguaagagauuaggacuagaauuccuugucugaccuguuggugaagucaccaguccuuaacaacauuuuagcuccuccaggcaggucauuacaaccuccaaauauauggaauauuuguuucuuguuggugucaguaccaacuaaauuacuuucuucuugagauucuuucuuccccuucuuuuuguuuuccuuugcuugcuuuucauuuugguuguuuuaauuuuguugauuuccauacuuuuagugaaaguaaaaaugucaaagagaaguaaguaugaaaugggauaacaggagauaauuccaccagauggaaaugaccaaagcugaggagguucaaaauaaguaaagcucuucccuaaucaugaaaggaauacaugauaaugaaauuuugaaaauuuagaaaaaugaaguaauaaaacucaaccauauggauaacuauuauaaacauuguccauuuuuuggucuuuuuucuaugcauuuuuccuaaaauuggaaugaugcgacacauuccauuuuacauccuuccuuuucacuuacaucuuucaauuuuuccauuuggguauuaaauacuuuuaugcaauguuugugcauuucaggucuuugacccccucuguguuauuauaccuuccuccacagguuacuuuggcuauucauucucauagcuacucucccuggaccuugucaacuacuggaaauuucugccaucuuuauuaucaaacucaaguaucucccauuuugaccacuaccuuucagauuuccaaagucuauacaucccaccuuacccuucuuuuuaucugaaaguccucugaucuaccccuccagccuuuucuuaccaacaacagaacggauguaacucauaaggucucuaaucagcagcagcagcaccugagaacuugucagaaaugcauuauuuccagccccaccccagaccuacugaaacagaaagugggauccggcaaucuguguuuuaacaacccuuccugguaguucugauccacacucaaucagaaaaacacuuauguaggucucacucccaccuaccaccucuaaccaacuguuuucugaacuuucuugucuaauguuucuucauuccucagacaaauguguuaagcaauuaguaugucccaggcacagggcuggcuaggcacuggagacaagguaaaacaggcaaguaggccuauucuuuguccacgggccaguagaaaauauuaaaaagugauuucaauaaacuccaggguuugggggaggcauauagcauacaccugaucugccuggugggaagaggguggucagagaagacgucagucuaaaaauaagugacacuaaagcugaaacccgaaggcaucagccaggugaggaggaggaggaugggggccaaauguugacuuuuuacaagcccuuuggcuucaggguagggaacuggauggguugggagggcggcggguuuguagacuggagagaguaagccuaguuaggaggcuagaugacaguugaaggcaggcugaacuaucauuguugauuguggagugcagauaggcaaacaaaccacccugugaugagggcaucguuaacacugucucagcucuucagaggccuccagcucccccaguucuggagcugcugcucuaagggguaccugggggaugucucugggguuuacagagucccuggggcaugucaggaggguguccacaaggcagaggcaguguuuggggcagaaagcaacauguaggggaaacaagcaaagcuccugaugggcagugaguagguggaaguccugguacagggggauccaaguccucucccagcacccagagcugaggcucaagcagcauggcugagcagaggaggccucccugacggugcguggggaggacucgggccccucauagggguccugcuccaaccccucuucuuccaaaaggccuggaucagaucccaggacucccuagcauccuggggucaccaccccauaguuucuuuaucccuccaccugaaagcuucauuuuuccccacuuucuuccacaauucaccuuaauggcccauuauaaccugagcccaaaucauuagcaaaugaagaaccagguucacuuuucucuaaggcagagcuggcuugguggggaggcgggagaggaagcagggagggagguacucucccacugguuuaguucuaauguuaaugaagcaaaaaaaaggagguaaagcagcuaaguuucuguguuaaaacugcuugaaaauucacuuuugugugugugugcaugucggagggaguguguguguuucugccacgaaacauauuuaaauguagauaagacuugauggguuagaugucagagaugaaggagaaguuggaguaaaagaugacuccaaagucuguggcuuagagaacugaguggauuucuuuuuuuacucaaccaacaguugcucauugagcacugaguucaggaucuauaaugguagacacaaauccaccccugucuuucuaguguuuacuuuuauucucggagacagugggaauaugaugaguucaauuugaggugcccaggagacacccaauugaagaugccccagaaggcagaugggaaccagaagaaaucugguacuggagagaaaggcuggguugcaaauauuggauuaggagccaucagcauagagagauuaacugaggccaccagaguggaugagaucaauaggacguuuccauaaagugagaagaaaacagagccuaggcuagaaacuaaaaagaagcauuuaaagaaugggcaaaggaagcugcaaagcugcaaugguuuccuugaagacaguccuagaauaauucaaacauauuagccuucuucauugcugaauuuggacuucuaagcuacuggagaaagucacagaucugugcugauugguuccagaauacacucauuaucccccaccuccacaaugcccugaaaucacucuguuuuccuagucaguucagucugcauucuccugccaccugccucagcacuuucacuggagcuucuaaccuacgucacuaucacggagguaacaagccaaugaacaagaaugccuucagcuucagcuucuggcaccaaacuugca

SEQ ID NO: 13612 - RNA, 2007 nt, Homo sapiens
uuugcuacaaauuuagguccuucaauguuuuaaauguguggaacaaugcuacaucuauacuuggguuggcuuaaucaaccucuucaauggugggcccugaggaagcaccaccagagggaggagcuccaccaccagggaaucccccaggcauuccuccuggcaugccuccugcacucugguacagcuugguaaugaugggguuucagacuuucuucagcucuuucugcugauguucaaauucuuccuucucggcagucugauucuuaucgagccaguugauaauuucauuauacuugugcagaaucuuguguuuguccucaucguuaaucuugccuggaaguuucucaucuuugagaguugcuuucauguugaauucacaggaaucaagugaguucuuggaugacacuuucccucugcuucugaucuucagcuuuguacuucucagcuuccuggaccauauauucaaugucuuccuugcucaaauggcccuugucauuagugauaguaaucuuguucuuuuuucuuguacucuuguccacagcagaaacauugaggaugccauuggaauuagugucaaaagugacuucaaucugaggaacaccucggggugcaggagguaugccugugaguucaaacuugucaagcagguugucguccuuggucaugguaugcucaccuucauaaagcugaauaagcacaccaggcugguugucagaauagguagugaaggucugugucugcuugguaggaaugguaguauuauguuugaugaggucaguuaugacucuaccagcaguuucaauaccaagggaaagaggagugacauccaagagcagcaaaucuugaacauuuucagacuugucuccagacaggauggcugcuuggacagcugcaccauaagcaacagcuucaucaggguugaugcucuuauucaguuauuuuccauggaagaagucuuggagaagcuucugaaucuuggggauaugaguagaaccaccaaccagggcaauaucaugaaucugugacuugucuaguuuggcaucucgaagggcuuucucuaccggguccagggugcuaaggaacaggucagcauucaauucuucaaaugaggcacagguacuggagguauagaugucgauuccuucagagagagaaucgaucucaguacuggcaugggugcuggaagagacaguacucuuagcacguucacaagcaguacggaggcgucuuacagcucucuuguucucacugauguccuucuuaugcuugcgcuuguacucagcaauaaaaugguugaccauucgguugucaaaaucuucuccaccaagugggugucucuggcuguagauuuggccucaaagauuccauccucaauagugaggauugacacaucaaaaaugccacuucccaggucaaagaucagcauguuucuuucugcucuaaccuuuuugucuaagcuguaagcaauagcagcagcaguuggcucauuaauaauucuaaguacauugagaccagcaauaguuccagcaucuuuguuagccugacacugagucauuaaaguaagccggcacugugaccacagcauugguaacagucuucccaagguaggcuucugcaauuuccuucaucuuugucagaaccauagaggacacauccucuggauagaagcuuuuggucucucccuuguauucuacuuggaccuuaggccugccagcaucauucaccaccaugaagggccaaugcuucauagcagacuggacaacagcaucaucaaaucuguguccaaacagacguuuggcaucaaaaaccgcguuggugggguucauugcaacuugauucuuugaggcaucacugaucaaucguucaguguccauaaaggugacauagcuuggaaugguucaguuucccugaucauuggcaauuaucucuacuuuucccugauggaaaacacccacacaagaguauguggugccaagaucaauaccaacugcaggucccuucgacaug

SEQ ID NO: 13613 - RNA, 2401 nt, Homo sapiens
aaggggaacuaagcagcaguugaggcuggaacauuucaggaauccugcagaacuuuauagaacaaggugcggauguuggaccuuauccaaaagucaaaggaagccacuggaggguuugaagccaggaagugacaggcccugauccacauuuggaaaggcuccuucacucagacccaugcaaagcccugcgggcggguggguuuauuggggccacuccccucggcugccuuucuccaccccagucaccgccuccugcuucucagcuuagccaucugaggagggugggaaacguguaauaggggcggggggaagaaaaacguucuuaaaaaaaauauuaaaaagaaaacaucccacuuggcagcgagugcgcgggaaguucagcgcgcgaguuccgggcuucccgcccgcccgcagacgaccgccggugagcccccagcccccgccuggccgcccgcuucgccgcguccgucaguccgucggucugucagccuccccuucccccacgccuccuuucuccgggcgccgcgcgggucgggaggucggaggggcccccuaggucuucaggacgcccuuggcccgcgucgcugccggcagcgccucggcggcggcggcgccugcagaacccgguaccuggcagguucgggucucugccgggcagaaccucgcagcccauacuccacggcuggggccucugacgccuccgcuuguggaguucuucccugagcggcuguaacuuuaaaccacucugagcgaggccuauuuuuauucagaaaccagcgaccagggcgucuguggagaaugcucagauggagggccagcccgccacuugaaguuuucucacaaaucugaggggaaggaacgucuuguccuaauaaucucucuuugcgauuucacaguucuguugccgcguccuaggagggccagauugguggcuguggggacuuuuggaugaggguguugccugagcugggggagucgugucugaacuccauugcuuggccuuuguguggugaucccgaggccuccacacuugaaccgggccaaagcugugaccuaguauccccccacagggauugcucaaagaacuccaggggacaaacucacaguggcaaggacaaggagaugaauguagcagccaaguaccgcauggccucccuguaugugggugacuuacaugcagaugucaccgaggaccugcuguucaggaaguucagcacuguggggccugugcuguccauccgcauuugcagggaccaggucacccgccgcucucugggcuaugccuacgugaacuucuugcagcuggcugaugcccagaaggcgcuggacacaaugaacuuugacaucauaaaaggcaaauccauccgucucauguggucucagcgcgaugccuacuugaggagaucuggaauugggaacguauucaucaagaaucuggacaaaucuaucgauaacaaaacccuuuaugaacauuuuucagcuuuuggaaagauccuuuccuccaaggugaugagugaugaucaaggcuccaagggcuaugcauuugugcacuuucagaaccagagugcugcagacagggccauugaggagaugaauggaaaacuacucaagggcugcaagguguuuguuggcagauucaaaaaccgaaaagaucgugaagcugaacucagaagcaaagccagugaauucaccaauguuuacauaaaaaacuuuggaggugacauggaugaugagagauugaaggacguuuucagcaaauauggcaaaacucugaguguuaaggugaugacagauuccagugggaaauccaaaggcuuuggcuuugugaguuuugauagccaugaggcugccaagaaagcuguugaagaaaugaauggaagggacauaaaugggcagcugauuuuuguaggccgggcucaaaagaaagucgagcgacaggcugaguuaaagcaaauguuugagcagcugaaaagggaacgaauucgugggugccaggggguaaaacucuauauuaagaaccuugaugacaccaucgaugaugaaaaacuacgaaacgaauuuucuucauuuggaucaauuagcagaguuaagguaaugcaggaagaggggcagagcaaaggguuuggcuugaucugcuucuccucuccugaggaugcuacuaaagcaaugacugagaugaauggccgcaucuugggcuccaaaccucuuagcauugccuuggcccagagacacuaggaaagaaaaacguaccuuuccagcuaguaucugcagcaggugggagaaugauagugaucucugccugaauugaccucaguaaauuucauauuccacaugaugggugcuuaguuuaguaaacuuuaugauaaaacguuuuuuauacaaagccauuuuuuuucuuuug

SEQ ID NO: 13614 - RNA, 779 nt, Homo sapiens
ggaaguuuugguucuuuuuuccuccccuguugcaaauucucaugguuuggguugggugguggagagcgcgugucaucugcggguggcacuguccacggugggcgggcgggccucucuacucgaaggugaccacguuuagauucugagacgggaaguggagggugaauaggucaaggcggccuuuuuuuuuaguuuaacuuuuccuuuuuugcugucuagucauccucgucggucuucugcuucuugguaucgacaucgucauccucaucaucuucagcugcccgcuugcccguagcugucucagcuuccucaucuucaucuccauccucuuccucaccaucaccuucuuccuccuccucuuccuccccaccuucuuccucuucuucaucuaccucauugucagccuccugcuccccauuuuccucauuagcauucccguuagcaggggcgucucuuccauuuucugccucuuccacaacuuccuucuucuccuguaaguccuugguggugauuucggagcuggugucuacggcugcgucugacaugguggggcacgccggugauccgaugcaggcgauuaaaaagaaagcgagaguucagggacucuggcgauaaagcugccggaguccgcggcggcggaggaggcgcguggcggaggcggcugcggcgagcaaggaggcugccgcgagcaaggaggcugccgcgagcaaggaggcugccgcgagcaaggaggcggacgaggaacaaugcaaagauggcuuuucagagcagccaguggg

SEQ ID NO: 13615 - RNA, 2253 nt, Homo sapiens
guuuacuaaaaccaauuaacaauuucacuuuccuuaaaagcagaauaauuucaagucugaaguuuucauucagguuaaaaucagucuacauucaaugcuagagguucaacaaauucuaagacaggucauccgcuacaaagauaggcuggagcagccacuuucaauuuugccugaauuuuaucacuaacugugauaaaagggcacuuaaccucuuuuagcuucccuugccuugucuuugaaaaugaguggguugaacuaaauuauaucuacgaucauuuccaauucugugauucuagaaccaucaaucuaaaucuacauggauacaaccagagcuauaggaauacuguuuagugggugggaaaaugaaaugugcacagacagguaaauuuaaggcuaaguagaguuaagauccaaguuucauauuuucuuuggaaaaauuuugauuuauuuagugguugcuauuuauuaagaccguuggccagucagccaaggcagacagagacugcaaguuaguuccaguugcugaaaaaguugcuuccaguaagaguugggggugagggagaaggcaaggcuggaaauagaaacguaggagaauuugagcauaucucagaguacagagagaucacucucagcugggggagaaggaaaaucucugugaaagaagaaauuuuucagaugcaccuuggcaggcagaaauaguagaaggaaguuucugaugaagguaaucuugucauucccaaaauaucaugaugacuaacccuaugaaaguuuaaaauguauggauaaaaguuuccaugccacuacaggguuauuauaaaauuuaacuuaaaucccacuucaacaaaugucagucauugaagaucuuuguauaaccaauauugcaaaaccuuugcugauggauuacuuauuugaaucaaaauuuaauauagcaaaauuucagugaaggagaugugacgggcucauaggguuuguugucuauccucuaauaacuuuguagucuccucacauccagucacaaacuuccucugaguuggaagccauaugaaacuuuuuguucucugcagcagucuauaagaaaaaauuacuuaguccauuuuuaaauauuuauucuuucuauaauaauauuauacacacaaaaucucagcuuugacccucggaggagagccgaagguccaacguucugaugauuucauauggacauacacuagcuguuauuugaagaauaaauauuuaaaucauagaaugaguaagcauuggaagaauaaugauggcguuuucuuuguuguuaaucuauuugugccugaauuugcuuuaaaugccccuuuaaauuuuuuucuaauauagugggacuaaggagaguaaucauaacucguggcaauaucggaggacaggggugugacuguggccauuuagugcaggagcacagcaucaguacagucugcggcuguuuucugguggguuuuaaucucugcugucgcugccuaucacaagauaacuggagcccagguuuuucagacgguauuauaugcugaugcuguguuaccaaccucuguaauuucugaguuucucauuaucaaaggugggagccucaucucugcuuaacacagcagugccuggagagguaauaaugaugaugauuuuuaccaucccugggguuuagaaugucuccucuguuaugaggcuugcccaguggcgggagguagccucagaacucccuaccccuggagcacuuaguuggcagcauuuggaagugugugcuuguaucuccgcaagcugggagacugggauggagagccaaaaagggagggaggaggugaaaugccuagggaguugaagggaaagaagugagaugagguaaaggaaucuugaguugucaggaaauacagaagcaaaaccagguagaaaagaaaaacaaaaacaugggacaaaaaggaaaaggugggaggagguggauggaggugaggauggcaugcuuugagauagcuguuuggagccuggcccuuauuuuccucuguccaguaaauaaaacugaauuuugucuuccuguggcauugaucuucacucugggcagguaagacuuuccccugguaaguguugaacaauuuagggcaggcccccugccaaagcuaguguguguuguccagugccuuauaugguaguuuaucaauaggugguuguaauuuuaaaauaaucuaaucuccugucuccaaggaagcugccaugaagucacugacgugugaucggugggacauu

SEQ ID NO: 13616 - RNA, 4721 nt, Homo sapiens
uucccuaccguguucaaucuuuuaaaaauuaauaguccugagugcagucuucuggaaccagaaugccuggguccaaaccacagcccuaccguguacuagcuguaugacuuuuauccagucacuuagccucucugcgccucaguuucuucaucuguauauauauauacaccuaucucauuagguugaagauuaaaugaucuaauaagcaugaaaugcuuaguacaguguaguacauaguaaguagcauauaaguauuagcuaauaauaauaauaaacaaugaaaaugaggaugagguagcagaaccauaaccuugacuaccuuuguggaaccucuauuccagggugaaaauacagauaccaagaguauauaacauugaaaauauuuuggggccuggugugguggcucacaccuguaaucccagcacuuugggaggcgaaggcaggaggacugcuugagccuaggaguucaagaccagccugggcaacauggugagauccuaucucaaauuuaaaaauauauauuuuggaaagccucgauucaugccucuggucaauauucauaaaguauuauggcccauuggaaacgaucaugcuguagcagggaaagagagccuaacauucucuccgauugcaaaaauaacaugcguaagagccacuucugaucaaguaacccaaguugauuagauucuguucaccucccccacacaaggccucugacggcacacacagaauggaugcagcauccuacauucuaaguguaaucauucaaaccaaccuaaucauuuuuuugacaaaggauuugggaaauuaauguaggcuuguuagccaggggaaugguaguaagcagcagcuucagucaaagcuagcuucaauacauacauuaacaggcaagggguaugguggcauuccccagagaauucaaggcaaaagucaggugugguauaugggcguuuucagaauucaccccgauaaggucaaccucaagaucuuauucucacuuccaaucucacacaauagaaaaaccuauucaguuuccacuacauaacccuuccuagagaccacuuuaaaagauguuacuguaguccacaauuuuuaauaggugcgcuugaaauggcauuguaaccauuugcccacucacuucaggaggcaugaaaggaacccagauucagccauuaaagucuuacauuagacagaaaucaacuuaauuuaacuaaccuaguaccuuccuagauauacuuuucuuaccuuucuuucucacaucucaugaccaauuugcagauaugcacugcugguuuaguguaccuaaauacagucauuacagacuucuucuaucguaucuucuggagagacauuuugggauacacaauuuuuuuuucuuccuuccuuccugagacacuuugggauacacaauuuuuucccccucccucccucccucccuuccuuccucccuuccuuuuuuuuuuuagaugaggucuugcucuuucacccaggcuauacagcacgguggcacaaucauagcucacugcagccuccaacugcugggcucaagggauccucucaccucagccucccugcuagcugggaccacaggcacaaacaagauccacaauauuuaugcauuugaagacaggaucucuuauguggucaaacaucucucaaucucucuauuuagucaacuacuauuagcuauucuagagaggaaaauuaguaauuauugugggcuugaaaagagaguuccaaucacaaucaaguuugucuccugagguuaaaagcuaaccaaaggccgggcgcgguggcucacgccuguaaucccagcacuuugggaggccgaggcaggcggaucacgaggucaggagaucgagaccauccuggcuaacacggugaaaccccgucucuacuaaaaauacaaaaaauuagccgggcgugguggcgggcgccuguagucccagcuacucgggaggcugaggcaggagaauggcgugaacccgggaggcggagcuugcagugagccaagaucgcgccaccgcacuccagccugggcgacagagcgagacuccgucucaaaaaaaaaaaaaaaaaaaagcuaaccaaagugugacaccuacaaugugaaucugagugccuccccuaaugaguaaugagcaguauuaaauuacagguuacuacugauaccauauacaaaaagcuagaugaugucuuauaaaaguaguuauuaaccaaagacaaauuaacaaaaccuuugguuaaaaggcuucguaucauucuugauaugauaucauuucuguuucucuauuuccuuauugguacaugaaacugcaaaugugccugauguagauuaauauuuuaaggguauccaaucguuaggcaucaugccuccacauuaaucuuuugcauuuuguugcauauaauccuuuucccacaguucuaauuuuagauauaguuaguccaucagaauuaaucuuuucccauauaaagacuggucacagcuaagaucgaauaguuucuccuuaaucuuuuuuuuuccucauagagaaacauauggauuauuuuauuaacuggucuuuuuacucucuuuucauuuugaaauuacaaacagauagggaaaagguguccuucacugcuuguucccagggcuaaagcacugcaguaacguucgguucacaacucaauagcauccuugggaauggguuacauuguggcaaucuuuauccauuauuaaaaauacacacagugguuuuauggaaaauguacuucuacuaucaacaaaaaucuuuugggcuaaacaccgaauccacacugagggacagacuuaacuuuaagcuucuaauauagccugcacuuuucuaaguuuacagaagaguuguuucacugaaaauucugccaguggauaugcugcaaagagaaauagcaaaaagcaaagucauuuucauuuggacgcauaaaacuaugaugaacucaggcucaauuucuuggcuucuuaaagcuuugggauuguuuuuaucuugcacagugguauccgaagcagagacauuuagcuauuccuaauugugccaaauagauacaaauauuaauauuucacuggcacuuaccauggccaaggugaaauuuaaaauguuaaauacuccuuauuuuccaauaaauaaugcacucuuggaagccuuagaagacuaucccagcaacuuuacgacauagcacguccuucccuugauucuaauaguaaacaaguuccaagguucuucuacaaucaauuucuacaaucaaucagaaauguucuuuggcuggcaaucaugacuaaagcaccacuuugaaagggaaaaagagguguuaggcuguguagacucaaaguagagagaaagccuucauuguuauauacuagccacugauuuagccuacgcugauacucaauauggcaaagcaaaaacuagaguuuuacagacauacuuuguuaacuggcuuuaaucccucaaagugauaucuaagucaaauuuuaaagaccaagacaaaauuuaaauauacuagagguauuuauacuuaaaagguacugaagggaacuauuuaucuaaagaaaauguuaaaccccaauuucauagcacaugccacugcucaauagugcaugauaugguuuggcugugucccaacccaaauuucaucuugaacuguaguucccaugauccccacgugucaugggagggacccagugggggguaacugaaucauggggcaguuaccuccaugcuguucuugugauagugaguucucacgagaucugaugguuuuauaaggugcuuucccccaacuucacucugcacuucuccuugcugcccccauuugaagaaggcuguguuugcuucuccuuccgccaugauuguaaguuuccugaggccuccccagccauuuggaacugcgagucgauuaaaucucuuuccuuuaugaauuacucaagucuugaggcuaauacagugcaauuuugagugauuuuuuuugaauacuuauuuuuuaaaguaggugagaaauugauucuucucacaggaauaaucaaacgagacuuuuuuuuuuuuuuuuuuuaaacagaguuucgcuuuugucccccaggcuggagugcaauagcgcaaucucggcucauugcaaccucuggcucccaauucaagcaauucuccuaccucagccucccaaguagcugggauuacagaccugaaccaccacacccagcuaacuuuucauaucuuuaauagagauaggguuucaccauguuggccaggcugguauggaacuccugaccucaagugaucugccugccuuagccuaccaaacaaguccauuuuauaaaaccauuuugggccgggcgcgguggcucacgccuguaaucccagcacuuugggaggccgaggcgggcggaucacgaggucaggagaucgagaccaucccggcuaaaacggugaaaccccgucucuacuaaaaauacaaaaaauuagccgggcguaguggcgggcgccuguagucccagcuacuugggaggcugcggcaggagaauggcgugaacccgggaggcggagcuugcagugagcugagaucccgccacugcacuccagccugggcgacagagcgagacuccgucucaaaaaaaaaaaaaaaaaaaaccauuuugaaaaucuaaaagugccaucauuucuuaaaauaaaucacaccaauaguuaacuugaaguaaauaucuuuaaggacuu

SEQ ID NO: 13617 - RNA, 1026 nt, Homo sapiens
acauucaacaggcagcagcgcagcgggcgcgccgcuggggagagcaagcggcccgcggcguccguccguccuuccguccgcggcccugucagcuggagcgcggcgcaggcucugccccggcccggcggcucuggccggccguccaguccgugcggcggaccccgaggagccucgauguggauggccccgcgaaguuaaguucugggcucgcgcuuccacuccgccgcgccuuccucccaguuuccguccgcucgccgcaccggcuucguucccccaaaucucggaccgucccuucgcgcccccuccccguccgcccccagugcugcguucucccccucuuggcucuccugcggcugggggaggggcgggggucaccauggccgaggcgccucaggugguggagaucgacccggacuucgagccgcugccccggccgcgcucgugcaccuggccgcugcccaggccggaguuuagccaguccaacucggccaccuccagcccggcgccgucgggcagcgcggcugccaaccccgacgccgcggcgggccugcccucggccucggcugccgcugucagcgccgacuucaugagcaaccugagcuugcuggaggagagcgaggacuucccgcaggcgcccggcuccguggcggcggcgguggcggcggcggccgccgcggccgccaccggggggcugugcggggacuuccagggcccggaggcgggcugccugcacccagcgccaccgcagcccccgccgcccgggccgcugucgcagcacccgccggugccccccgccgccgcugggccgcucgcggggcagccgcgcaagagcagcucgucccgccgcaacgcguggggcaaccuguccuacgccgaccucaucaccaaggccaucgagagcucggcggagaagcggcucacgcugucgcagaucuacgaguggauggucaagagcgugcccuacuucaaggauaagggugacagcaacagcucggcgggcuggaaggugaguggacucggcgcgcg

SEQ ID NO: 13618 - RNA, 1026 nt, Homo sapiens
cgcgcgccgaguccacucaccuuccagcccgccgagcuguugcugucacccuuauccuugaaguagggcacgcucuugaccauccacucguagaucugcgacagcgugagccgcuucuccgccgagcucucgauggccuuggugaugaggucggcguaggacagguugccccacgcguugcggcgggacgagcugcucuugcgcggcugccccgcgagcggcccagcggcggcggggggcaccggcgggugcugcgacagcggcccgggcggcgggggcugcgguggcgcugggugcaggcagcccgccuccgggcccuggaaguccccgcacagccccccgguggcggccgcggcggccgccgccgccaccgccgccgccacggagccgggcgccugcgggaaguccucgcucuccuccagcaagcucagguugcucaugaagucggcgcugacagcggcagccgaggccgagggcaggcccgccgcggcgucgggguuggcagccgcgcugcccgacggcgccgggcuggagguggccgaguuggacuggcuaaacuccggccugggcagcggccaggugcacgagcgcggccggggcagcggcucgaaguccgggucgaucuccaccaccugaggcgccucggccauggugacccccgccccucccccagccgcaggagagccaagagggggagaacgcagcacugggggcggacggggagggggcgcgaagggacgguccgagauuugggggaacgaagccggugcggcgagcggacggaaacugggaggaaggcgcggcggaguggaagcgcgagcccagaacuuaacuucgcggggccauccacaucgaggcuccucgggguccgccgcacggacuggacggccggccagagccgccgggccggggcagagccugcgccgcgcuccagcugacagggccgcggacggaaggacggacggacgccgcgggccgcuugcucuccccagcggcgcgcccgcugcgcugcugccuguugaaugu

SEQ ID NO: 13619 - RNA, 13565 nt, Homo sapiens
gguggccacugaaagucagcggcgcggacugcccugagggcgggaaaggguggucacugggucagcccgaagcaccugacaugagggcggggaccccgaaaugcacacgaaguccggaacuggucuucugugauuuucauucgcccuggucucuguucccuuucguacucaaagcucgugcauccagggaggggaaaccggagauagggucuucgggccccgggcagacccucugugccgcugcaaaccguugcagccugaggcugucagguccucccccagacaccugcggacccucccucuccuggcuucccgucuggucauggcgagauucugggucugcguagccggugcuggcuucuuucuugcauuuuugguuuugcauucgcguuuuuguggcucuccagugaguuggguagugaggaaaugacugucgggugugcggguagcccuguugggaggcgucgccacggucguggcauggagguggcaggcccugguucccucaguagcuugucucaaagccugcaccuggguccaaacugccuugacccuuugaguuuaaaaauuuguguauguuacaucgccauuuuccucuuucccaacucuuacuacauccucaaauaauuugcagacuuguauuguggucguguuggucuuuaggcaucuaagcucauuucuuuggaauuauuucaguccagcaaacuucuaguugucaaggcaugcuuaaaaauaagcccuguuacccggcccccccgcccuuuuuuuguucuuaccuagacgguaaacuaaaucugaauugucugauuuuguuuaagguuuugaggaacuuuacuuuugcaguuuccuggagaacugagaaaauucuuuaccggcuggauguggguuggccuaagcacccagaauauuuuaccggaacaacauuuuguguugcaguugacucccucaauggauugguuuacauaggucaaguaaguaaauagagauuuaaaaaaauuaugaacacaaaggaaguaacagccuuccugucuugcuguaguaacugaccauaugcguuuauaucaugcuaauugugcaauuuauuuuugaguuggucucaaguauuuugguuucgaaugugaaagauauguuagauuuugaaagugguuuuuguaguaaaauucucaguuauuuuuuuucuucgccaagauacagauuaccuuuccuuuaagcugauccuaagaaguuauuuuuuguauaccuucagagaggggauaacaucccaaagauauuaguguucacagaggauggauauuuccuacgagccuggaauuauacaguugacacaccucaugguauauuugcagccaguacucuauaugaacaauccgucuggaucacggauguaggaagugguauguauaguaauaucuauuaaauuaucuuacuggaaaucacaucuuugcacauguccuuguuuguauuguuuaaaaucagaguugcugaaucuaauuguaauuucuuuaacgauucaugaaaucacauguuuuuaacaaacuuuauuuuguacuucuguggaauuaagaaauuuaacaagggcuggacgccguggcucacgccuguaaucccagcacuuugggaggccgaggcgggcggaucacgaggucaggagaucgagacgauccuggccaacacggugaaacccccgucuccacuaaaaauacaaaaaaaaaaaaaaaaaaucagccaggcgugguggcgggcgccuuuagucgcagcuacuggggaggcugaggcaggagaauggcgugaacccgggaggcggagcuugcagugagccgagaucgcgccacugcacuccagccugggugacacagcgacacucugucucaaaaaaaaaaaaaaaaagaaagaaauuugacaaggagccuguuaauaugaucuuuccuugaacuugucuagggucuuuuccucuuuaaagcaucaguugcucuucucagauuaaauaacucuaaacugaagccaaauaaaguggcagucucugaaagcaaugacuggaauccuugacucuuauuuuccuuuuccaguuuucuuucauaaaagauugugaaaucguaacugcuuuguugcucaaagugcaaagauugcagaaacuguuguuaauguuuuugaaauucuacugacugaagcaugucugaaaucuuccugccaucaaauauuuuuaguagaaaaagcugaaaaaugaagugagcacaacugaaugugcagcuauggagaaaguuuucagagaaacaauucaccuguggcuguagcuuaagacaaggcaauaccugagauauccuggcauuacccuaggaauucaggaagaaaugggauuauaaagacauuauuucuaguauuccuuggcccaguuauguucuugaauugagagacauccugguucuacaguccuggcugauucagauaccauuuuuuagagauaaugaguucucaguuucuguaaguagugccauuaucacagcuguucucagaacccauaagauuucugggccucagcugauggcccauuuauuucaugcuguguuuuacauaguaugaaucugguucaaccaaaaaaagucuauagauuaucacugagugaauuguuaauacuauaaugagagucuauuuucacuuuuuuccugaagauccacuguuaaagaccauuucuuugaguucauuuuauucaugugauuuuuaaaaauaagacuuccuugauucccagaaauaaaaagagcacagacgaucucuucauuuuuuccauuacagcuaauuuucuacccagagaucugaagacaguuuuauauucccauuucccaaaggaauaaauuuccucuaaugaaaaauauggcuacaaauuagccuuuuuuuuuugagaaaauuuuuuauugguagucuuuuuugcuaguuuuuagaaacuuggaggcuuauguguuuuuuauugcuaugaacuuuagcucaacugucuaaaaguguaauaguaaauaaauuauuuaacauagaauuguaaugcaagcugauucacuuucuuucugguaagcucaauguauccaguuugucuuuugaauaccuaucaauuaauuuggcauauguaccuucaaauugauuucuguucacugcuuuaugauauucccuuauuaguagucugcuuuaugcucuugcuuguaagauaauuuuaacuuaaagaaauuuuaacgugagaaaauaagauacucaugauuuacaaagauuauuuucuucuuagcaaagaaaaguuggguugaauuuugaaugucuccacaaggugaaaaugcaguuaaaaaaaaaaucuguaccauagagaacguuuuuguugacuuacugaaauuuaaggucuguaugugagugauugaaauaacaguuucaaauauaaguuguucccuuuacauuuucuucuugauuuccuuucauaagcaaugcuuauucaaggucauaagauuaaaaaagaaaauggugcaccaauacuuuguuagcauucugaguuuccuguauaaugagucaauuauggggauguuauuuauuugaauuuagaauccgcuuauuuuggacuaauggagauuuuaauucgugaucaaauuuggcuguaauuuacgaagaagcuauagugcuugucaauuauauguaauuuccuaagccuaucaccuauuuguuauuauuuacuucuaucaaauuuuugcucuuagcuuacuugaaaaaucugaauguuuguauagugguuuuauuugugagauguacauaucuaucuuuauaggauucuuuggucauacuguuaaaaaauacaguucuuuuggugaucuuguucaagucuuggguacuccaggcaaaaaaggcacuaguuugaauccuuugcaguuugauaacccagcagaauuauauguagaggacacaggagauauuuacauuguggauggagauggaggauugaauaacagauugaucaaacugucccaagguacauuacuuguuuaugguauuauaaaaauauuauaaauugauuuuaauuuguucgauauuugguauaauguuuuaaguguuguguaugaagcgguguguaaagagcuaaguguauuacuacgagaaaacugaaaaacagauggguaugauugcccacaauaaaugauccugauaacaggcccacuuauucuucaccaaaggccaggagauuccuccaaaaguaacuggcaacaguaugagaauuucuagugggcucaggagauaaguguguauccuauuuaauuaagcauguagaaauuagaaaccuagaaucccagacucaaguauccuacaggcugauuaaucagcaagcauuuuauugagugcccuuucuguguccucucuaguaucaggaggugcagaucuauuauguauugaaacaaugaaauguagucuaugcuauugauucuuaaagcaaaauggacuuaggaggagaaacuaaauugccuggagaaauagaacaagauaucaugaaggaaguaguuauugaacuaaacuaguuuuggugggaggagaggggaggauggauggaacauucauggaggguuuaucaugcauggucuacaggcauuuauuagcaggaaagaaggugaagaugcacuuuuucagcagcagaaaauacaauuugggauguuucugaagucuuauuugaggauuauuaaagccauguuuuugccuauaacauuuuugagguuuuccuaguagaaaagugauguuacaacagcagguuuuauaagacauucuuuuaggaucuacuucaagugagcucugucauuuggaggcuguguagucaauuuaucaauuaguaacugaauuugguugauaacaguugaaagggaaauguagaauaaggauaaagcaagaauccaaaaaauugaaugaaagaaacaacgaaaucuaggagacagauugaauauaaguguauuaguuuccugugguugccauaacaaauugccacaaacugcguggcuuuaaacaacauaaauuuauucucacaguuuuggaauccagaaguuagaaaucugguagacugugcucacucuaaagguccugccuugccgcuucuaguuucugguggcucaagcauuccuuggcuuguggcagcaaaacucugaugucugucuccauauucacauggcggccccuucuucucuguguguuuuugugccuccagucuuucccuucuuucucuuaauaaggauuuagggcccacccuaaauccaggaugaucucaugagaucccuaauuuaauuuuaucugcaaaaacuauuuccaaauagcaucacauucccagguaucaggaguuaggacuuggacaucuuuuuaaaggaccacaguugaacccaccguagugcguaauaaaggagauagacgguaaaaucauaaugugaauuuuuaaggucuguggaauacuaauaucaaguaacagauaaguugggaaggggaaccaguuuuagggagaggauggcauaaacccuaaacaaugauuuugaagcagucaugaaaaauucaaguggagauaauaauuaaagaaguagauuaauucccuaaagcagagaaggaacuuuaaaaaaaaaacuguaagaaaugggcaaaugggcauauagacaggaaagccgagaaagcauagucaagugaaccagcgguguaauuaaauaguucuuuguaaccuguuucauaaaauaugcaaaugcaugagacauucuauauguugcucugacuauauauuuuuaccguuuauagauuucaugauccuuuggcugcauggagaaaaugggacagggccugcuaaguucaacauaccucacaguguuacacuugauucagcuggucggguacaaauacagcgucauugugucugggacuuugugucugaauauguuugugugugugugugugugugugugugugugugugugugucugggcauguauauauagauugugguauacaugugugucugggcauguggauacauguguguuaguggguaugucuggguaauuacucuggggcugggugugcacacauacuuucuuacaaguguuugaguccuauagugaggggguuccccaaacauuuagaaaggagcaaaauggauuuccuguaccauuuaaaaggauagaaggcacaaauaauggaucugaacauaaaguuaccugaaagaaaaaguugcccucuuacugggaaaacuccacuaaaaguguuugaauaucuuuucacuucucaagaaaaaaaugugcugaucuaaaguggagugggagagguuaaccuuggaagucugaaaaagagucaccuaggcaaacucuuguucucacuaacuccacauuguuuagggaacagaaagcuuuagccaacaaauuucaaucaguuucucucuuuucuacccuacucacuacuaucucuuuugcauuuacucaauuucuaagcauagaucucacuucuuugagguuaccuuuucacaacgaaaccgccaccaaaaaauuuguauauuaguuucuccugcucuuuuccuauagcagccuguacuucguaucauaguaacuaucaugcuauauuauaaucauuugucugucuccccuaauagaugucaggcuguugaaagugcuuacugaaucucuuuugcuuuauuucuuugugccuaguacacaguagucauauuuauuuauuaaaugacuaaaugucuugacacacaauggguacauuaggcuacuugccuucauaccauuaggcauuuaauccauuucuacuucugauucagugcucagcaaacaaacuucuaauuaugacuuggcuuccuaaucauaauugauugacaaaaaugagaauguuuugaucauuaaaucuucugaucugccauaagacguuaaucaaccaugugaacuuuguauauaaauugggaacuggaaacuuugaauuaaacuuuugcacauuauccuccugagcuugggugacucauugugugcuaagaaaaaaaaucaaauuucagaacaugcgagaccucgacccagguaaauucaucauggugaggaacgcccuucuaaaaggccuuggaaaucaucugauggggguacucuggcauuccugagugauaaagagugucaauuauacaaaauuguguuuuauaacaauagcaauucuguucugagcauuuuacauaauuaauucauuuaaucaucaccacaacccuauaugaaagguuagucaguuccagacuuguuguuauguguuaaacaggaguucccauaaucaaaauucauugaguguugagcaggacagaugaugcuaacaaucuaaaguaucauuccauccuaggguguaaacuauacuucuuccuuggucauuugucugggauacuagucucaaacucuuuaagaaaaccuauccuuacuaaaggaccauagaucaggaaaagaccuugagaaauugcuuuacuuuggcaucaacaaccuuucuuaaaugguguagugaguuuugauuuguuucugauuggagauuaauucaauggcuaccaaaauucacacauauugaugaagcuguaaucaggguuaccugugaagaaauuaucucucaauccacaaacccaagaaauccaaaggaccaaaagcagggagguagaaguaaagaggacugacccacucccaguccauucuuucauaccucucuacaacccuggccacaagucaucaaaaaccauuuccugccgggugcgguggcucacgcuuguaaucccagcacuuugggaggccaaggugggcagaucacgaggucaggagaucgagaccauggugaaaccccaucucuacuaaaaauacaaaaaaauuagccgggcgugguggcgggcgccuguagucucagcuacucggagaggcugaggcaggagaauggcguguacccgggaggcggagcuugcagugagccgagacugcgccacugcacuccagccugggugacagagcgagacuccaucucaaaaaauaaaaaaaaccauuucccuuuaugcuuuaagcugcaugcauguggccaugaaaugucauuuagaaugcaucucacuucuugucuuagaacaaguuccuuaauaacccauuacagccuauaacaaaccuaaauuaaaccuauuacuguucuuuauuuguugcuaaaauaccucaggcuucuucaguugguucagcacucuguacauaccuugguaauagcagguauggguuuaaugauacugcaaucugaaugaauaccucacauccugcuauauugagcucuugagaaguaaggcugcuuuucuuugucauguugccuggcccaggagcugacaagccaguaguacucauugaaaaaugaaugcuuguuagaggaaugaaugaauguugucaguuuucauuaucuacugauccccugcauuaugguagaguacuccagcuuuuuaguuauucacacauuuagaacaguagacagaguauuauaagcuuuggguuaagacagcuuuggguugugccucucccauuuguaagcucacuucagagacggcaaccuuucugaacuuuaguuuuuccucaucugaaaaugggacuuaacuaccuucuuuggaauccucuuaagugagauaauguauggugaaacuaaugaaaauaaacauucuuuucccuuuuuucuucucauggauauuuuucaauugacauuuuuguguguuucucagguguggguugcugaccgaggaaauaaaagaauccaaguauuugauaaagacacuggggagugguuaggagcauggaauaauuguuucacagaagagggaccuucuucagucagguaauuguuucauuuuauugcaaaaugcuuguuuuaguuaguguaugugucucacuuccucugaauagcuagcugaaaguuuaaaauauuuauuguuaauuuugaauuaggggaaaauagaaauauacagagaaauuugauauccaagauuuucagaugccagguaaagugaaaacaagaaauaacauaugcuagaccucuccucuagccuuuauuugguaaauguuuaaacaggacaaaaaucaaacccagccuaacaucaauucuucauuaauuucauuuuguggacuaugauauugauacuuuuaacaaauuuaagcuaaucuuuggcuuugcuuaccaucauggacaucuuauuccuucauaaacagaauuagaucaaauuaaaauucuucuuaaaagaaucauucagcaaguaggugccuacuguuguuuggcacaguaggggauuaaaauguugaaaaaaaauacccuuauguuuuuucacagacauuuauuauguuaaaugucuuucuccuuagguuuacuccugaugggaaguacuugauuguggcccagcugaaucuuagcaggcucucagucguagcagcacccccagugggaagcauuggggaguguucugugaucagcacaauccaacuagcagaucaaguuuugccacaucuccuagaagucgacagaaagacuggagcagucuauguagcagaaauuggagcaaaacaaguacaaaaauaugucccuuugaauagcuauguuccuucauuugguucauaauguuucuuuccugggaauauuucaaguggcaguucagauucucaauucacuaagugcuuaaaaaugauguucaagcacaagaauuuauuuuucuaguauaaaagaucuaguaucagaaagauuuguuuuuguaucauuaagaaucuuauauuuuguugcccucuugggacuuaguuuuauuuguaagugcauaaggauauuuuaaugaaaggaaaguaacuaaaaaaugggguugggaagagggacuaaggugguaaccucauuauuugcccugguagacugauucucccuggguaaaaaaaaugggaauaaaaaugagcuugcaugauaauuuauuaaauuucaugugaagaacuccagaccuccagauugugcaacuaacauaaaaugagcugcuugagagauuguaaauaagaugaacuauugauuaauuugaguacccacagagugcugugucuugacgacuuaaaaaugaaaaagcaggauugccuuuugaguagcuugcagucuaguggggagacaagcaggcaaacagucacaacacagcaaaagcgaccuuggagcauagugggacuuuuggaguaggagugcugcauuugacugagggaaucauggauacuucgcaggagaagugaauuugagcucagacuugaaaacugaggaggagcuuaccaagggacaaggaggagaaaacaauaauuuccaaguaaagaagguauaaaaaguuagaaguguacuguaaacuuugauaggcuuuuaggccuuuuuuaaagcccaacuuggcuucuguccauuaccuauaagauauuuaaugucagucagccuuuaaauguaggaauaaaauggcuggcaucuaagcacuuuaguaaaagagguuuuuacaaauaacuaaggauuguagagcuuccuucucuuuuuuuuucuuuuucuuucuuuuguuuuacaugaacucaacuuauuccuaacauuugucuaccucaaagaaauuucaagauuauuuagauaacauggauaugugccaaauccuuugagcuguuaagaugauaauuuccugcuuuccuccuacaucuucuccucccacucccuccuuuggugugaauauuggcuucccaauuaagaccuuuuuuuuuuuuuuuccaguuuguuuuagcuuauuauagguuuuggaggaacuuugccauuuuguaaucuuucaaaucauucuucacccuuccucacaucagcuuccugcuuuucccaguguuuuacuguaaauuguguagcauaugacaaaucuugagcugacuuuccucuucaccuguuauggcuggaguauuuuccagaccugaagggacucacacuuguuuugauacuuggaucacaucuccgugagguuaggaagguaaaucuaccaacaggaagcccuguacucuguauuccaaggccauugguaaauguguuggugccacugaucggacuguaugaccuuaaacaagucaccuuaguuuucagugaaaugggaauaucauugucuccucuuucaugaaugcugugagaaucagaugugcaacagguacagacuugcccuuugaaaucuauaccucuggauacauuagaggcauuuuauuaacaaaggcccuucuaaaugugcuauuuauuugacaauaacuaucagauuugccuuaauuuuguguuuauagcauuuaucaaaacguauccucauagacuuuaugcagauuaauauggucaauugauuuggauaaaagaaaguaauuucaggguuuguuuuuaagccaggacaagaagugcaaaugccucuuugaagcaauuuaggcuaaacugauuuugaaauuucaaaauguuuuauuuuacuuuguuuuauuaagccaggacaagaagugcaaaugccucuuugaagcaauucaggcuagguaaaccgauuuugccauuucaaaacguuuuauuuuacuuuguuuuauaucagagucuuauaaaaccugcugcaaauauuucugaaugucuuuguaaaaguguuuguuaguguaccugugauuauaguacuucacuuuuuuccuuuggauuaauugguuaaaugaaugagaaauguguuauguuuuuuacuaaaaaguauaaauuaaaauuuuggaaagaaaaggcaauauuaucuggcuccccaauuaaaguuugauuuuauugucacaaaagcagucuauaacuuuuuauuccuuuaaagaauuucagcaauuaugaaaucacaaguugaugcugaaagaauaucccacuuuucacacauauagcguguaagcugaugugcauaaauaugacuagaaguugcuuagaacauuuaaagaauguagcuuguuuugagguggugggaggguacaacugacaguaauaacuagcuaauugucuacauuucugcauuaaaaguggaacaucuuuauacuucuacuuuuuaggucuauucuuggaguggggaggggagaaaguguucuaaauuagaaaaccaaaggcuauagauuuagcucuaucuuucccuaccuguaccaucagauugggucuuucaaguggaauauuuaucgaucagagaaaacuuggaugaaaucugauggugaacagagauuuaccacgaauuuuuuuuuuuuuuuuuuuuuuugagacagagucucgcuuggucgcccaggcuggagcgcaggagucucgcucgcucggucgaccaggcuggagugcaguggcgccaucucggcucacugcaagccccgccucccggguucaugccauucuccugccucagccucccgaguagcugggacuacaggcgcccgucaccacacccggcuaauuuuuuuuuuuuuguauuuuuagcggaaaugggguuucaccguguuagccaggauggucuugaucuccugaccucgugauacgcccgccuccgccucccaaagugcuaggacuuuguucuuaggucacuuaacagauuaaaagacugcuucaagcaauguaguguaaggcuacggcaauaaaguccuauuuuguuuugccuuugcuguuuuuaagcacuuuugcauuugaaaacaggacagauuggauagucagcauuaaaauggaaacucaaauuuuugcuuuuuaggcuuaccaaaauaaaugagaguuuuuaaaaguccuaaauuuauuacuuuaauuuguuguauucucugcuauauauuuucagcaacaauaaaaaaucaaaauaaucaucuuuauugauucaguaaaaaguuuugagacaacaaacauauaaaagcacucagucaaguguccucugcucuaauaguucccuaccugguugggaaaacaagcuacuuaaaccuugucuuuuaguaguuuuaggagauaccauuuuuggcacuuguguuauguuacauucuugauacacaagaggucaguagcguucugcuuauaagcauuucuugaaaucaaacaugggcuaaacuucauacuuugguuguuuuuuuuuuuaauugaagcuacaguguucaccauacuuucauuguuuuucuuuuuucugccacuugcuuacaucuuaaggaaauugcuuuaugggugaaacauuuuccaagcauuguuggaaauuuuuuacugguuaauuggacuuguccacaauuaaaaaaaaaguuuaaaccuuuucaguaauucagacuaacagccagaagugaauuaacuuauuuuaaaugaaggugaaacuauaaucugaaugugugaguuuaguacaauagagaaugaauuuguauuaguggggaaucauucuuuuuucucccuaguaguuguuuuuuguugucguuguugcuguuguauaaaaaaaaaaaacaauuucaccuugugguugcuacuuuacaaauaagaaaaauaaguuuuuuauaaagacucuuaggucauuucuucaucagcuacucuggaauccaugaguuuauaaauuaauccucuaaacgcuaaaugac

SEQ ID NO: 13620 - RNA, 547 nt, Homo sapiens
uauuuauuuuuuacaugaaggcaauuuauuaacagaaaauauuuugaggaaucuuguucacagacggcgaccacggugacccccuuccugagagugcugucagaggggaugggggugacguccucaauccucccgaucuucauacccgagcaggcaagggcucugagggccgacugggccccagguccaagggucuugguccuauuuccuccuguggcccggaguuggauguguagggcaaugauacccagcuccuugcaccucugggccacauccuggguggucaacauagcagcauauggcgaggauucaucucggucugccuucaccuucaucccaccagucacacggcagaugguuuguuugccagaaagauccgugacauggacaaaagugucauugaaggaugcaaagauauggcagacaccaaauacauucuccccuucagccaccugagguccgagguugaugaccuguucuuccuucuuuuccuuccccuuuccaggugccauuucugcacgucgucuccagacuccacacgggaaag

SEQ ID NO: 13621 - RNA, 36196 nt, Homo sapiens
ccaguucucuucggggacuaacugcaacggagagacucaagaugauucccuuuuuacccauguuuucucuacuauugcugcuuauuguuaacccuauaaacgccaacaaucauuaugacaagaucuuggcucauagucguaucaggggucgggaccaaggguaagugagugguuugguuuuauaaaccauuuuucuuuuuccucagcuuguuagauguucaaguaugcauaaaguuucucauauaugccucaggguuuuuuuuccuaauuauuauaaaguaauaggaaaaaaaggaaaaugugaguauucugugauuuaucuaugcacuuuuaagcuuuaagacuuaauugcucucuaaauaccuugaauauaauugcuuucuuaugaaauguuauauaauucuaaucuaauuaacacaauuuagcugggcauucuuuuauaauuccauuuauuuauguuuuuauuuucuuccaaaaaucugaaauugaguuuucaaaauuaaaaaaucuauuguuaggaacuaucauauguaugcaaacagcauugaaauaucucacaugauguuagagaaaauuuuauuuaaauuacauaugaagguuaaauacuggguaauguaacuaguucucugaauucuuugaagcauuuaaguuacuuuuaaacucugaauucuguaaaauuugcaaagguaauuuauauuuuauagaacuaaugcaacuacaacuaagcauuuuuaaaauuacacauaauuuuguaacuuauccaaccauuuauaauuuuuuaagcggaucuuggcacuucuuccuaugccucacaggaauuuucauaauguucacaagcuucuuugacuuacagugaaaaaagacuucugucccuuuaagaggggaaggggaaccuuaaaauugugacagaggauguucugaucuguuacuuccauucaaaaagauaaauucuccuuugugcaaccauauuguuucaaaguuaauuuuagcacauuuacuucugugauuacuuaccuagaaaauuacagaguauagugucuguguacauaauaaaccuugucucuuuugcucucugaccucucauuguuccagagagcccugaaguuauggccauccuccaaaugagcacaugcuugguuuaaaaagggucaguagauuaucuaccauuaaaaguaauaaggcacauagaaauaaaauuacguucauacuguuugaauaguccuaguugguuaacuuuuugaaaagcuuguauuuuacucucagaaauguauaauuuuucucucucucccugccaccuccuguagacuuucgguuuuucaacaauucaguaggauugugucaauaauuagauuugugcaaggcuagaaucaugucuuuggauaucaaauccacaucucaacauuuucuucuaucaaccaaucuuuagauacgaaaaacuagucauuauuaggacauuaacuuuuuuccuuucccucuauccuccagcccaaaugucugugcccuucaacagauuuugggcaccaaaaagaaauacuucagcacuuguaagaacugguauaaaaaguccaucuguggacagaaaacguaagucucuuuuuuuuuucauaauaugucaguuccaaaaacaacaucaugauguauaugccuuccccuggguguacacaccauucuucuugaaaauacugaccaaaauugugagaguuauuuaaagaaaagaaaggaauacauacgugaauaaagaaguucucccugcaucuccaauauuacuauuagaacucagauuucuuccugaauccaugugacauggaggccagaaggaagcagaucacauggcucaggauuggguauagaauccgugugaguaaaugauguuguuucuacuccugguuuggcccucuuuuaucuuaggcaagucacuuaaccucugugacuuaguuuccucauuuuauaaaaaagugggccagaaaaacaaacugauuuaaaauaucagaguuucugaggcaaaaaguuaauguuugucucuagucauuuggaaauugucuaaaguauuccaguuuaccggagaguuuucaucaaaguuuaaaguuaaaaaauacuugaguuuuaucucuuuauuuaauccagugauucuccguucaagaugcuccauccccagagguccacaaggugauaacggaagcucaucauuauaguuaauaucucaauagcccaaaggaugauuauguuuuaacauauguuucacugauuagcuuaaaauuugaaagcauuauuuauuacuuaauagacaugccuucugguuuauuuuaccaauaaauauugguggaaaaaaguaauaaacacucuggacuuauuaaggucaagaaccacuccugugauccaaagucuuuauuuuacaaugagggagaccagucauaaauagggcaaguaaugcaaucagaaagguuuaggugucauccccagucaagaaaacagugcaaguggcuccuuccugcuuccuauuaauuugaaguccacccucagugaaggaucccuugagaaucaaaagaccccaggaagaaccugcuuaauacaucagcauuaaaauucaguuacccuaaguucggguggaauaauuuauuagaaacuuauuucuaaguuaauaauauugguauaaauccuaaacaugggccaggagugguggcucacaccuguaaucccagcacuuugggggggcugagacagguggaucacuuguggccaggaguucgagaccagccuggccaacauggugaaccccaucucuaguaaaaaaaaauacaaaaauuagccggaugugguggcaggcaccuauuugggaggcugaggcaggagaaucgcuugaaccuaggagguggagguugcagugagccgagauggcaccacugcacucccgagugggcaacagagugagacucugucucaaaaaaaaaaaaaaaaagauacuaaauauggaaucacuuaacuucuuguagacuuaccuguaaaacauggauuuaauagcuauauuauagaguuucugagaaaauaaaaugaauugauaaaugugaaauuacuaaguaaccauaaugcauaauaucaauuguucuuaaaauuaaacucuuuuaaacaaaugcauagauguagacaggaaaggaaguugugaccagaugccuauuugaaaugcacaagauugucuuuauuucuaaguaagaaccauguauacaaggcauuuaagcuuagcuggguugcaucuccacaugguaaccaagucuagggcaccagaggacuuugcugaccaucuccugcucauuggcuuaauagaguuucaacaugauguuaucuuuugaccugaacauuauuccuauuauugugcagacuucugcuagacuugugagucauucacacaauuauaaugcaaucaguuguuacaaugaucucugccaugcugcaagcuaggccccaguagggacucuaaggcucugaguuuuccucuuuguuauuuauauucuuggauaccaugaagcauauuugaaaugcacacuuaacuagauaagaaaggaccuucacccugaaauguuagggagaaugcuuauuacauccuuccuagaagauagagaagaaugccauaaauuuacuuuaaccaucuaaauauaugagagaugucaaggcuuguacagaggcuaugccaaaauucuuucuugcuuuccauuaaaaaaaaaaaaaucacuacuuugaagccuggcuuuuuuuuuuuuuaaccagaaauguaacagugucuccuuuguucaauuguauuagcuuauuuuucuaaaguagauucauuuucaaaaacauaguuacgucugggcacugaaauaaauguaaaugcuaauuucaaauaaccaaagaaaucaauacuauugacaggaagacugacuggucugccaucugcuugcuucugcugaaauuuccagagauaucaucaggacuuuaugaucagaugacagaaauguuugccuuucagcugacaguugcucuggggauuugagaaaaguaaacugagcaggccuaaugaaaaacgugaagcuuccuagggucaagauauuguccaaaauauauauuggucuaguaauauaguauucuggaaacuuccucuagagaaugucugugauauuuuuagcuggcaucucaugaaauguuagauacuauucugaaaacaaaaauaaauuucucauguuuagagcuauguauagcaauauuuuuuuuacucuuguuuugcccuacugaccauaugggaacauugaguuuuggguagcauaaauguucuucugaaaaaaacugcuuuuuuuuucuuuucaaaauauccgcucagagauaaccacauuguucaauuaucugaugauauuacaaugaacugcuggaauuuuaucucaucuacugcauuaauucucuacauuaugacugacccuugucauauuagcauuugcuaauaauaauuuuuuguuaaauuuccuuuucuauucacuauuuuacuucaaguaaguauuaucaaucuauggacuaagcacauuuguaucucauuuuuuaaauuguuuacaacauaugcuaaagcuaauauauaagcaauuguuaaucaaucuuuugacauccaauaauuagauuuauuuacaagagcucauguaaauaaaauuauuuagaggcucuauuaugauuugcauaaggcuccuauauaccuuuuauauguuuccaauaccaacuauucuucaaacuauauuaaaauuagagaauaacuugaaguggguauuucccauuuaauuuugucuguauuuuuagcuaucuauuauucuuaagccaauauuucaugccaggaauuuuuuauuaacaaauaaagaaugaggauccaagguuauaaaccagacuacaaauccuagauaauuacuuaguguagcaggguucaauuugaaaacauuuauuuacuuuuauucaacucuauaaaaucaucuuuuauaucauuaaaauuuuugcuucuugauaguuugcuuuuaucauuuuuaucauacuaaaaaaagauuuuauucuuauacuuggcgaucucuuucaugucuaaauuauuuuauucauucauacuucuugaauacaauuaagacaacuggauaaaaagccagaaaagaaauagcauuugaauaagcugauucauguuuaauuagugaauugcaaaauaauuaaucuauaauugucauaaucuguuugacaugauauuuaucaauuaaaaauuacaaaacgaugugcauuuauuuuuuacuuguaauaaucccccuauuucuaauuguuugguacauguaccuuuauauuucuuuugaaaggaaacauaaguaacuauguaaaauuugaguuaaaauaggcuaccuauguuagaugaugaaguccagaaaauauucuaugaaaugcgaaaaaauaaaaauuaggauuauauuauaauauuaauaauauaauuauacauuaauauaaucaguuuuuauuuuguaagcaauuauauauaauuuuaaauuauuauuuucccucaaaauauaguaaauuagauaaacuuauuuuuuguauaucgugauaucuugaauuuucuggucuguuaccuuaauuauugccuauagaacuuaacacacuucguuaacuuuaaacaggaugccacuuucuugaauacuaaacucuaauauuaaaauaaacuuacuuagauuauuuuuaucaaauuuuacaaaaauaaaaagauuuuaaaguuuauauauaauauaauacaauuaauaauccuaccaacaauucaaaccaaauauggcauuauuuuaucuagcaaugagauagcauguuacggacuccaaugggucaauguauuuucuuauguuuccaauuauauuaaagcagauuucuagccauuuuuaguuuacaaaaugauuucaaaagcauuauuucauuugagauucacaauuacucugugaguagauauuauagcuacuauauucauguuaaaugcuuggggaaacagggacuccuauugauuaaaugacuugcucaagguucacaugucaaccaaguaguagaacuaggacccaaaugucguucuucuggaucaacauuauggaacuuuucuauaguaacaugagacuguagugagaaaucaaacucauagaaauauagaaaaaaucggccgggcgcaguggcucaugccuguaaucccaacacuuugggaggcccaggugggcggaucaugaggucaggaaauugagaccauccuggcuagcacggcgaaaccccaucucuacuaaaaauacaaaaaauuagccaggcguggugguaggcgccuguagucccagcuacucgggagguugaggcaggagaauggcgugaacccgagaggcggagcuugcagugaacccagaucgcgccacugcacuccagccugggcgacagagcgagacuccgucucaaaagaaaaaagaaaaaaucaggggggaaaaaaaaccugauuuuuagaaccucaacaaaucaagucaauaagugaaauauuuugucaaauuuauguaaaaauguauccuauuuaguuucucauuuuaauauuaauuuucuuccuauguacaggacuguguuauaugaauguugcccugguuauaugagaauggaaggaaugaaaggcugcccagcagguaaaaucucaauuuuuugaauuaaauaaggaauuauaugcaaagaaaggguugagguggcuuguggagaagccaauuguguauguguguauucagcaccauccuaaauccaagauauaucccuccuauuuuuguguuaaucaugaauuuaugaaugauaaaauauaagagcauauuucucaugcacuggaugcugggcaauacaacagaaacuuagucacaaauuuaaauuaguucagcuucccuucaggaacaaaacucuuuacaaaauccuguucuuugaacuugucuaggaacauggaacucaacuacuuggcaaaacuucaucuucucuaguugaacagcucugauuuuauaauauucuuuauauugaaauuugguuuccucuacuucugccaacuagagaaaaaaaaaauagcucaucuauuuccucuuugaaauggcagccauucagauauuucaugccaaucaccacaccuuuccuccagcuaccuucucuucuugaauaaagucuucuauucucuggcuaaccauccccaauucuuuuaauaugacacagacuuugaagcccuccccauuauaacaccaacccacagaaagucucuaguccaguaaucuuucuucugaauacaaaccuagacugauauuuaaaguccauccaugugggucugagcauuuaagacaauaccaagauaaguaccugauuuggggacaccuugcacuuuggauaaugucauugguaaccauguuacaucauuagcuuauauugaauuuagaaucaauuaaaauugauuacaguuuuuuuuacauacacuauuaagucaggucucuaggauuuguuuuucucaauuuaggcauaggaauuacauggaaccuuguuaaauuuaaccuuguucauuuugacucaauuucuccaucuuuuuagggucuuuuaaaauccugguuuuauacuuaauaguugugucaccaaaucuaaggauauucacaaauuuaauaaccauugauucuaugcuauuaaucaaauuauacuaauuuucaaauaaauagggucagaaaaaauaaguugacugcacauuaccagauaaaucccuucaggcugacauucauucaugaaucuuucuucugacguucgggagaaauaaucuggaaggauugaauauuuuaaaucauuugcucccagaaauuguaaugaaaacaagcaggccuacauauuuuuagggacccaaaucuauaaaaaugauagauuuaaauaacagauaauauugaauuauaauugaauuauuauugacauagcaggauugagaucuaaauagguuaaauguuaaaccaggaugacaguuuaaauuuuuuuuuccucaacacaaaggauauguaaaauaauguuuuucaguagcauuuuauuauuuagcacucaaaagauaacuuuuauauaaaaaugauuauucauauaauuguauugcuaaaauuauuagcuaaaugucuugggaaacacagcauaaaguuuaaaugauuaugaauaauauccugagaauauuauccccaguacugauucauuucuugauuauuucaguuuugcccauugaccauguuuauggcacucugggcaucgugggagccaccacaacgcagcgcuauucugacgccucaaaacugagggaggagaucgagggaaagggauccuucacuuacuuugcaccgaguaaugaggcuugggacaacuuggauucuguaauucauuauuuuuaucaauauauuuauuuuuugcuguuauuguuauuucauuuuaacugacuuauuaacuuggauauuaguagaaauuuuauaucuuucuauuguacauauaugagaauaccuaaagggaugaguuauuaagggaaguaaaauaucuuaauacauccguaaauagaauaaaucuccaggagacuuauacuuuaauuuuuuuaagaaggggaaucaagaaucagcuaaaagggcacuuacuauucuauuuuacuccuuuccucuuuccuguuuguuugugaggauauguauguaauuucagauaacaugucuaacagaaagguaaguuaagaagccuacugaaauuuaaaauuaucauaagcaguauuauacagcaauauuuuauuacguauguuuaauuauauguauauauauggauguucagguugucaaauuuguauacauguauguggauaguuaaaugaaaugugaaaauacauuugauuuucagacuuuugugcacagucuaauuuacaaugccuuaaauuauuacucaauuuccgaaucuauaaaacugauauaaaaauacauuccuacuuucuacuagauauggagaugaauugauaauuauuacuagagugaaauauacauaauaaaauguagguauauaucuguaggcauuaucuugcuacacuagcugugugguuaauugcuugauuauagaaaucgcuccucugguugucuuucaccgcaucucuaaccaccucuccaguuccuuuugcugacucaucuucuuccuugccuuaaagaauugagcaaugagaacacauggacacagcaaggggaauaucacacaccagggacuguuguggggugggaggaggggggagggauagcauuaggagauauaccuaaugcuaaaugacgaguuaaugggugcagcacaccaacauggcacauguauacauauguaacaaaccuucacguugugcacauguacccuaaaacuuaaaguauaauaauaaaaaguaaaaauaaaaauaaaaagaauggaacuuauaagaauuucuuccagcacuugacucugcucuuuaaaugcacuuaucaugguuucaacuaucacuuuagugcauacaaacaguaaaccuacgcuuguuguuuggacuuguuucuucuuggaaccucaguagaauauuucuauuguuuaucuuagcauuuauccuuggauauaccaucugcaucuuuaaacaaaaguuaucuaaaacauaugcaauuuucuuuccccccaauaaauaauugguuuuuuuuguugucuuuuccccacaauuggcaguaccagugucaauguucagacuugaaauuuguaagccauccuuaccuccccuuucuccaauucuuaaaaacugcuguuagccucaucucauguuucaucuaaagugaucccccuaauacucuaauuucugcuguacauuaccacucaaccuuccugaagccugguucuaaucauuaaauuccaaugccacaaaaucuucagugguuccuuauggccaguuuauuucacuccucuuagggcauuaaaguuauccacguuauugucccacauacccuucuaaauuucuuaguauuaucugagaaacauaaaaguguguauuaaccaaacuggacaacuuuugcucucuuggcauucacccuaucucagcacuggauuuaaaagaccaccacaccauuccuauucauuuaaaucucauggucuaucuccaaacuacuuccgaauagcuguucuuucuuauuggagcccugaaagcauuuuuccccucuguccuauaucuuacucugucuacuuuuaccugcugcuauaugauaaacaguugugacuuuuugcuuuacuuaucauuauauuucccauagcauugaguaaagcauaauaugacacauaguguuggauagauaaaaagguacaggacaguugaauucuugaauuuguuauggaauaaacaugaaacccuuguuaaaacuuaaguguugcauacaaauauaaugucauuuuuguuuucuuuuguuugccauuuaaaguauuuuaaauaugugauaauuucauaucucccuuucuuaucauuuuauuauuuauaucaagauugucucuucaucaacauauucacuuuaaaaauuguguucuaaguacuguaucacauucaggauccuuaaguaaguaucugaacuuacaaaaucccuuaaccaauuagaauaauauaauuuuaaguuauuuaugucaauuuuguaugaccaucugauaaugaaaugagaaaauagcaagagaguagaaauagggugaucguaagacuuuuacuaauguuccacaauaaauugaauuucuaucauugcaauuuuuccuaggauauccguagagguuuggagagcaacgugaauguugaauuacugaaugcuuuacauagucacaugauuaauaagagaauguugaccaaggacuuaaaaaauggcaugauuauuccuucaauguauaacaauuuggggcuuuucauuaaccauuauccuaaugggguaaguuuuaucaguaaaaaguacacuuaugaaaaauaccuucuuuaauuuugucuauacuuuuuauauaaugcucacaaaaauaauaaaauguuagugagaauaagguaagugcuauauuaugacuuuacccccaaaucuagggcauguaaauuuccaaucugguuauuaauuucuacuaaagagugauuguaaaggacaaauuacaugaacaguucauugacaguagacagguauucuagaaaaggaaauuuuaguaguugauauguuugaaauaauuuaucguaguagcaaaaagaauaaucaaagaaugaguguucuuuuacucccccucuagcuacuguacuaacugaaguacuuguguguuuggaucagauuuugugggaaacugccaacagggucauaggacuuuuuccacagccagccaaauucucagggacgaaagaggucaaugaagaaacaauuuuuaggaaguucuuguaauguaacuaauuauaucuauacaauaauuauuuguuucucccucucaaaacuuaaauuuuaggacugauuagacuucuuuaccuaauucauugacccacauuaaaaaguuuaugacuauuugcauaaaagagaaaagcaauaauuuaaaugaaaaaaacaccuuugccuuauguugcuagauauguuaaguaugacuugacuuggguucucaacugguucccuuuucucuuacaguuucuuuuuuagauauaacaacauguaaaucuucauccacagcguuuacauuuacaauguaguuuccuguauguuacauuuacuaguauaaaugaaaaacugggaaugggcuugcagucucaguggucaauggguaucucugguuucagcacuuugauuuuuccaaauaauuauagguugucacuguuaauugugcucgaaucauccaugggaaccagauugcaacaaaugguguuguccaugucauugaccgugugcuuacacaaauugguaccucaauucaagacuucauugaagcagaagaugaccuuucaucuuuuagaguaaguccaagagcagauugucuugagucauugaaaucccucuucuucuccugucaaaaucuaaaaacaauaaaaaugcuauuaaaucuggcaaaaauguaacacauauuuuuugaaaggacuacuauuuucauuuuacacagaagaaaccaucucauaugaaauaauaauauuucuguggacaugauagaguaagaaugguuagucacaugacuggcguguauuuagcucauuuagaacguguucaucuguuauuauauguacugcuggauauugcuacagucccauaaacaugggcagaauucccauucuugcaaacacaauuugaagaaaguuggaaaagacaugguugugucaaaaaguaauauuuugaagauuuaacaacaacaaaccucuauaguguaggaaucagcuccuucaugucagccuaggcuaaguguguugcaaucuuuuucuggauuuacaaugugaaagucucugaaaagcacauuuguguuucaggcagcugccaucacaucggacauauuggaggcccuuggaagagacggucacuucacacucuuugcucccaccaaugaggcuuuugagaaacuuccacgagguguccuagaaaggaucaugggagacaaaguggcuuccgaagguaguuuaaugucuucaucucuaaggagucucccagcauucugagaagggaauaaaaaagaggcuaguccuuaccaauaauauuaguuuuaauaagcaaaggcagggaaaaauuuuuauucugagauguacuaugucuuccaaaaguccuuaaaagaguaggcagaguauaauucuuaaauaauaagaauacucucaagaucacauucuuucauacugcuuucaaguaaauaaguaguagauauucagaaggauuagcagguguuggaaagaaauauuagaucaucaaauuuuaauauuguaugcacguuaugcaaugcuuuuaauucuguauuuaugccaaaagauauugaguugugagaacuguaugguucucuugggccucuaauuacugauacacauaagaauuugguggcuuuccaagcuucuuugcuguugucagauagguuuuacauugugcuugcauacuucacuuacucagccuaucccaaaauacauuuaaccaauuuaagaugagaaaauuuuaggaugcaggauagauauaauguaguugaggcauagaucccuccagagguccuucaaugaaucaucuuuauuugguuacuuucuagaaguugccuuccggaaauaauuugucuuauccucagccucuaucgaccucauuacauguuauauacaaauauucugcuaugagcagcuauuacaagauacugcucuuggguauuuuggaauuucacaggccuuccuuuucuuucucuuuugguagagagggaucuugcuguguuucucaucauggucuugaacucccggccucaaacaauccucucaccuaggccucccaaaguguugggauuacaggugugagcccuugugccagucaaaguuccucugaaaggaacaauucuugcuuucacaucaggaguuacuuuuuuaugauagcuggaacuuaaccuaccacguuuucuaauacugcaccaaucauuuccugaagcugaucuccucuuauuauuccuacgaagcugagcuguuucuauuuuauaguugauaggaaaaaacuuuuagaacauaaauaggauuuuaaagcuguuagugaauccuuagguuuuacuacauuuuaaggaauacuuaguuccacagugaaacacaucuuuucagggucaaauguuauuucccuugaucugaaagcuaccuguuuuuauuguguucuccagcucuuaugaaguaccacaucuuaaauacucuccaguguucugagucuauuaugggaggagcagucuuugagacgcuggaaggaaauacaauugagauaggaugugacggugacaguauaacaguaaauggaaucaaaauggugaacaaaaaggauauugugacaaauaauggugugauccauuugauugaucagguccuaauuccugauucugguaagcaacuuuuuuuguuuuuguuuuuguuuuuuuacuuacuguaauuuacuaauuaugcugucucaaagaguaaguccaugaaaaaugaaugugcaguauaaagaauggcaugcaaagcacuaacacaauaaauagugagcuacuugagcacuccauagauaggcaguguagugaugggaacuccaugcaugaaucuuuggcuuucuaggguuucugacaucuaauauuuauaaccguuuucacagugccagaguuuuucuuggaaagagaaggaaagaucuaaccaaauggucagcuuuggauaaauggaaaagcuauggaacucacaguauagagagaaagaugagagaugaacaauagagaauuaaagaaacauguaguaggaagacagaaaaauauuuuccuucugaaauuuaucgugauuaucaacucccaccaaaaaauggaaguggaacucucuuauuagggaggaggaggaugucuuaucacacugacauugcaguaaauagcuuacaauauuagaaaagagucaggaauugauuuacuaguuucaugauggagauaauagcaaugaugacauuguugugauggugaugguuuauuuuucagccaaacaaguuauugagcuggcuggaaaacagcaaaccaccuucacggaucuuguggcccaauuaggcuuggcaucugcucugaggccagauggagaauacacuuugcuggcaccugugaauaaugcauuuucugguaugugcuggacacuguuguuccugcucucugccuacacaccuuuuuuucuuuaugaugauuguuugcaauaagaaacaauaaauguuuuaggagguguugauuaguuucugcauuggcuacacauacaauguguuaacacuacauggucucuacuaaaauguucuucauuucuaaacauuucauuauaauggauaauagccuacagagagugaaauuuguaauuuguaauuaagacuauucaggccaggcgugguggcucacaccuguaaucccagcacuucgggaggccaagacaggcagaucacuugagaucaggaguuugagaccagccuggccagcauggugagaacccaucucuacuaaaaauacaaaaauuagccaggugugguggugcacuccuguaaucccagcuacucgggaggcugaggcaggagaauugaacugaacccaggaagcagauggcaccacugcacucuagccugggcgacagagugagacuccgucucaaaaaaaaaaaaaaaacgaaacuuaaaaaaaagcauauuuaguuucucugugaaucuaauauuuccagcacaauaaggaugcauugacagaucucuaaaaaaauaaaacugauuucuuuauuugauaccaacauaauaauauuuagaaauaaauagguguguuuugcaucucaaaauuuggacaguaagggugucaaauuauaaauaaauaaaaugaagagacuuauacacuuccauaucaugauguaaaauaguauauauaaauauuucaccuaguaguugcuauucacagaccauguucagauucaugcaaccuucgaccuuucucaggaaaaugauuucacagacauauuuaaauuguuaggcaacauuuauuaauuaaaaauagguaacacaauuuuuuguuuuuccaaaugcuaaauugugauauaaaaacuauuaaucaaaaaaauugaauuccuagauauccugacuuucuucuuuguaauaauccugcccauguguuuugacaauaacccauauuuaagagguuguuugcuuugauucucuuuccaguaaucaagauuaauuuacaaaggauucaucaguaguucuuucaugugacuaacagauaucuaauuaucagacaaagccuuggccaccauuaagguuuagcauuugccagugaccacuauaaaacuauguagcccuuacagaggugaaacucauugauugaacugguuggaacuguauuauugucauuuaauacaauaggucacagaguuucuacuuggugaauugaauuguuaguuuuuagcauuugguugauucauguauuauaugagugcaaaauccaugauaucaauaaugucagggauuaucuguuuauaugauucugucuuaccgggagaaacuucaauguuuucuaaauaaaauaaugcucuuucuuaaugaauuuauuuacagaugauacucucagcauggaucagcgccuccuuaaauuaauucugcagaaucacauauugaaaguaaaaguuggccuuaaugagcuuuacaacgggcaaauacuggaaaccaucggaggcaaacagcucagagucuucguauaucguacaguaagugaaucacaacaaaauaaaaagucugucaaaugacaugucaaauaaugcuguuucaaugaauauuucacagaauuuuaugagugugguucuaauaguaaauauucauagaagcaucagggaacuggguagcuugggugaaaagacugugagcaaaguccacaacaagugcuauguauucaaaacucagauagauauuuugcauguguuucauuaugaauaacuuucuauucuagagcaucaauuauuuuaaauuccagaaagcaguaaauuuuuuaaaauaaacuuuuccuuugcagaguacuuuacaauuuucaagguaauucuguucucugccuacacaccauuuuucuuuaugaugauuguuugcaauaagaaauaauaaauguuuuacaagguguugauuaguuucugcauugacuacacauacaauguguuagcacuaugcugucucuacuaaaauguuuuucauuucaaaacauuucauuauaaugaaucaaauaugcaaggugaucuuauacuguaaaauaaccagucagcaucugaauaucuuuugaauggcuuucaagauaaaccuuuauuggcacauagagauuucuggacucuaaaaaaggguuuuaauguacuuuuuuuuuuuaagggacagaauuucacucugucacccaggcuggagugcaguggcacaaucauagcucacuguaaccuuaaacuccuuggcuccaggggacccucccaccucggucuucugaguagcuaggacuauaggugcacaacaucacccuaguuaauuuuuuaauuuaauuuuucuugagacagggucuugcuacauuucccaggcuggucucaaacuuucagccuccagugaaccuccuacuuuggccucccaaugugcugggauuacaggcaugagccgcugcacccagcccuaacauacauuuugcugcaggaaaauuuauagaaauauugcuuaucaaaauuacaguucaacuaaugauacguucaguauuuguccagauaacacguacagcuacaacuaaaagacuucacaggaagucaggcauuaccuagaacugaaucuggcacaugucagcagcucccugcagcuacaaaauuccaaacauuuuuaaguaugcauuaaaugugcugcacuuuaaauuuuguauauacaaauauauguguguauauauauaucacguucguucaaaaagcuaugaauaugucaaugauuugacuuacaaugaugaauagggucuuacagucaagaaaauaaaguaaauauuugugaagaucacuaaaagcacuaaagugaggaaaccuuacagauaguguuggccaaaagagggucuagagaaauaguucaaaucugaauagaaauuauaaaaaauguagaagugggauuccauggaacuuuuguaauuuauugacaaaauuaccugccugauccauaagguagcuugacuuuuaauaaaaaacccggcuagauaagaagugucuugugaguuugugugagccauugaaaacagaggaaagaagcuguucccguggccucagacaccaggcaaccucucagaagggccgauccggaaacuuaauuauguaguuacaucuauacgggaaauuucaagcaaggaaaaugacaccccauaccuuucuuuccuuuccuaggcugucugcauugaaaauucaugcauggagaaagggaguaagcaagggagaaacggugcgauucacauauuccgcgagaucaucaagccagcagagaaaucccuccaugaaaaguuaaaacaagauaagcgcuuuagguaagccuauuaguggcaccuccacagagaaugagagcuauuggcauauuuuuguuucauaggcgguaucccaaaaggcauucagucuccuaugugguugaaaauggaauuuagaauaaaauguucauacaaguguuuucaaaauugauauauguuuucgcugcuacuuucugguacaccguuauaugauuucaugugugaaaacaaaucuaacagacuaaacuacuucuugacauuuuucuuauaguuuuuagaaauugaugguauauauagcaaagacuaucuuguagaguauuacaugauaaaaaugcuucuuuuuuguuaugugugaccuugucaaguuuuauaggaugaaaucagaugaaaaaaauuaaaaauuguauuguauauuucagucauuuuucaugauaaaacuuuuaacagguaaauuguauucgaaacauaugaaaauguaugagcaguucucucaugcuuuccacaauacauggauucuauucuauuacaugcacuguaggugaacauaccuaaaucuaaaucugacaaaauacauauacauucuucccacuuagcaccuuccucagccuacuugaagcugcagacuugaaagagcuccugacacaaccuggagacuggacauuauuugugccaaccaaugaugcuuuuaagggaaugacuagugaagaaaaagaaauucugauacguaaguggaagugaauuccagauauuuucccuuucauuucaggaucucacuucuuucucaagcuuuccuguccagaugucugccuuaaaaaugcccccucucugguauucaugguuagcuuuaguuuccuuuuauuucguccacuugggauguguggagggucacucaguaauguucuuaaacugugaacuguuauguuguugggcuagauguucacuuaugugguuucuauuaaagaccauguaaucaggggacaaagaagaaaacaguuauaauuuagaaaauaaauagauuuuuuucucccaguaaguuggguucuauuuugauuaggcuaauugaaauaacuauguuuugaaauagcaucgauaucuacuugagagaauaaugauauuaugagaaaguacaauauggaaaaagauaaagacuaauaaguguuuuguuucuuaguccuuaucaaaaagucauauuauucaauaaaaauaaacauauauuuuccccuaggggacaaaaaugcucuucaaaacaucauucuuuaucaccugacaccaggaguuuucauuggaaaaggauuugaaccugguguuacuaacauuuuaaagaccacacaaggaagcaaaaucuuucugaaagaaguaaguugucuagaaugaauuuaugauaguguucauccaucauuaaguuaucuaaauauucauccuuaaugaaauuuccucauugaaauugccuccuauuuugauagguaaaugauacacuucuggugaaugaauugaaaucaaaagaaucugacaucaugacaacaaaugguguaauucauguuguagauaaacuccucuauccagcagguuuguaauuauugaacucauugauaggcuaagucuuuuuuuaauaugaaccucgauuuuuauuuuaugcuuucuuaccaauauucauuuaauauuucucuucauagacacaccuguuggaaaugaucaacugcuggaaauacuuaauaaauuaaucaaauacauccaaauuaagguacuaaaaguuacuugauuuauuucuuuuuuuuuuuuuuuuuuugagauggagucucgcuuugucgcccaggcuguagugcaguggcaugaucucagcucacugcaagcuccgccucccauguucacuccauucuccugccucagccucccgaguagcugggacuacaggcgcccaccaccacacccagcuaauuuuuuuuguauuuuuaggagagaugggguuucacuguguucgccaggauggucucgaucuccugaccucgugauccacccgccucagccuccuaaagugccaggauuacaggcgugagccaccgcgccuagccuaaaaguuacuugauuuauuucuaauauguagaacauauauuacagguuuaacauaacaggcuagaaauguacgcauuaauaaguaaguauguacugggcuuggauuacucuuuguuguuuauguaccacugacccaccuguaaagaaauggcaucauuucuucaugguuuuguucaacaaauaucuauuaaaagcuacucaggaccaaguauuguguaaaguguuaugaaaaauauguauuuaaauuggacaugucuuuauucaaaaaguuuacaguccaauuuagaaaaauaaaaugguacauaaaugacuaaaaucguuguaucauucaauacuuucacugcagaauauaaaggaaagaacauucacuuauaaaaaauugucacucaucacagauuaaagggaacggaauauuuuucuucuuuuucaauguaggguaaaaguagcaggaaacauaaaauuguguuucauaaauauauuuaacuuuggauuaauuauuauauaauuuuuaaaucucugaguaaugaauccaaugauuuuuaugcccucugaccugauagcauugaauuggaagaugauuuauaugaggacuucacuucuauuaaguguaauaauagcuucacuauuuuuacuuuaauaagaauuaaaguggugccaugguuuuguuaacacaacuaucaccuuucauguuacuaaauauaaacauuuauuuucaguuuguucgugguagcaccuucaaagaaauccccgugacugucuauaguaaguauauaauaaauauuggccaccuggguggcaagguaugaaaaaagaaaacaauacauuucuuuguauuuacagagauuauugauaaucugguauuuagaauuccaaacuauggccaaucucauuucacuugaaaaaaggauugaggucucagauaaccuucaacuccaaugaacuucuuccccacucauuggaaaaacagaaaugauaugacaugagaaagacagcaaaauauaauauuagcguggcaaagagccaggaaaauaaaaagacauauaaagggaagagauggcgaaaagacccucuagaaauaucuaaaaauucagauguguggacacagaaaugaccuuagccaagacuuguuguucacgccacccucaagcccugagcuaucuaagggcaggcugagaagcacguguugaagaauaccaauguuuauaagguggcaguucaaaaacucucccauccaaaauuggacaaaggaacaaaaaaaucugccaugugacaaauuuaaaguuuccaaauuccaggguucuuugaucucugacacaaccagauuaucaaaauuaaaccucuacuacuuaacaaugauaaaggguauuucauucucauaaguguagcuaguaguauaucuuuuccaucauggcuuuuucucuguuuaucuuuucucucuuucuuuauuucacuguagcuuucaagcagaaauucuuuucauuuuguuuuggcucuguaauuaaacacucaaaguguaucaguagcuaaaacauuacuucaauacccacauuuauucuggcuagaaaaucauuccauuuuauaccaugagcauccaguuauuuaauuaagaaaauuucccuuaagauuuauacuagauauggaaaaggaguaaagccaauguaaggagcaaaacaaaaugucugcugcuguuguugauuucaauuaugcaauaauaacaugcaauuccaggaucaggccagcucagcacuguauuaaagauuuaauuggaauaguuaugauucaccaugggaauacaaucuuguaaaaaauauguuuucugaaaauuaagcaauccuuaugggcucuauucaucagacauguuaugucaucuuucuucaucaaagguauaaauauauacauaugcauauauauauauacacauucccacuacauuucuuuagcuucccuucuuuauccaucuuaguuucacuacuuucuauauaugugaaugcaauaucuugauuacaaugagcaaaaauauaauuauuuucuccuacuaaauuacauccucacucacagagcauaagcuacauuuuauuaagacacacauguucaaugguccuucccuaccuacccagaggccuugaaacagcucuaacauuuacauuccaauguaagauguuucuuuuacuccuccuuagacgguaugcuguuauuaagaaguauuuuaaaguagaaguaaagauaaauuaaaccaaauuuucuauuuuuauauuucguuguugacuuguuucuaaaauuccuauaauuuuuugcugcauauuauccucauccccaaaauaacauccauuuuaaaguguauaguugaggggaaggaugcuguuuuugguauaaguugucaaauauggaacauuugaccuggagagggcuaaaaucaauauuuaauccucagagcuucaccugucaaaacuauuuaagucugcagaaaaucaagauugaaaugaaaacuaccaaccagcugaacauccaaaacgucaaauuccuuaacaugauguaaaaaauguaagcuaaaaggaauuaguccauuuugauagcagcaauagagagcccuguguauucguauucgacuuucauggaaagguucuucuguggcaagaccaccuguggaacuaguaccuaaacacacagauuuguuuuauuuuagagcuucacaauuugagaucucaaaauacaaaaccuaauaaggcugaaacacagggucuaugaaggcuaagaacccacauuaauucaaaaaguugacacagcuaaacaucuuacaagcaugaggugagaacugcagaaaccaaagcugugcuaacaucucaccucuacugcuuugaugugaucuagaugcacaguuagcuucaguguggcccguuaucuaauagaaccaucuuucaaggcuuuucauuagaaaugacaaaaagccaguugcucuggcuguguggcuucagaggcacauuuccaguuaaucaguacaaccaaagucaaccaaauaguugacugguauuuaauuuauuuuaauuuacuuuuauuauagaucuagggggguacacacguagguuugauagauggauauauugaguaaugcugggguuuaggcuucuagugaacccaucacccaaacagcaaacauaguaccuaguucaaagacuauuaucuuacuuagguagacgacacacguuuaaaauauauaccuuuaaauuaaaaaaaaaaaaggauagugauaacaaagcugaaaauuaaagacauuuuagccuauaacuuaaauacugaucauaucauguuuguugaauagagcucaugucuggcuggcugaaauuuauucuuacuuuuaaguauucugaacuauguuucauuuuuuccuuucuaugucacuguuaucagaugcaugaaaaacauuuuaaaagccuuuuucuuucauuuuuucuuuuaauugagaaagaauccagcaaugcaauuuaagauauuaugaauugcaugacauuaaucauauuugucuucuguugcaaugcagccaguauuuucaagaaguacaaaagaagguaaagcgcuuuagcgguacaauuaaaaauuacagauuucuagauauaauuccucacuuugugaguauauauuucacuagaucaaauucaagucacuagacuucagaguucaacaccuggacaugagaagauauuauauuauguaccauaaauauuuccuguaucugacugccugaacauauuaccacauccugugccuuaguauccuacagagacaaaaaagaaaaggaaaaaaaaaaaaaaccuuuguucagguuuuuauguaaauauuuuucauguuccacuuucuauacuuucagcaacuaaaauuauaaccaaaguuguggaaccaaaaauuaaagugauugaaggcagucuucagccuauuaucaaaacugaagguaaaaaucaauguuauacaugguuccuuuuauaguaaaaacaucuguaaaaauacugaucucuaugaauguaucuacauucuuuuaaaaacuaacauguuaaauguuauauaaccaauauuauaccaauggcaugcucauguaauugcagaaugcggagugcaaauuauuuagcaaaguagaugaugcauuccuaauacuuucaguacauuugcuuguacuugauuuaauuugaaucuaauuggcauugcauuaacuuaguauacagauacucacuaaacaaagacaugaguuuuuuuuacuuuagucagacuccuacaggcuguauacucuuuauguugcuuuguuugcaaucucccacauguucuuucuuauaacagugcaagaagcucuuccaaaaaaaaaaaguauaggcauuuuucauuguguaacauaagauagcauagaagcuauguuuacugaaagcuuuuaaaauuacaaccacgcaugagauauuuuuuaauuagaccaucagaauuauaaaacaaaaugaguaguuuaugcagugaauugauuuuuaaaauacuuaauuccagcccugaacauauuauuacauacagacguauauauuauacaugagauauauauaauacagacacacacacacauucucuccugauguuucagacuagaacauuaaauaagcaguuacuuuucucucuacucccacuauguauguuagccaacuucaacaucuuugauguuacuuucauuucauguauuuuaauuauguccaaggaucacaauuuaaauuuuuuaagauuuccauguauaagcaucuuaauguagcaacuuacccagagaaaagaacuaguuaucuccuuugugcuauaagaaagcuagaaacagucuuccaaaaagagaacagauuauaucuuugauggaaucuuugggaaacuguaauuauacuuauguuugguuuugcuauuucuuuuggugguuugagaagguaacuucuugaauacuuuuaucuauauuuuuuaaaguaagucauuaauuuaaauuuauacacugaaaauacauagguaaaaacuuauuuccuagcuaauuaguuaucuauauuaguauuuauucuugagacuuaaaauugaguuauucuuugaaaucuauccuuguuuuuuucuugaaaaaaauacuauaauuauaauuauuuaaucgacuuucuauagugaugaagacaauucgguauuuuaagaagaaauuaaaucagaaaguuuuguugaaaaaauguuccuugaucauuguaauaaaacaugacacaaugaucuuugauaauacaauugauuuuaaaaucaaaucuuguccuguuuuuaaaaaucagauucccuaaaauuuugcacuauaauugugcacagcuucuuuaccugaaauuauuuacaugugccaauguucuuauuuucaaagauucuucuccuuugaagcuucuuuauucaacuuauuuaucuccucaaucuuugucaguaggauucuauccuacuaaucuuuauucaguuaagaucauacuggcgggucaucucuacauggcuucuucuuauaaagggaacauggaugaaaaauggaguugugucaccuacucauuaauaacuugaguucagaaauuacacuccuguguagcauaaugaaggaaacaaauauuuaucuuaguaguaauuuacaaugguccagcuuccaggauugcuacuggcauuuccuucuuacuauuugaacaauuacagauuuauugaugacuuuuaaauucuuacuaaaugaauuaaacuccaggacacaauuuuaaggugucucuuauaaaagauacauaacagcauuuuggaauuaagaauaaaucagcuaaaauucaauucaacaaauaguuauugagcagcuauucugcuggguacuuucugagguguugggaguaaauaggaaaacaauuuugagaaaaucucuucuuuuauagagcuuaacuauaaaggauguuuccaaaauuucaguuuggcuuuucuaaagaaauauugauuuagauauuuuauuaacgcauuuuugguucuuaaauuccuuaggcguccuuucuuuugaaguuaccgcaccuuaaaaaccuggcuuuauguuuugugcucaauaucccuuggccuuauauaucaaauauuauggcaugaaauacuuaugguuucaaaaaacuuuacuuuuauuuucauuauuuuggauuguucuaggcugguuucguuuugguaaucauguacauugacaauuucugaacaagcaaaaaaaaaugcucucaaagauaagcaagcaacaguugcauuccacuauugaaggcuauuacaguaugaguuaaauguacugaacuuauuuuucuuacuccucugugaaacagucuuaauuaacuaauguaguaagcagcuuucuaaccuucaaaaugauuuucugugguagcaaaaucauuuugcaagucaaaugcaacacuaguuuaucuuuugcauuugaaggacuguuuaacuauuaacugguuaauuguguaucauucccauacagaagguaaguacucaaauuauuuuccucauaaaaccugacauucagcaucuuaaagguagguauacauuugguacuuucuuauguucacuccuauacccacuagaucaaaaauauaagguacugagugauuuuaaaacuuaaaugaaaaauuuuaauaaggaaaaaguaauagacaauaucaguaugauaaagugggaucuacaccaguuaucagagaaacacaaauguguacauacugcaugaucugcaaaguguagccacauauaauauuuugcauaaucauacuuuauaacuacgaauaaacagauggauuuauccaucuguuuaaaagcuaaagcagaugaaaguaauuuuaguagcacacaaacagacuaaaucauuuguucucauaacucuugucuaauuugaagacaaugggaaauauuuaaaagugauuucauagagccugaaaccacuuugacauuugaguugagucacaccgaauguugaaauaaauguccuauuccgguaaauuuaaaggacuguuuuaacaugauaauuugucuccuaaaauaaugucccaggacccacacuaacaaaagucaaaauugaaggugaaccugaauucagacugauuaaagaaggugaaacaauaacugaagugauccauggaggugcguuccuuauguuaccuggggccgacuaccuucgcugugauuauuuugaaauaguguugguuuagaaauauugaacaucugauauuuucucuuaguucuuauuuuauaaaaauugugggaauuauuuccucagcuaugaguucuuauuagcuggucagaaauaaaacauaguuagcuuuuaauggaucuaguuggaauuaauuuaucuauuaagucacugggcccaacaaaaugucaugauuuuugcauauacaagugaggauuguggaauaaaauuguaacauuaaugucaguauaaaaggaaauauuagaaacaguaggaaaaaaugaccauuguauaagucucugucuaauaagccacuccacuacuaggauuuaugauagggcucccauuccaaugauauagaacucccuggauucucacuaaguauuuauuccacauccagaaaacaaguaugacauggagaguuaggaugucaaauggcccucucucucaaccaagauucaggacauagcuauuaccuuuuagaucccuauugauaugauuuuugggggauauguucuaaaaauguuuaugauugaaucuuaaaugguaauauuuguagaaauauaguuaaucauuacaaugucuagcuuauggauguauagucacaauaugaggguaaaucaaaugcauuuguauuccccugcuuuuagagccaauuauuaaaaaauacaccaaaaucauugauggagugccuguggaaauaacugaaaaagagacacgagaagaacgaaucauuacagguagccauuaauuccauacauggaucuaugccuagauuauaaagaucaaauuauaguuaauccccaaauauaagaaucauuaaagaaacaagucauuuucauagugauuacuaaaguuacuucauauuuuggcagauauaauauuauucuaaauauguaaucuauguuuuacucugaauugaaaauuuguagacaaaucuaaaagcauuuguuuuuauuacauguaugcauacauacauguaauaugauauaccauugauaugauauuccauuuucacuuuacuguuuguuaaugaguuagaggacccuagaagaaaagccauuuccucauuugagcuuccauuaaucuuaaggucuguacaucuaccugccaaaauagaagcaaguuuauacaaagcaauugaucaauauuuucaguaaaccucauaucagacuuccaaacuagcguccaguugguccaaauuagccuaaaauucgccgaaaauccuuaauucagcuauucuuuaaguauuuguuuaaacaauuagugagcaaguguggcuugugccacccauuuauggaaauaaaguuuuaucggaacacagucuuucccauccauuuauauaauaccuaaggcugcuuucacacugaaguaucagaguugaacaauggcaacacagacuacauggcccacaaguguaaaauacuuacucucugucacuucgcagaagaaguuugccuacuucuguuuuagaccuuuuucauuguccuucucauagguccugaaauaaaauacacuaggauuucuacuggagguggagaaacagaagaaacucugaagaaauuguuacaagaaggucagcauuucuaggaaaauaagaaugugacuuuaccuaagcuauccauauacaagucuaaaauaacauucuacauguuuucuacucuaucucaaucuauuguucauuuccauaccaacaagaaaaaagcacaagaauaaggaauuaagcauaaauggcagucauauuuuuuauacaguauuuuguucaacaacuuuauaagaauauuaguaugucagaaaacagcacuaaaauuugugaaagaaucgaguguugggcuggaauucauuauugggcagaugccauuauuuaugacauaaagucugcugucuuuauuuuguuauauaaaccaauuucugcuauaaacauguauccucucagaggucaccaaggucaccaaauucauugaagguggugauggucauuuauuugaagaugaagaaauuaaaagacugcuucagggagguuaguaaaaggacaacaacuaacccccuuaacagguucuagugacugaguucaacuuuuuaaagacugagcaagcagauuuuuucuuuuaauuggguuaaaaaaaaaaaagacaacauccacuguugucuuaauagauggauugguucaaugguaguuaauaguuaugaagaaaugauuacuaguuuaaacagucuuuaaaaaguucuaugguauaaaguuuggggagcaaugaauauuuuuuuugcuuugauucagauaauuuuaagggccuuuuaaguaugcaaaagggaaauaauuguuaaauugcuagcuguuaaacaagcccaaauuugauauacuuuuuauauuuaaaaaauuauauucacugcccccauaagagcaaucaaggcaugucuuuaaauucuauacauagauauagccaaaaauagugcauuuaguaacauucuuuuccaaaacuauauucuugggaaugaauaucuguuucuucuaacaguuugagugauaaucuauaccuguagauauaaguuauuuugcauauaaaauuaaucuuaaucuuuuauggaauguucucugucuguggcauuaaaugaaccuuaagaacaaaaaaaaaagaauucaaaaucuuacacaaacccuacauaguaauuauucaaagauguuguuuauauagauacauaauuuguaucauuggcauuugaauaaacaaauuucuacuucauuuuuuaacaaggaaagaauuaagcugaaaaauuauuuuuugugaaacauguauuuauauucuuuagaaaaaccaaauaggcacuuugaaauauacuauuaauugagaaacauaacugaaguuugauguuuauccaaaacacaguccagauggcuuuucagcuuauacuuuuuaaaacuguaucacuauguccaagaaaauguaaauuaucuugggacuuucuauauuuuuagcaauuauuauuucuauauucuguaguuuaauaaacguaaaaucucuuaaauaguauuuagaaacuugucagugauaguuuaaaaauuuuuaauucaaccaaugauugaauuuucccucaauagaaauauauaugucugaaaaauacaaguuuccucccagaauucuaagaguacauagcacaacagagccauaacggaaccaaagauuccuguaggaucuaacaaagaauucacuaucuaccccuaaaugcucaacugucugcuaggaaaaaaaucuaaggauuugagggaagagacaaacacauuaugaagauuaaauugaauucuuuuuuuuuucuuucaguccuugccauaguaagcagcuuuguagaaugguagugcuuuuuagggaaucaauaaauuaguagcugcaucaguuuauauugcuuuaauucauuuaggauuaaauuucagguaaguauauuuucuuccccuuugauaagccccuguuauugaggccacuaugaaaaauccaguuaaauacuaaagaauugcuucagccaagaaaacauauaacugcuacaaguuaaguauaugacauucaauuuuuaguuaaugaacuccuuucuuagcucuugccucugaucaucccagaaguuuauuccuuuaguucccaguguaugaucucucuacauaucuguaaggcaucgguuuucacaaugccacgucaacuauuauagcauugugaaaaaacaaaaaaaauuaaaaguuuuuaucaaaucauuucuccaagguuuugcuuuuuguaggaaaaacacuauaugcgguagaauuacuaguaccagcauuaauuggacaugcuuguuuucuuuuuuccagcuaucuaaaaccaucaggucauuacugagucacaaguauccccuugucuagauccuaaaaggcauugauaaaagaagcuaguaaagauuacacuauguaagacuuuuuuuuuuuccaaggucuggccaauuaauacauaucugaaccaugcucuucaacucaauaaguucuaccuaaaacugaauuuucuaucuaaacaguucauaucguauacauugugguacauguaguacauuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauguuuuguauuuuuaguagagacgggguuucaccguuuuagccgggauggucucgaucuccugaccucgugauccgcccgccucggccucccaaagugcugggauuacaggcgugagccaccgcgcccggccauguaguacauuuuuuguacuuuugguaauuugaguauauuucucaaucauuuaagucaugacuauuaacauggcuaacugguacuuugaguacugauguugugauuugucacugauacacuuccaagaccuuaacugaaaaaauuucucauuaaaugcauaaaauuuuugggcuuaccuuagaauuaugcauucugaaacgacucaagcaauuaaaggagaauaacagacuaugucgaaaggaacaacaacaaaaagucauuuuugaagguuuucgcaaaucugccaacauaagagguuaagauuuguaaccucuauagagaauaguagaucgaguuguaggucugcauucagucugagccccaacucaaucccaaauuaguugacucuuuucuugcuuguuuccuucaucugaaagugaggauaguagugauaccuacagucuaaauaaguuaauauaugacaagcucuuagaacaauguucagcacaaaguaagcugucaucaaauguuacugucaaucaucaauugacauuaacauggucaauuaaguaauguuucucacccaacuuuaaauuuccauagucauaaccauggaaacauacaaaaaacaaacaugcaaauaaaaugucaaaauaauugagcugaguacuuugcaugcuuuaggaaauaagauguagggugguucuuugugccaauauauucaaguaauugguuuaucuucccauguuuugcugcucuaaacaugaucuaauauaacucucauucauguugacauagcagagagcugcuaggaguaaaccuguuuucuacacauuaaucaagcuguucuuucaaaguauuuguuugacacauugaauguuuuuuauucuggaauauuaucacagcaaaaccucauuaauuggaugcuaucaaaauuaugaaaggaaaucugagugagcacacuuguuuugaaaagaaauugguaaauacuucuaugaugcaguuuuaaguuauacaauuaacugcuauuuggaauuuaauaaguccacuauaagcaaugugccugcacaccaauuaaagguuggaucugucucuucuugacaauuuuuuagaagccauuauuucguuaccaaauaaaccugaaguuaagaaauauuuauauuuacaucuauuuauaucuguuggagaauauuucauaacucagacuugguuguuuuacacagacuucuccccauuauccaacauagugagauuuuucuauaguucuauauuuuacucuaguauuaaugugguuuuauaaaugauuauaugccuuauauucuggggggaaagaaaugugaaaaugugcuaaguagacagaaacagaauauauaaguuguuuugaauguuauuucuuuuuuaaaaaauuugcuuggugucauauagccaaaacuauucauggugacaguuucauugcuuacuuuuuauaugauuucagcgaauugaaaacauguauauaauagaaaaaacuggacuucaugcugaguauagaugauacauauaaaagaagucaaaauuuggagaaaaaauuuaaaaagauaaguagaaaaaugaaguaacuguagaaaccauacuuacucuuugaucucaaaugcccaaaaacugaaugaaaaugugaauuuaggccgaccagguagucuugucaauaaacuaaaagaaaaacaggaaaauugagaaauauguuacaacuauaacaacacaaaacagcauaguuuugaaacacuugcaguucuuaaauauaaaagcuuuuauuaguuaauuuuuuaaaaggaucucauaggauugacacugaaucagguugggagguggaacaagggugauggcauauucuuucugaauuacuuauuauaacauuucuagaaucauuaggucagugcuacuuuguugucgucaauguacaauaaaggaaucacaaauugaucuuagugauaauuuuacagaggcagacauugcacauagguaugacugcaaaaauggguggcuaacucugggaagauacuuguguuaaacuuuauaugacauuuaauaacccuucaucauaaggcaauguuuuuuacaaaaagauugaaaaaaucauguaagucauuuacucugcaaaaauggcacauuaggugggguuccaaaauccauaaugaaacaauguguuuugcaacuaagaaacauucauuaugauauauggaaaacacugucugucuacuuguccuuuacgaaaaaauguaaaacucugaggaucauaaaauuuaacuacuaaaaauaaucuucguguuuaagugauacuuauuuaagacuuuacacuguucuguuuaaccauggucuccugucugauuuuagccauaauugcgaaguauuucuaacuacaacaauuuaauuuuagacacacccgugaggaaguugcaagccaacaaaaaaguucaagguaaguguauuggcuauaguaauguguguauauggccucuuuuguuacaugaagagaaaucaaacaauaggaaagauuuuaaaguauuuuauugaaacuuguuaucgaucagagagaaaagcuagccaguuuugaugaaaacaauuuugauaacaaucagaaaauaaauuucucauguucuauacuaucagaaucuaauaacaaauauuaagggaaaggucaacauacucauguaaacugcuaggcauauugaacccuugagauagacucaaguguauauucuccauacauauauauauauauauauauauauauauauauauauauauauauauauguaauguuuuguauauacaaguauacauauaauuuuguguauauaagaguuaagucaaaaagaaauuguugaauaucagagauaaacaaauguagauugcagguggaccugaauccuuaaaaauguuauuaugugagacaaugcuacaguuugagacauaaguaaauaagaaauguauauaugcaaaaaaccauuaauauagcuauuuacaaaauguucauuuaaauauguagauuauauauguauauaucacaugugcauuacaauuuauuucauaauuacacuaugugcauuugcuaauuccuccacuuaaguuaucuuacauuccaauacauugagagagcaagaauuucccuuguggaagcuagaguaaauugcaaguuuggaauugcaaguuuggaauuucuggguuaauuagauacuaguagugaaaaggagacacaaggcuuaucaaugcgcuauaggaacuucuuacuuuaaaccaauccaauauacagaccuuugaaaguaaaagaucaacugcacagauauuuuuuaacuaaagaaugugucaguaaaucuauguaaauauccaaauugacacaaauuuucuaaagaguuaaaauuauuaaauuucaaauuauuauuuuauauacuuuugaucaaaauauaauauuugcuucaccauaaguugaagauauuaagaaaacauaaucuaagguuuauuacaaaaaauaauggccucugauagauauacagagaauaauauauucuuaaauuuuaaaauuuccuaacauuuacagucuauacauucuccuuucuuucuaauuaggaucuagaagacgauuaagggaaggucguucucagugaaaauccaaaaaccagaaaaaaauguuuauacaacccuaagucaauaaccugaccuuagaaaauugugagagccaaguugacuucaggaacugaaacaucagcacaaagaagcaaucaucaaauaauucugaacacaaauuuaauauuuuuuuuucugaaugagaaacaugagggaaauuguggaguuagccuccugugguaaaggaauugaagaaaauauaacaccuuacacccuuuuucaucuugacauuaaaaguucuggcuaacuuuggaauccauuagagaaaaauccuugucaccagauucauuacaauucaaaucgaagaguugugaacuguuaucccauugaaaagaccgagccuuguauguauguuauggauacauaaaaugcacgcaagccauuaucucuccaugggaagcuaaguuauaaaaauaggugcuugguguacaaaacuuuuuauaucaaaaggcuuugcacauuucuauaugaguggguuuacugguaaauuauguuauuuuuuacaacuaauuuuguacucucagaauguuugucauaugcuucuugcaaugcauauuuuuuaaucucaaacguuucaauaaaaccauuuuucagauauaaagagaauuacuucaaauugaguaauucagaaaaacucaagauuuaaguuaaaaagugguuuggacuugggaacaggacuuuauaccucuuuuacuguaacaaguacucauuaaaggaaauugaaugaaauuaguguuucuug

SEQ ID NO: 13622 - RNA, 45420 nt, Homo sapiens
aggaaagcguaggcgaaaccuccccacgccagaaagcaaggccagcuggggaggggggcuuucaucuuaguauuuuccgcaucuugauaaauaggagagagcaaucuuuugugcugaguguagucuuauuaccucuuagaaugcucugcaaacuuaauuucaucucuucuuaagagcaagcuuucugaaauggaauuaggaucacuuugaaguggacccguuuaacagguuuucuuaauuuuucaagauagaggaaccuauuuaaacucuaaggaaaaauaguauuuuauggugcaggauuaggcaaagcugcacaaaaugaauucugaaugaaauaucugauuaucuaguagaacauaaauaauugugguuuccuccccuuaagagagugugaagccccaacugaccccuuugugugccuuugugagaaaagccgcuugcucaguuucuccagauagagcuguuuaaaucccuugacuccugaggaaacugaaggcccgcaauugccccaugagagccucagcccugcagcugcugcugauugugggcugcucugcuccuggugauaagagugacauaaauaacaacucacuaaaauguaggagugauuugcuuuaagcacuucagcaccugcuguuacuaauuaaggguuuagccugccacagauugcaaauggaaauccaguguuuuaaaaauuguagagacuagagugcccugcauguuacugugaucacagaaaugaaacaguggaugaagugucuuggugacaaugaugucguguuauuaaaaccacccacacuuaaaggguauguaccaagguguuaauagggcuuacccugagugguggaauuacacuuuauuuucuuuuuugaauuuuuuaguguuucccagugaauacauguuacuuucguuuacaaagguguaguaagcaauucaaacagaaaaagauauuucaucaaacgaagccuaacacugguucagauuacugcuugcaggugaaaaucuuagauguacuaaaaggcaguuuuccaagcagaauauacuagaaacauuuauuccuuuuucuuuuugucaauagaucuuuuuuaucgccuguguucauauuacauugucaacaacauauuuuaaacuaaauaaauauucagauuuauguugauuauaaacuauucuguuaauuugaguuauggaacugggauaguggacuugagcaguguucugauuuguccauuaacauuccaagugugcuauggcacugauuuuguaaagcagagaaagaagcauuuggcaaaagagcaaaucaguucuuuccagagcugcuuuaugucauacccgcucugugccauggugcaagaugcuaugcaaaaacuucagacuccugcacagaacgguggguuaguggugcuuguuucuccucaucccuuuccagaucaucuuccuaccuacccucagauuucucccgacuucccacuaugcauguucugcccuucauaacucuuucuugacuuuuuuuccccccaaaaggccgagagauucuggggacacuggaacugagccucuaaggggaggauagugcagucagaaugccaugugcuagcuagggaaaggcucaagcuaggcaguugauuucuauuauuuuaaagcuuaugcucugcaggaggcccuguuuccugagcacugugauucaaacagugcagagcccagcauggacacauuuuccucucuccccugguccuuccccugcuagguugauuugacguuuucuguguucuuugugcucaguucgguauuacuugcaaaaacauggcaauaacuaccaccugcagggcacuauacaaacacuucucauaacauucuugcaacguaagcauuuugauccuucagacgagggucacuuaagugucuuauucaaagccacugguaaauaguugaacuaagugacaggacuguggucugucugccucaaauggcuuugcucccuucccacugcaucaagcuguugaaaaaagauaacacccuuaguagaacuggucauacucuauucuuccuauauuccaaggauugaaugccaugcuuucuuaucagcagagaaaagggcuauuagaauguaagccccaugagggcaaggaccuugucuuguuuguucaccuugugcuccuagcgcccagcccugugucugcccuauaguaagggcucaauaaauaucuauggagagaauaaacaucaagcauauuuaagcagagacauaaaguggcaggauauuuuaaaagaaaaaauaaaccuuacuaauagaaaguuuuacaaacuauaucccaggacacccuaguuuauauguguuauuuuaguguaauuauuaauggcaccuccuuucauucucaaaagagccucaguuuggaagaucaauuauauggccauacacccugaucguauuagauagguuauuuuugggcauucauauucgcuucaauuaaucagguuaauuaaaaaacaaaacuauaauugcuccuguugugaucacuuguuaaugacuguuucauuguuuggcuuuggguucacaaagaauauauuugcauagaagaaaucacaugcuaugguggagauucgcaaacaaucugcgcucacaggcaucacaaaggcuuagagucccaugcugcuccuaaagugcugcuggaaaugaggaguguuuauaaaaugaaaaggaaacacacuaguagggccccaacgcucucuacuguagaaauuacauauuucaaagcucauuuaaaaguguugugcuguguucuuggaauauagaguauugagggaaguagaaggaaauaaguuugaaguagguugguagcaggcuaugaaacaccaugcuaaggaguuuaaauugguauccuguuuagaguaggguacugcaggugaaggagauuggcucaugaugauugagcacacaggucaaccuccccaucuaccccaaacuccagagcagauguuuucaaaaugugaugauuccuucaaguaaauaucauggaaaaauaagaaggcagguauuccaaauuaaaagaucaaggagauacaacaaccaaaugcaaugcauaguucuuaaugggaucuugguuugaacaaagcaacuucucucugaacguuaaaaaaaaaaauacacaguaaaaugugacauuuagaaagcaaaugggguccaauuacaccuaaaacaaaaguagaaaauccacagcuuaaaagacacaaagagaagaaaugcagugauaaaacaauuuuagugauaguccaggcucaauguugacagaaacaaagaugaaaguagcccaaagggugcucaccugguuugaauuagcuggguacagaacucccaggccagguuggcccccuggauuuacccuguggacucucccagcucacuccuacuaaagcaggagcaauggugccuuuaacuuaaggauaaaacucaggaacuauucucuaaagaaaaugaacuauacaugagaugaggacuccugguaugaguaauuucccgaucucuguaacugaaagaggaaaggaaaggcaguucuuuccaggaggaaaauaaacuaacauacuuggucuucagaguagagcccaccuugauuuugacaauuagcuggcgccagccuuucugcucuccagccuuugcuuucacucauccugcucacucucaccaaacccauagucaguugucccauuaaaggaggcccccacugaggaaacaccaccucagcugcaggagaaacugccuguucacacccacuuaguucuugauucauauuuauguuuggaaacaaaggauugacagacauuaacagaacuagacgaaugcacacacugaacgauugaagagacagauuuuuaaggugcuguagucugaauguuugugcccucuaccgaauucauauguugaaaucuuaacugcuaaggugauggcguuagcagguggggucuuugggaggugauuaggucauaagggaggagcccuugugaaugggauuagugccuuauaaaagaggcccaagaaagaucccuugcuucuccaccaugugagaacacaaauaaauugccaucuaugaacuagaaauugugccaucaccagacauuuaaucugccagugcugugaucuuggacuucccaaccucugagcugagaaauaaauuucuguuguuuauaagccacucaguuuauagucuuuuguuauagcagcuugaauaaacuaggacauaagggaauagaaaaaaaaaaaacuucuaaaauuugaauuuguaucuguagagagaauaucacauccuaaaaauagcagguuaugaaaaauuacccaaaaaaucuuagaaauuaguaauucacauuaaauggauugaaauuauauaaaaaaauacuuagaaggagugaagacuaagcugguaaucugaaaaaugaagaaaucucugagagagaagucaaggcauguaggaucaauuuaagacauccagcaucucuuagaagauuuacaaggagagacaaagacaacagaaaggaggaaauaaagaaauaagagaagaaaauuuucagagcuacugugugccaaguaggaugaauaagauauauacuuaaacacagccuagaaacuaucagaaugcagaggaaaaagaggagaaaagcauccaaaggaacgaagcagcuuauucuuuucauuagcaacuuggauuccagaaggaaaauucagagacaaagugauuuugaccuuauaaguauuugcuggguaaaacuugcacugaauugugagagcacagugaagauguuuucagacuugguaggacucugaugcuaucagacggucuuuaaauaauuuucugagccuguacggcaauucaguaaaaugaauccaagaaagaagcaaauaugagauacaagaaacugugagacucagagaaacaaaaaauuaaguguaaauguuaauaaaaauguaaauauuuaauaaugauuggaacuaaaauuccagauagucaugguuugggaaguauaugggguggagggaggcauguuaaggaugcugccuuguuuggagagaggcuguagauuuagauuaacucuacaucuuaauugaaaauggcuauguauacuuacuaauaauuaaguauuucugaaauuuuggcggccaaaguggaguaauuugaguaacaaaauaaaugauaguauuggauuguaacccaaagaauaaaauaaauauguccuuacugauuuaaauaaacaauugacuaaauaaguaaaugagggaaaaggaacauauccuccuuacauaagauuuccaaaucauaaauguagauggaaggaaauagaaaaucaccaauggaaugucauaguaauaauugcuacaggcaagauccacaaauaaagggcaggaacagaggguauaacuuucaggagaaaugggauauuugcaaagccucaaaccaucuccacuaacauauuuauuaauuacugugaugguuuuaacguacauccacaauuguuugauauuccucccuccaagaggugguacuuuagucccuuuccauugaguguggccagacuuagugacugccuucugaaaacaagaauguggaaaggauaaacaagugacuuaacaguggagaaaccuugcagacgccaucuuaaccaagcgaccaaggugaaccucccuggaaaucucucauugauauaugacaccauaagaagggggcgcucauguccaugguauucuacccaaaaucuauaguuccagucuaauuaugagaaaacgucagacaaauccaaguagugggacacucuacaaaauaccugaccagcacuccucaaaagccaguaaaaacugagaaaccauugcauauuagaagaaacuaggagacacgaggacuaagugcaaccuauuauccagaugggauccugggacagaaaaaggcuaucaguggaaaaauuggugaaauucaaauaaagucuguaguuuagcuaauaguacuaugcuaauauuaauuucuuaggguuuucuuucucacaauuucuuaguuuugauaaacauacuaugauuguaagauguuaauauuuggggaagcugagucagauguuuaugagaacucaccauacccucucugcaacucuucuguaagucaaauuaauuccaaauaaaaagacaauuaagcacuuaagguauaaaaauuagggauuucacucccaaagcauuauaggaacaacaggauggaaaaaugaaaauuugaucagccuaagaguagcuauggaaaaaaaaaauuacaguaaauaggaagccugaaauaauaaaugaaagggaauaaggucauuucacauuaaauuguaaauguucacaauuaauugauauuagcuaauucauuacauuacauuaaugaaguuaauguacacuaguuaaugucaguaauguaauuacuuaaauucauacauuaaaaacugaaagaucagcuuguaaaaacuguaaauucaauuaaaagcuauuuacaaaagucacagaaaagaugauaaagaaaaguuuaaaauaaggggguaugaagaacuaagcuguauaucagaaaaauaaaauuugaggugaaaaacauuaaagggcaaggagguauguuuuauauaguaguauuugcuauauagaaucaucuauauauauacacuaauaacauacuauguaaacauagauuacauauguuguuaaauauuauaguuauauauuuauauaauaucauuaucaugaaccuuuauguacuuaacccauaauuauaaauauaaccuaugauuagagaaauugauggauugacaaaaccauaauuaaggagauuuugauacucuucuuucauaaacggaaagaucaaguagaccuaauauaagcaaagaaagaauuaacaauuuuguucuaaaagauauauagaacuuuaugcacaacagaaaacagguauuguuuucaaguacccauggacgauuaacaaaaacuguguauuaggcuaugaagaaaaugucaacaaauuuuaaaaaguagaugucaugcaggacacauucauuguugacaaugcacugaaauaagaaaugagcaacuaacaaauagucaaaaaaauaaaaaaccaaacauacuauugccuugaaaauuaaaaacaccuuuauauagguauuuaauaaaagucuuagauuaaaauggaacuaucaacugaaauuauaaacuaauuagcaaugaaugaacaugaacucacuauauauaaaaaugugugggguacaacaaaaugccacuaggaggaaaauuuagauccucuacuuugcugcccaauagaacuuuccacaaugaugaaaauguuguguaauuauaccgucugauaauccacacuuaccacaugaggauguugagaaugugaaauauggcuagugcaacugaacugaauuucaaacuuuaauuaauuuuaauuaacauaaguuuaaauagccgcauguggcuacuguauuggacuacacaguucuauauucucaauaaagcauuaccagaaaaagaaaaaaauaaacauuuauaguuaagaagcaaaaugaacucaacaccaguaauagguauuauauauauauuuuaaaauuaaaacauuaaacaauauaaaaacuccauaugaaauggauuuguaaaauguauaugaacaaaauucauuuaagagaaggugagaaacuucaauuuaccauuaaucaauaaggaacuauaaaaugaaauguaagauccagcucuauaaaugucuucagaaccagauuuucuagacauguuuuaccuaaacuuaagaugcagauaauuucuguguuuuauaaacuauucaagaccauagaacaauauuuuauucuucaaggcuggcauaacccugauaccuaaacaagauaaggcaauacaauaaaacaaaauuauaucaagauucauuuaugaacauagaugcaaaaaucuaaaggugaaggcauugaauucauuacacauuaugaauagguuuaucccagcaauacugugauggcuugacauuaggaaaucuauuaauaugauucacugccuaacagaucaaagaauuaaaaaaaaaucauguuauacugaaaaagcauuuaauaaauaucaacacccuuuucugauguaaaauucuuagcuuccaaauagaaacuuuuuuaacugauaaaggauauugaucagaaaucuucaguaaguaucauauuuaguaguaaaaugauuugaaauauucccacuaaagucaggaacaagacaggaacaccuacugucacuccuguuauucaccuuuguuuuggauguucuagccaaugcuuuaaagucaaauaaaaggcauaaguucuggaaauagagaaaaaaaguguaauuuuuugaaggcgguaggauugccuaccuaggaaauugagaauaaucaauggaaauguauuggaacugaacagagaguacuauaaagugcauuacuugaagcaaguuccuuauacagaaaucaauagcgcuucuauaugucagcuauaaucaaucagaaaauguagugaguaagaagagauccccuucacagugaccuccaaagguugaaauaucugggaauacguaggacauaucugggaauacaugcuaggacacaugcaaaaucgauaugaaaguccauaaaacugaagaucauaauagacccaaauucucuaagaugcauacuuccuaaauacggagauuuaauauagcaacaauauuuucuaauuaacuguuaaaauagaggccaccauaauuaaaacuuuaacaagguuccuugacaaacugaugccgauuucuguuggaagagaaauuguuggaaaauauauaauaacugaauugaaaaauaacagggaaacaugcucugucaaauaucaaaacacacuauaaagagcuaguaauuaagcagugugguauuaaccaggaauaggcaaauagaucaguggaucagaaugaaguccagaaacacacacacacccccacacaccccuaccuggcauugugaaaacuucgcucuugaaaacacugagagaagguuagucuguucaguaauccuguugggucaauuaguucugcauuuaaaaaagaaaacugaaagcagauaccuaccucauauucaucaccaaauaaacuccagcugggauaaaaagcuaaaugcaaaaauaaacccuuaaaaguauuagaauacucuaccaaagcauauuuuaacauaaauggagauggcuuugaaagcaagauaaaauucaccaaagccauaaaggaaacaguagauuuguuacuaaauauuaaauauuuauuagugacaagagaccuuauaaucagaauuaaagggcugggcacgguggcucacacccguaaucccagcacuuugggaggccaaggugggcggaucacccgaggucaggaguucgagacuagccuggccaacauggugaaaccucaucucuacuaaaaauaaaaaaaucagccaggcaugguggugggcaccuguaaucccagcuacucaggaggcugaagcaggagaaucucuugaacccaggaggcagagguuacagugagccgagaucacgccacugcacuccagccuggacgacagagugagacuccucaaaaaaaaaaaaaaaaacaaaaaaaaagaauuaaaggcagagugacagacuggaaaaaaaagugguugacuaauauccagacuguauaaacucccacaaagcaauaagaaaaauacaaaccacaaauaggaaggugagcaaagggaguaaaugggcaugcaugauaaauaugugauaauaaaaugcaaauugccacuaaaaugaaaagguacuccauucauucaaaaaaugccaauaaaaaggauaagauuuuuugcucacaauacaaaauuuuuuuaaagguuaagaauaaucagucuuauuaaggguuuggggaaaugaguacucauauauacugcuuacggggauauaaauuuuuguauccuuuggaguaugcaaaacaaguaaaaguuuacuuucugauuuucuaguuuggauucgaggauauaugcuuauuugcacacagauguauuuauaaauguauucaucauggcaccguaauaacaucaaaacccaacacugggagaaugucucaaucaauugucaucaucgaaaauaaggaagacuggaucaagaugacagaugagcacauuuaccccugaucccaacaaauaauagaaaacguauuuuuaugagaauaaaucuauaaccgccuggaaaaugagaauguucccagugaaucagaaauuuugaggaauuguugaacuauauuguuaaaugaaaaaagcaacucacuucaaaaaauacuaacagcccauuuaugaaaagcuauguauguguguaucguacuuauauguuugacacaaaaaucaucuggaaggauagacaccagacucuugacagcaguuccuuucagagaagggauugaauuaggauaugagagaugguaaaggaagguugacuauuuuauaaaaaaaaggaagaaaauuaggugagcagguggaagugccaaagcuuugcuuacuuuacuauugccuaguuucuugcaccucaccuguucuuucuugcaacccucaggaaaccaggcugaaaagagaaggaagccccacggggccacuuacaccagcauccugcccuguggaguugcuucuuugccaagcugccuuucucuuuguacaaguauuuccagccccuucccucacucuuagcuucaacucuaaucaccucccaaaucuguuuucucauacagaugucuauggccuggcauuuccaauugucuucuauuuccauuaauuuaagcauccccauucuuuggcauuuucaguggguugaguucauuagcuguagagaauaaaacauacagaaauaaaacaugaaguugggaaugcucuuuuuccuaauugaauauacuugaaaauaucuccaaaugcaaauggccuuuuugguuccuaauauugagguuugaauagcacauauauuccauugaaaggacuuuauuucaguguuucuuaugauuuaggaauuuaaaucuuucucuguucccuggaauguguguuucaccaaaauaaaucaugugggagagucaugacuuugauccuuucagcaauaaacagauuuuccagcaggaaagacuuuuggaaaacugagucauaagaacucuaucauuuaauaggaugagagagaaauuugcagaaaaacugaaguagaauagcauugguaggcaaaauguuuaaaaacagggugaccuucagaucuaaucacuagucuagguacugaagaugugaaauuaguaguuccuguccuugagcugcuuauaguugaccaucuagccagucagacuagauauggagucaauuguuguguuauuugugagcuuuauuuaucuuauccucucauacaugacauuuucccuaugccuaggcaauaauuaugugacgccucugcuuccuucucuuucaggcaaaaauagacaucuuauuaguuggagaugucacugugggcuaccuggcugauacuguacagaaacuauuugcaaacauagcagaagucaccaucaccaucagugacacgaaggaggcagcagcgcuuuuggaugauugcauauucaacaugguucucuugaaggugccuucuucacuaagugccgaggagcuggaagccaucaaguuaauuagguaaacuucaaaagccuugaugcuguaucuuuagaaucauuuuuuuaaaaacccauuuuuuaaaaacuccuaaaaagaugauauauuucuauuuuacuuuucaaauugaggggccagggauuggcucaugcguguaauccuggcacuuugagaggccgaugugggaugauugcuuuaacccgggaguuccagaccugccugggcaacauagugagaccucugucucuacaaaaaauuuuaaaaaauuagccgggcauggugacaugcaccuauaguuccaguuacugggaggacugaggugggaggauuguucaggaguuuaaggcugcaaugaacuaugaucaugucacuguacucuaaccuggacgacagagugagaugcuauuucuaaaaaaaaaaaaugagggauauuuucauggggagagucuauguacauguuguuuuuauuuccaguuugugguauuuuauuauaaggaauuauuuuaacuugaaaauagguacggauuagaauguaagaaucaauuugucauagaaauuuauuuaguaugcaaugcuuacauuauucccacacauacuccuuuuuaauaacuguaucauuaaaaugguacaucuuuccagaguucauuaauuguaguggcagacacuaauaaggaagugagcacucuuagcucucuguccuguuagcuggggacugaggugucuccuggagccauggggccuucuggauucacuggguccagaaaccaccaccuccaguguucuuguuucgucuugcaguuccacauaaguucugcuucuuuucuuuucuuuuuuuuuuuuuuuuuuuuuuugaggcagagucucguucuguugcccaggcuggagugcaguggcgccaucucggcucacugcaaccugcaccucccggguucaagugauucuccugccucagucuccugaguaacugggaugacaggcaggugccaccacgccuggcuaauuuuuguauuuuuaguagaggugggguuuuaccauauuggucaggcuggucucaaacuccugaccucgugauccacccaccuaggccucccaaagugcugggauuacaggggugagccaccaugccuagccaaguucugcuucuuuuuaacccacuccagcucuagaaaauuggagcccaguggugggagaguuagauucuucccugccacuuaggauguauuuagauaggguuagaucagagcaaauuuguucuccuuccaugaaauacuuaauagauaaaguggaauugucaauuauauuggaacauaugagagcuucucugcauuacaagauaagccucuuuuuuggcuaaaaaauucagagacaauauuuugaucccugaauaaacaggcaagcaaaguauguuaagggaaaagaaagguugaaaugagaagcccaagccaucaaguuacuuauuaaacagagagacagacagacagauacuacucuugggguuucuuagaacaacuggucugcauuucuuuuggcuuucuacaagguauaugaacucuagacacaucaggcaaacuaucuaccucaaagugaauuccacuucuaaaaccuguuguaaacuauccuacuucugagaauaugcuuauuuuauuacaagccuuaaaaaaagggaguucccuuggcugggaacucaucauaauacuucauuuauaucauauuuuaaaauuuuuuacagcagcuacaugaggcagguggagcaggauuuuauuguccuuacuugacagaugagaaaacugaggcugaagugacuugccuaagaccacauggcucauuuuuacaaaacuagaugagaacucuacucuucccuucauuuucuuucuagaagucuguaauuaauugacuuuuguauugaaaccaccucuuuuucaccugugagguucaguaugugccaagcuggguguauaucaaacauagauaugguuuugaaagagccccagacaauucaauauggcuggucucucucuucauuccaagauuaggacccuagcuaugccucucugaauggaguaaagcuuugcauuugcucacuaucagagccaccuuuugaacaagauaagagugaaguucuguuuaagaaccagcuuuauguuuagcugcagauauuaaaaccuagaagguuagaggagagaauuucuugucugauacucacuucagcagcuuuuauugcccugaguaacauagcuuaagauuucuuagcagagaaaagaaaguagaugaagguaccaaguguauagcuaugcaaacgguaguucuguuauuuugccuuaaaagaaaucauuuguuugaaagaaaacaaauaauuuguggaauacaccuggacuuguauuccuuguuugucuccuguugcacuauucccaacacccagugaaggucuugacuaccagcagguguuaucugccuugcuguagcuccagugaaugccuguauggaugggugggagaagcgccauccuaggcaggcaaugccuucuagcuuuuuugcuccucucugcaaggggacagagucguuugguuaugugugugugugugugugugaggguguguaagcuuugcuuucauggugcuguccucagaggcuaugaaugucucugaaguugccuuuccugcccucagaauuguuaugaguuuaugaauuguuuaaaccccuguagaggauguuuccaguuuucaaccuauaguuuuucuuaugguaaugagucuuguacauguacugccccauuuguaaggaguuuaaaccuucaucuauccuaaagcacuacaucuuuugaguuugggcuaauauuuaaugacuaaaccaaaaugaaaagccuggcucuacuuuucuucugcuguauuuuaaauuuuucucuuuagaucuuuguuguugucugguaauauuucaaaagcuauguaggucuaggaaaauguacaacuacguaccuuacucuuguuucucugggugcuuuaugucuccugucaaugaaugaggaauugaugauagaaugaaaguggccauauauauguucaguauuagagcacaugaucacaaaucuauacaucuguaagacauauagauuuuuauugaaaauaagaaugaaguuuagccuguuagcuauaauauuagauuuauuuuagaauaaaaugaaagcagcuuccuuaaaagauucuuaaauuuaaucuuacaaaacuauguuuuaagcuaggugcuaaucauucacugacuuuaaucaugcauaaaauaucaguacuuuacagacuuucucaagaauuauggcacaucucacuuauagguuaacguuccugauaguacugccuaauuuguuuucaucucaagaauguauugaaagaguauauuuuuauugagcagaugaacucagacacuaccuaguggugacauauuuuaagauaaucuuaggauucguaugcuuagcuccagaauuccagggauauuucacucuuggcuuggauaaguuuucacaauugaggauacucaaagggcagauacuugauaauucagacacauccugauacuuaucuuccaaagacagguacagaaaguuuaaauauguuuuaaacucgucaguauauggggaguugcgguuuucuucucaaugaaaugguuccgcaguuaaaauucugugauucucaugagcucagagcaguuuagcaacagaaaaggaacgcaggauguggcuccaucugcuccgucaacaaaucaaguuugaaucugauuucauuucuuccccauguagcuuuaauugucugaccagcuaacugaucacuaagaaaacccaaucuugugagccacggagaucuaacaaguuguccuuuuaugucuccaagacauccuugacuugacaauguaacucauuaaaucuuacuagguaguuuacaugaccuacuccucugaauauucgacaauaaacacaguaacagcaaaacaucuaaguagcuuuacuaaaaccuuuguccuacgaauugguggaggaagugaauaggaacugaagacaacuccaggucuuuauaacuucuagcaccaugucacauggugaauguugcagcaggagcucugugggagagccgagugggaacagggcacaccacucuucacuauuagccagaauaaacuaucagagcuuaauuaaguaauuaacaaagaacauuauuuguuacaagucccauguaggucauaccagguuaguuuggccgcauuuagcccacggacagaauaguggguaacuguacucaagaaaaccacaacccaaagaugauacuggcuuuugucccuggaaauccuuauggcucuaagagaaguaaagguagaaauuuccgcaggcuucauagggacuuauaacacccuuuggcccucuuagaugauagauuucagaggccagggcuuuccugagacccuuugaucagcagaguguacaacucagcucaaaacacuuguauaugaucuuuguuuuuucagcuaccagagacagauccggggaugggggcaagacaguggguggguacugcugcagguugagcgaugcuggcuccaguucuagagggcacugcaggcaggcauaggaauggaacccagaauaucaguauccaaucucaaaagugagguguagccucaggaaacaucaugacauuuaaacagcguaaucgugaaacaugagggaaaauggauuguccccaaauaaauugcaaacacaagagacauuaauugagaaggucucagagccuacaguuugauuuugguauauagaagaggaaguacuaucaguugguguggauaaaagugauuuuuauuuugguuuguuuuugcauugcuuaguuuuguuucaaggaauauucauucacaaaaaaagagaacauuuucugguugauccuagaaacuagaaacucuuuuagcuuauugauuuguagggaaugugaaugaacagcugagcuuaagaccagaguauuggauucugggaacucuuaucgauugcaggaguucccuauauagcagggggaguguguguuugguaauugauucugugcuaauaacaaaaguccaagaaucccaccuuugucugauguaaagcuugaaauuugaaagucaucagggcauauaaauccauauauccauaucuuacauauuuuugugucaguaaaauuaauuuucaaauuuuugaaaagucggguuuucaaaaauggacauaggaagauuucuaaaagcaaacaaccuguuuuuaaaaaaucauuuaacuguauuuaacuuaggauaauuuacuuuuuugaauccacuaugcaguauuuuuuauuucaacauuuaaacuacccaauaauuuucuuucagucccaucugcucaguccauuauucccuuucaccucucuuuccucauucuguugucuguaccuccguuauaauccacacuuucucaucaccuaaaaauauguauacgaggcuaggcauaguggcucuugccuguaaucucagcacuuugggagguugaagcgggaagauugccugaggccaggaguuugagaccagccugggcaacauagugagaacccaucucuacuaaaaauacaaaaaaauagccaaguguaauggcacacaccuguagucccagcuaccugggaggcugagguacaggaucgcuugagcuugggagggugaggcuguagugagccuugaccacgccacugcacucccgccugagugacaaagcaagaccuugucucaaaaaaaaaaaaaaaauuaucuaucuaucuaucuaucuaucuaucuuucugucugucuaaaauguauauauuuauuuucauauauauaugaaaugcugacauccuggcaggcaucauucugaucccccuauucccucugugucaccacaccaccuacaccaguguaggaagugccuuucuuaccuccacauuugguuggccaggcaaacucuauccucccuccugcauaugccuauuuugaugauaauauucugaguuucucauuuccucauagaaaccauauauucuuuccuuuccucucucucagccuaaacuccccagaauucauagcacagaaucaagucugaauggaugucaauguggugucacauuuucuuaauaauccugcuagucugaaguaauuaauuuaguaaauacucugaaauauuuaacuuuaccaaagguucacggguaugcccgcuuuccuuaccaucagcucuugccuggaucacugcccuagggucuuuccaguccaccugugucaccccuaucagcgcaucccaucauaggcagaguggucuuucuaaaaugcaaauguaauuguguugguugcuccugagcuucauagcuuuccguugcccauuuuucuucaauaccaaaccuuuccuguggccuaacaggccuucugugagcagagcccagcccucccucgcucuuuggucuccacuuaugcuuuucuuccucagaugcccugugccagagcuuuccuggacaucuuguaccuucucaaacucaccuguucucgaccaccccagggcuccugcauaugcugugccuuuugcccagaguguucugugcugcacaucugcuuucugcccucccccucuccccagccuuuucugugucuagccagcaccaaggguugucugccuggaagccuuccccaaggcugcugaggcagguuggugcccagacguggacuccucuuggcccuuuugguuuuccuuccuggcauuggacacauuuucagccauaaaauuaucuauaaugauucguuuaaugucuuuuugccccaagaccuccagcugugugagagcaggaaccuugucugucuguuuaccaugauaucccccagagccuagcacagagcuggcacauaagagguucucaauauauaugacucagauauauaaauuuauauuaauauauaauguaauuugaaauauagaauguauacuuacuuccaaaugcauauguaagauaaacuaacaauguuauacagugggggugaucccaguucucauuuuaauaaauaaauaauaaccauauguaaccacaugcuaauaaaugauguuuuaaaguauuugagaauaguuugcuuuucuuagguaguuuuaaacuguucucuuuaaaaucucuuucacagucacauucucccugcaaaucauuucauuuuggcuaaugccaaggcucaguauccauccaauuaucgaauuccagacuuacuguacugaguuuagugaacuauaaugccacuuuaagaaaaaaguuuuauuugaaaaauuucaagaaauaaaaggggagagaguauaauaauacacccauaauguagccucagcgguuacccacaucuggcucaucauguuucucccuaccuucccaccccugcccaccaguggauuauuuuaagacaaaucuaaaauacuguuuuauuucauccauaaauacuuuaauugguaccucucuaaggugaggacucagagaauaaccacaaaacccauauuauaccugaaaauuaguaaucacuucuuaguauugucaaauaucccauuagcauucaaauuucccugcuuauccuuaugauuuuuuuuaaacugugaguuuauacaaaucaggauucaacuuuccuuuuucuugucuuguucuuuaauuauauauauauuuaaaaggagucauuugucuuacagaauuccccccauucuagauucugcuuguuucauucccaugauguucuuuaaaauguuucuuuccacaaaauucuuguaaacugaugaucugaccaaaaauuuggauaaaguuuaggcuuuuuuuuuucauuuuuaagaaaaagugauucaucucuuuccucacugauuugagaugcuacuuuuacuaaauuuccauauuaaugauauuauuuuaaauucuaaagaaaugaagaaaaucacuguaguuaguuccuaauaagcuaaacuccugaaucucaauuuuuugaauaaugauuuugcuucauuuuaacauuuucuuuccucucucagauuuggcaaaaagaaaaauacacauucacuguuuguuuuuauaaucccugaaaauuuuaaagguauguaccugcuaaauauaguauuuguuuuuucucuaaauagaaacuauaaggucaauauuuaauauaaagauucuuagguuguauuucagggcauggaauggauauugcuuuaacugaaccacugacaauggaaaaaaugaguaaugugguaaaauacuggacaacaugucccucaaacacuggugaguaaaaaauuuccaaagguuucaaaauuugaauuaaaaucuuugaaaacucugcucauauauucugacaaaaacaagcauaaauaaaauaaagggagaaauauguauucuuuaccuggaaagaaaaaaacuacaucuucagagguuuagaauguguugcccaagggcaaauacagugcugcgguaggcacaggguuuugggugggggguugaagcagcauuguguuacuguuuuucuuucuuuuuugguagccuagcuaccauaauuucuuacucauuaaaauggaauuaacugugcugugucauugugugauuaucuaaaagccaggggcccuaaccuacaauuguauugugcuuucuucuuugcaaaacacuugcauagaaauuauuuuacuucuuaaaguuaauagggugguugcccuuucuguuucagauuuuagaugcagaggauuaaugucaaugcuucaauuagaccucacauuucuaaacucuuugccuauuauauuaagcauaucaccaguaucuaaacacuuuaauuaaacuagcuuucauuuggcuugugaaaggacagacuccaauuacggaaauuaaauucuacuggaaucauuauuggucagugacuauuuuuggucuuucucggccugggauacuaaauaagaaaucuuuuaaaauuaagaugauguuaaauugggacuauuguuggucaagggguacaagguuuugguuauauaagaugaacaaauucugggggucuaauauacacagugugacuauaguuaacaauacuguauugucuacuugaaauuugcugagaggguagaucuuacguguucucaucaccagaaaagguaacgaugugacgugauagauaugucaauuaacuugauuguggugauuauuucacaauauauauguauauuaucaacucaaguuguacaccuuaaauauguacaauuucgaauugucaauuauacuuuaauaaagcuggcaaaauuaagaugauuuuuucuuaaaaugggccugaaagacauuuucuggauucuccugauaaugauuauaugagauuuacuuuaacaguccuuuuuuaauguucuuuuuaaauauucagaugagugagucuguuugugacauuccaguggcucccagcccuugugguucuuccuggaaauggcuaacuuuggugaccgagggcuuuugcaaccucuucuuauuugguucucagugaaauagagcagcugcucgucaccugcccaugccccucuguuggucaugaccaugucugcuuccaguugucucgucuuugcucuaaggaugagcagcugcaaaaaaggaaaaaauuuuuuucagaugcuauauuucgacagugcagcugcuuguugaagacucaugcguguuuuuugucuccugacauuuaccuauaaauaggaacuugauaaauaacucagucgaauguguuuuaagcacaccugucacuaagugacuagaaucuggcuuaaagguaucccgggguaaauaauauagaguauuuuaguuuuugcuuucuaaccuaggugguuuuauauuucacagaaaucuauaaauugcuuucaguuuuaaaaauacugcuuuguaaaaucuauugaguaaaagacaacugcauuaaggauuggggcuuguguguuugauuagcgucaucuccuuaagugacuucagaaauaaauaguuccccucucaaaacuuucaguuaagacugaaaacgcaacugggccugaagaacuuggauugccccugcagagguccuacagcgaacaccugggauauuuuccuacugaucuauuugccugguuaguuuuuuguucuuuuucauaauagcaauauuuuuagagaacuuauugauuguggcuauuuuguggaagaggggugcagcauuugcuguacuuaagaauccugagcuggcacuguggguacacauuacagaaguauucaacuuaauauaaggaaauacuucauaaacaauuagacuugaccacaggggaacaggucaaauuguaagguagugaguuccccaucauuggggaauaugaucaguauuagagucuauguuaucacuaagcaaaguuaaauagcgcagugguauuuaaacuucauaaaaacagugaaauuccucaaacaaaaauuuuacauggaaccccaauauuuaaacagacaagagcagccucaccuguuauacaccuacuacucugcuucuucccauugucuuucucgaacucaugaaccuauccacccaguuauugaaaaucucccuuuaaaaaggauuuaguaucuuuuacguaccucauguagcuuuuggaaucuucuuguuugguauacaaggcaaguuuuagugugugucucugugucuccuuguguuucucugucucucucucucucauagacauuagaacuggcauucaaaccuggauuggguaggcaguugaacuggggaucagacccuuccuuccaaugcuaguaugcuuauaaaauucaauuuuugugaauuucuucccuucacuuuaagcugauuuccaaggagguuuuaaguagagccuagggauacaaagaauggacauaacugcugagggcaugcguacugaugauggugagaauuuuaaguuagucacuuccagaauuuguagaauguggccaucuacuguuuugaacaagaaagggacuuggcagucaguaagugugguuaaaccaaagcugacuuugguaacgcagagauaucaacagcuuucuuggucuuauuuaacauuuuaaucuuaaagaggcuugccguauuaacccuuaucuaggauaugggguugggaaagguuuuggaaggucuuaauuuucuuauauuacuugcaacugcuuuucuuuuuaaaaaaguuuuuaugacuacauaguaugcaugugcuuuuugaucucuacucaucuugaauccuucugucuucccucaguauccuaccacuguaaauaaaauuuucaaaucaaguuauaucucuuaggauagaggaaauaggauuaguuugcaaguuucuuagauuaauguauuuuuaaaucaaucagaaugccugaagaaguucugcaaaaauaguagagccagaaaauguccauuaaaugacaaauuuuaaaauggagggaaccugcgcuuugcugguuggguuggccuaggguguaucuuguccuucuaauccuuuaugcuuuuuuccuguaauguaccuuuccuucugaagggugcauagucauauaauaugguguagucauaauugauaaggucagaauguuuuaauccugcuuguauguauuguuaacaauuuauuuuagaauuuugaucagucauugaauuuaggaugauuuugauaauauauucuuuugaaauuuugaaauaaacauucugcaccaaaugucuaagauaugguguuuugacacuuauugccccuuuguaugaagcaagagacuuagagaagcauccuuuguuuaguguauuggugcguauuauuuaauuuugcccgacaauuuuccccuuuaauguauggugugauuuucucuuguuucuagcucugaaucuuuaaggaauggcaaugggcuugaauuaaaugcuucguugucagaguucgagaaaaacaaaaagaucucucuucuucauucaagcaaggaaaaacuaagaaggugaauuuuaauauagcacuuuuuaagcauuauucuuuuguagggagaaauuaaugaauuuuauaauuuuuuguaguauuauuaaaaguauaagugaaacuaguaaacuuagcaaacaaauagaugccacucacucauucagccuuguagucauucaauaaauguuucugagucugcagugcaugccaaagaaggauuggagaacugauauaaaaaguaagucccugccuucaaagguguucugagucuagugcucagacagacuuuuaaauaggcuauuaaguagaaaauuaugcuuuuuaauacaugucaugaugagaacacaaaauaaggacacuaggaaaguuuucuaagacagaguaaggggacaguaaaaguuuucuugagauggcaguagcuaaauugagcuuuccacacguugcaauuaauuugguuuggaaaucagggaaggguauuuuauauggagggaauaauagguacagaggcuggcagucuuagagaguccagugaauuuauggaacugcauguauguccauaugguuggccaucaggucacaagggggaagaggcaaaagaugagagguaguaaguaggggcuggguauuucaugcuaugaaauucaaauuauaaccuagucuguugggcaguugcuaaaggauuuuagcaaaggaguguuaugaugagauuuauaccuuagaaugaacacucuaauaggauguaacacagugaauugcauccggaggccagaaguagucuauaauaagaaaugauaauuuccugagcuaugguguuagcaaugagauagagaggaauaagccaauucuagauguauuaacuaggaagaaucagcaugagcauggcuaaggauaagugagguguaacucccaaguggauggugacaccauccacugacgaagaaggacaguagaauggcagugugagguaaauauauuuuuauuuuuacucuuguugagcuugaauacuucuagguuugaauaccucuuggagugcagaguuggcccuuugauucuagagaaaggucuaggcuuagaaauacaggcucagaggaaugaggacacagcauuucuuugaagcaguggacauagggauggauauaggaugauugugggaagcacguagagaagggacuaguggagaaaagaaccuuagaaagauucucaguauuuaagguacaggcagcagagaaggaauccauggggaacacaaagaguuacuaaggagauaagaagaauaccaagaggcagugguauugagcagaccaggggagaggaauuuccuaaaggaacaggugcucaggaguaucaugugaugcagagagaucaaguaagguuaagagcugguaacugacuauuuguauugagccagaccuagaugucauugaucuuggcaaaaauaauuucauugguaugguuagagaagaagcaccauugcagaaagaaagacaggaacacagaugaaaugaaggugugaaguauuuacaaagggacugaggguaaaguacgagauuuugauaagaggccagacuuuaauaugcuuauguuacaaaagaagcagcugagagagagaaagaaguuuugaagauccucauauucuaguuaucugugguugcauaaaaauuaaaacaagauuuacuggcuugaaacaaccaccauuuuauuguaacuauguuuuuauggguuagcaguucgagcagggcucagccaagcaauucuucugccuacaugacauuaacugagguacucauaguuuucagcugguggaugguccagucaggaggguccaagacauugcguaucuggacuuuugccagcauggguuggaagucugagcucagcgggggcugucaacugaagccuuuccagcagaguaguuuuagugucauuggacuucuuucaugguggcuuagggcuccuagagagaguguuucaagagacaggaaggggacgcugccagucucuucaggccugggcccaggccacuucuaccauaugcuaguggucagagccaucacagggucuacccagauccaaggggaggcacauagaccccaccugucagugggaggaaggucaaauaauuuuaaucccccgcagcugaugaggagguguuggugauggagugagcaucccugaggaggcagaaggcaagggaauccagaaccggguggaagaaugucucuuccauggaaaauggagaggaggaguuuaggcucaaugugaauucacaugaauuuuucgauggggcccgaucagggaggaaguugagcaaguucuuugcugaauggucccccuccaucugcugaagauuagugggaagaugaugggguuugggcuugaugggaugggaugguggauaggcuacucuggcucuaaagggcuucauucccaugacugcugccuugcuaggucaagacuuagggcccgcuggccagugcugucccauagaucucauucaucugaagccaaaugagaaaaauacagugcacugaguauuuuuuaaagcuacauauuauacaauugauauccuaagauuguauucuccauacuuuauuugauguuaaaauaauguugauauuagcaaaugauuauaaugaaaugaugcgaggaaacauuuauuccuuguuuuuucauuauuuuucauguccagaucuaauggugggaauccuuuauuggucccccaaaguuacguguuaguuuucuuuuuaaaauuuuaaugguugaugaaaacuaaaaucuaaaaccacucaucuaguagacugaaaagaugcuuugggguuguucacaucuguggcauuauuugaaggacuagaaaucuuuguuucucaaaaagaagagcugugacaaggaccucccccuuucucuuuagagauuugccugggagcucccaggagguaaacaccaucccugauuaguuuuugucuuucccucuuaacccuucugaccaugccugugaaucugaaaucguugcuucuagucuguuuccuuucuuccuccuccucuuccacucaccugcuuuacauaugguuuuggguuuuuguuuguuuuuaagcaguagggcaacaugauguuugcuaauguuaaggaaacgaugguucuggccaauauuuuugcacuugggaaauuuuuuucucugauacucgcauucuuauuagaacauauuaaucaaaauuagcuaauucuuauauucuuggugaaaucccauucauuauauauuuauaaauacauaaacauguuuuuaucuuguaaaguguguauucuccaaaugaugucaucacauuuuuguguacccaugagucugacaugauggugguguaauaauuuugggggugucuauucacuugagaagaagggaaauguugagcuuugccauagugucccacaaaugaagacuuuuccaggacuagacaagucuuaaagauucaagaaagguagaacaggcaguucucagaggguuccaaguuguaucuggcccagauaccuuucccugugaguccuuguuuguuugagacacauuuauacagaggagagccccaaguagacauccgugccuuguuucagaucuuagagggaaaauguuaagucuuuuaccaucacauaugauguaagcuguggccuuuugugcaugcuuuuuuaucagcuuaaaaaaauguuuccuucuagucuuaguuuaggauuuuaucaugaauggauguaaaauuuugucagucuuuuuuucucuaucuaguaagaugauaauuucuccucuuguuuguuaauguggugauuaugacugauuuuuuuaaaugcaaaacuucacuuugucuuaagguguagauaauuuuuguuuauugcuggauuauauuugcuaauauuuuguuaacaauuuuugcaucuguguuuaugaaagauauugguuugcaguuuucuuacaaugucuuuaucucauacuggucauauaaaaugaaauggaaaaccuucuguuuucugaaacaauuuguguagaaauguuauguuugauaggauucaacggugaagucaucuaggcuuggaauuuucuucgugggaaaauuuuaauuacauauucaauuucuguaauuauuauaggacuaaauucccuauuuuuuccuuuuggcuguuuuuuucugugucaguuugguuaauuuaugucuuucaagaaauuuguccauuuaaucuuaagugucacauuuguuuaacaacaugaucuuauuaucguuuuaacaucuacaggucugugaugauggcuuuuuucauucccgguauugauaaauuguguuuucugccuuguuucuugaucagucuagcaaaaaaagguuugucaguuuuaucgauuuuuuuucagugaagcagauuuugauucauugauuuucuauauuagcucauuuuuuuauuucauugauuucugcucuuugucuuucuauacuuuguggguuuuuuguuuguuuguguguuuguuuguuuugagacagagucuugcucugucacccaggcuggagugcagugguauaaucuuggcucgcugcaacuucugccucccggguucaagcaauucuccugccucagccucccaagcagcuggaauuacagguguccaccaccacaccuggcuaauuuuuguauuuuuaguagagaugggguuucaccauguuggccaggcugaucucaaacuccugaccucgugauccgcccaccucggccucccaaagugcugggauuacaggcaugagccaucgugcccggccucuauacuuugcuuuuuaaaaaaaaagucuuugaaaauguggcacauauacaccacacaauacuauguagccauaacaaagaaugaguucauguccuuugcagggacguagaugaagcuggaaaccagcauucucagcaaacuaacacaggaauagaaaaccaaauaccgcauggucucacucauaagugggaguugaacaaugagaacccguggacacagggaggggaauauugcacaccagggccugucgggggguugaggggaaaggggagggagagcauuaggacaaauaccuaaugcaugcggggcuuaaagaccuagauaacggguugauggguggagcaaaccaccauggcacauguaugcauauguaacaaaccuacacguucugcacauguaucccagaacuugaaguauuuaaaaaguagagcgggugcaguggcucacgccuguaaucccagcacuuugggaggccaaggcggguggaucacgaggucaggagaucgagaccauccuagcuaacacggugaaacccugucucuacuaaaauacaaaaaguuagcugggugugguggcaggcgccuguagucccagcuacucgggaggcugaggaaggagaauggcgugaacccgggaggcggagcuugcagugagccgagauagcgccacuguacuccagccugggcaagagcaagacuccgucucaaaaaaaaaaaaaaaaaaaggucuuuguagguagaaacuuccaucauugauuuuaaccuuuucuucuuuucuaauauaagcacuuaaagcuaaaacuuuuccuuuauaaaaguuuuucucuaagcauugcuucagcugcaucucaucaacuuugauauauuuccacuaucauucaguucaaaauauuuucucauaucccuugugauuuuuuucuuuucacuaguaagucuuuucacuguuuagaaguguauaacuuaacuugaauguuuggagacuuucuagguauugauuuauaauuuaauuaugcugucaucugaaaacaugcuuuguaaaguuucuguccuuuguuauuuucugaaacuuguuuuauggcccaaagcauguucucccuugaugaauguucuauaugcauuugaaaagacuguauucuucuguuugggggguguaguauucuauaaauauuaaugagguagaauuagucaauaguguuuuucauauauucugcucccuuacugauuuuuugaggguuaaguuuuucagugacaacucuuuuucccuuucuuccugagaguuuuugcuucauguaguuugagauucuguuguuagaugccugucuucuugcugaauugacccacuuauccuaaggaaaugauaaugcuaauuuuucuaugcuaguacucccugucuuaaaaaaucuacuuugauauuaauauagcuuucuugugauuaguguuugcaugguuuuuuucuaaccuguauaugucuuuauauuuaaagagugucccuuguaaauagcaugucguugaaucuuguuguuauuuuuuacucauucugacaaucucuguuguucguuuucauauaauauacuuacuguuaagugcgguuuuagguucacaauuuuucuauuuguguucauuagucuaaucuauuuucuuuuuccuuuuauucucauuaccugccuuccuuuggauuuaucagguauacuuuagcauuucuuuuuaucucuuucauugacuuuuuagcuguaacuauuuuuuauugguugcucuagggauuaugauaugcaucuuuaacuuaucauaaucuaccuugaauugauauuaugcccuuaaaauacaacagcauauuucuauuuaccuucuuucauuuuuucuuauuguugucauacauuuuacuuuuacauauguuauuguguuaguccauucuuguguugcuauaaagaaauaccagagacugaguaauuuauaaagaaaagagguuuaauugacucgugauucugcaggcuguacaggaagcauagcagcuucuguuucuggugagcccucaggaagcuuacaaucauggcaggaggcaaaguggagccaaugugucacauagcaagaggaggagcaagagagagagaaaggagaggccccaaacucuuuuaaaccaccagaucuugcaugaacugagugagaacucacucaucaccaaggggauggcgcuaagcuaagcccuagagugcccccaugauuuaacaccucccaccagguuccaccuccaacauugggcaucacauuucaccauaagauuuggaggggacaaaacauccaagccacaucaguuaucaacccagcauuguuauuuguuuugcuuaaacaguaagcugucgcccaguuaucuaauacuguacaacagauuacucugaaacuugguaguggaaaucaacaaacuguuuaucauaucucaugauuuugugagucaccaguuugggcagagcuuggcucugugauucuucucagugugguguuaaccauggcacuccgugauguucagccagcaaaacuggccugucuggagauuccagcgcagcgucauccacacauguggucuucugguggguguggcugcagguugugcucaaaugggcuguucuucccuguggucucaucacuucuccacaugguaucuccagcaagcuagaaggaccucuuacaugaaggcuuaggauuccaugagaccagugugaaagcuacaucuucugaaaugcuggucccagaacugucauagagucacucuccagauaucuuuugauuaaagcaggcacaggccagugaagauucaagaggagaggaaauggacccugacucuuuguuggagaaauaaguaauuuucagugacuuuaaucuuaacucuuaucuuuuuaacccaaauuucagauucuuguuugcaguagaacaggcucuucacuguauacaagauuuugucugaguugcaaaaauucucuccccaugaauuucccuguauuaccaucuuuugcuccugcauuuccccacucagucuuggcugccacaaucaaagggacauaaaguacaaggacacuuuuuucuugccucuguaguagaaaucuuagcaguauacagcugcucuaggccugucaaauaaauauauacuauugguuuuuaaaacauuaauaaauuagaaaacuacccuuuaauguaugccaccauauuuaucaugucuuagacucuucacuuguuugugcaaaucauauuuccaucagauauuauuucccuuuaucuucauguaagauaaagacauuuucagauaaaagacaacuuagauauuuugacaccaguggaccugcagaguaagaaagcugaaggaaauucuucaggcggaagggaaauaauaacaaauggaaacucgaaucacuagaaggacuacauagcaccagaaaugauaaaugucugagcaaaaacaaacauuuuucauuuuaaacuauuuaaaauacuuaaaacuguuauaagcaagaauuauagcaauguaucaugggguuuauaacauauguagcuauaguacauaugacuauuacaugaagaaugagugggauaaaugcacuugcauaacuucugcaguuauacauuuuaugugaugucauaaaguauuaacucuagacuaugaaaacuucagauauauauuguaaucccuagagcaacccuaaagagauaggcaaaaugcauugcugugaagccaaaagauaaauuaaaauuggauuuuuaaaaauauuuuaaaaugaaggaaggaaaggaggaacagaagaauaaaaaagcaaaagagacuacagagggaaaaaaagguaugguagaccuuuauccaacuauauccaacuuauaggcagaaguuuucagaauagauaaaaacaaacaaaaccuaagacccagcuaucuacugucuguaacagagaagcuuuaaauauaaaaaaauaaauuaauagaaauauauccauuguggaaacaggaaguauaagaaagucagauaggcuauuuuaauaucaaauaaaguagacuugaagacaaacaguauuaccugcgguaaagaggggcaauuuauaaugauacaagcgucaacuuuucagaaugauauuaaaaucacaaauagcaugugauaagaacuucaaaauauuuggaucaaaaauuuacagaauuaaauggacaaauagauaauuuuaaaacaauugcuggagauuuaacacuccucucucagcaauuuauacaacuggacaccagaaaaucaguaagcucuagaagaugugaacaccgcuaaccaccucaaucucaugaauauuuauagaguaacacucccaacaacugcagcagaagacuccuucucaguggcacaugguacagucacuuagauagacugcauaccgguggggauauaagaagcuucaaaacauucaaaagaguugaauuaauaaagauguguucccugaccacaacgaaauuaaauuagaaaucaguaagaguaagauuuaaagggaagucuuaaauauauggaaauuaaaaaaaaaaaaacuucuaaguaauccauggguaaaacaaaaaaaaaaaaucacaagaaaaauuagaaaauauuucaaagugaaucuauugagaacaaaauauaucagcaaaccacuauggcacacgucuagcuauguaacaaaccugcauguacugcacauguauccuggaacuuuaaauuuaaaaaaagagaaugcaauauaucaaaguuuuuaaguaaacuacaacaaaguuuagggaaaacacuguggcuuuaaaugcuuauauuagauaaggcaaaaggccuaaaaaucaguaauauaagguuccaucuuaggaagcaagacaaaguaaaacaaaauaaacccaaauaagugggguggugaagggggaggaggcugggagacagacacaauauaucacaaucaugaaugaaagagggaugaucaugauagcuacucuaaauauuuaaauacaaaagaguauacuuugaacaauuuuaugccaguagauucuacaaccuagauguacuggauaaauucuugaaaaucacaauuuaucaaaacugauaccagaugaagcagaaagucggaauagcucuauguuuaacaaaauugaacuuguuaucaaaaccuuaccaaagagaaaacacucaggugguuuuaccaaugaauuucagcaagcauuuaaagaaguaauacuaaucuuaaacacguucuuacagaagugggaggagggaauacuuccuaaccccuuucaugggaacaacauaacccuaagccugacaaagacauuauuuauaaagaaaauuacagaccaguaucccucaugaacauaaaaacaaaaacacuuaacauaauuuuagcaaauuaaaucaagaaauauauaaagauauaauaugaccacaucagggguucauccuagaaaagcaagacugguaugacauucaaaaaucaaccaauugggcuuggcaugguggcucauaccuguaauuccagcauuuugggaggcugaggcagguggaucacuugaggccaggaguucaagaccgaccaggccaacauggcaaaaccucgccucuacaaaaaaaaaauaaaaaaauuagccagguuugguggcacacaccuguaaucuccgcuacucgugaggcugaggcaugagaaucacuugagcccaguaggcagagguugcagugagcugagauggugccacugcacuccagccuggaugauagagugagacucugccucaaaaacaaagcaaaccaaugaaauucaccacauuaacagaauaaaggagaaaaaccaugugauuaacaaauucugaaaaaauauuugacaaugcucaauauaccauuaucauuaaaaaacaaauaucuuucagcaaauagauguggaagauaacuuccucaauuuguuaaaaggcaucuauaaaaaacuuauaacuaacauuguacuuagugauaacauguugacugcuccuuaaaaagaucaggaacaaacuaagggugcccauucuuaccauuucuguucauuaucaaauaaauaauccuagccauugcaauuaggcaagauaaagaaauagacauacacauuagaaaggaagaaggaaaacuggcuuacuauauguagauggcaugauuggguauaaagucaaaguccuaagacguuuacaaaacagcuacuggaaccaaagaaugacuauaacaggguuacagaagauaagguacaaaaaucaaugguauuuuauauauuaacagcaaauaauuauaaaaugaaaauauaaauauuaugacauuuaaaguagaauaaaauagcuuuaggauacuuaggaacaaauaugcaaaaaaaaaaaaacaaaugaucuguacauugaucauucaaaauguuacuaugaaaaguuaaauaaaaacuaaaucaugaauuauaccauaauuaugaauugaaagacucacuauuguuaagaucucaguucucaccaaauugaaacauaacuuuauuugaauccaaaucauaaucccagcaaguuuuuuuccauaaaaauugacaagaugauuuuacaauguaugaaaaggacuuagaauauccaaagcaauuuugcaaaaguacaacaaaguagaaggacuuaaacuaucuugacuucaagacuuacccuaaagcuacaaucaccaguagguaacuggcauaaaaguugacaaauagaucaauggaacacaauagcccagcacuggauccacauauuuauagucauuugauuuucaacaaaagcaccaaagcaaauauuuugggacagaaaaucuuuuuaauaaaugaugcuggaacaacuagauauccaucuggaaagagaaucaaccuugaccccuuacuucacaccauauaaaaaauuauuucaagauggagcauacucagagcuguacuauaaagcuaaaauuauagagcuucuaggaugacacuauucaguugaaucuucugcuguguuaaaaauuauaucuucaucaucucauacaguagccacuagcaacaugugguuauugaguauucgaaauguggcuauugcaacuuaggaaaagaauuuuuaauauauguaauauuaauuuauauuuauuauauuuaaauagacucacgucuauugacuacuguauuggacauuacaguucuacaagaaaauagaaugucuucaugagcugagaguacgcagauguucuuuagacaggacauagaaagcaauaaccaugagagagagagaguaaauaaauuggauuuaucaaaauuuaaaacuuuugcuaucaaaaaguuuuaagaaaauaaauacgaaagccgcagauugggagaaaauauuugccaaacagauaucugacaaauccugguauccaagauauguaaagaauugcuaaaacuaaaaaauaaaaagaccugcaauucaauuaaaauguagguaaaauaucugcauggacgcuugacaaaggaagcuauacaagugcccaaaagacacaggaaaaagugcucaacaucauuagcugucagggaaaugcagauuaaaacauaauggauacuacuguguaugccccagaaaggccaaaaugcuaaaaugaaaacuacugaugauauuaaauaucaucaaagauuuggaacaagaggucugauacauugaugguggaaguguaaaaugguacucccuuggugugguaagaguucugccuguuuuuauaaacuuauaaaauggcccaucauuucuauuccuagauauuacccaagagaaauaaaaccaugcauucauaaaaagacaucuagaauguucuagcauccuuauuuguaauaacccaaaacugguaacagcccaaguguucaucaauaagagaauggauaaguaagcuguggcauauuuauauauuuuugaauacuguugcucagugaaaaggagcaaacugcugauaugguuagccccauagauaaaucccagaaacauuaaagcugagugaaagaagcuuuacaaaagaauacaugcuguaagauuuuauuuauaugcuauuugaggacaggcaaaagugaugugguauggaaaaaaaauacuagaauuguaguugcuuuaugggguuaggggaugguauugacugggaagaaacaagggccuuucuggguuugugauaauggauuuucaugugugauuaggauuuucguuacauauauauuucaaauacauacaguuguauguauuuguccaaacucauagaaugggacucauugugcauuuuuguuuuauguaguguuuaccugaaaauaaaguaauuugagcuacugauacauuuaggaguguaaugugcuuaugucuacaacuuaccuugcuuuaauauauguaaauauguuaauguaugaauagugggaugacacauauauaauaaagcagauacuaguugagcaucucuaaucugaaaaucugaaaucugaaauguuccaaaaucaaacuuuuucagcacugacaugagauaguggcaccuuuucuuucugaugguucaguguguacaaacuuuguuucagguacaaauauuguauaaaauuuccuucaggcuauauauauauauuauaaaacauaaaugaguuuuguauuaaaccuugggucccauccccaagcuaucuuauuaugucuaugcaaauauuccaaaauccaaaaaagucugaaaucuuaaacacuuccccaggcauuauggggagggauacucaaccuguacaguaaauguuaacuguagacucuuaagugguaaguguauagguguucacuguauaauucuuucaaauuuucucuauguucgaacauuuuucuaauguuggaaaauuuuaauagcauuucaauaguuucaauucugaaugugacauaugccuagcaaaaaauauuuggaaaauguagaaaauaaagggaauaaaaaugauccaucauccagccauccagaaauaacuguacuggauguuuuugccuucagucuuuuuuccuaggcuucacuucuacuuuguuuaguggcuuggauuauauuuuauaugcuguuuuguggccuacuuuuccccaauaagcuuuauaacaucucacuuccacugccaggugacauucuacugaacuaauaauguacagcagcuuacuuaaggcauccuccuauguuauguguuguuuucuauauuuuacuaauauauugcucuaauggguuucuguguauacauacugugcucuguguuuuagauucacuccucaggacggauccuuguaaguggaagaaccaugucaaaggcugugaaaaguuucaaagcccuucacacacguugucaaauuguugacucuucuauccuucccuucccagaauaguucccgagacacccccgcagagcccccagaguuccucagagcucagugagaacaccacugauguagaauauuugaguuauucauuggccguaugucaaacuagguuuuuaaauauaauuucucugccauucugguguuuacagagguuuaguaacuugccuaagguuccaguuaguaauagcagagccaccauucaacccuguagaugucaagguaguauucagcacaaaacaggugcuuaaagauguuuauuaaaggaacacauggauaaaugaagccaccaagggcuuaagucaguuagaucuacauuuccuaucccccuucagagcugugaaagacagguuaguuucuuucugauaccugcauccuggucugcucguucugucuguaccuaccucauguaaaggaagcagccuucugauuuucuuuuugcucaggccaugaagucaugugguacaagaugcuagcugaucuguuguuggaaauguggucuaggucccagugacaugaagguccugacugcucuuugccuucuaggcuucuagugugaaucgcaaaaggauuuuuauaucauguacaauucucugcucggagggcagaguggucugcacauuuccguaggcagcagggggugggaagggugcuuuccucggugacugggcauccugcgcucugcagcaggccugaggugagagagcuggggcugccaucggcacacacagugcacuugggcagugguucuuuguguagcaguaugcgugggugccccaggaagcugugauuucaggggcugugagggcugcuggcuuguggggacacagccuuucucugaaauggagacuauauagggaggggaugguuccuuuacaaacauacccaggaggaaguguuguuugucuuuggguacaaugaagacaaugagacuaauuauucuuuauguauugcaauucuguguccagggaaagaaucaaauauugcugugagcagcugcguacucucuugccguauguaaaagggagaaagaaugaugcggcuucaguucuugaggcaacaguugauuaugugaaauauauccgggagaaaaucucuccagccguuauggcccagguauuugacucccaaagcuuugaauuuuauccuuauagacaugcuuuaauacuacaauuuuacuucuuuuaauuuuuuaucauuggaaaguaugugucuuuguaucuauguaaaaaugucgguaucuaccuaaauauauuucuguguuuuuuagauuacagaagcacuucagagcaacaugagguuuuguaagaaacaacaaacacccauugagcugucucucccaggcacugucauggcacagcgguaugauaagggcuuuugcgaaucugaagucugcuaguuauuuuccucccauguugaugcuaaauauguacacaaaaacugcuauccacagugaaagugcaggggcuuauuaagggucagcgaacuuuucuaauugccgauguguaucauuucguugcagugauaaacacagguaauauucucagguccaugguuuuuucaucaugugacucacccuugcuucuccuuucauuauuucugagguucuuaaaauggggcuuucucccuugugaguguagggaugguggugguccagcagggacgugauggcuucugguguuccuccauuguggagaggucucgggcccuggagcuguccagcccuauuucaauuaguggugcuuaaagcaggucauuagugcaaaaugugacuucccaaaugauuacuuucuucucuagauugaucagaauauguaaacaaagagaaacuggagaaaaagcacaucauuccugcacauccuaaggaauuaucgugggucaugugucuuugcucauauguaaauaauccauaguugaggcuuuaucaguguuuuuagaacuugaaugauaaaagggcaauugaacucagcaguguccacauuguuuuccuugaaaaaugugcaaauaauuuuuucuguccuuucaagggaaaacagugugaugagcacuuacuccccugagagagggcuccaauuccugacuaauacgugcuggaaugggugcuccacuccugaugcagagagcuccuuggaugaagcugugagaggugagcuucuccuagcaucugugccacuuagagggggaccugcccugcccugcaaacccccaggcuccugugcauucaccaccauaaccagggaauccaggagagcugaugaguccuucugguauugucagccucagguacacaagguggcuacaguuguuuaaauaguguuaugccagaaacugggcucaaaauugaccguaauuaccagaaagcucauucuguugauagaugauaagcacacuggugacuuuguuuauaauaugaauagaaucucaggggaggggaaguauucguauaauuucaggacugacuguguccugagcauuuaacauauuuauuuaccuccuucaugccuuugcuugcaugucaccucucaaagagaucuucucagccacuuucucugcuguauuugucuugauagcacucacugccuucugcuauucuuuacuuguguguuuuguuuguugccuaucuuccauuagaaugucaccuccaugaaggcagggaauuuuuuggcugguuuuauucauugcuguauuucuaguaccuagaacaaugaccaacauacaggaggggcucaagaaaucucauuaugugaauauucauuguggaacaaaugcuuucccgcugggaggcauuuuuguuauaugugccguauaagccuagacaugcccguguaccugaaauaacaagauggaaaaaaauagaggaaaagaacacagcuagcaguuugugacuuuuaguauuccugaagauaaaguuacucuccgucuagaaaccaggaagguauggaccucuugaccuaaauguuagacgcuagaugacaggacugccucucuccucagccucucaguccuagaugacacuucugacuuccuccaacaggcucugcucucaccaagcaccucccuuguaccaggaauguccuuccucccucaccugcgcuaguuaguaccaaguccaucccuaguucucagcuuaaaugucccugccucaaagauggggacacaaagaugaauaaaaggcaguucuuguucuuauggagcucacaacuuagugguagaaagggucacaaaagaaauuauggcccagacagucuuguaagugcuguaguagaggaaccaugcacagauggggauguggcggaagccaugggaacaaaugaagguuaugcagcauagugucuaaagucaaaagagcagggacccccagauagaacccagcccugauucuucauaucaccaaagaagccucaggguguuauuuuagucaguuuagacuuuucucccaacuuagaggagagaagagaggagaagaaaaaaaaauugccauaaguagcaguggcugaaugugacauggaaugauuaaaucagcuuagauuaaaucagauagagaucaggccacaggcauaugccugucaauguuauuuuuuuguacauacaauacuauuuauguccugcagaaacucugaaacauuauuuucguggcagcgaguucaggccuuucuaugccccagcauuucaagacacugccuccccuaaggagaccaaucuugggaagccagagauaugcuaggaauagaccugugguagguucaaacccuaggaggccuugaagguuaaggagucaaaacugccauuuuuauuugauguaaauacauuuuugcguuugaaaaccagugccgauccuuuacuaaccuggauaagauaaucaccguguucauuuuuuaauguauuuccuucaagucuucuuccagauauauuuuucuauaguaguaaucauuggauaucccauuuuguuucuugaauuuuuuuacuuaacuuugugucauacauauguauauuuguuguuaugcaucacucaucaccauuuuaauaguuuuaaucauuuaucaaggguagaguaauuuucuuagccauuuuccagucgcuacauuuagcauuugcaguuuggggagagagugauuuuuuacaucauaugauaggaaauauuuucccauauaugaaguuuucuguauuuuggacuuuuccuuggacuggauuccuggaagaguauaauggguuccuggaagagugugaugggugacuuagagaacagagaacgugaauguauguauaggcucuuaaugcauguugccaaauuguuuuggaaagaggaucagagaaguugcaaucaguuaagucuuccaaauuucgcuuucacuacccgcaucaggaaguugaaggcuagagaaguuaaaugaucacccaaggucccaggguuucugugcugagccugaucuguaacacagacauguuuuaaccuuaucagcuugccuuuuucuguucuuuuucauaaaucucuguauacaguugcuuaaauuauuuuuccacaaacauuucagauacauuuguauuuaaaguagacauaccauuauauuauuuuacuuucaauauuauuaauguccaguagaaaauaaauauugaugguauuauuugagauuacauuguuaauauuauauauucaauuuuuuuucuucuaguuaccauguagaauauagcuauaugaugauauaaaccauucugcugaauggaguuguucuuuccaaccuucuuccuugcuucagagagagucaauuuugauugacgugcacauucacauacaucagaaggcacagggaucuucugcuucuauaaaaccugucuuuuaauguacaugaacacuaauuuauaguguguguauugcacuaaaugucacaauuagaaaguucacuuuguuuuuccaucagcauucggguguagcagguaguacagauuuguaaugugaggaaaugaaauagcgggcaguuuaugucgaauaacagucguucugaauuacagaauuguggauacugacccauauuuguuuucuuucucauuaaaguuccaucaagcuccgccucagagaaugcuauuggugauccauauaaaacucacauuuccagugcagcgcugucucugaauuccuugcauacugucagauauuauucuaaagucaccccuuccuacgaugcaacugcuguaacaaaucagaacauuucaauucauuuaccuucagccaugcccccggucucaaagcuucucccucggcacugcacuucuggguugggccagacgugcacuacacaucccaacugucugguaaguuuccagggguccauggaucagauuggacccuuucacuccagccagcagaaaccccugaccugcauuuguuguugcuacucugguuggaaggcugggaccuaagagcuugauucugagucucucuacccugaugagugaaaaggaggugcagucaacccaugcucucgcuccucaugcugcagggcuggugucucgauauccagaaccagugaagcugaaugggacugugcuaguuugacggugaccagguggaaucugaucuccccuagcacugauugcccaccccucugcuucuacucagagcuuccacaguggcacaucccauuuuagcacccucauccucaacuggccccguaacuaacugcuacuuaucucuuaggugggcagcaucacuuacacuaaucaaaaagcuuucuuucagucaccagccaggcugauuucagauaccaggugucuucauacagcagauauuuacugagcacccauuauguucugacauugaguuugucauuguacuaagaaugugguauacaaagguagacacgaucccugcccucaugcagauuuaguguuaaggggaugcagacaaagaagcagaaauuacaauaugguugaagcggguaggaggagugccccacuauauauaucagcuagaugugggcaagguuagugacugcucaccccuggagaaauaccaucuaugucaaucucuagccacuaaggaauagcuagguagaggggugaggaaucgggagugaguaggcaagagcaguccuggcagaugggucagcauaugaaacagucauaccugcauuguuuggaagaacugucuagugcuagaggaagacucaaacuaaauuggccuacuuaaaauggacuucuguuaacuuuaauauaguugcuaauacuuuugcauauuaacaauagcuaacauguuuugagcacucaauaacuaauagugccaaauacucuguguacuuaaugugcaugaucuuaugagaaucccugaagugauccuuugacgguagauacuguuacaaucuucauaugacaucuauaaaaugggaauaauagugaccuuccaaaagauauuuguaagaaaaauauucuaaagagaauugcgaagaaauguuaaaauauguagugucuacagauaucguaauguugcuaaugaucauuaguauuccaauaggaaggcuaggguaaaugaaagcaaagauuacaauauuaucauuuuuuaauuguugaccuauacuuacucuggguggguuuuguugaauuguugugagaaaauaauuacuuuuaauaagaauauauauuuaaaaaccuguaagcuuauucaccugaggauuuaacauaguuuugcaaaucauuucagauuguuuuaggauauagaaaauacaaucaugacauuaugaguaagagugggugaggauucaauuaauguggguuuuucccccuucuuugcagcaacaguuuugggcguauuaaaagcacauguuugaaauucacacucucaaccaccuacugggcgcaguuugacaaucuaggaaaaguggaacaaagaaugauuuugaaagcuccacccaaagaccuaauaucaaaagaguuggcaugguuuggcuucugauaaaugcacucaaagcuucugcagauagaaagaccagcagcgaaaaagcuggccacacacugucacucaucuucauacacacuuggauccccgccagccagagagcuacaagaacaaauggccucagugaccuacacucucuuuucucaaaaaauauuccacaauuuaugaaaaaagcaugcuauaaggaagauccauguagacacgauaaaaugauuagauugggaagguguguugauaccuugugucacugaguacagauauuacaacuugauucuuauuuuuaguaucccugugaauuacugucacucauuucuagguggucuuuuccuuauuugacauuuuagagaguuuccuucuucauucaccauccaaacuaagauaugcagagagaugcugaaagagggguuuaccuccucacuugacaacuaaugaauaaauugaugugugcuuuugcauuucacaaucccuugagugaaacgauggcuaauagguaaauauuucuuucuggaccuuaaguuacagacuagcagguuuuuuguuuuucaucucuuccucccuauggguauuagaaaggacaguugaaaauaagggggaaaaagguuuguuuuauauuucacugaauuguucuuauauguaaguuuuauuauuaaauaaaauacucaguuuucacccugagcauuguaauccauuuuuguuuuguuuaauaaauauauguuuucucuuuuaguagu

SEQ ID NO: 13623 - RNA, 2932 nt, Homo sapiens
cuuagacaaaccaacagcagcuucuucugacauauacacacgcacacucaccccggacacacacucagcacacuuuuccuccauuugauuaacagugcugcacacacaaugauuacgggaaagcgcaaauaaauacggaaaggggugcuuauuuugacuacuggaagagcuuugcugggucucagcgcaacuuuuguuuuuuauuccugagaaggugaucucuccaugcgguucucucacacaaggauucuuuaaaagaggaagagagacaagcagaggggggaggacagucuuucacuuuaagaacggcugggcucaaagauaaaaggaagggaaaagcagcagcagcagcagcagcagcagcagcagcagcagcagcagcagcagcagcagcagggaaaccaacgcugcagcacuuccgaaaggcauuuuugauccauuucugaguguugcggcccguuucuccaccgaaguuggcuccagcucuagcagccgcauuggaucccacagcuuacugcgagacuccgguguacaauccggaucucugccccaacaugauugcggcccaggccaagcuggucuaccaucugaauaaauacuacaacgaaaaaugccaagccaggaaagcugccauugccaaaacuauccgggaagucugcaaaguaguuuccgacguacugaaggaaguggaagugcaggagccgcgguucaucagcucucucaacgagauggacaaucgcuacgagggccucgaggucaucucccccaccgaauuugaaguggugcuuuaucucaaccaaauggggguguucaacuucguggacgauggcucacugcccggcugcgcggugcugaaguugagcgacgggcgcaagaggagcaugucccucuggguggaauucauuaccgccuccggcuaccucucggcgcgcaaaauccgguccagguuucagacgcugguggcucaagcgguagacaaauguagcuaccgggaugugguaaagaugguggcagacaccagcgaagugaaacugagaauccgagauagguacguggugcagaucacgccggccuuuaaaugcaccgggaucuggccgaggagugcugcccacuggccacuuccccacauccccuggccgggacccaaccggguggcggaggucaaggcggaagguuucaaucucuuguccaaggagugccacuccuuggccggcaagcagagcucggcggagagcgacgccugggugcugcaguucgcggaggcagagaacagacugcagauggggggcugcagaaagaagugccucuccauccucaaaaccuuaagggaucgucaccuugaacugccgggccagcccuugaacaauuaccauaugaagacucugguuuccuacgagugugaaaagcauccccgagagucggacugggacgagucuugccugggugaucggcugaacgggauuuugcugcaacuuaucuccugccugcagugccggcgguguccccacuacuuucuaccgaacuuagaucuguuucaaggcaaaccucacucagcucuggaaaacgcugccaaacaaacguggcgacuggcaagagagauccugaccaacccgaaaaguuuggaaaaacuuuagaggaugauuuaaucaagagccgaaauuauuacccuucucaaaguccuuauuaaguguaaacuucuguucaauuccuaauauuccacuccgcagugcaaacaaucucuuccuuuaaaaaggaauaauaauacaauauuuaaacaucaucucacccacccccacaaggggagaaaaaguaggggaagcggauggagaaaaacccaaagccacuaguauuagaagacuucuuuccacacgauuuccuaucucccuugaaaaguacaccguaacacuccguaaacagcccagcuguaacgccagaccgagacgaacacucugccuaacuaucaaaggauuauagcaauccuggugauuuaggugcaucugucugugaguaaacacgauuuggauaugccaucugaaagaaacuguaauguauauuuugauuuguaacaaauauugugaucucacauugucuuugaaaguguggauguugguguuuugugauuuggugaacagaacuuaaauugccauucuggauacuuccagacauuuuccacuaacaaagauaucauuuaaagguagauuucuuccugguacuuuuaucugucuuugaaagugucugaacuuuaaaaaguuuacauuuuguuucaaauauugcuuguucuauuucuaacauuccauaaauauacuugaaauguuauuuaaauauauucaaagaaauuugaauucagcuuauauaauaacgcuugaauaucugaauuauauauuugaaaaaugcacuugaaauacacuggauaauuacuuuugugauuuagauuuuaauuuguugcugguuuuuauuuaauuagaugguaauaaaugaaguaaaauaaaaguuguugugucucacuuuaaauuguuuccuaucacaagauguaaugaugcauuuugaaaaucaaacccacuugaauaucuuaaauauuuugagaaauaugcuaaugaaauccuuaaaaauaaaacauuggagaaaagcucuuucuguauagguccauaagauaacaaucuacucucagucucuaacuuacuuguaagacaauuccuuucuacaacagaaacaauuuaaaucuaccuuugaaagcuugcucuucuuguagcauuuuugauaauauaagaaaaaaagucuaucaugacaguagagaugacugaguuaaaaaucugacuaauucagaggaaaugaacuuaacaaagucauaaugaaacuucgaaaauuauguaugaaaacuaauaaaacgauccuuucugaccaauauauuuuaugucaaaccuuauuuuaugua

SEQ ID NO: 13624 - RNA, 15851 nt, Homo sapiens
agcaauguugaacuaaaauuaccagauaaagauggggaauuggugauuaauucugguuuaauugggccaacagagcuuauuuuuuagcccaagaauaacuugagcuacaaccuaaagugaagggaaagccaggaagcuguguguaaggugguuuuacacuacucccugccucugcaucucuuuacugugguugucugccuugauuaugguuccaaauaaaggacagaaacuggcuucccugccuggucccacacucaccuuuuccugagaaugacuucuccugcauguaccugguugcagggauggcucccagcagccauguuuaugcaggccccacaggcaugggcaccugaccccacaggcaugggcaccuggccuggucuuguccaaugcaugucccuucucucacaaucuggacuugggaugaaucucuugaacugaaaaaacuauaaacuucagaacugucaguagccauauuuuuugugugugaacugagaaccagagacaaugagacugcacuaagaagaauaaaguauauggauagaaagagucaaaaaugcaaaauguggaguaugacauuccgaauuuccagaccuuuguuccccuguccgugaguuccaucauccuaucugcaucuccaccuuugaaguuuauaauuaaugccccuuuguuuuagguaacucaacuggcuucuguuacuauaaucagaaugcucuaaugagcauuguuacuauauaggaaucauuacauuugucauguucaaaugaguaagaaacuacaaggaaggagaaaugcauguggaaaaacacaacuggggugcaggagaucugaguucaaaucuuccuucuagaaucucacaaccacauagaaucauagacuguuuauguuaauucuuaaagguaacccaguuccacugccaacuagcuagaugaccuugggaagaguuuuuaaccccugugggauuaacuauaaaauggccauaaugauuccauucacucuaugaggcuucuuucagcaugaaaaucuaugcuuauauagcacuugauauaagcaaaaggaguuuccccuggaauuauucuugaagccacauucugugcaugaaaagguugaaagagcuaacccuaagaagcauauaccagcugcuuauguuaaugauagguaaaauugaacauuuucuaauuuaaauauaguaaaugucaauuuucccuaacuuuucauaagauguuuugacuuugcuuaaacacuaaucuuagaacugaacauauucaacuucccucuucauccaaaaaaaauuuggcgaauauugagagccaacuaaaugccugacacuaugcuagcugcugugcccucaaagaagaaaauagaaggucccugcucucugagacuucagugaagguggggaagcuaaggaggauacacacucaugccucguggucggaucggagcugccaugcaggugugguguguguaagaacaaagcgggagucaugagcaggcugagggugggguggugggggaagcaggcaggggugugacgaaaggcaucauggaugaaguaacaaguucagucaggguaacaaggcagggguaggguaggcugggcaagaauagcagggccuuucuggcaguuuuggcauauccaaaacauggggcugagaaccagcagcucaugcucuggaaccugcaguucugugaugcaguaaaaaccaccgcuuccaaggguaucauggauuaagggugauuccagaagggaugagggagcuagaaaugaguuuuacuauaaccgggggaaguccaguauuuuaaacuuuaucacgaaagauaacaaaggaauccaacauauauuggagugauagaaucccagaaaaguaaauauaaugaaucacagauagagacaucuccucugagagagcgggcugauaaaaauaguaaauaaucauaaguaacuuuuuuugagugacugcuaaaugccagaugcuucaagcuuuacgcacauugacucauuucugcauaccacaacccuaugaggcagauucuauuauuugucucagagagguccucucaguaaggccuucuccuucucccaccuauuccccuuuucugcucuuaucaccaucuaauacccucuguguuuuacuuacuauuuuuuauuugccucucucuuuuugauagaguggauacuccuuaaaggcaggaauuuuguuguuugcuuugcuuacugcuauauccucagcacuuauaacacauaguaggaaucaauagauguuggugaaugaaugaauuauagaaauagagguacacgguacacaaugguuaguagcuugccccaaaucgaacaaccaggcagugguaggcccugggagcaauggugugaguggcugguagaucuugggcucacagagaggcauaaugaaauugaggguggggagacuggagcaucagccggguuaaaaagaggcuuaaaaacucauagauucacuuauuuuagucauccaacuauucaauacuauuuacugagcaccuauuaugcaccagacaugcuccagguacuggggaaacaaugguggacaaggcagaaggugucugcgcucaguggggaggggagggaagaugacaacagaaaaggaaacaagcaaauacacagaauaacuucagaggcugauaaauucugugaugauaauacagcagaguaaugugauggagcauaacuagagauagggggaauaucuucacuaaauaggucuucagaaaggacuucuuugacaaaauuauguaugagcagcauccugcagcauguauguuucuuuuuucuggggagaggguuuuuuuuuuuuuuuauugaucauucuuggguguuucucacagagggggauuuggcagggucauaggacaauaguggagggaaggucagcagauaaacaagugaacaaaggucucugguuuuccuaggcagaggacccugcccuuccguaguguuugugucccuggguacuugagauuagggaguggugacgacucuuaaccagcaugcugccuucaagcaucuguuuaacaaagcacaucuugcaccgcccuuaauccauuuaacccugaguggacacagcacauguuucagagagcacaggguuggggguaaggucacagaucaacaggaucccaaggcagaagaauuuuucuuaguacagaacaaaaugaaaagucucccaugucuacuucuuucuacacagacacggcaaccauccgauuucucaaucuuuuccccaccuuuccccccuuucuauuccacaaagccgcgauugucauccuggcccguucucaaugagcuguugggcacaccucccagacggggugguggccgggcagaggggcuccucacuucccaguaagggcggccgggcagagacgccccucaccucccggacggggcggcuggccgggcggggggcugacccccccaccucccucccggacaggguggcuggccgggcagaggggcuccucacuucccaguaggggcggccgggcagaggcgccccucaccucccggacaaggcggcuggccgggcggggggcugacucccccaccucccucccggacggggcggcuggccgggcagaggggcuccucacuucccaguaggggcggccgggcagaggcgccccucaccucccggacaaggcggcuggccgggcggggggcugacccccacaccucccucccggacggggcggcuggccgggcagaggggcuccucacuucccaguaggggcggccgggcagaggcgccccucaccucccggacaaggcggcuggccgggcggggggcugacucccccaccucccucccggacggggcggcuggucgggcggggggcugacccccaaaccucccucccagacggggcggcuggccgggcagagggccccucacuucccaguagggcggccgggagagcccccucacucccggcagggcgcugcggggcggggggcugcucccccaccucccuccgcacggggcggcuggucgggcggggggcuguccccccaccucccuccgagacggggcggcuggccgggcggggggcugaccccccaccucccuccuggacgggguggcuggccgggcagaggggcuccucacuucccaguauaaaggaaagaaguuuaauugacucacaguucugcaugguuggggaagccuugggaaacuuuccauuauagaggaaggugaaggagaagcaagacaccuucuuuuuguuuuguucuuuuuuugaaacugagucucgcucugucacccaggcuggaguguaguggugcuaucucggcucacugcaaacuccgccugccggguucacaccauucuccugccucagccuccccaguagcugggauuacaggugcucgccaccacgcccagcuaauuuuugcauuuuuaguagagacaggguuucaccauguuggccaggauggucucgaucuccugaccuugugauccacccgccucggccucccaaagugcugggauuacaggcgugagccacugcgccuggccgcaagacaccuucuuuacaaggcaacaggaaagacaaucaucaagagaagggggaagagcuccguauaaaacugucagaucucaugagaacucacucacuaucacaagaacagcaugggggaaacugcugccaugauucaguucccuccccccagucucucacuugacacgugaggauuauggggauuacaauucaagaugagauuuggguggggacacaaagccuaaccauaucaguaguuuaagcaucacuuucccccauuuuggccccaggugggauagaucagcagacaggaggguugcaaugauuaugcuucaacaaaggaugccgucauucacccauaggcucugucaccaguggaauccugucucuaagccaucgggccaaacacacguucccuguuguuggacacauaguggugacccaaugacacucuuaugaggauuugccugccuccgccugagcaggugggugguuccacgcuucccaacuccacugauuuauuuccucaggccauccuggauucuggcuucaccccuguuagugugcugaggccacacuucuugggcccuccuccggucccaugccacaucacuaaccacagcuggucuccucaaauuugguaugugucccgcccucuaguuccgggccaaauccuucagacucuagauucgugaaccucauucaccuucuucuucuaagcuaaugccucccuaccuugguccuuuucuauuuucuguacucucuaucuuguccuggugacaaggcccuccaggccuggccccacccggccacccuguccaccucccaccaccauccacuggcuggugcaaucugcuguucaaggcauaaauuuauucagugcccagccccuccuucugcaagguaaccaccuagaaaguuagucuaacacccuuucucugcccuguguggggagccuguggaagcuggucucaggaucuggcuggguaaaccaucuguuuaccucuguguggguucugacacuccuagccaguucuguuucucugaaccuuguuucuccacucugcuugccaagucccuuugucuuauuuuuuucucccucucccuccuuccuucccuccccccauccuuccuuccuuuuuuccuuccuuccuuccucccucccucccuuccucccuuuuucccucucuccuucucucccuccuucucuucuuuccuuccucucuuccuuccuccuuuccucuuuccuucucucccauucucuuccucccccucucuucuuccucuuuuuauuuuugucccaugcuuuaggccuuccuuggcccuuccuggcauugcuuuuccugacagcaacacucaauaauuuuuaaaaagcaccugagcccuuuguguugacugaugccaccucuguuguggugcagauuuguuuuagaggcagauguccagggacgcugaacacugaaauccauccugcagagcuugcuguaggcagaguaaagaaguuugcucuguaguuuucccaacagccuucucaaauccaugggagacgucucagacaccuuguauuuaauagacaaggaaaugagcucaggagauuugccccagguuguaaauuaaaucagcacaaagguagaaaugaacacagagcucucagauuggaagcuguccagacagcugcauggagcaggggcacagcucacugucuuucaaagccucaaccagggcuguugcaucucggacacuuggcaguuacuggaaagucauguuaggcuuuccuguugauucuuuaucuuguggaggaguugcacagucaaugccuuguucaagauuaaucauuuucccuguugccuaugacugaggcuguuucucacauccugccccugguuuugccugucccaaggauuucgucugaagggcgggacauucccccugccucuucgcaccacagccagagccugccauuaggaccaaugaaagcaaaguaccucauccccucagugacuaagaaucgcaguauuuaagagguagcaggaaugggcugagagugguguuugcuuucuccaccagaagggcacacuuucaucuaauuugggguaucacugagcugaagacaaagagaagggggagaaaaccuagcagaccaccaugugcuaugggaagugugcacgaugcaucggacauucucugguggggcucgcccuccugugcaucgcggcuaauauuuugcuuuacuuucccaauggggaaacaaaguaugccuccgaaaaccaccucagccgcuucgugugguucuuuucuggcaucguaggagguggccugcugguaagucauucaggauuauuacugaauucucuccuguuuccuagauguuuucauuauguauuuucauggaaaguuuuuuguaaugcauauuucuaaaucaagugacuuuuuuguugcuguucauuccuuugaaagcagauuauacaaaagcgagauugguacaguauagcguaguaauuuuaugagauguuguuuuacaaaaugcucuuucaacuaaaagugaacugccuuuuugcuaaacucuauagguaggaaacagauauucgcuuuuaaaucagauuugagagacuauagaguuucuacuagaacgggcagucauuuaacauuugcucuggggagccggaagggguuggcugguucucugccuaaaucaacaguuuugaauccaaauucucugcuguuuauuuucagccaucugugauagggaaaaauaaugaauugugagugcauugcuauuuuaaaagaacucuaagcuuucuccuuuauguaaggcugggguguggcgucuaggaaaaacccuacaguuagcagcaggucggugucugaagcuaauaguggaauguguuauuuuuuccaagaauuguuuuugauugaagugagaggaauuucccugccaaccugggagcugaaagcauuagcuucaaccacagcauggaaagaaugugagcaaacuuaaguuugcuacuuuaaagugcugggauuaaaaauuuuaaggagaaauuuuauggaaugguaccauacgugauaaauuuucuuaaucaaguaaaagauaguaaaacauuuaaaccuaauacacugauuauggcauggcaaaucugcccuaaauuauuuauuuaaugagauuuuauuuaauuuuauuuuauuuaaugagacgggguuucgccauguugcccaggcuggucuugaacucaugggcccaagugacccuccuaccuuggccucccaaagugcugggauuacaggcaugagccacagugcccgucugccucaaauuuaagcauuauuaucauguuaacaugauuauuugucuuaaacauaacaucacacuuaaguuucuuucgaucuugaaccugaaguauuucauauuuacuauauuuuaagagcuuaauauuguuaaguuaaaacuaugcauuuguauaaucaaggaagcaguuaauauuuauuauauauagcuuucaugucucccauuuacaaaaaaguuucaguuauucuauuaaagauuuguugguauauucugcauuuuacaaguggaaaaaaucagauuuaaagaaaggguuuaauauuuccaaaacagaguuuguuaucuggggucgugugauaaacucuuguggaauaaacacguuuacaguuuauuauuuuacuccucccauguuacauccucacccuaaaaaaugcuuugacagauuacaugaaaacaagcagauaugacauuuaaauggucuuuuucuccucagagguuuacauucuuugagauaucuggucaaccuaaucaaagccaguuaaugucauuggaaauaaauauauuuuaccaagagaugccuaaccugacccauaugagccugagcaagacaaugaccugacuuuguuuguuuccuaaccagaugcuccugccagcauuugucuucauugggcuggaacaggaugacugcuguggcugcuguggccaugaaaacuguggcaaacgaugugcgguagguccuccugcccugguggugaaaaugacuccuaagauguagcuguggcacucuguggcucacuuccugugugucugcuuuucccuagaugcuuucuucuguauuggcugcucucauuggaauugcaggaucuggcuacugugucauuguggcagcccuuggcuuagcagaaggaccacuaugucuugauucccucggccaguggaacuacaccuuugccagcacugagggccaguauguaauuacucucuacauggcuacacauuuuuauccaccacauguauauaguggcagcucuaucaaaccagauaggcauccacuuauccauccauccacccaccuagccaguguuuauucucacugacucaggcaugguuuaggcaauagguauccaaggauggauccccaguccccgaccuaaacaaauucuaaaugcuucuuuucuuuucuuucuuucuuuuuuuuucccccagagacagggucuugaucugucacccaggcuagaaugcaguggcacaaucauagcuuacugcagccucuaacuccugagcucaagcaauaccccuuccucagcuucccaaauacagagugcuuuugaauagauucaauaauucaguccuuauaauaacccuaugaagugacuuccuauuuuaaagaugaggaaacaaaaucacagagagauggaguaauucauccaaggucacguugccagaaaguggcaguuagcauuugaacccaggcagucuagauguagaguuuguguucauauagugcaucucaauuacuucauacauuauaccagaacaauugccugauuaaguguaauacauuuuacuacuuuauaagaaaguauuauagaauccauauauaauaagaauggcaacuauaugaauuuaacccaagcccagggcaaaccaugcccuuaccccuguguauacaugcacucauauaaaacauacacauacauacacucauauaaaacauacaaacuauguacaaugcccccuuuuuuaguuauuaagcuauauaaguaaggccuauucacaaucauaauaucaggauaauuugugcuguucuaccauucuauguugauacuuauuuuuuuuaucaguuauccagaaaagaacagaaacagcacagcugauagaaacggauguauguggugaugaauggaugacauguuucuuugagcaggaguugauucugaguuucccuuuucccuacucaacuuucugaaguugaauuuugaaagguuuaguuuugagauucaugauuaaaaauaauauuaauaacaaauuauauuaucaagaauguuugaccccaugaauuuaaagcauguagugaggauauaugaaucucacaaauuuagcacaguuaugagaucaugaauuugaauuagcuggguucaaucacagcucugcaccuaucuguaggaaaaggugaaaugagcucucugcaucucaguuacuccacugguaaaauaaaaucaauggcaauugucaugagaauuaaugaaauaauauguaaaauguuccccacagaggcugccacauugugugcaacugccacuguuagcuguuaauauuagcuacuaccuuacaauaaacauaacccaaugguagccuuugaaggaaaauugauacuuacagaaguuugaaauuuugguguucaaaacugugaucaaucaugacucagcuuuuaucagaacauacuggauguacuaguagaaaauggcuauucacauauguacaaacauacaaaacuauugcacaaacagacuucuaagaaaagucaugacuuaugcaaccagaaugcagggagaggugguaguauugcuaaaugguuuuuauagcuauuugacuguuugccccucccauuauccacucuggauucuacaagaaaccuuccuccucuucuaugucauucuucauuuaaaacuguccaaggauuucaauaugggaaauaacuaacagucacaagccacagguuaguugccugggagccagguggagccaaaaauuuuuuuuuacauugagaccugaaaauauagauuuuuguucugcugacaugcagaaagacagggccacaaaaacagaacuuuuuuugaaaugaacaacuauaaucucugauuggcucaaugaacuauucuaaaguuaggucucaaauuccaagccccuuuguucuguuguggaaggaagucgugauaagaaaagaauuauaccaggccucuuuguggaauuaagucaaaccuugauuuucccacaugauuguauuauauuuuguuaagaauccaaauacucuguagcaaaggcugaaauucuaggagagcuaucagaaguagaauuuuucagacuggaagaauauccagguauuuauaaaaucgacuaaauccuagaaucuauagucagauaucaccucaguaugguuugcugacauuucacaaagcaacuucauauuguuauuuaucauucaacugcuuuuaaaaugugcugaguggcuauugugugucagauacuguucuagcggcuggauauacaaugaugaauaggucuggcuccuaccuucauggagcucagccuuauugaauagauacauaagcagcuguucucccuggacuagguuagaugcccuuccucuguggcucuuccauauuuuguuuaccgaucagcauaucuguugcauugagauuacuugugacuugucucuuccuuuagaagcuaugcucuuucaggacagagcccgugcccugugcuccauuauauccccagcucuggcucagugucagacucacacugacugcucaauaaucuuuguugaaugagcaaaugcagugugcuacaugcuauuaucaacucuugggcacagcaucaugaaagugaagagcuaucagccgggcguggugguucacgccuguaaucccagcacuuugggaggcugaggcaggagaauggcuugaaccugggacguagagguugcaaugagccaagauugcgccauugcacuccagccugggcaacagagucagacuccgucucagaaaaaaguaaagagcuaucaaauuaguuggguuuaaucccaugaauuugcuuccuguugcaaauuaauuuauuccuuaaaaacaaaaaauagcuuuguuccaaaggucucaguugaaaaauuccagcauauuaaauauccaaacuugccagaauuuggauaauuuucagcaguaacaaauugagauguaauaaaaugaucuaaauuaauauuuuaaaguucaaaaaaaaaacuagccuaaagagauuguauuuucuaaauauucacucaauauugaauacaaauacccaucuuuuauaccaauaacaacaauaaaauuggaaaacaguuuuaaaaaacaccuacacauacucuacuuuagcacaugaauuauuuucauuuuuccgcauuugcucguaguuuacuuccuacacauacaugaaucuuaccuagcuuuaaacacagcacaaauacaguucugcauuuuuauuuuuguuuauaagaauucagaugccuguuagggaauauaaauaucauuauaaggugagaauuucugaccauguaauccuagauuggggucaaaaauuauaaauuauaauuuuauguuuaucauuacaguaggaucugggcuaaauuccuccauuuuguggaaugacaugcaguggaagaaacuuacacaggauauugaauaauucauuccuuuuuucugaaugaaaaaccaccaaacaaaaguaguuuaugaaguauccccucaaguaugaccgugugucagaaguuucucuuuuuacccacagguaccuucuggauaccuccacaugguccgagugcacugaacccaagcacauuguggaauggaauguaucucuguuuucuauccucuuggcucuugguggaauugaauucaucuugugucuuauucaaguaauaaauggagugcuuggaggcauauguggcuuuugcugcucucaccaacagguaagaaccugcaugaaaaugucguagucuggcccugguguuaauauaccauuguuuucaucauaaagaaaaaggcaaaaccaaacaugcucgaccuaccagcauuuauucugauaucaucuuuguagcaacacaauuauagcauucacuuuagcugucaguaacaagcuuccucgagucucacagucacaggauugucuuaguucuuugcaguuggcucuauguacacaagaacaugcugcccauagacacagcgcucccuucaggaucuaauucacugccucugcucucgcugcagagacagaaaaaaaagugaugucugcucuuuguuugcuguuauauucccaacuaguauacauaaguaauagccaaccauucaaugcaucaggcacuaugcuaaacccauaugacucaaauauuaagcaauaggcuuaagaucaccuacucaggaaauaacaggcuucaaaccuugagucgcucugugcaaaagcuccuacuuuuaaccuguauuccacacuugcuguuugguuggauuuucugcaauuccuuccuaauaaggagucauaaaaaugccuaagcaguaaguauggagaaucacuagcaaucuuugaacagcagcucaugaaaagccuuucguugugaaagaaaaccaggaagcacuuguuuccuggggauaugauuuaggagaaaaaaaugcauuuguuuguagcagugaaaguucuuguuucuauauccuccuaaaauauauauauuauugaauuaaugaaaguccagcuuugauccuaucuuugagaggguuauuuuaugucuuauauuuuucaaaccauuuacuccucuggugccagaucuguuaacuuucuuuuaaaaauaagacaaaaaccuaaugaaaacugaaagcccauugcuaccaugaaaaacuuugcugaaaauaaaaggaaacuuucuguaauuuugggggaagguuaaaaugaaaaucuaguuuuccuuaucaggcaaguauagcaagauuaauaauuucuuuggcaaauuuccaagaaaauaagggaaugggaaaccuucaauauggagcuucuuucaagcaguacgguuggggaagggcagagaaguauccucuagggauugcugucaugcagcuuaccuuuagccuugaauuucauacaaggcagaguucaaaguaagugauuacuuguacuaaauguacucacuuaguacguuuuggggacaggcauaaagagccaaugaccaaaauggcugaagugauuuggcagggaaugauacucuccucugauuugggguaguaaauacaccagguuucccagcugagucacuguagggauggcuucuucccagauacuacagggaagaucuguuaccuuuguuuauaagacaaaagacacuuucaaagggcaggucuuuucauguagaagagucagguccauaacucgguagcauuuaauuugaaagguuacccacauugagcucauaccagugugaaacuuccauggcauuaucuuuuaaaucccuaagauuaaaaccccacacaaaugcacucaaagcaacccaauaucaguauccugcaguuucuaugggcccuuucugcagccuuuacucauggaagacaagggaucuggguuuguuuaggaaacauuuugugagcauuguccaagcccuaaguaugguuggccuaagcuuugcugaagcuaagaucagucuguuuauguuugcuuaaaauaggaacuuaaaggacuaaaaugucaucauuauuuauccugauuauagccuaaugguauuuuauuuucucuacagcaauaugacugcuaaaagaaccaacccaggacagagccacaaucuuccucuauuucauuguaauuuauauauuucacuuguauucauuuguaaaacuuuguauuaguguaacauacuccccacagucuacuuuuacaaacgccuguaaagacuggcaucuucacaggaugucaguguuuaaauuuaguaaacuucuuuuuuguuuguuuauuuguuuuuguuuuuuuuuaaggaaugaggaaacaaaccacccucuggggguaauuuacagacugagugacaguacucaguauaucugagauaaacucuauaauguuuuggauaaaaauaacauuccaaucacuauuguauauaugugcauguauuuuuuaaauuaaagaugucuaguugcuuuuuauaagaccaagaaggagaaaauccgacaaccuggaaagauuuuuguuuucacugcuuguaugauguuucccauucauacaccuauaaaucucuaacaagaggcccuuugaacugccuuguguucugugagaaacaaauauuuacuuagaguggaaggacugauugagaauguuccaauccaaaugaaugcaucacaacuuacaaugcugcucauuguugugaguacuaugagauucaaauuuuucuaacauauggaaagccuuuuguccuccaaagaugaguacuagggaucauguguuuaaaaaaagaaaggcuacgaugacugggcaagaagaaagaugggaaacugaauaaagcaguugaucagcaucauuggaacauggggacgagugacggcaggaggaccacgaggaaauacccucaaaacuaacuuguuuacaacaaaauaaaguauucacuaccauguuguuguuguuuaguuucauuauccuuaaaaguucucuuuuuucucccccccccccuuuuuuuuuuccaguuugcaaguuauguggccccuauugcuaacggcuuccugucuuuuuguuucuuuauccuacucucucauccucuuucuccucuucuuucucugcugucuguaaauugccauugcuguaccugugggaucaucaccccaguuaggcacugguccuuucuaccaggugcugcaaguaucagccucccuggaaggguaacaggcauuuuucuccuuacuguacaggguuaggcucuuucaagugacaggauuccuggacuuauugggaauuuucuauagaaauguuccguuuuugguguucauuggucuggacaacagauaagcaaauuuauaaagaagcauaaccagcuauuagacagcagagcuccuccuaugggcaagcugcccugcagugggcggcuccugacugaagguuucagccuauucuguaccauagucccucuggcaggcuggugaaaccuacagacaccuucgaagaauaauguucauaaauucauaaaaugcauagaauuaugaagaaaaccaauacacuagaauauuuuaugaaaauguuuuuuuaaacauauagugua

SEQ ID NO: 13625 - RNA, 140912 nt, Homo sapiens
cgagcgggggcuggccggcuagggacuaggaggucauacauaauucaacagcucaacuuucgggcccgccucuuuccugggggugggaguuugcuccaaacuuuguuuaugggacaguccgggagcugcugcggccgcgcugucugcuucuccugcgccuccuuuucgcccagcacuagcgccuuaggccagcucgggggaugugagagccgaagcccuuagacugccaggcacagagucgggucgggauuugucagccaagccucggcuccagcuccgcaaucucgggacucacccgagcgacccaggcccgacggcaaguucgggcgggacggcggccgccgcgcgcucaggcucagcuucgcugcccgcccagguagugcccgcuggagcucgcgcgcucauccggcaccacuccagggcuccaggcuccucgggcuuccggagucgagacgugguggaguuggcucgggcugaacuucuuucggggggcugccuguccuggaaucgugcgaccuuuccuuugccauccugcgguucagcaagccccgagugcaguuauucccuccaccccucgcccuaucuucuccuccuccaggcaacuucuuugcuucaagaaaguugcauaauucucgaggccaggagggaccccucccccauccugcuggucuuaccgcugagugucugggaucuccaggcgggcaauuaucugucuccucguuuccuuuucccucuauucuuucucccaccaucucgcccucucacccuguaacccucuuacccacuuccuccgacuuuaaauaaaaggcugaucugaccuucuuuuugcagaagaugaauccggccucggcgcccccuccgcucccgccgccugggcagcaagugauccacgucacgcaggaccuagacacagaccucgaagcccucuucaacucugucaugaauccgaagccuagcucguggcggaagaagauccugccggagucuuucuuuaaggagccugauucgggcucgcacucgcgccaguccagcaccgacucgucgggcggccacccggggccucgacuggcugggggugcccagcauguccgcucgcacucgucgcccgcgucccugcagcugggcaccggcgcgggugcugcggguagccccgcgcagcagcacgcgcaccuccgccagcaguccuacgacgugaccgacgagcugccacugcccccgggcugggagaugaccuucacggccacuggccagagguacuuccucaaguaagucagccuggagccgaagaaggcaccaagucacagugcccaacgcgcgcguguguucgugugugugugugugugugugugagagagagagagagagagagagagagaaagagagagauggugcguguccuuccacgguuauuucacagauauggagagcuggaagcagggagugagucucugaguguuggaauuguaagggaucagaagcagggaucagaagcaguggugaaguucauccaccauaaaacacacaggugacuuugccuugaaucugcaggacugaagccaacucuugggcacagacccuuagucccuuccuuggccacucuaagucagauaguccagagccaggcccuuugggaugugacaccgagauaaaucagagaaaagcugugaagcuuggggaacagagggacuuuuggugaaguagguggucugcaguuucuaucuucuugggaaaagcaagcuggaaaagugaacagugguugguaggccauagugcucccagcugggugacauaaugaccacacagcacagugauguuauuagcaacugugugguggaguaguugugggcuggacaaaucaaucguguggaaauuguuaggaguuuuauuacauuaaacuuguuaaccuaaaauaccaucaaaucacaagccugcuuugucacucuucuuccuuucacauuguuccagcuuuuugaugucaugaauuuuacauuaguugaaauuuucaaauuacaccccacaggaaaauauauucucaaacacuagaggagguuguuucaauugugguacccuaagauaacuacauuccucaggagaaaccaggcuggaacuugaaauguuccauugaggucauagggucaggcuaucaaagauggagguugugccagccuaaccacuuguuucaggauugccugcacugccagugagggaaacuccucuccuaagaacuugacuuagacuucauuuuaaagcccauauuucuuuaguagaguagccuuagugcaaaagugaagacacuauguacaauuuuaaaaguuuaaucaagccuuucuuuggcacuaauauuugaugcucugauugcuaugagagagcccuaagaaugaauacacagugauggaugaaguuuacuauagugagcccauugauucauaccagugaccaauucuuauuacuuccccaucucaaggcuguugauaucuuguccaaggaguucuuuuguuguuucugagauugguguaaugcugagauucugaaacagacuugauggucauuuaugccacagcuggucuucucuggguuauugagugauaguuuggacaugugcucaguccuuugacuucuaaguagcugguggagucaagaauaugauguaauaacaugacuuuuguuguuguuguuuguuguuuguuuuuguuuuugagacaaagucucacucugucgcccacgcuggagugcaguggcacaaucucggcucacugcaaccuccgcccccuggguucaagcaauucuucugccucagccuccugaguagcugggauuacaggcacccaccaccacgccuggcuaauuuuuguauuuuuaguagagacgagguuucaccauguuggccaggcuggucuugaacuccugaccucaagugaucugccugccucggccuccuaaagugcugggauuacaggcuugagccaccaugcccagcccuacaugauuucuuucuuucuuucuuucuuucuuuuuuagauggagucucgcucugucgcccaggcuggagugcaguggcgcgaucuaggcucacugcaagcuccgccuaccggguucacgccauucuccugccucagccucccgaguagcugggacuacaggcacccgccaccaagcccggcuacuuuuuuguauuuuuuuuaguagagacgggguuucaacauguuagccaggauggucucuaucuccugaccucgugaucugcccgccucggccucccaaagugcuggaauuacaggugugagccaccacgccuggccccagcccuacaugauuucuaaacuguguuuaugaauauauacacacauacguaugguauaugaucaguauaacugugauuauuaaaaauaugaaauaggagcuaggcuugccuaauaucugaggaaaacuagacgaaaaagacccugaaacaaaagcaaaacaaaaaaauuccuuuauacauuguguuuugaaugauuggaguagcucagaacugccugugaacaagggcaaaaguggaaguuagccuuggauuuagagaaaguugcugugaucucucugcccauccccccaaccacaaccacucuccaauccaaagcagagugcaucuucauuucacuuuggguagucaaugaaaaugacagcugaaaaaaauguguaaguaguaggcuggccugcucugaugcuaucccuggaaguauuuuggccaagugacuaagagagguuaagaauuugucagugacuauugucuuuaaggauaagcaaucugccaagaguucucugaauuucuuguagaguuuuguuuaaaguuggaauuagguaaaugucauacacuuuguuacacagccucaaaaggcaguguauuucaguggauuaaguagaagcuugaaaaaugauggugacucacuuggaguuacuuuucauuaugucuguuuauuacuuuacuugccaucuaugaaauagggcugaggcuagcagauacauuuuuuuuuuuaauuuuuuuauuuuuggcugggguagagaugggguuucacuauguugccuaggcuagucucaaacuccuguacucaagugauucuccugccuuggccucccaaagugcuuggauuacaggcaugagcuaccaugcccagccagaagaagaaucuuuuucuugacucuguugggaguugagagcuuuauaaguuggaaaucaaaggauuuuagaaugacaagggucaauuuuguuuaguuuaguuuuugacuagaaaauugaggccacggaagggugaugauaggaauuugggaaagucaugugguuauuuaaugguggacccuggacuggaccucuaaucuguugcugucuacuuaggcaacaguuuuccuuuuuccccaccgacaccuuucccccaugucacuuccuuagcuaaacaaugaacuuaaugggaaacagagccuggacaucuaagaagcuuuaaaaaagccuuuugucauuuucucagguaagauuauuccuagguauaugauguaaucacuuucugcaaccuccugaaggcaccuuuccugagcauucacagcuuuccugugguguucagguguccugugguauucagauauuccuuuagaguaacaaugacuagggcaugguggugcccaccugcagccacuaccacccccaccccaucucuaaauaaaaaguuuuuaaaaauuagaguaacagugaagcagauugaauguuaaaacaccuagccucugaaaaccacuguguucauucauuauuccugcuguccucucaaucucaugaaucaggcugggguguugggcaaccuggcacacugacugaauacugaucacauuaaauuuuuaaaaggucucugauuauaaauagaauacaugcuuucuauacauaaaccagaaaauggggaauuauaaagaagaaaguuaucuagcuucaguagaauuucccaucuuuacucuuucgcaaacauucuuguaaaaaucuuucauuugaguaacgugauuuuauaagaaaaaagauuuuauccuccucuuaaauacaauucagacuauaacauuuggcugccacgucucauuuuuagugacaauuuuaguguuuugccuuuucucaaaugugugacagaaaauuauuuuuguccaagugauccaugcacuugguaacaaauccaauauacaggaggacauuuguugaaaaacaaugguuuccuucaccuccucaaggcucacagagggcaacuuuuaauuuuuuucaacuguacccauauuuaauucuuagauuguuaccuucuuaagcuuaaguaaugugcuuuuaccaccauguuuugauuuaucaacuuuuagcaccugauaugaaagugagaauguagcucuuuaagcuaguuuucuuuuuucucucccagguuugauguuuauaauauuuuaaauuugucuguuaggucaccuuuuuuaaauaaucaucuuuuuuuuuuuuuuuuuuuuuuuuuuuuuuuuuuuuuuuuuuuuuuugagauggggucugucucugucacccaggcuagagugcagugggaaucauagcucacugaagccucaaauuccugggcucaagugauccucccaccucagcuuccugaguaacuacgacuauagguuugcaccaccauauuuggcuaauuuauuuaacuuuuuuguagagacaggguuuccuaugcugcccaggcuggucucaaacuccuggccucaagcaauccucccaccggcuuccuaaagcacuaggauuacaggugugagccaccacaccuggcuuuuucaacuuuggauaguauuucuugauuccuuaugcuguaugucaguaauguuuggauugcuaccaguucuacuguucacuuuuugacaauguugcuuuccacauugccaaagcccugaacccauaaccuguauuugugcuuugccccaaaguugaccaucuuauucguauaugauucuuaaaguugaaaauccauaaggccgggcgcaguggcucaugccuguaaucccagcacuuugggaggccgaggcgggcggaucacgaggucaggagauggagaucauccuggcuaacaccgugaaaccccgucucuacuaaaaaauacaaaaaaaaaaaaaaaaaaaaaaauuagccgggcguggcagcgggcgccuguaguccuacucaggaggcugaggcaggagaauggugugaaccccggaggcggagcuugcagugagccgagaucgcgccacugcacuccagccugggcaacagagccagacuccaucucaaaaaaaaaaaaaaaaaagaaaauccauaggcaacauuuacaugacuacaauucugugaaaugauucauugccuugugugucaggauuggauuuuagacuugcacugugggucugguuuuaggauuccugggccaaucaaaggaugagauaucuagccccaaagucaaaugggauuuuuuguuuucucacucuucaucaguuguuuaaauuuguguuaccuuuuaguuuuuucauauuuggaccaugacuuucuuaaauuuuuucccuaguauuucugauugccuuuuaauguguucaugcauuauuugccauuauuaugaucucaaaaguuuucuaggcucucaaucuugucuaaccuaucgagucuucuuugucuaagcuguaugccgagauuccuuucucguucugugccguucugaacugguuauucacuaagcccacuacagagcugucauccuggaacuucuuuccauggcuggaagugcuguuuccuuuucccgugucuuccuauuuuuuugguuuaucccucauuuugcugcaguacaugcuugaguaacuucuuaagaagugguuuguaggagguaaguuuuucaaguccuuuuuuaucugaacguauuuacuuaaaaauuguucugacucuggcuuguuuuuucuguuuaucuuugaaugacaguauaauguagcuguuuucauaagggcccuuugucauucaaaaaauacugucugcuaacucaguugucuguaaugugaagagagugauaccuguugcauugugguuugaaagaugagcauauuuaaagcaucuggcgcacaggagauguucaguacaaguuaguucuugcuuucucuucucucucucccaacacacauagccuauuuacccagccaaaaucagaagcagaaaccuuggcaauaggggucaggugauuuuugacucuggauuacagcuguagcuuugagggacaaccuggaucuggaguugaaagucaguuuuaaguuuaaaauaaggaguuagagucaacuuuccugguuaagagaaaccuaaauaggaaugcucacuguaagugcccuuuugcuucagcauuuugggcagaggauacccaacuccaucugagaagugucuaguuuuuauuguuuggaaucuagauugucacuacaaauugagcuguuuuugugugugggauaggggaggaagaggaaauggagaagggggagaugagcaggaaagguaauugacauuuguugauuaccugcuguaugccagacaaggcagagagugagagucagcacaucccagagagauagcaacagaauuauaugcauauggaacuuuuucauaacccuagaugcuuuuacguauauuauuucuuuuaacccucacagugaucccaugaacagguauauauuauuaccucauuuuacuguuaaguaaacugaggcucagugagguuaaauaaauguccuggggucauauaacaggugaguggcagagaugggauuagaacucugugauuccaaaaccuguguuccuguccuuaugccaugcugucucaugccaauuguguggcccauaauuaggucuuguaauuauguauccuugaugaucgcauaacuguggugguggagugguggauggauuuuuagaguuugcuucugaacugagucuggguuaugcuauuuggaacugucauugauggugagauagagaugauggaagaaaacccaaauauaccagaaauggguaguacaccuccauugucuauuuauauuuuauucucaucaagauuuccaccaaggugacucacaccacuaaucuuaucacuuuggggggccgaggugggaggauugcuugaggccaagaguuugagacaagccugggcaacauagcgagauucugucucuacagaauuuuuuuuuuuuuuuuuuuuugagauagcguuucacucuugucgccuaggcuggagugcaauggcgccaucucagcucacggcagccuccugcucccagguucagcugauucuccugccucagccucccgacuagcugggauuauaggcaucugccaccucgccuggcuaauuuuuguauuuuuaauagagacagaguuucaccauguuggccaggcuggucucaaacuccugaccucaggugaucugcccaccauggcaucccaaaguguugggauuacaggcgugagccacugcacccggcggucauauggauuucuuucagcuuauucuuuacuugcaugcucucuuuccuggacuucuagcuuuuauuuaauguuccgucuaggcauagcagaaaauaaauaagaaaggaaaagaugauguucacuugcucagugcuauuaggagaagaagugaaaugaagaaacauuuauaaagugcugagcgcagugccuggcacaaacaccaccuuugcaaguucauuccuguuauuguucgggauuuagacggugaaaggggcgaugaucuuccagggccuugccuuugugccaucuaaaagaucuuuagccaguucagcuaauuuacaacuagaaaucauuugaacuuggcugggcgcgguggcucacgccuguaaucccagcacuuugggaggcugaggcaggcagaucaccugaggucaggaguucgaaaccagccugaccaacauggagaaacccugucucuauuaaaaauacaaaauuagccgggcaugguggcgcuugccuguaauuccagcuacucaggaggccgaggcaggagaaucgcuugaauccgggaggcagagguugcagugagccgagaucaugccauugcacuccagacugggcaacaagagcaaaacucugccucaaaaaaauaaaaaauaaaaaaaauuaaaaaaaagcauugaacuccuguuuguguuagcaucgugaguauguccuaaaagaagaaauguguggcuggcuuuaucaccgcaggcagcugacagaaucuggagagagaaggggaacacagacaaaccaggccaaagagcugguuucgaccugugguccuagagccuggaucagcugccuuccaccuugguuugccggaagccuuuguaagguguguccuaagucagucauuuauaauaugacuaaaggucugaaauuugcagcuguacagaaugucugucaguuucucccauuggcuguacuccuucuggccucaggaacuuggcacaagcuguuuccuuugccuggaacauuauuucccugcuuuuugccugcuuaacuccuccauuaccuucagauaucagcuuagaugccacauccugcaggaacuuuuccccaacuugcagcucccacucuggauuagaugcugcugcuccuccucccauaggcccuucuguuuccucagucauugcuccacucucauauuacuguuuuuuuuuuguuuuguuuaguuuugguuuuccuuuuuuuacugcacuguaaccuccaucaggggaagaacgauguuugucuugcuuggcauugcuuaacuugagcacagugccuggcacauaguagguguucgaaaggaauccuguauuauuuauuuuuagccauuuucauuguaaacuugcacccuggaauucguaggagucuuccaugcuuggaaauggcauuccauuguaucugugccccuuugacugcaagauuaaugucagagcuccagauacuaaaugcaguggagagggagaugaaugaaggcuggguguucagagaagucucauaaaggugcuuagacauaaauggaaccuucaaaaaguggcaaagauauagguaggugugcagacaagccuuccaggaaaaacaggaugggaagagagguauagaggcagaaaugcugaggguguguuuuugagacuaagaggagcuuguacugacuuguauuaaaagauagguguugguugguagaugauuaugcaucccauugagguucuggagccucagcuagggugggcucauugaccuuuugcuaguaaaugucaacuuucucacuccuuaguuuugagauacacgaguccuagcuuuuugugacuguagcguaagaccccaccauugucaccuauguugagaucuuccugguuguuuagagaacuaagcauuuuaugcugacuuaaaagagucuggaaauuauggucuuuuuaucuuuccauucauagcuccauccuauauucaauuuagcaaguacaguuccaaaauuguggguggucuuuacuucccaaguaagugggauaccaggcuacccuugacuugggaccgccccugcuggaucuaucauuucugcuuguaaaugaauagcuuuugagucugcuuguucccagaauacucucuugugguuuucgguacuuucucaguuccucugaggcugaucaacuagacacagacaaaacugagauucuggaaccauagucaucccaccagggcccaccuaggcccaguucccugaggaugcccugccugggcagccaguggccucccucucaggaacgcauuuucuaaacucgaaaguucauguuuucaggugacuucuuuaaauuaaaaaaaaaaguuuuuaaagagguaauaaauacauuuaaauaccaagaaccuaaaauaaguacaaaggcauuuacugggaagagucuuucuuucacucuccuccaguccucuugucccccuccccagagcacuaguuuuuuuguuuuuucagagaaacucuuugugaguacaagcaugcauguaucaauguagauauccaccuagaccaugucaacacaacacaaugguaguguacuguacacacucuucugcaccuucuuuuuuuuucacuuaguauaauauaucuuggaguucauuucucuucuguacauaaaccucuguuuuuuuuaaggaccacauaguauuccauugcuuaggaauuuaaauguacaucauguccccuacugauggacauuuaauuguuucuuucucuuuuuaauuaaaauuuuauaugcucaaacacuguuggagggaggaaaguggaaaagaaauucuucugaucuucucugaaucccccauuuagaaaguaccauuguuaacacuuuauucagaaauauucuuugcccaaagaacagcucuccgguucccaucuaauuuguuagcuagcuagucgguuaucuaauuuaucugucauccacuguucuaucugucaaucagucugcuuauccuucuuauacaaggcugaugcauggucuaccaaauucaauaaccaguuagaguggaugcccaaccaauaagaacugauggcauacugcugggaaguaacugauuauauagcuuagugcuacucaaaguaugguccauggacugaugccaguguacaguugaauuauaacuggccuaugaagagcuagauagagaaguugagaguauuuagaaacuuuauggcaaaauggcauugcuaugacauccaaguaggugaccaaugcaauuaucuuguggaacaggguaguuugggugugucacucuuguguggugagucacauguggugugagcuauguauaagccauccaccauaggacuacauacuggucuugacagauuggaaauaaaaccccgguccuucaccacagauaguuugagaagcaguaaucuguuuaucucucuuaacgaccuaucuaaugugucugucauccaucucuuaaucaauucaucuauuuacuuaccuaucguuuuauuuuuccauccauccuucuagcuauaauuuuugcaucaaccaauuaaucauaccuuucauuaacuuaauaaucauucuaagagguucagucuuaaaauggaaaucuauggcacaaagguuguauauaaucuguuuucuaguacauaauauauuuuaugucuuuguggcuucuacaguaacucauuguuuuaaaauuuugcuguggcacaucucaauucugaacacuguacaaaaauccaauuucuguucuuuuuugugacuagucugcugguaagcauugccagugacagacucaggagucaaaacauggugacuggagaaaaauacacaugcuagguuguuuauuuaaaaaaaaaauauucauuugugauggcuuuucugcagauauuaaaauacugaauaucuuucuccuaguuugcacuugcaaagcacuucuuagccuagguuuucaaaggggcaccugggcaccuaucauaguugaggcugcaacugugugugauaacccaucagaaaggagaaaacccaagcaaaugguaaaugugacuauaaugaacaaacguaacuuuuacugacuucauuuauuuugggguuuguuuuuaaaaagcuggcuuuuguuauaaaaauaauacauacucuuaccaaaaaguccaaacagaacugaaaguuauaaagugaaaaguaggggcugagcaguggcucauaccuguaaucccagcauuuuaggaggccaaggcagguggaucacuugaggucaggaguuuaagagcagccuggggccaggcgugguggcucacaccuguaaucccagcacuuugggaggccgaggcgggcagaucacgaggucaggagaucaagaccauccuggcuaacacggugaaaccccaucucuacuaaaaauacaaaaaauuagccaggcgugguggcgggcaccuguagucccagugacucgggaggccgaggcaggagaauggcgcgaaccugggaggcagagcuuguagugagcugagaucgcgccacugcacuccagccugggcgacagaucgagacuccgucucaaaaaaaaaaaaauaaauaaaauaaaagagcagccuggccaacauggugaaaccccguaucuacuaaaaauacaaaaauuaguugggcaugguggcguguaccuguaaucccaguuaccugggaggcugagacacgagaauugcuugaaccugggagguggaaguuggagugagcugagaucaggccacugcauuccaggcugggccacagagcaagacucugucucaaaaaaauaaguaaaaaaagaagugaacaguaaaaguacugcccaccucccugccaccaccacccugcaaccccaagacacacacuagguuuacuccucagaaguaacuacuguucccaguuacuuguguuaucuuccaaggauuuauuaugcauauauguauauaugacuugacugauaaaaacagcauuaguuuguuuuugcauugugggaagucucuguuacugguugagccucacauaaccucaggaccggguagaguacagacauggauuaaauucuggagaacuggaugcaaugccugaugggaugucucagggugaaaagccuuaucgggguaaccaugaucuagagacugggauuugacuuuuugguucaagaaagugacgucucugcuggcccaaaacuggucagguuuucgaggacugucugaugugagccauacuggggagaaacagggauagaaauuuucauuacaguuccagaagcacagguagugacuggaauauucugccacucuggaaugaagguauucauaagagugauuuaauugcugaaaaguugcuuuaguggugcuggaaaagagaagaagugagaucauuuuaaucacugaagggauauuagcagguaaauuugacaggauuuggugauggauuggauaaaggcagcgaguaaagcaggaggaaaggaagauuugcagauugcuggcuguauaaugucagggcugguggcgccucuaauuguagcaagccguacugggagccuuggaagaaguggagaaauuauuuaacauauugaguuugaagugacuuuaagaugcccaagggaggaaaaugggguguaguggaauguguauaauuauucaaauccuggugugguugagauuucuuagagagguuacagauagaaugagaagaaacaagaaguacugauggacccuguaaagagauggagagagaagagaaagagagguaggaggaaauccagagaguggugcguggaagccagggaagaaagucuuucaagaagaaagaaugguuagcucugugguguguuucucagaggucaaggaagauaaggacugaaaaauguccagugaaugacuuuuccacgaggacacuuucuuucccaggauaggucauaacagggccugagguacuaauucuuaugauaauucagauaauuuaguuuugagagacagaaaaauaaggaaaauaaagaucucaauuagauaaggugugaauacacucccacauagucccacaaguuuccauauaaccuauagugucucucacuuuauugccguauaccacacguuugcuuguuuaagcauccuauuaaaaugggguccgaaaucaguguuuuauaacuaacugagcuaaguuauaagacucggguaaaaacaugacucuaauugauaugaucauuacuugcugugaggaaaauuacagucugcaauccuagcuugguaaaaucuucgucacaauuuguagugcacaggacuguuauugcuggcacacgucauaacuaaauuacagccauaaaaauagcagauuauguuuggagaguaucaguaaaaaauuuaugguuccaaauauuauguaacuguaguuucagauaaauguuuaucuuuccuaucuuuguuucuccauucacuggaacugauuuugauaccuggcaaaggggacucagauuaaugcaaguaaguucgccaggccaguuugcccuuucacaauauaagguaaauaaaacauguuuaauuauaucaaacugguuugaguuuggcugcauuuuguaguuaaagcuuguauuguaguuaaaaggcuauucuguauuuugcuaauuugggagcauuugguggccuuguuacagauuugggauuuguaaagacaugugaauuuaguaggcgggauuaagaaucauaaaagaagcaguaaacuugagugcugcucauaaaauuacuuagguuuucugcagaugcauucucuagugcaaccguccccacuuuuugggucuuuguuuuagguauuaugugaaauauaacccuaugcauaugcaacuuuuggcaaauaaggauuucuuuuuuuuuuuuuuuugagacggagucucacucugucgcccaggcuggagugcaguggcccgaucucggcucacugcaagcuccgccucccggguuccggccauucuccugccucagccucccgaauagcugguacuacaggcgcuugcaaccacgccuggcuaauuuuuuguauuuuuaguagagacgggguuucaccauguuagccaggauggucucgaucuccugaccucgugauccacccgccucggccucccaaagugcugggauuacaggcgugagccaccgugcccggccggauuucucuuacaaaauuauaucauccaacuuauauuuggguauucguacuuucgugugugugugugugugugugugacagaguuuugcuugucgccuaggcuggagugcauugaugcgaucucaguucaccgcaaccucugccuccuggguucaagcaauucuccugccucagccucccaguuagcugggauuacaggcaugggccaccacgccuggcuaauuuuguauuuuuaguagagacgggguuucucccuguugaucaggcuggucuugaacucccaaccucaggugaucugccugccucggccucccaaagugcugggauuacaggugugagccaccacgcccggccacauucguacauuuuaacauaaaauccaaccauaaggcuauauuguagaaaagcuugaaggaaagaaggcaggaauggagaaaggaucagcuaccuaaaaguugagcuguagccaaggguauguuuaaaacaucucuuuuuuaccuaggcuuuuaaaaaaguuuagcuaucuuaucuaucaucuaagaaaaguuaaccuugaguuauugaucuugcaugucugcauuugaaguaugaagaugacaggggcugugcuuugggccuuggaaagcuguguucucaagcaaagguccaagagcuguaauccguaugguacacaguggaaacauuguucuuuguauuugucuguugcuaacuuuuuaauaaacuauuaaguaguuggugauuauuaacaguaggagcagaauguagggucauuauggacaauuuggagugucaacauuaaagaaaugauuuuaaagguuagaucccaauuguugagacuuugccugaaacuuuggcagguaaguagagugagggauggaccagcacaaccuuuuguaauuauuagccguagugaagugagucaaguuuugccacagugcuuuuuguuuaaccuaacaauuggccggcccuaguuaauuguugaaaaccauuaaaggacucaaauuucccaguugcacaugcauuggaauguccagcuuaccucaugugugugaauaaagggccagugguguggcuaauuaaagugcauuguccuuuaagcaaagcgucaguaacaaauuaaguuuuaagaguucucgaaaggcccuucugaggacugguaaacaucuugguggcugguacauaucguauggagucuaggugugaaagcugcugaaaacaagcauuauaaacuuccaaguaaguguggagguguaaacugaugccauagaguugcuucagcugaagcgaaagaucauauuuacugacacuuauuacaaauggguuuuuaaaacaaugucuguuuuguacagugacaguaaagucugccaagaguaaaacaaaaaguuauauuguggaacaagauaaaaggacccugcauaauaaauaauaucgaaugccuuaaaauaugagguuucauuuccaaaauauaaauaugagcuccuaaaugaauguuuaaauaauuugguuuuucuuugauuugccagugacuugauacguaaaauaauuuuggcucugaauauguccagaucuaggccaucacaauaaagaauacaucuguauaguaaauacaaaauaaagcaaccacaaaugacaucauguuuuagugauagcuuaggaauuguuuuuuuuauuaugauagaccaaaaguaguuuauuggcuauaaauaauauauuuauuaucugccaguuucuaagaguagcaugauaucucugauccaaacuguauugauucuggucgggcucgguggcucaugccuguaauaccagcacuuugggaggccgagguggguggauuacuugaggccaggaguuugagaccagccuggccaacauggugaaacccugucucuacuaaaaauacaaaaauuagcugggugugguggcacaugcuuguuaucccagcuacucaggaggcugaggcaggagauucacuagaaccagggaggcagagguugcagugagccaagauuggggcacugcauuucagcuuugggggcagagcgaaacucuguuucaaaaaaacaaaaacaaaaccaaucuauauugguucuaaccuuuaucuauagacaaaagcauugguuuaugaaaaccaucagagaugcaagccauagaaacuuucaaaaaguucuuuaagaugcaacugucuggaucugauaaauaguuucaauuguuuugcucuugaucuggauggguuuugagcagaggagauugggugaaauuaaagguuucuuaaaauuguugacacugguagagaggcauuuaucugaauacaguggggaagaccagagauguugcuuaaagagauuuuguaagaaaaguaggcacaauucuugugaaaagugggcuacgugaauaagggcaauccaagaaaucauguuagugccccuguguaguuguaugacuucuguacuuuuucuuucuuucuuucuuucuuucuuucuuuuuuuuuuuuuuuuuuuugagacggagucucgcuguguagcccaggcuggagugcaguggcacaaucucggcucacugcaagcuccaccucccagguucacaacguucucuugccucagccucccaaguagcugggacuacaagugcccaccaccacgccuggguauuuuuuuguauuuuuuaguagagaugggauuucaccguguuagccaggauggucucgaucuccugaccucgugauccacccaccucggccucccaaagugcugggauuacaggcgugagccacugcacccagccaacuucuguacuuuuucaaaggugaacuuuuggggaggugauuucuugagaaguggggaagauaaugggauaaguuguaaaagugcccagaaauaugaguuuauaagagaccuugagagcuacauacuaauguagcuguccauuaguaugaaagaagaccagacauguuguccaagcugucuauaggaaaauagaagagguaacuuuagguugucguggcucacacuuauaaucccagaacuuugggaggcugaggcaggagaauggcuugaggccaggaguuugagaccggccugagcaacagagcaagaccccaucucuauaaaaaaguuuuaaaaauuaacagaaugugguggugcacacugcuauagucccagcuacuugggaggcugaggcaagggggaucacuucagccuaugaauucaggguugcagugaacuaugauugcaccaccguacucuggccugggcaacagaaagagacccuguauauauauauuuuuuuccaagauaauuuuagucuuagucuacucugaauaacaaagaagaaugauuuauucauuuagaggcauuuuaagagcagucuuuguagaccauugcuagaucuuuuuggaaugggcugccuugaaagcagagagaauguaaccaugugucuuuaaguggcauuguuuagugguucuucacggcagcccaaagagaaaguaucuggcaucagauuugcuggaugugcagagaugccaguaucucucguuugagcuagccucugcgguguuuuugcucucaaaccuggugguagagugacggcuuugauuugcuuccugccugaagccugcuuuggaugaauuuaaaaaccuguuuguuuccccaucggccggcugagccuuacccauaauuccugaacuuugauuauggggguuauuacaggacaagagcuucuuuguaaaagagcauguuuaauacucuggggucuagcgugacuagcggauauaaauuguauggaagcaauuaaaugcgaaggaaaugucaugugggcugaauuuaaacauaacuugcggcauugauuuuuuuuuuuuaacuuacacuaagaaggauggagagagaaaaaagaaagagaauggaaacaggccaagcgagucagagaagcacacgcagagacaagagaaaaggagucauuuuuaacauuugguuaaaaguccaaagcccagagcuagcauuaugugaauuauacuaguauuaugccauugcccuuuaaaugaacucuuuaaaaacacaaaugucagggaaguauacuguacuuggggcuuguaucucuuuccaguugcuccucuuuaucuuaaggcauauauguacauacagcagugauuuuuuuuggaauauguuaauaaacaggccugaaggaagcuccguaaacgauuaaagugcuucuuucccuaguuuucucuccuuuuaugcucacggccacugcaugccucuuuucuuuucuuuucuuucuuuuuuugacaaaguuucgcucuuguugcccaggcuggagugcaauggugcaaucuuggcuuccugcaaccucugccuccuggguucaagucauucuccugccucagccucccaaguagcugugauuacaggcauacagcaccacgccuggcuaauuuuuuuguauuuaguagagacgggguuucaccauauuggucaggcuggucuugaacuccugaccucaggugauccaccaccucagccucccaaagugcugggauuacaggcgugagccaccgugccugguugccacugcauaugucauacagaguagcucaucuuugcacuuuugauuaggaguagugugucauuucucacuugccuagaauguccuacaucccuaugcuuggucuauuaagacuuagccagccccaucuccugucuaaugccuuauuacaccaaccaacuagaagggaucuccuccuacuccagauccccauaguaauuugaucuauugggguaauuugccacuuaaucuuuucuacuguccaucagagugucguguaagguuuguuuguaaaugaauggguuuauuucauuucuccaacuugccaauucuuagaauauggaacugguguuguauuguccuucaugccuagcacauauugguacuagggaauauuuauugagauuaauguuaauacugaauaugggccgggcacgguggcucaugcugauaaucccagcacuuugggaggccgagguggguggauuaccugagguuaggaguucaagaccagccuggccaacauggugaaaccccgucucuacuaaaaauacaaaaaaaaaauuagcugggcaugguggcacaccccuguaaucccagcuacuggggaggcugaggcaggagaauugcuucagccugggagguagagguugcagugagucgagaucaugccacugcacuccagccuggccaacagagcgagacucugucucaaaaaaaaaaaaacauacucaauaugcuguuaaaauaaucaaaaugugacuggguggucacaggcagaaauugaugcuuuuagauuagauguaauaauauagcaaguuugaugugaaauugaguuuagaaauaauagacaaccuuugauuauuugcugugauagagaguacuuguccuuuauuuuuauucuauaugcuaugaacucauagugacaagaaccaaaucuuaccugccuugcauaauacuucucucuuuuuuuuuuuuuuuuuuuuuuuucacuugagacagucuugcucugucgcccaggcuggagugcaguggcaugaucccagcucacugcaaccucugcccccuggguucaagugauucugccucagccucccgaguagcugggguuacaggcaccugccaccacacccagcuaauuuuuugugcauaauacuucucuaaugccuggcccaaagcauggcaugcauaguagggauucauuuaacuuuugcugaaagaaauauaaaugauuuuuuucuuuuaaauuucuacauuauuuagauuuucuggugacucuuuccuaugcaauaagccaauacauauuuauggagcacauacugugugccacauacugguacugugcuuagcauaaaggauacauauaauguauauuuuacuuuagaauauauucuauucuuuguauuuaauucuuagcccgacuauaaauucuaaaaaaucaguuuuucaagcaaaaacaaugaagauccaagaaaggaaaauuuccugguauuaauucaauauauucaucuauucccagauuauuuccacauuccacuugaugguggaaauuuacuacccccuccuugccuuucaaaugauccuaagaucguaaccuuucccaauggagcugaagagguagaguaggcuguuuggguuucaaaggacuuuucaggacacaaaguaaauaggggaauuggagauaucaacaaaacuaauuaaguggauugacugugucaguagugaguacagagaugucagaaaagcuaguuguagcaaguauuuaaacacagccucaaguucauuuucagugguguugccaucauccacaaacuucaaagaaaguuuagccagauuaauccaggaaaauucauucuccugggaacaucacauucuaaauuacuuauucauuguuaauaucuucauuuaaaauuuugacuugaacuuuuuuauucuuuacuuguccuuuaagaucacacagacccaagauuugauaagguuaucaucuuuucagaucucagaaaagugggaaaaugaauucccuuuugaccagaauaaagggaagaagaauuuaaaauuauaaaccagguuuacuuuacucauagauggucauauauucaacauugccuuuuuuuuauuuuaaaaaacugcccaagucauaaauaaaugcauucuugcuuuaagaaauucagcuaaagcaauagacuuucuugacccucuauccccaauccugcucaucuccccagaaggagagcccauuucucaguucagggacuguccuucagacuuaugcauguagaaaccaaugauucaaguuuuucuucuucuccuucuuccuucuuccuccuuucuccuuccuccuccucccucuuccgcuuccucuucuccuccuacucuuccucuucguccuccuuccucuucuucuucuccuucucuuucuccuucuccuucuccuucuccuccuucuucuucuucuucuccuucuauauauuguaccuuaacuucguuuuuacccaccacuuuaaaguauuuuguucuaugacagcagcuagagaucuuaauacguuacuccauuucauggcuauacacaguuuauuuacccguuuuccuaguaaugggacuguaauguuacuuaaaccucaucucaaagaccuaauauaaauuaaauucuagcuucauuugaaucuuucaucacuuugaagggagauuuuuaguaauuaucaaaagauaugagaucaaacaaguccaauuacuaaaaauacaaugcauuuguaugauaauuuaaacuucuuuuaaauauggagacccagagcacuguauccccagcacuccugugagcuagccaggagaagaggaacauugucacaaccacaugaagaagaggguagagcagggcccccuucugcugauuucugauuauacagggcucuuuggucaagaucacagaauguguuucucccucccaugcaagaaaggcagggauuccuccucuccucuuuagucuuccaucccugcucagagcuuuuuggcuagcauugucaauucaagguuuggccucagagucuuugauuuaaguugugaggggacagacauggugaggauauaccguggccgggucuggagggugagcuacugagaaucagggcagggaagaggcucagugguugcuggugcugagguagugucuggaaagcacauccgugugaaagggcgaaugccagcugagcauggccuugggucacuggcugccuugcaaacaggagcuccacaggagagguggacuugcacaacagcagccugacagauccagggucuuucacuugcuucuuugggauccucaccaagcaugucauucaaccauuuauugugcauggaccuugguagggaauaggcauugcucuguuuucugauuuauuucuccuugaaagcccauucucaagggcagggaacauguuuuauucuucccagaaccuuaggauaaauaaacgggaaaaaaugagugaaaaaggaaacuuuggugggagauaaugaggcuuuuccuuacugcucuuaucuuuagaagcugggucacagacaucuuaauaugcauuuacguguauuuauuuaacaaacguguaccuagcacuuacuuugugccaggcauuguucucacacuguucacauuuaauuaugccaagaacucugacagaaacacuauuuuuauccccacuuugcucagaaaacugauguacagggcauuuaaggaacuugaccaaagccgcacacuaguaaggacuuaaacuugggcagucugggcccagagccacccuggcucuccuuuucccucucaccggucuugacaugguugggucuucauuauuuuucccuuucuggaccucucaucuuuccuuccucuuucuccauuccuguugccuccacccuacugugugaugugaucauuuauuuguagacugcagcacacuagccucugacuucaguccuuugcacaccacagccaggcuaaucuuccuucaugauggcucucaucacccuuuuccugcuacagaacucuucuugguguccuguccugucagggcugaucuccugccugguuccuaaaccucuagaaucugacagugugacccugcucaucgagccucacuucccuugcaacccauuugcugccacccacagcuccuggcagugcuuguaccccuucccuggagcacccucacucaccucuucccugacccuccaucaguucauucugccauggauuuccuucuaggucucaccuccugccugacuacacagcucuuaguguccgcuccaccccugaacccagucuacaggcuguuggauuucauuguuccuggcuucaaaaagccugauuagguuuaaacucuuugggggucuaccauuauaccuagcacugagcugggucccaaaggacauuguugaguacugggauuaguagguaggacgcuugccuaauauuggacuuuuuacuugguuuccucacccuuaaaugaagaacuuaaaggagauaauggccaaguuuccuuuuaauuugcuuaaccaauuacacuugcauauauauuuuauuuuuuagagacaaguucucacuugucacccagaguguaaugcauuggcacaaucauagcucacuauaaccucaaacucgugggcucaagagauccucccaccucagccuccuaaguagcuaggacuacaggugugcgucaccaugccuggcuggcuuauuuuauuuuuguagcgauggggucuuccuauguugcccaggcuguccuugaacucuuggccucaagccauggucccaccucagccucccaaagugcugggauuacagacgugagccacugugccuggccauacuuauuuuuuaacagcuucauugauauauaauuuacacagcacauaauucacucauuuuaaguguguaauucaauaguuuuuaauagauucagguauguacaaccaucaucacagucagguuuagaacauuuucaucaccaaaaagagaagccccaacuaacuagauagcuauuagccaugccccucuccuccacauucucaucuucaccagucuuaagaaauuacuaauccacuuuaugucucuguagcuuuguuuauucuggaaauuguauguaaauugaaucauaugauauguagucuuuuaugaguggcuuauugcacuuggcauaauguuuucaaggcuccucuauguuguagcauacaucagaacuucauccuuuuuauggcuuaauaguauugcauuguauggauauaccacauuuuguuuauccauucauuuguugguggacuuuuggguugucuccaccuuuuugaaaauuacauccauuuuugaguggaaaaugaucuuccuuuaguggcuucuacaguugccaacagcaguuucccucuacugcuuuaaagguagggaucugggcuuaauggcuuuguuugcguuguguggauggacagguuggaugcuuggucaucaaugucagagagcagucauagagaguacucaugagcuuuguaaucagacguacugguuugaaucauggaucugccacauaaugagcuuacauaacuucaggaagcacguuuccucguugguaaagugggaacuaccuugccuguuuccuuagagucagagcuaugcuagaaacuacguggccuuggggcaacucaaccaaugcagagggaccucaaggcuauaaaaauaaauaaguaaauaaauuuuaaaaaguaaaaauuauuuuuuaaaaaguacucucacgcccguaaucccaguacuuugcgaggcugaauccaggcagaucgcuugaacccaggaguuugagaccaaccugggcaacauagugagacucugucucuacaaaacaugcaaaaaauuagcuguggauaguggugggcgccuguagucccagcuacucaggggagcuaaggugggaggaucacuugagccugggaaguugaggcugcagugagccgcuguacuccagcuugggugacagagugagauccugucucuaaaugaauaaauaaauaaagugcuuaaaguucucaauuuuauuaagguaucaugccucacagcucuucccuaccaagcauggagcccaggaucaccacccuaguugcaguacccagaguggaccuacuuaauuuuguugggauaauucaugucucccuucguguguguuaauggccucucuugaucuuggaucuggauuugugcuccagucacuaccccaucaggucauuugacaagaauggcuauagggagugaaauguuuuucccucucugagaagauacagcgggaguguaauuucauucuuugugggauaggcaaggaggaugcauugcuguuuuuugguaagcuuuaccugaaaguaguuaugccagaggguagguggugauucugagcuugcuuaugguuauugaauauccauuggcacuuauauuugggguuuguacgugaagacugaaaaugccuuuuuuaguaacuggcugaaggagagaugaaauguuaauuugauccaaacuuugcuuggagagugguguuucagaacugauuuugcuaaugucauuaagaaucaaggaacccgacaauuuuggauuuuaggcaaggccucucucuacacccagaguaacaacuuaaaaaaauuauuuuaaaguaaggagguuuuagaaacauaaacucuuauaauaguggaucuuuugagagaauggaaaguaagucauuuuccucaucuaaacuuagcuucugcccccaugauauugguaggaggucgagaaauuugacugugagaauuaugugaaucuuuauuccucuuccucuauucugaccccaggugaguggggacagcucuugccuggcauuucucccacuggcuugacccauuaauggcaacugugaaaaggucaacauuuccaggcugacauacugaccacauuuugugugggagaucucaacaaaagaauauuuguuucugggaggcugacauccccuuuuguccauuaagccuguccuuuccaucauuagauugugaaccuugucagaauuaaguagagcuuaaaaacaaggaaggaaugaguaaaggaaauuuaguuugcuacaucuaaaugcaaauugugcaaaaacagaugggugagguaagaauggacgucauuccuggcgugacugcagguacucuuggucuacaccaugauccuggaaaaggaggauuuaaucaucugaguuauuaaccguucucauuaccuuaggcauugugacucugcuuccuauugauccuagagcuaaggugccccgauuuauaugcaaacucuuguuuaccugcccaauaagugcaaaagggcuuaagcaggugacuggggccucacaugaagugacaagacuauuucugccuagaagguacgggagcugagcgggacugagcuggucugcaggaaaggcaagaagaaauucugauuaucugucccaaauagagccauauccugucuaugagguggccagcuaggagaguggaaacaguuuagaucuuugucuuuggcuacugguccgagagaaguugcuguucuucuuuuauccuugguagaaaaccuuuucuucaucccuaccuauucauugcuagagcuggaggccaaagcaaaaugacagacuguaauuuuauaugaguuauuuugggacuaacacucuuauaauuaugguucacuuaaauauuauaauauuacuuauugcaaaagcaauuuauagggaauuggaauuuuuuuacagaagaaaaaaacgcaccgaagauuuuauuauucuaauauccuugaaguuagcccggugugguggcucacaccuguaaucccagcacuuugggaagcuggggcacgaggauugcuugagcccaggaguuugagaccacucugggcaacauagugagaacucaucuguacaaaaaaugaaaaaguuagcuaggcacagggugugugucuguagucccagcuaccggggaggcugaggugggaggaucgcuugagucauggaagucgagguugcagugagccaugauugcuccacugcacuccagccugggugacagagcaugacccugucucaguaauaauacccuucaaguuuuucccuauauguuugcauauaugguuuucauauuguuauacacuuucaugaucagauacuccauaguagauggguuggcugauaugaaaggauuuuuuguuuuguuuuauuccuuuaauaugugucaucaacaguuuaaaacuuacagggauuuuuaauacucauuuagugccaguugucuuugaaacaauauuuuuaucaaagauuguugugacagagaagaauaucuucaugguuuuguuuuggucuucacuuggguaacaaguuacugguauuuggagaacaggagagacuauuuuccucagauuucgaaauggcaaagcauaggagugagguuggagaaaccacagggucuagcgggaaagucuuuuacaggccacacucaaguccugguugggguuagcuucgcuuagcagauuccccagcguaggaaauacugaccuaguucuuagauaaucucugaggaguuucucuguaaggguauauaaguauccuaaaugaauagguggaaaauacaauauaaguacuuuugugagccugagggacucuucuguaagaucaaagacaaauauuuuaguuugacugagaaaggagugaaacuuuuuaaauaaacaacaguauuuauuuuaauagggagucugaggucuuuccaguaggaguugggaaauaacuuuuuuuccucuuaaacucaugcugcacaauuaaagaaaaauguuuuuucucugaaccuuuccuucaaauacuuggcagagauuacugccagaagaaugagaugggcacaguggcugaugccugguaaucccaucacuuugggaggacacgaugguaagauugcuugagcccaggaguucgagacuagccugggcagcauagggagacccaucucuacaauuuuuuuuuuuaaagccaggcagggugguaugugucuguggucccagcuacucaggaggcugaggugggaagaucacaugagccugggaggucgaggcuguagugagcuguuaucaugccacuguacucuaucuagccugggcaacagaggcuagagcaacucugucucaaaaauaaaauaaaauaaaauaaaauaaaauaaaauaaaauaaaaaaaauaaaaagaaucauuugugagacuugagagacuuguaccauuggauuagaaucuuucuugguacuaaagucugaaagagcuggacuugagcuagguuaaccauccauuuucccuaaccuucaaaagcucaccuagucuauccugcggacaaggauauaugugcuccacgauaccgaaaaagauacugcuggggcaagaauuagccugucauacaaagcaauaaacaauaccaagagccaaaauuugacuucaguggcagcuguuuccuagagcaguauuuguuugaguuuccuuguugcaaagcaugcagcucacaaagugccccaaacuggcuuaauaaguuuuguuuguuuguuuauuuguuuugagacggagucucgcucuguugcccaggcuggagugcaguggcgugaucucggccaccgcaagcucugccucccggguccacaccauucuccugccucagccucccgaguagcugggacuacaggcgcccgccaccacgcccagcuaauuuuuuguauuuuuaauagggacgggguuucaccguguuagccaagauggucucgauugccugaccuagugguaugcccaccucgaccucccaaaguguugggauuacaggcgugagccaccucgccuggcuuuuuuuuuuuuuuucgagacggaguuucgcucuuguugcccaggcuacagcgcaauggcgccaucucggcucaccgcaacccccaccucccagguucaagcgauuuuucugccucagccucccgaguagcugggauuacagacaugugcuaccauggcuggcuaauuuugcuuuuuuaguagagacgggguuucuccauguugaucaggcuagucgcgagcucccgaccucuggugaucugccccuucucggccucccaaagugcugggauuacaggcgugagccaccgcgcccggccaauaaguuuuuaaugucuucagaauuuuuuagaaagcgucaacuuucuuuaaaaauaauaggacccucucaggcuacaaauauaaggagaagggaaggagacccacccuggagaguuuuggaggugaaccccgcugugauuucauggacaacauggauaucucuguuugguuuaauacaaacuuugaccagcuugauuugggggccuccuguagccauagcacacacucuucaguuaucaccaccuauuccuuucuuccuggcuucucuggcauuuccagggggugcaggaaagggcugguuuaaggcagcuggcauaccuuccuuucucucaggcuuccucacuccuaggacuguauaccauaguuucuucccaucaaaauuucguguuccucugcucauugcauuucauuguucagcauaaauucaggguugauuaccccacaugacacccuacauggcugaaaaugggguggauguuucccaaaggaaauuaggauuguggucaggagagaaggggaauagaucauggguuuaccuuaacaauauguuuacccuaagaaggguuguuggauaaaauacagguauucaguuaaauuugaauuucaaauaaacaauagguaaauuuuuaguuuuaaguauaucccagauauugcaugggacguauuuguacuaaacaaauuauuuauuauuuaucuggaauucauauuuagcugggcaucuugcauuuuuauuugcuaaaucugaugacccuaggucccuaagaaacuucucaugucucauuuuauguuuuuuguuagcuuaccuggccuaagauuucuuugcuuuggagaggugcuggggaguggcacggugggcaggauauuacacuugugugaauuaagagagggcagggcauaaauaaaguauuggccaagcagcugcuugguggccucaggacggaguagguguucaacaaccugugcgcugugugccaagguugggcaacaccuuguuuuugauacuauucuuagaugcaccuuuaugcuguguguauuucaucaccccaugugccuacacauucaauaugggugguuuuccaauugaugcucuuuuguaguccucgugggaagauaccucugguaucuucccuuggaguauggaaaaaaaggaguagaauuuuaccucuaaccaaaaacgcucagccugcuuugggauuuucaaugcuaauuacuuuaguaaaguaaaaauuauuuuucuauacugaacaucacaucaguucuggccauuuuuuuuuuuuuuacauacuauagaauauguauauacuugaaugcaaacauucucuuuaaauucuagcucaaacaagauauuauuagcuugguuuuauauauugacugauuucaacuggauggauuuuaagggaggaaaacccauaggaaauaugauccugaggcaccgaggaugguuauaggacguggucugcugcugcauguugcauuacuguaugcuggguuuuugguacucuuucucaaggcucuguuauuaguugguaggcuccaguaaugaauauagaggacugacagagugggauuaacuuauuugcaauuguuuccuacugaaaucaaaugcacgguuuucccaauuuaagacuuggucccuuguaccuugauuugauucagaaagccaucugugauguuuuuguuuccuggcgccugcaggaaaacucauuugucaugaguuacaauuaccuugcagucauugcuaugugguuguagcacacucauugcuaagaaugguuuaugagugucaccuuaauccaugagcucaacugggugucagacgucuaggaagggagggacuugguagguacuuaaaugguaaacucagggugcugcauggaggugauuaaggagguggcauuugguuugagucagggcuuuuagugcuaugcauagaacaacuuguuuccuuuugagaauauaauuguuugcaugugaugcuaauuuccgcuuuuuuuuuuuuuauuuggaaucucgcugugucgcccaggcuggaguacaguggugcagucucaguucacugcaaccucugccucguggguucaagugauucuccugccucagccuuccaaguagcugggauuacaggcaugugccaccaugcccagcuaguuuuuguauuuuuaguagagaugggguuucaccauguuagccaggcuguucuugaacuccugaccuuggaugauucacccaccuuggccuuccaaagugcugggauuacaggcaugagccaccauaccaugcucagccccuaauuuuugcuuuauuaaaacaaaaacaaaauuugagucacuauaauucugucacagaaggcagggaugaaaaaggguagaguuggccgggcgcaguggcucaagccuguaaucccagcauuuugggaggcuuaggcggguggaucacgaggucaggagaucgagaccauccuggcuaacaugaugaaacccaagcucuacuaaaaauacaaaaaauuagccgggcguggugggcgccuauagucccagcuacuugggaggcugaggcaggagaauggcaugaacccgggaggcagagcuugcagugagcugagaucgcaccacugcacuccagccugggcaacagagcgagacuccgucacaaaaaaaaccaaaaaaaccaaaaaaaaaaaaaaaaaaaaggguagaguugucuauuucacuaacaaccaacuuuuccugaaaaaggacuuucuguaaagauuaagaaugguacgggcaugguggcucacacauauaaucccagcgcuuugggaggcugagguguguggaucacuugaggucaggaguuugagaccagccuggccaacauggugaaaccccaccucuacuaaaaauaaaaaaauaaauaaauaaaauaaaauaaauaaaaugaauuagcugggcaugguggcacaugccuguaaugccagcuacuugggaggcugaggcaggagaauugcuugaaccugggagguggagauuguggugagccgaggucacgccacugcacuccagccugggugacagagucaaacuccaucuaaaaaaaaagguuaaaaaugauuaugauuucuuuuucuaaguuuauuaagaaacaguacguaucaguucauuccccuuagcagaagcaauguuauuuuagaaggaugcagcaaacuugaucuuauauagucccaaguguggcucccaucuccaaggugguagccagccuggacagcuugaagaacagagacugggcuguuuggccaugaaugcagcacagaauauagauuccugucucuggcuugugugauggaggguggacuagucaggacuguuccagcugaagaugacagaggucuagcucacacuagcuggugcaugaaccaagugaggccaagguuggcuccagauccagggacuucauuaguaucauuuagacuucucaucucucugccucuuggccauauugccuucuccauuggcaggaauauggccucaggaagguugggcauccacaucccaaacgagcagccucuaaagggacaagagggcuucccucuacccgcccucacccgcccacuucaauguaugccaguaucuguucauuugaccuccugugagcucagcagagaaggguacuggauuguucaucauucaggaaucacagaguuagaauggagaaagauuuaguuccucaauggaaguggucaugguagugguggggagggauguggccggacgaagggaagugauucugggcagacgauaaccacauacuuucuccacagagagugaugcaagccacaugggagauagggacccuagccuuaacccuguagccuggcuggagagcuaagcauauaugcaagagagcacaacauugccaaaacuacaugaagguaacgaggagaugcagaauuaagugcagccaugaagcauggcccuucagaaaggacugugagguucuggcauuguauauaaauucccauuugccauaaauaguagcccucuaguuugcuuaucaggauuguaucuucucuacacggucacauaguggaugauuagcccugaaagcaauuacauaauuuccacuuauacagauuuacauuuacccauagaaaguauuucucuccuauucaaauaaggaugucagaaugcaaguucguagaagugaugucauucaauggacaaaaaauggauuaauucaucagaaagaaagacaacauauauugcaaacuuaaaugaugugggaugccuuucacagcuaauggcaucauagcauggccuuugggacugcccagaauuccauuuuauagcuguacccuacuuuguucaucuagccccucuuacugagcauuuagguucuuucccauuuucacacuuuaaauggccauaugauaaacauucuuuuuuuugagauguaguuuugcucuuguugcccaggcuggagugcaguggcacaaucucggcucacugcaaccuccacuucccagguucaagugauucuccugccucagccuccugaguagcugggauuacaggcgugcaccacaacacucaaauaauuuuguauuuuuuugguagagacaggguuucaccauguuggucaggcuggucucaaacucuugaccucaagugauccacccaccucggccucccaaagugcugggauuacaggcauaagccaccgugcccagcugauaaacauucucaaagauuuuuaagaugcauccugagugcuucauuagaauuuguucuuagcaauggaauuacugaauccaaggcuauuauugccauaaauuucgauggggauaguaaggaaagaauaaugauaaacucagacccacuuuaguggguuacugaaucgagcacauuauuauuauuauuuugagacaaggucucacucugucacccagacuggagcgcaguggugugaugugagcuuacugcagccucugccucucgggcucaagugauccuucucccucagccucccgaguagcugggacuacaggcaugcaccacugugccuggcugauuuucuguauuuuugguggagauaguuuugguuugguuuugguuuugguuugguuugguuuugguuuucgccauguuguccaggcuggucuugaacuccugagcucaagagaucugcccagcucagccucucaaaauguugggauuacaggcgugagccacugcgccuggacgcacgcucacuugcuugcuuucuuuuucuuucuuucuuucuuucuuucuuucuuucuuucuuucuuccuuccuuccuuccuuccuuccuuccuuccuuccuuccuuccuuccuuccuuucuuucuuucugggaaaauaugguuugguuguaaguacaaaaagauaauuaucauuguuauauguuauuuguauuauauuauugguauaaauuuaaugucucuaauaaauuacuuugacaauuggucauucauauuuucaugguuuuugaaaacaaaguguaucuuucaaauaacaacaacuugauagaaaagaucauugcaccugggagaauaauaacaacaucccaaauuugcuuuaagguuauaccugaaaugucauugucagagaaacaacucauaagucuggguuaaaacaagccucuugcugauuuugaggugaucaaauuuaucauaauaaaaaaauaguuauuaccaaucaugucauaagacuggggggcaugcagugagcagaagcagauagguugugcaggaggagggugugggauauggauucauaaucucuaccaaaauauuuuuuagauaaaggugagugagugagaguugaaauaaagauaaggaaaguucaaugauugauuaaggcauuuugacucuuugggucccagagcagacauccuuaugguggcaaagaaaaaccacguaacuaauucggaaauugugccaacaacauguugaaacaguaguagagaaauucaaaguuuaauguuaggucacugguccaucguccauguacaacuuugagaacaccuguaaugcauuacaucagacauuaaaacauauguaguuauuuaaaaacugaucuguaauauaacugggcauagaccauauuaguaugauuucugucuucugagugaauguuuuauuuggacuucuuccucucuuuagauuuuugcucuuccuguauuuuuucuuucuaucaucuuuagcaaaagauugcuagugaaaggaguugcaccugguuaccuugauuaacacaucaagagcucuggaaaaucugguugcuggucuccaaauaguccugaccaugggaauauacaacaagcuacuguggugcagcggucucuugcucucggggccuuauuuauuacagcacuugcugcuagcauuagucacuucuguuugggcacugugguuuucugcuuccuuccaauaacauuacuugaguuaaaaaaaaaauuacagaaauguaguuucacaaagacuucugugauuagaauuacugucuggaauuuuuaaaagcagacagcaaagaagcaaauuuaagaaacuugaaaaguuuaaaaacaaggacuguuucuuuauaagggaggccuaaaaacuguuggguucauauuuuuugcccuuuuaaaugccauauuuaguauacuucaaaacaguuuaagcaaagcaaaagcugagguagaaaaagcauguuauucugugacauuuucaggacccuaaaguaagaacggcagcacauuuguuuucaggaaccugugguucauucagcaaaauuaauuccaauacagaauuguuccuaucaagggugacauggauucuuuuaugaugcuccagauuucugguaguuuguuugcauucucuccacuugugucauucugagaaaagagaauagucauaggacacuacaguugaaaagcuugagauucuuguguaaaggcugauguguguggucuccuagcucugcauccuagaggugugguuuauucccccauguggggcagaugcaauuguaacuuuuugcaauggaaaugcuguuaguuuccagacagaugggaugugagcuggaacuugaggaccuagauagauaaauaggaccuagauaaaaaugaucuaggcauuuguguuggcugcuauaaaaacauccucugucauguggaguagauaagauacucuauguuguuuuaaagaagucuuuuacaaagaagaugagugugugugugugggggggagcgguggaggaggggugcagaagaacauaugagauccagcuccccagaggaucuuccuuaaggcacuuggaacuaaguuugaaggcacugcccacaaauucucuccuucaucaagacuugucaauccagcuaagcucuguggucacaccuacugucaucuuagaagaugaauucugugguugccucaauuuaauggcugaccaaagagguuccaaaaagauccaguuagauccucaggucucauaucauggagguugggguguccaugaccucuguuuaugcucugugugccacgcuucccuuuauggguucuuuaucuaaaaaauaaagaaacugaguugucugaaacccucuuuggaggaggcaaucugguguagugguuaagaauauggauucuguagucagaauguuuggguuuugcaacaucucuaaacugagaugauacgaaaacaccuacccaacaaagcuguuucuaggauuuaagaaagcguuuuucuauaagagugcuauaagauggagcccaggaccaaaauacaucaaagcguguagauguuaaauggagcuaagucccaaauugggugacuaaaggaagguguaaugauggaauccugggugcuucuaauggaccaccaauuuggaaaacaaaauuuagaaaucgaucugugagauccugagagaacgagaccauugauauaauaugaucuccaguuucagccugugcgaggauuaaccagcaacccaagaaggcaauauuacuggggccaccacauuuuugggcaagaaagguaaacugugucccuuggcagucaguucaagccuaaaccuaaaguaguaggcuugaacaaaauuaccuuuguugugcucuaauaaaaauaaacagaguguggagauugaagaaaucaucaaccagugcuauauaccuguuuguuuguuuguuuuuggugacaggaucuuacucugucacccaggcuggaauacaguggugugaucauagcuuacuguaaccuggaacuccuaggcucaagugauacucccgccucagccuccugaguagcugggacugcaggagcaugccacuaugccuggcuaauuuuuaaauucuuuugguagagauaggauuucacuauguugcccaggcuggucuugaacuccuggccucaagcaauccucucaccuuggcgucucaaaguguugugauuacaggugugagucacuaaucuggccugguuccuuuuuuaauaauacuacugacaaacacugccucguagaaacuccugucagcgugaagaguuggaaggggaggggaacagugcuauuuuucuucuucaagaaguuucagggggcuccucauaggauugccuucaggaguguccauacucccugccucucuggcuguuucuuaucagcuaaaugguacaaccuccaagaggugugacugauggugaauuucaucucuuucugaaaggugccaugaaaacaugcaaggcuauuccucucugccauuguuucugucugucucucagcaggauaaggucaugacagaauggcacguuuaucuuggauuuccuuguuuggcaagcagccuggauaucucuggguugaacgucucuggguaucucacagacgucaauggguugaaggagauguuggcucuugcacugauucuuucagaagcccaggaggugguggggaggggggaggagaagaggggacaggauuguacuugucgugucacugcccucucaguuggagcuuccuuuaccuuuccaggcuccuacagcguggagaggcagccuaguauaaugcaaggcacagagacuuuaugucuaaauagagcuguguucaagucucgacucugccuauuuuaagguuuuucuccuauauacuccucaaaaccccuguacuuauucuucgaugauauuuuuucacaucugacauuacaucuuucucucucucuuuuucugcauuugucuguaagcuuuagauauguggggaccacaucuuuuucauagcuauuagauuguuaaacaguuucuggagcuuggcuuacugagcuucaaacgcuggcugugugacauuggguaagcucucuagccucuugccugccuugggugguguugucaggauuagagauaaauacauguuguaucgcuggcaccaagaccagcacagauggaugcucgagagauguuguucuccuuaccucaagcuugguaccagcgccucagugucugcugaccccaccagcaugcccggauguaucuguuggcugcaagacauuguagacccaggcuuguagccagccugggcaggcagcuuguuggcucaaggaguccuucguacuguucuucaguccuucgaaugucuuauucucagacgcucuucugagaggacaugccugcaaagagcacaggcuuuaucuuuggaaucucuuguuucaguccaucccuaagaaauugacaguagccuuuaaaaaguaacccuuaaaaguuauuucaaaaguaauuauaguucuuuguuaauuaagggggaaaaaucucccauagucuaucauuuguauaucuacuguuugcuuugguauacauccuuccagauuuuucuaugugcauguacuauaauaacguuguuuucuuuuagccaaugguggaauauucugcauuuuauuuuuguauccauaggagggauuuuucagaguccaugaauaauauuggacucugaauauugguaugauuuauggaacuuuauuuuauuuuacuuuauuuugagacagaguuuugcucuguuucccaggcuggggugcagugaugcaaucccugcucacuguuaaccuccaccucccggguucaagugauucuccugccucagccucccaaguagcugggacuacaggcauguaccaccaugcccagcuaauuuucauauuuuuagugaagacaggauuucaccauguuggccagacuggucucgaacuugugaccucagguaaucccccugccuuggcaucccaaagugcugggauuauaggcaugagccacugcgccuggccugauuuauggaauuuuaaaagguuccaaauccuuuguuagaaugaggccaguuagaaauaaugaaaaguggcuaauccguggaaagccauaagccucuagugguuuugaacuugaagaagcacagcaaagcacacacacugugugugcauugacuuauccacaugcuacuacauaagccuggagagagauggggacagaaggaaagagaagacggauugcacacugcuccaauccaauugcccuggagugagagugagaugagaugaaaguucguuuuuccuucugcucaucaugguccccaggagacccucaaauugugaccaccuugucauggcacaagguggcuccuaaauggaaaccagcuaucuucucagcuaucuguuccaaagcgggagguaaaacugggugugcugguuuuaauuaagagauagcaugucuaaaaauggcacauaaacuuaauaugcaguuaggagauuuucagggacauuuuuuuucuacauuaguuucgcauuuucuuggugacuuuagaaacuaacccccuuauuagacucucuggccuaugcacauaaagcaacauuuacucccucccucccuccuucuuacuuuuucuuccacuuuaagcuucuaguuugugcugggacugcgggauguaguaaugaauaaguacauggccuuuguccuaaauaacuuagguucaguuuuagaaagaaaucugaaaaugacuucucauaauaccuggcagaaugaaagaaauuuauuaaaagagaggacagcaggccaggugcaauggcucaugccuguaaucccagcacuuugggaggcugaggcgggcagaucaccugagguugggaguuggagaccagccugaccaacauggagaaaccuugucucuacuaaaaauacaaaauuagccaggugugguggcacgucccuguaaucccagcuacucaggaggcugaggcaggagaauugcuugaaccugggaggcagagguugcggugagccgagaucaugccauugcacuccagccugggcaacaagagugaaacuccaccucggaaaaaaaaaaaaagagagagagagagaggacagccauuuuauuaggaaaguacagaggaagaaauacguaguucuagccaggggauuucauuacaugggauuacagagaaggguguucccugaacugaauuuuuaaagauagggucaaauuuucauaggcagaaagaaagggugggaagcggacauucucaauuaaggggaaaaaugagaucuuauggaagcuuuaaagccugagacauuugagggaacagaauuugagaauugagucugcgaugagacaggaaaagcccacaggcaguaaaaaaugccgguggcugagugcaguguagcuuccacugaacucuguggauguuuaugcuuauuugaaccuuguuggaauauuccugguuuguuuuaugaagggaugucucucacugaggauauugacucagggacguuuccucuuucagucaggauggccuccaucagaccaauauuguucucaggccauuuuuuuguuuuguuaucuuggauaaacagagagaggcugauucauuuuucuagaaaaacaggaugcacuaaaauacugcaagugacaaugaaacagacaugcucacguacaauaauauuuauaaagggaccaaacaauauauguagcagacaccucugugguguggccgcuaccccuccuccaucucacuugccuugaguccuuggccaaguggguuguuucuuucgaucuguuuccucagauaucaaaugagaccaauaauaccaacugaacaggcaugucucaaggaauugaugaguaucaagugcuagaaauagugcugggcacguaguaaguagccauuccaauagagcuuaauuauuugugcacuggguacgaaauacugauucguaauuggagcaauauauauucacaaugauuuuuuuaaaacuuuguauuauggaaauauucaaauauccauaagagaacaguaugauaauuucccacguaccuaccaucccuccacuucagcaaucguccacauucugccauucuuauucauugauccccuuccucuuuuagaaauguuuuaaauuuguaaugguuaacugcuaccuaaauuauuuuaaagcaaauucuggagagcauauaauuuuguguauagagaguuuuuaagagucugauaaaucagugaccaaagaagaaauccuuauaaaaaaaugguugaaaccaguguuuugaaugcaauuuucagagcugaauuauagguauuucugcaaccaaauuaggacaugucugcaaaucuuuaagaguggcauuuugaaaguucaguauuguuuauuucauuuaaggagcaugccacaugcuggucugcacauagauuagcacuuaggugcauaugcaaaacacuuuuuucuaauggaagauuuaaaacauaccucaauacuaguagacuaguauaauguaccccccuguaaccaucaccuaagcuaucuuuuuuuuuuugagacagaguuuugcucuugucucccaggcuggaguacaauggcgccaucucagcucacuguaaacuccaccucccugguucaagugauucuccugccucagccucccgaguagcugggacuacaggugcaugccaccauacccggcuaauuuuuguauuauuaguagagacaggguuucaccauguuggccaggcuggucucgaacuccugaccucaagugauccacucaccucggcuucccaaaguacugggauuacaggcgugagccaccaugcucacccuaagcuaucguucugaugucuccuuuugaaagauguucauauuguuuguaagagacuucuuaggucaaaagagccuuaaugauuuuggaggaagauguagaaucaaacauuuauauuacacuacaugaaaagaaauucuuauucaucagugcuauugccuuugaaaaguacagucaguacugcuugauguggguauguucugagaagggcaucauuagauguuuucaucauuuugugaacaucauagaaaguauagucuacuacacauauaggcuauaugcauagccuauugcuccuaagcuacaaaaacuguacaguauguuacuguacugaauacuguagguauucaaugguacagugguacaaauacaaugguaaguauuuguguaucuaaacauagagaaagguaauguguugugccacgacauuuccacagcuacgauguugccaggcaguaggaguuauuuagcuccaucaugaucuuaugggcccacuguugaauguaccaucuguuguugacccaaaagucaugcugcacaugacugugugucaguaauagcucucagaggaacugauuuucccagaugaaauauaaguaaaaucugauguuugaaagcaguucaagcaagaccccucaaaagacauuuaagcaagaacacauuuggaagccaguacugaaguguuaguaauggauagggaaguuauguauuuucucuucuuucuuuuuuccauucaucuuucucucucucucauuuuuguuuaucugcauuuuacaauuuuuuuuuucaccgugaguguggauuuucuuucaccaugaacauggauuauuugauuguugaaaaauaacaaaagcccagcuggguguaguggcucacaccacuaauaccagcacuuugaaagguggaggcaggcaggucgcuugaguccaagauuucgagaccagccugggcaacagugagaccucauuucuacaaaaaauuaaaaaauuagcuggguauggugguaugugccuguaguuucaacuauuugggaggcugaggugggaggaucacuugaacucagggagggucgaggcugcagugagccaagauugugccagugcacuccacccugggcaacagagugagacccugccaaaaauaaaaauaaaaaaguaacaaaagaauauaaguuaguaaaucaaagaagagaugccgggaguggagauuggcuguauugagaugaguaugucaggggcagauagauaauguuucugaaccagcaagcuuuuacccuucaucuugcugcuugucuuuaacccuuuccuuggucccugggucuugccucugcauucucauuacugaugguagggagugguacucaucuucaugacauaaucucauuaggccaagagagaggauaauuggccauaguuccuaggccaguccccuaagcuguguuaggcuuucauauaugauucugucugguccugugccuuuacauuuccuggucuugccuucugagacugcccagguuuuaagagguggguguugggaaaggcuaggagaugguggaugcuggaagacaaaacacuagcagaguguagucucuccccuuaugauccugaaaguauaaaaagccaucucugcucugcugccagccuacccaccugcacuuuggaagaagagcuguuggauauuucagaaugguuuucagacuggcauuggaaccguguucuaaaguuaacgaugauggaaauaauuuaguuguagaggacucuagacaggcuuguguaaagcaagcagguaaaggaauaaaacauuaaaaauuguguaggaagagauguuuugagguaucaguguagguggauugugaguggagugacauggggagggaguuaagaggagacgauguucaugguuaaagaaaccauuuauacagacgugacgagugcaggaauucugaucucucauaugacaaaugcugagaauaacuccuauuuuccaugcuaauugcuaauuuacucaucacauugaauauccugcugguggaaaaauucaguguugcagccucauauccuccugcauaggaaguacucagugacccaagauguuagagucucuuuuauggcacuucccugaaaagaaaauauuauuacuuaauuggcaggcaacaggggcuuuuaagggacucauccgaacaccaccuguuuacuuacaaguacaaaggacaggaaaauuaauuacaaaugauaccuuucucuuaaggguucuagguuuccagugcaaaauaaugaugauccaacugccaaaguauauacugguagguggaguuuuuuuuuuuuucuuuuccccuccuauaauggauuaaguuaaucugugagaacguuuacccaaugcccauuguaacaaaauuaugugaauugaccagauuucauuaaguauaaaaugaauguaccucgaacuuggucuuugauguggauuuugagcuacuaucaggccacaguucagguauagcaaggauaugccccaaaaaagcauuccuguuugauuauuugguguuugauuaucagaauuucuggucuagaauacaguccaggugguaaccuuuccaauaugagugucuuccuaaggugggucaugagauggguuggagaauccaggguucuaagccagucucuugccccugacgccauaugggacaugaggugaguugcccaguuuuuaucauuugucaaguaggaauaguaaugucugaugugauugaggauuaaauguaagucuaggcaauaauguaaauagaaguguuuuugaaauuaaacugacaugcaaacuuuugauugaucacaguaaucaaucagugaacaaacauauuugugagcuauggaauuagccauaaaugugaaggaagcuagagaaaaggggaaugacauuuccaguaagcuagcaaacacucuggagcuauguuauuaacuguuaaaccauguagucuggguagguaucauuagccacuuugccacaacuccccaccucauauccuguaccccauucaaauucaguccuuucauugcucagacucaucucgccuuggccauucugccccucacaauaugauuuucccauuucugccuuuugaaacguugaguaaucaaaacuuagaucaaaugucaguucuuucauauagucuucucugauuacuccaguuggauugaucccucucuggccuaugucagggauaggcaaacuuucugaaagaguccagauuguuuuuuggcuuugccagacacauggucucuguugcuuccacucaacugugccauuguaaugugaaagcaucuguagacaauacauagauaagugaguguggccauauuccaauaaaacuuuauucacagaaacaagcugccagcuagacuuggccugcaggcuguaguuagcugaccccuggcaugggucauugucuugcuacgcagcuuucuugguucugcguacauuuugccuuaaccugcauguuaguggccuucuuuuuaaaaaaaaaguuuuuaaaaacuuuuacuauuauucuuauuuuuaaagaugaggucuugcugucacccaggcuggagcaguggugcaaucauagcuuacugcagccuugaauuccuggggucaaucuaucuucccaccucagccuccugaguagcugggaucacaggcauaugaaccaccaugcccagcuaauuuaaaaaaaauuuuuuuuuuuuguacagauggggucuugguucacugcccaagcuggucucaaacuccugacuucaagcgauccucccaccuuggccucccaaaguguugggauuacaggugugagccacugugccuggacaguaaggcuucuuaugaacagcaguguccaggcuguuuucuucuuuugagucccccggauguuguauaaauaggagaguguucaguugauguuugacaaaugagugaacagugaaugaaugguggcugcuuucagaaguuggcaacccugcuguccuucuggauggcugagcucuuccagccuucuggcguccugccuccuuucccuggccugcccugcuagaaagagaggagagaaggcaucuuuucucugucuuccucagccacccuuccacuucuuugagcaacuacuauuuacaacucaaagaauucuuuauuuauacugugugagagacuguuuacccguguugaacuaacauuagguuucuuuaaaucugcuauuaaaacgaagaguggccauuuguaacuuuaggagcauaagagcuggguucaugauguaagugaacagagacacccuuaaaguuauuucccaaggcccugggaaugcgauuuucuuaguuuauuuguuacaagggaguguuuuguacauugguagaggaaaauacuaugaaacaaaaucaaacaaaaacaucauuacauuuuaaaaucauuuugcaacacugagcagguaugaauuugguacuuugcuuguaauuggaaaacuggaaaguugaaaauuuaaguauggauauuaugauuuucaauuuuuagaagauguauaguauauaauggcaguuugcauuugauguuagaaagaauagcaucucaagggaaaacaaaaaugcuuuccguuccagaaaauguuaaacauuccuuuuuuucuuaggauaaacucacuacuagcuacuuuucuucugccugagcccuucauuguaaaagugaauuaauguuguccucugaauucuguuggggaaaaugacacagaaccccugugaaugaagaauugcuuuuaauuucacuggacgugaggcagaggaggaccuuggaaaaggaagguuauuauuuccucuguggaaacguuuaucuucguuuucugggugacugguaaaaacaauaguuugcuguggaguuucaguaaucaaagaagaggaaauagcaugugagugacugcaaguugguggggacaacccuggcucuuuugaaggugaaacuuacuaaagccacauuagcuaucuccuagugcaaaggucgagaaacauuuucuguaaagggcuagagguaaauaguuuagacuucaugggccauaaagucccuguuguaaauuuucagcucugcuguugugguaugagagcagccauagacaguuuuagaaacaaaugagaguagcuguguuccaauacaacuguauuuauggacacaaaaauuugaauuuucauaugucacaaaauaguauuauuuuaauuuguuacaauuauuuaaaaauguaaaaaccauucuuagauucccuguuguacaaaaacagguaguggguaggauuugggugcagggcauaguuugcugacccuauccuggugaacuagcgcaauaauuucuuagguggggagguguaguggauaacacauuacacauucuguaccuuuuaguagguaauccgauuaugauuagcuaacccaaacuugugaagaaaauuuccugguggaguuggauggcuuugaggaguccaguguucuugucccugcccuguuaguguaaagcugaauggcacuuuggaccuuggcugcccaucugguacaugaugaaguuggacuagaugacuucuagggcuucguguagagcuuaacauuuuauuuuaauuaauuaauuagguuuuuuuugagacaaggucucacuuugcuacccaggcaggagggcaauggugugaucagggcucacugcuaccucuaccuccaaggcuccagcaaucuucccaccucagccuccugaguggcugggacuacaggcacaugccaccacagcucacuaauuuuuguauuauuucuauuuuuuuucuuuuguaaagacaggguuuugccauguugcccaggcuggucucaaacuccugggcucaagcaguccuccugcuuuggccucccaaagugcugagauuauagcgcgugagccacuugacugaucuuaacguuuuagacccuuuaucacuuguguuuugguucuucuucugauaauuauugcaauuuaccuuuuaaaaaauuauuuaggccuggcguggugacucacaccuguaauccuagcacuuugggaggccaaggcaggcggaccacuugaggucaggaguucgaaaccagccuggccaguauggugaaacccccaucucuacuaaaaauacaaaaaaauuagccaggcgugguggcacaugccuguaguccuagcuacuugggaggcugaggcaggaaaauggcuugaacccaggagauggagguugcagugagccaagaucaugccacugcacuccauccugggugacagagcaagacuccaucucaaaaaaaaaaaaaaauuuagauauuuguugagaaacuaauaugugcuaacugugcaggcucuggugauggugguugugugugugugcacauuugugugugugcaugugugugaaacagaugguaggguaguuacaauacaaaaauguacauauuaguauucuaaauaaauuuuuuuucuauuuugugcagucuuucuugaaguuauaaaaacaauauaaugggcaauuaggcauuuacacuauuuuuauuaaaaauaauaaauguauaugaauaauuauacucagaauucaacaauaucagauauugauuuuugcaguuacuuuaguuauucauuuauuuauucauucauguaacaaauaguucuugaguaccuaccauguacuucaaggcacuggcuuaggccuugaagacuaaacuauuugcccucacgaaacuugcauucuaauggaaucuccuguugaagaugcuagguagaugguuuuauucguacuuuucagaggagguguacuuauucauuacuuauuuuucuuuuuuuguuucaguuaucucuugggaaaucucugaguaauguuuuugaauuaccagaggaaauuuuacagucacacaggucuuuguugacuuuugcagucgccuaaaguuguuaaucauugaagagaacucugauuccucacugacaaagaaugaauucuaucguuuuaguuauauuaguuaauuuggaaaguacuucaaucaauuuaaaacuuuagggaagaucaauucaguaaguucuuuagaaaaucacuacgucaaggcugggugcaguggcucacaccuguaaucccagcacuuugggaggccgaggcgggcggaucacgaggugaggagaucgagaccauccuggcuaacauggugaaacccugucucuacuaaaaauacaaaaauuuacccgggcauugcggcgugugccuguagucccagcuacucaggaggcugaggcaggagaauggcgugaauccaggagguggagguugcagugagccaauaucacgcuacugcacuccaaccugggcaacagagugaaacucugucucaaaaaaagaaaagaacuaugucaaauucucaaaggucacugaaguuaacccguguuaucagucuucuaagcagcauuaguggauuuauauuuauguuacacauuucuccucauaaaaaaagauuucacaugcauuuauucaaugaauacuaaaaaagaugaauauuucaaaaaguaaaagcaacugaaaauaguaauaucuguuaaaacugcgucauggcuuugccuugauaucaugaguuuugucugcuuuuaugaggguggcauuuuugggcuuuacaaauaaaaaaauaccauuguaauaguaguauuauaaccguaaccaauaguccaacaauagcgaaagcauucacuguguaucacuccccuccaggccaccccggcuuugcucugcuucuagucagaguggaugccucgcaguucuuuuugaauaaaguuaaaucugacuucaggucuuucacacacacauuugccgcccuuuggaaucucuuccuucucugccuuuaucaucuaguuaauuccugguaagucucaacuugaaaggucuucucuuuauggaagcuuucccugaguuuuauguggacugaaguuuccccuguuagcauccuuacuucuucugagcaacuguaauuguuuaugucauuaucugacaagaagcuggaugaaggcggaguguguauugcccaucacucuauucucagcacuugguuugaaugagccuauaagugguauuuuacccaccccucacaaaagaagcuauaucaauauaagcuauuauucguguaauuuagugagaaauacugauguuuccucaccccauaguuuuguguaucuuuuguagaccucaguguuucaugaccuauauauuauaauguuuacugacuagauuuggucaguuacuauuugaggaaaugcugggauuucuuagaaauuuuaaugauaaaagaaugcauagggccagaauguuugaaaccaagacugccuuagagaaacccagggcauauagcagacacauuuuugaccugaaacgcuuaaagcggaaugggacaggaaaauacauaugcaugaaauaauuaguauguuucucagucuguccaggcuacuauaacaaaaauaccauaaacuagguggcucaggaaacaacaaacauuuauuucucacaguucugguagcuaggaaguacaagaucaagacaccagcagauguggugucuuaugagggccuauuccucauagaucaugccuucuacccgagucaucauaugguagaagggauaaacaagcucucucuggccucuuucaugagggccuuaaucccauuccaugugggcucugcccccaugaucuaacuaccuuccaaaggccccauguugggagguuauauuucaacauaugaauuugguggggacacagacauucacaccauagcaguaugccaccugugacaguaccuguuugucuuuauagcuguguucucuuguuucuccaguaucucagugguauuggacaggauauuagauucaggagaggacuucagaauguuaacuagugguaagaaagcagcuucaugggguggcuggggcuugagggagucuguaacucgggaccacauuuuaguaacuagagaaaauguuucagcaacuguauggugauaagucccuagucuaaaucucuagcacaaaucuuucuuuugagugcuggauacccuauucuuuugcccauuaaacacgucuacuugcaugcgccacagucaccucaaaggcaacauguccaaagcaaauucauuaucucacucucgaacuugcuccuucuccguuguuauggaacucaguaaccacauugcucaaauuacugccucacccauuauuucuuccucaccuaucacauccaguccuccaaguucucucagucccgccucauacauuuccuccauaaccugcucccuugucuauguuuucuaguguaggucacuacacuagaaaggucauccuuugcuugugcuccugcaauagucuucuaacuggucuccuaccugguagcuggucuuacucuccucugauccacucucaugcuguggccaaagugauuuucuaaaaagacagaugucuuaauuaugcaugugcuuugaagcuccucguuuggcauuuaggauaaaguucaaaugccuuagcuuaugagaggcccugugaccaggucuccacucuccaaccauauugaugaucuuacaguuucuccuguguauugugcugucuccggccucuggaccuuuagugcugcuccuucugucuaaauuacuuguuuucucaauuagugacccuucccuccuucagugcacaggcuuggaagccuauccaugaaucucacuacccugaaauccaagggauaaggugaccaugaaccucagcaccucaagccuuccauugacauuucccuccuuugcuccauggguaagaaugcagaacguauggcuucagcuucugugugggccuuucucuaugccugguuuuuccuggcaccuguccucccaccugccuucuggccugccagugugucugaucugagcagacugggagggugugaagaagggccaguaccgcuucagcaggaagggcagcacacggaaggccagcagccuugggcuggccugcaucugccccucacauacccuacagagaaacacugagcagcuggucagcaugugggcugggaggaauggggcugggcuaggggacuagggauuaaggcagcccuuguagcagcaacugugacacaaggagcaccuggcccuccuggaagucccagggcucuuucuuugaccuccuuccuucacuuccugcauuuucuaaauuguagcuaaaauuugagauagaacccuaagaguaaaaccuggcccugcuagcauugauuuccugagauuaacuucucuuuuagcuaaggagcaucucuggaugaugaguagagauggaagccaagucaugugcccuuaaaguccugugcaagcuccuucccgggaugugguggggugugcaugcagugagcugugaggggguggcccugucacagggaaugaggccucagccauugucuggcaguguuggcagugugauuuuaagccaguuauuuaacuucuaggucucagguccuuagccuauaaaguugggauaauacuuaucuuacaggguuggagcaugaaauaaauauuaagagaaucaaaagcaaaaaugcuuugcauauuauguaauaugaaacuauuuuucauguacuacuacuuauaguauuacuacuauuuauggaguuuaaaaaguuucuguguuuugaauauauuuaaugaacucagucuuucuaauuaucuguauguaucaugaauacaacauaaaaucuaugaccguggcaaaauacuaucacugaccuuagauguggccaauguguucuugacugagaucuguacagcuucacaugcuuuuuuuuuuuuuuuuuuuugguaugccgcuuauguagcaccaguagaggauuuuuuuuucauugacauuaucuuauauuccccucauuauuaggagaaaaugucaguugauuuucugcguuacuaaggacaugaacaaagaaaacuguguaacacaaaacuuucuguguggaauagagaaauuuaaucacugucaugauuucaucaguggggcaguucacagcuuuagggcaugccaaugagcuguaucacuucagaguuaaccaaagaaagaaauguaaugggggauggagaauguaauuagaguggaguacaagggggggguggggaaccuuuguaacuaaauuauuagcauuaucaugaagaaacugucuuuugaauuguuuuuaagcuaaagaaaucauaaagcaguguuuuuaugugacuauguaauuccccuuguauuugagguuaauaugcugcaaauucuucauaaaucuucauuaagaugucaaaauuccuugugaagccugucuucauuugcauucccuuguacaguuauuaacaaagacccuuuaugucucugcccagcuugauuucagucaugaacuccauuuuccuuuuauuauuucauagaaucugguuccuugauugaacuuaguaaaucauuucuugaggacuuggugggaagccagagagugguagugaggggggcaguuuaugagcccaggguggguggagacccuuguuccucaaagcaagacauuauuaacuuuagagucuccucuuaucagaucuuaaaaauucuugcccaaaguuaauaguuuuugaaguuugcaaauagauuucuacaguugaaaccuagaguagaaagaagccugguuauuuauuuauuuauuuauuuauuuaucuuuggcuuuaaaauuaggcuuuucuggccgggcacaguggcucaugccuaucaucucagcacuuugggaggcccaggcaagcggaucacuugaggucaggaguucgagaccagccuggccaacauggugaaaccccgucucuacuguaaauacaaaaauuagcuggguguggugaugcuguaaucccagcaacucgggaggcugaggcaggagaaucucuugaaacuggacagcagagguugcagugagccgagaucgugccacugcacuccagucugggcaacagagugagacuccgucucaaaaaaaaguugggggggaagccuuuucucaccaauugagugucaguguggccaguguaaacaaggaugaaaauagcuauuugagggguuugguggccacuuuaaaguugugucagggcaaugaucaacacuagaguuucaguuccuguugagaucugugcucucuaccuuucagucugugagacugagucggaauguccccaaguauuuaggacccugugacugcuggaauuucaggguugcucaggguccagagugaaaagaacgcugcugccaauaacgccuucccaucuuggguugccuuuguucacauagcuuugcuuauucuuuaauccaaaucaucagcucauuccaaaauaguugcuagcaaaaauacaugugaaugcucauucaagaauauaaaggauauuaaaauauccucuuauaucaugacucugcagacggaaaauucuaccugaacuuugccuuugguuuucuuaacauuuccucuuagcccuacguagauacauuuuucuccugugggggaaaauuuauuguuuccucauuuucccccagcauuauuugagugucugcaaaugcauauugguaguuuuucuaguaggaccugguuugugguuguuaaugguaaaugugaaaauuagauguaguccaggcucaaaaggaguuuaaaaucugauagaaauaagacuuuccacaaccacuaguguggcaaaaucucuguggguaaauguaacuucaagcauaauguacccaucucucacauuuugcucaaguugaauuucuuccguucugaggcagccacucccucuguaccauaugauuacauggcuugcuuacuugcuguacugccuuuagcauugucgguuggguguuuuaaaccugcacguuuuauuucucaaguagaccggaggauccuuaaaagguagccaaagaauagaauuauauaauauuuuaaaaaguaaaaaaaaaaaauaauuuuuuucauauucugggucauuguagcuuuguuuacaaggacuuuacauguugaagaauuggaggauguauuaguuuuggguuuuuuagguugguuuuuagagaaguauuaggaaguucccaaggggauugaccuuguaguuucaagaaaaggagaaauggucaugccugggcauuuuugggugcuuuguuugaaauaugcauccacuuggcuggguguggugccucaugccuauaaucccagcauuuugggaggcugaggcagguggaucacuugagguuaggaguuccagaccagccuggccaacacagugaagcccccucuuuacuaaaaauacaauaauuagccagguaugggggcucaccugugucaccuguggucccagauacucaggaggcugaagcacuaguauugcuugaaccugggaggcagagguugcagugagcugagauggcuccauugcacuccagccugggcaacagagugagacucugucucaaaaagaaagaaaaacuauaaaaaauuauaaaauaugcaucuaccucuugaaauugauacauuuuugaauuuggaaauguugaauaauuagagccugagcauaggucuauguuuugcuaagauaauguacuugggagggugguuaaaauagucauuaauuuuggucacaaauuuaaacagagcuugcuugacagggacagcuucucucuguuucaugcagugucauuuggaguggcuugacugggggacaagggauuaauuuucaagggggcucacccacaugacuagcaaguugguguugacugucagccaggcaacauuuucuuuccaagugggucucucuacaaaaugcaugagcuuccuuauggcaugguggcuggguuccaagagugagcauuccaugaaacagaaaguaggagccaugaguuggugccggaaacugguacaucauauuuaccauauucuauuggucaagcaguugauaaugugaauuuuaaauaggaaauuuuaugacucauggaaagacuuuauuuggauuucauuuaauguaucaaauggguaccccaggguggcuauugccuugaggaaggugcuuuauuuccacuaauguauaaaggaaggugccaggcccaugagguacaacuaaugcuuauuaucaauuuuauuuuauucuuccccuucaggugaguggagugagugucaaggacagaggacugaggucccagcuugaggugcuuggagggacagagaagaaucagggugaggaagcugucaggcuccucuuuucccuuuuggcccugugacuuuauuagcuuaacuaauacuucauaguguuugcuauguaccaggcacuuuacauauauuaacucaauuauauucccaucggggacuguguuacagguagaaucuuaauuaaagcuacugcuacugauucuuaauaauggcauuacuugaagagauuauuauuaauaggcccuugccccauuugauuacacugugugauauacaguugucccuugguguccggaaaggauugguuccaggacccuggaagauacaaaaauuugacgacgcucaaguccuuuauagacaaugucaucauauuugcauaaagccuauacacauccucucuuauacuuuaaaucaucucuagauuuacuuauaauaccugauaaaauguaaaugcaauguaaauaguuguuauacuguaucauuguauuguuuuuuauuuguauucauuuuuacaaauuguuguacuaucauuauuuauuuugaauauuuucaggccaauguugguugaaucccaggaugugaaacaggugaagaugaagggcccauuauauaccuugucgcuauuuaaagaugucucaaacucuuggaauuuugauguuuuugaacauguaacuuaauggauccuccuucauauuauuguaguuucucuuaauacuaaaguagauauuauugccuugguguauuuuacuuuuaaguuuaaaaaauuuuugauuuaaugauacucuugaggauuuuaguuugggauauuaccacugucaaagcuggcagguucuucacuugauuaagucuuauuuccacucaacaccauuuaaguaguuugagacugguuauaaugagcauugguacaggacuggccccucuuuucagucaaggucaguuggcaacagcuauacacuguuucuuuauuuuggaaagguuuugcuugcgcaaagacuuacucuuuuaaccaaauccugcuuuucaucuguuuuugauggcaacagaccauauuucccagccauuugcaaacagugccugucuggcgggauuuccuggacacagcccuugacaaccauuacuggccaacuuuugaacuucaguguuuaaccugguuauuuguucuguguuuucugccaugggccaugggaaccauaagcuuauccuuuugagacuagcagaagguccaagaacaauccauuugcuaauuggacccauugcuuuccccagcccauuaaccuucaugaaucaaaucuuccuuccaauauccagcuauucaucuacaagucaguacuaugcagagugauacuuucuaaccaaggugccuaugguagaccuuggucauugccauuuuggaaucuuuaccuuauggacugauauaauccaaacaugucagugugucauaaaaauugguuggccaauuaaagauaauuugauagugcaaauaucauuaaaauuguucuuauguacaaauaauaauuuaaaaauccauauauaaugacuuacaaguaauaaggccguacuuuuuucacucuaaaaaaaauaagcaaaugauaaaacauucaugcucuuugacccagugguacugauucuggggcucuagccuaaagaaauaacucaaaacauugagaaaagcuuaugcuuauggauguuuguugaagcauuauuuguaaugaauaaagaaaaauauaaauaucuaacaguaaggaauuguuaauuaaauuaugauguugaugaaaguuuuuaacggcauuugaauauuguuaugauguuaaaugaaaaaaaaauggaauacagcauuuuccacaauauggucacagccauggaaaaaacaugcauuagaaaaaagacagaaaccagccaggcacaguggcucacgccuguaauccaagcaauuugggagacacuaggagacacuagaaagaagauuaaagaaaauuucaagagugcuuggcuugagugccagucagacuuggguccaaauuccuacucuuuuacuuaugagcuauguagcuucaggcaagucuuuuaaacuuuugagccucaguuuccucauuuauaagauggggauaauaauuuuuccaggauuauugugaguauuaaaugagauaaugauacaaguaaaauucuugauaaucuauaggcaaccaacagcuggaugguggcaaguacuaauucguagcuucaagauguucucaguuguauucuugacuuuggcauucuucuguuacguuugcacugauuuuugacaugcugcuaggagacagguaaugugaaggaucuauugggggguuugccuuuacggcuuuucugguacauuguaggucaaacaccaacaccuguguuaggcccugucacauauucagggaccuucacuguucaccugagcuuaaccaacaacacucaccugcaggcaugcacuugaguacagaugcugcuuguuuugagugaagcagauacagaaaaucuuuaacuacaaucccauuuauaaaaggguggagcuuauuucuuuuaaaaaauaaucauuccaaaaagauuugcacagaauuaauuuucaaagggugaccucucuugugcauuuaaaaugugauucaagcaaaccaaacaaaaaaaggauucggccuacacuuucaguggcacgaaguaaagugcacuuguguccaagguuggacuccuugcuuuucuuccaagcaucuuucccagucucaucauuuacuaguuuauauuuuaaacuuagcuucagaaugcuuaugcugauguuaaugagucuaucuucaaaugcuauuuuaguuuaucuuuuuuacuuuauuuuauuuuuuuuugagacaggaucucacucucacacagcucacagcagccucacccucccuugagcucaggugauccuuccaccccagccucucgaggcacugggacuucaggugugcgcugccacgccuagauagauaauuuuucuuuuuuucuuuuuuuuuuccuucuucuucuucuucuucuuuuuuuuuuuuuuuguagagcugggguuucaccauguugcccaggcuggucucgaaccucuaggcucaaucuaucacccaucuuggcauuccaaagugcugggauuacaggcuccuggccuauuuuaguuucucucuguucuuuauaguggauccuuaaggcauagagaauuuuaggaagaguaugagcauggaauaguaaagucauuguugucagcauacgacagagggaaagucacugagucuuuuugauccuuggcuuccuuaucaauaaaauacuaauauuggcacuguuuaccuaacaguuauugugaagccaaaucacaauagcuaacauuuauuaaacaauuauguguucuaggcaccauguuaagagcuuugcaugcuuuauuaacuuuaauuucaggguaacuuuauggaguagaucauuguguccuaaucauaaugguagcuaauauuuauugauaguuuucuaucugccagguuuuguucuaaggucuuugugugucauagauauugguagaaaauggaggcaccaagagauuaaguaauuugcccaaguuaauuuaaguagaaaguguaggagcuacuauuggaacacaaucugauuccagacgucuuaaccacugugcaauaucuccacuguauagauguagaaacugagaaauagaagcacaguagcuuauccaaagucacacagcuaguaagcggcagaucuuaccuucaaacaagauucgccauugcgcacaucauuaucuguuaugcaacauggcuucaaagucugagugauggcaccagguacugcucugagugcucuucagccucuguccucagagucaagaaaauguguaccaguggcggguccacuagaagauccacugcacuacggcuguugccuuguguauucaaauccacaguuccucauguccugaggucagcgagccacagagaagugggcucaccuuuucuaacuuaaucagugcacugacagaggaacagguuacagagggauuucucugggaaagcuguggugccagggcuugcuugugcccagcaagggaauuagaaaugccagggcuaauuccccaguggagaaugauucagaagaaaaaugaauuccugaaggcuguuguguuaucagugccaggucugagagagcagggcaggaauaugauggcuugucuuuggaaaacauccaaacaacuuucaguuucagaacagacuucacuacuucucuuagaacacuuacuguccuuuacuguaauuuuuguuauaacuggaggauagaaggaaauaugcuauuugauuuuauguacaaagaauuuugaguccauugagcuaauaaugucucccaagacaauaccaguuuauggagaacuugguuuuuuguuuuuguuuuuguuuuuuuuugagagauggaaucucaccauguugcccaggcuggagugcagugauguggugaucucugcucacugcaaccuccaccucccggguucaagcgauucuccugccucagccucccgaguagcugggauuacaggugcgugccaccaugccugggguaauuuuuguauuuuuaguagagaugggguuucaccauguuagacaggcuggucucgagcuccugacuucagguguucaccugccucggccucccaaagugcagggauuacaggcaugggccaccgcgccucgcccaauuauggagaaauuugaaccauaauaugaauguuaauuugggaggaauucuacugcaguucauuuuggaaacuugaaccaaguaggaaggauuuuauuguuaaaaaaaucugaucacauuuuauguaauaaaaugucaaacaugcaaggagagaguaauaggguaaugacccaccauauaccccuugccuagauuuaagaauuguuaacauuugguauauuuguuuaauauguuauuuaauaguaguauuuucaagcaaauaaaauauaugauauuuuacuccuaaauacuuaaauaguugccucuaaaaaagaagaacauuuucuuacauaacaaaauuacuauuuacaugugugacaaaaucaacaauaaccuauuuuuuucuuuuguuuuugaacauuuucaaaccugaaaaaauguugaaagagaguuugcucuuuaucuagguucagcaauuguuaaccuuuuuccaaaagaaguuauaggcaaggcugggcgcgguggcucaugccuguaaucccagcacuuugggaggccgaggugaguggaucacgagguuaagagauugagaccguccugggcagcauggugaaacccugucucuacuguaaauacuaaaauuagcugggcgugguggugcaugccuguagucccagcuacuagggaggcugaggcaggagaaucgcuugaaccugggaggcagagguugcagugagccaagaucgcgccacugcacuccagccuggcaacagagcgacacuccgucucaaaaaaaaaaaaaaaaaaaaaaaaaaaaaaguaaaaaagagguuauaggcaauaugagauuuucccuaaguacuuuagaaugcauuuccuaagaauaagacauucuuuuauaccauaacaaauucuauuauuauacccaagaaaauuaaccuuaguacaauaauaugaccuaauauuuagcccuuauucaaauucccccaguuguuccaaaaaugucuuuuguagcucugugugugugugugugguguguguguguuugugugugugucuguuuuccccagugcaggauccaaucagauucacauauugcauuuaguaauaauuauguuucuccugauucaaaaagugucucuccccuugaccauuuuguuuguuuuucgucuuaaccuguuuugaaaaaaacuuuagaccacuaucacacacgauggguucuuuaugauuaaauuagguuaaaauuuuucacaaaaauacagcauaaaugauuuugugaauuucuuauuguaucuuaucaggauagaagcaauaauuucuuaaaauauuauuuaauauccaguacauauucaaauauuccuaauggucucagauguguuuuuuuacaucggcuugcucaaaccaaauauuguacaccauuuaaaaaaaaucgacauagaaaaaucaauuacagucuuuuugagggggagggggaacuccuaaaccagaauaaguucagagaggcccccugaccacagucuuaauuucuauuccuuguaaaugccucagaguaauucuuaggcuucugcuauauggaaacuacaucccuuugucuuuuauacaaauuacuugaaaaaaauggagguaauuucucuugauuacuuuaagaaaugaaguagaauuuuuguagaacaguauacaaaccauaaauaaacggcuugaugaauuugcacaaauugaacacacccacguaagcaggucucugacccaagaaacaggauuuuucccagcuccaaaaagcgccccuuccagauuccccaaggguaccuacucuaacauccagcgucauggguucauuugccuuaugcaaauuucuucucuuucccugaaaaaggaagcacgaaguagagaagccauacaaaauauguauauuuuaauuagguauuuugaaagcccaccuucaaagacauuuuaaaugauauacuguauauauuuucacacaaaauaauucccacaacaauguuuuacauaaugguuucauucaauggcucccccugcuucccuagaauugggauuucauccaaaacacuaaagguuaaguuaucaauagaacucaaagagcauuuuguuuccauuuguauaagucguuuaauguuuuuuaaguccacgcauguguuaacaaaggaggcagucaauuacaggggagcuuagcaaggcauucuuagaguucucuucaguggugagcagugucgaaguggaaucaggaaaagagcaacccuuuucacugaaggaaauuauuuuaauuaguaauucucaaaggguaauaaacagucaaauauuucugaaaucuccuggcuuuggggcaaguaauuacaaugagcaugcaauuaaaaaaaaaaaaagaaagaaaacuaagacgagggcauguacaaucaauuaaauagaaguaauuacauuaugagggcuucaugaguaguguacggugcauuaacauuguggagacaaaagccaccagacagcacauuguaugugcaagucuuuugaaucugagguugguuuucauggucuucucgauucuacguuguggggcucugccacugguagucgguaacuuucuaaugcacugaacuggcaggagugauggcagcaugccuauuuguggugucuagggaagccuucuuaaaucauugguaugcccagccuaaaucagaucacgcggauccugcagucgguaucugggugauacugugauugguacaugaguguaacuuggcucggugugccuggaguuuuuuuuagcagggauaggaaucuaccaucucugguguguuuuucaauguggcaugccccagugacauuaguggagaagggacuugcuaaaguuagaaaguaagauugaacagcuggguucaaggccuuauacuagguucccaccagcuguuucaaagggauggagaggagccacccagagugcuuugcagcagcugugaccccgaaccaagggaagcuuuauuucgaaagcacacuaagaauagauacaggcuccugauuuuaaaauacagcggacgauuaaaagcuuucuggguauaaacaguucaggucacuuuuuaaaaacacaaguuaauuucaagcuauauggaaauuuacauguguguuuuacauauguauauauauuuauacacauacauauaugccuguauauauauauucugauauaugccgauuaaucucucuaaucuauauuagcucugcuuugaaugaacuuugucguugggaugcuuuggcaucagggcuucauagcauuguacuuacauuuauucagugccuuuggauaggaacgccuguaguuuuuuuaguucuggucaguuggguauaaaauauugccauagugucagaagcacaguguguguucagacaaugcuguugaaucugaagucaugcuuguaauaaauaccauaaauaguauauuuugcaacuucuuaaaauguauucuauaggauaguaauaauuaagugaaaaaaguuacacauaaaaugaauuacagaaaugugggauuaagcuaauugaaaacuagaaucuuuuauaugcauauguauuguauaaauauuaggagaggaauauaacauucaguguuuuccauacuuauuugauaacagaacccuuuugggugcaggggugagggggauuaucuucuaggacugauguuuuauagaacaucauugagguuaccuugccccauagcugugucuccucacagucugguugaaccugaaagcauuuguuaccggagaaguagauuuuagguggaaauaccagaugcaguuggcagaaucagaagugucucucccuuugcugaauucacaaugacuuuguauucacuaauucuuucuccuacccccucccgcaauguuucucacauuuggcaacauaugauaacauuuguacauuuucccgcacuuuuguauuaauauauuuauuacgggucugaguauuuaaacaugaacuuuuuucucaagucauuuaaaaugacuacaauuccuaacccagaaugaaauguuucuucuaauauaacuauuuuuaauuucagaauacauugcaaaaauguuuuuuguguaaauguuuuaaaacauaagauauuaucaugaaaagguaauuucuuagaaaaauuggaauuuaucucuacuacuuuuuuuuguuuagagaaaauuuaggaaaagugaauguacaucuugaauuuuaguuaaguaauuacaguuauauagucaauuauaaaggcugguuacauagcuuauuauagacugaacacauuuuauacaacagcccuauuugaauauuuucccuaguuauuaaaauaaugaaaacauuaauaaaaacuaaaggcaauaugauauuaaaagcauuaauaaaaauggaaggcaaguuaggcuaaaguuacuaucagagacuggcuucugaaggaacagguuuuggcuuuccaaguggcagggccuuaagaaucacauccccagcucuggcuuaggguuccagcauugcucauggcauauucagcuguugccuugcaucuccaaaucuaucuucagaguccuuuuaccucuuccuuuuaggucauaguggagaguuggcguuccgcuuuguauuuauguuuuuuuaaguaguauuuguauuucuuucuuuccuuucucccuaacaacuacaggaucacauggaccuaauuuguuuuauugucacaagagucccuuuucuugacaggauaugccuaauuaaaaccaggguguuaaaaaaaaaaaaaaagcuaaguuuugcaggcaaguugacauacugugugacucaaggguuucaggagggacaaggagggauggugguguguuauugaagcaagaggaggaccaagccugcaggagauauuguuccaggacaaagucaggcuaucagcagugcugacgguccaccuccccuuuuccuuccuuccuaauggcccaaguuaugcacgucagccucuuuggguucacaaggcaguauuguaucauggaaaaagcccuagaccuuauuaugagaacaagauuugacucugcucugccacauggaaacuaagaacuuauuaaguagguuuacuucacccaacucuguuucuguaucuuuuuuuugagacggagucucccucuugucacccaggcuggagugcaauggcaugaucucggcucgcugcaaccuccaccucccggguucaagcgauucuccugccucagccucucgaguagcugggauuacacccgccaccaugccuggugaauuuuuguauuuuuaguagagaugggguuucaccacguuggccaggcuugucugaaacuccugaccucaggugacccgccugccucggccucccaaagugcugggauuacagguguaagccaccgcacccggcccauuuuuauuucuuaaaaacagagauuaguaagccuguuauguaaugaucaaguuaagaucauuuuugaagccauaaaaugguauauaaaugucaacuauuauuaucagacauuaacagcaugguuauugugaauauuaugacuaauaauuaauaugaauaauuauuauuguaacuaucauuauuaccaugauugucauuauuaggaauauaaguagcaauucauucaacauacauuuauuauuuagugucuauuguaugcuagauaugguggacuuucaggacccaugguguauaguaccugguagaggcucagccgagcaguuugcagaaucaacaggaaugaauugagaaugacuuaauuuguuuaauagaaugugacagcauucucuagaauuuguuccuuucuggggcaaguaaggaacaaaucuuccuagauuaguuuuaugaguacuuacagauaaaaacauauaugaugugaauaagauucaacuguuauauuugauaccuagaagcaaaaugauuugucgaaguaaacccauuaaauauguucauucauucauucauucauuccuuuaauucagucacuuauucuaugaguaguuuuuuaaugucugcuguguguaaggccuucugcauuuaguccauaguuggggcuacugagaaguugaaagcugcuuuaaagucuccuuucauuuuaacaccauuaaaaaaaaaaaaaacucauggaaaggaaaaaucuaaauguauccuguaaagaaaauaccauuuccucugguaauuaugauggucuauauccuguuuaacucauugcacgggguuccucuccaagucaaugaggauugcguaaagagucugaaggcaggaugugccucauagugggaugagaaggagccuuguggcuggucgucagacuaaauuuaaaccauuauuuguugugaauauaugauuaacguggggguuaaaaaugaaaaauacagcugcaagaguagguuucuuccuuugauaaaaacagaaaaagucaggagggacaagaagaaaacaaacacaguuacgugaggcaugcauucucuuucauaagaacagucaaauauauuuuagccuaaucuuucuuucuagauacaauaaaugccgcucccuucuggauuaggcagaugacagcaauaacaguauugcagcugggagucucccaggcugacaggugcuggauauaagaugccccagauuguccugugaaguacaggacaugcuaggcccugcuggaucugcccaaggagagggcagcuccugugucuguugacaccucguuuagauucucccgcucacucaaacagcugccagaggcagccguaaaauauugcuuaauuauagaacuucccuugauccucuuuaucccuuccuucuauugcauuuuucccccuuuugugccucucucuaguucagagcaccuuuaggcuaagcacucaugggaguauuaugguggcgccuuuuccaacucacaguuaaggcagagacaagauuuucaguccugcacuauagcuguggaauuauuuucagaggcuguaaugagcagguauagguucaaauguggaaugcagcaucauuuuuuaagcaggaaauggguucauuuuggggggaggauagcuuucucauuuuuuuucugauuagaaaaauaaugcuuauuguacaaaaagaacaaagaaauguaaagauaugaauaaagccuacuucccccuuguucauauguguucuauuuaccaaaacgggauuauguucacucccacaauauauuuuagcaaauacagauccauguaauuuaucaugucuguucagucuuccacugucugacuguaccauaauuuguuuaaccauucuaucaucauacacuaaagauagaaacaaaaccgcuguggacauccuuaagcauacauucugcauacuuguauugguuuggagucauguuugugauuuacagggaugcgaaaugagaucauuuauuucucuaacauuaaggaaaucugaauuaaggaacucaagagcugguuugcuggcuccgcugcaccuuucugcuuaguuguucuuacugaguggcuuccauuccucauaauuccagcugucugcugcagcuccagccaucacguucauaugccaggcuggagaaaagauggaagggugggaagcagaaacguaugucuauugcuuccguuuaaaaaccuuucccagaagcccacacagcacuucuguucauugucuagaacuuagucucuuggcaauacuuagcaccuaaaaagggagagcagauauuccaaagcaacaaccaucucugucauucccaucuaauuguuuucugggaauaaaagcuuugugcaaauggacuuacuggaucaaagcuuuucccagguuuuuguugcauauugauauacugcucuucagaaagaugguaccaaguuaagucuaguaauaugcgagaauaacccgccguaaguuuucagguucuuuugugugcauuuuaugggcauuuuuaaagcuauuuuucugaagcugcauuuuuucuuuuguuuauuaaaucauacauucuauaaagagugagguggagauuuuacuauuuacaauuuugucuucaaaaucuaugucuguacaaguagaauauucauuccaagcacuggaaggacauuuuaauguuauucgcacguauuuccucuacuccuaagaaaacuuauuuggagguugccaguugaauuaauacauuaaucaaaguaaggcagcucucuccuguuuugaaaaacuuccugucaauuaaauacaaggcacaguguaaaaguggcucugcccaaguuaguguuuagacagaaauguuuguauuacaccguggugugaccaucagcagcuccauaaauaaaggaaucaucugccggcgcuucccaccuuuuggguggggucuguuuucuccuucaguggaaggacauuggggucaucaucauuacugcugaaauguuauuacuuuagauuuuaucaaaaaacuuggugucaccaggucugaagggaaaaaaaaaaucaaacuuuuuucuuuuuacccucacacaccauccaacacagcacuuccgauucccuagcagacaccaacuggguguccuguaauuucauucaauucugacacuaccuacccagagauaguaucagaucucacaggcuaagggcuuagucccacaagacugcacccccuccagcccaccuuuuuagaugccaauugcaagcuacagguggugaccugugcuucugacuaacucccuccuuggauuugauccauuugcuagaaugacucacauaacucagggagacacuucacuuacuuuuacccauuuauuagaaagaauguuacaagggauucagaugaacagccagguggaagagauacauaggacaagguacuuggagcuuccacacccucucuggaugugccacccuccaggagccuucacauguucagcuauccagaagcucucugaacccuauccuuauggauuuuuauggaggcuuuauuacauaggcauaauugauuucaucacuggugaucagcucauccuucagccccucuucccuucccugaagguugggauguggugugggacugaaaguucgaauccuccagccaugugguugguucccccuggcaaccagccccuuccuaaggcuauguaggagcccaccaacagucaccucauuaaaacaagagaaguuccuaucacccagaaaauuccaagggauuagaagcucugugucaggagccgaagucaaagaccaaauauuaaaaccaaagauucuccuagcaccccuaucuacaaggguuauaggaacucuagaucggcaauggugacagagauuuauuucuuaauauaucacaauaucacacaugguuucccgauuugguuauucaaauugguuuauauuagcuuuuuuucaucuuucuuuaucuugcgaguguuacagaauaaaacucacuucucuucaaaguuagaaaagugaccagccaaaggauuacuaucacugagggaucauuuagaaacaagugauuauucuaaugcuacuaacuuaaauaaaaaaaaaaaaguuggugaaucaguagauggccgugccguauauauucuugcaacuuuccuauaaguuuaaagguauaucaaaacaaaaaguuauauacgcacaaauagauguugauuuuauaugauuuuuaucugcuacuuucaugaagaaggaugggguuugaagucauaauugaaacagguacauauuuuuguacuuuguuaaguaaaaaauuaaaucaaucauguauuuuuuauuaacauccacuuguggguacaaagauacuuacuguuuggaguuugcauaaacauacuuguuuaaaaacaacagcauuuuuuaggcuaaaucuguuuuuccauuaguugaagucauagaaccuucaaggcuuccugcauuucuguaccugguauguccccucacauuuuggaacuauuaucuccuuguaaauuauuagaaaaauuaaauuagauuaaaacuucuugagcauuucuuuauuaggaaaaauggaaauccauuacauauucuuuugcuugcauucaaucuuacugugcuuuuuacugcaagcugaaguccccuuucuacuuuaaaugggagagaaaaucuugugcugacaugagaugcucauuaccaccaaggcacucauuaccaacaagggcaguaaaggaaucgcagcuuuggcugccucucacacugaaucugagaguugcuauuauuagaaugcaaaaaaaaaaaaauuguggggugcuggugggggaacuaugugagacuugugguuagcuagaccuguguuuuaagaauauuuuugucucugagucaauuguuacuuaacuacucgacuauaugaaaucaaguauaucagccaggugcaguggcucaugccuguaaucccagcacuuugggaggccgaggcaggcagaucaccugaggucaggaguucaagaccagccuggccaacauggugaaaccccgucucuacuaaaaauacaaaaaaauuagccuggcguaguggcgcaugccuguagugccagcuacucaggagacugaggcaaaagaaucacuugaaccugggaagugaagguugcagugagcagagaucguucuccagucugggugacaagagugaaacuccaucuuaaacacacacacacacacacacacacacacacacacgaaagaaaucaaguauaucuguaguuuuugcaguaaauugaugucuaccauuauuucucuccauuuucuuguguucauuguacuauaagguguuuauugauuuuuuuucuuuuuuugcauuugaauuacucagaucccuuuaaacaguuuggauagauuuucacaagggaaaggaagggaacuaauauuuauagugugucaugcauauccggcacugugcuaggugcuuuacuuuuguuauuugaugaaauucucaaaacagccucauguaauggauguucuuaugcccauuuuacauuggaggagaccaaggcuuggagauguuacuuacaguagucucuuagucaguuaauggcagaaacagaucucaaauccacuguaccacucugccucauuugggugauauuuucgacugaagaugccaagaaauacacguaaagaaacauuguaggcuggguuugaaaugugaaccauaagcuguguuuccugauaauuauuuucaagguccccaguagcacucuccccuuccucugaagccuaaguuggucccuuucgaugccucaguuuuugucuuugauccuccaaauaauuucuugcaaaaugggaaccucacucugaaaagcaccucuagucucucuugagaugccgggguucaugccagcccuuuuuccaguucaaguugugucaugccuuucaaacaugugcaaaaagaaaguggcucugauggccagagccaggguggcucauccucuucccagaauugaaaaaaacaaaaccaacaaaaaggaauuaaaucucuucacaugaauagaggagaagcuagccuaacccaaaagaauuuuugguuuuaaagaggauuugccuucuuuuuugggaugagugacauuuaauucacuuggccccauuagaaagaagagaaaggagggcagugcagcuuuagcuucgacauauuucacauuuggaguggcuucggagcagccaagcacugggucagugucccauuuaagaacaacuggaaaaaacaacauguuaaaaacguguuaggcacagagagcauggaaaaacaauugucaaaguauuuuagcauuuagaguagcuuaguggcuacucuaaaauacuaacuucuuuuuaagacuuauugugagauugaagcugauuccuagauguuagaugcaguugauaugggaaacauuucuaacauacagcuguugagacagagugucaggcucuggaccauuuauaauaacaaaaacaauagagucugugcuguuuaccaccauacugcucguuguuucacugccaccuucucccugcucauuugacugccagcuccuugagggccuagguauuacaggcacucaucaccguaugcauguugaagugucgugaauucaucacugagugccuagcaaaucccgacauacauauuuggguacagcaucacuucaucuggaucuuggguguagaaauagcaccauauucuaacccuggaagaaacuggcugcauugggcuuacugaaagauaauauaauguacacaaagccuaguggacuguauauucaaaaguuuuucagugguaauuuuuaccacacuccacauuugccaaaacugauuuuggggagcagagcaagguggcacgcauguguagacccagccucgggaggcugaggcaggaggaucacuuaagcccaacuguuggaguccagccugggcagcaucucuuucaaacaaaagaaaacugaguuuggaacugaaucccuauggaagauguaccccacuguaaauacuugucuaaugaaaaaauggaugaauacauuccacuuccuauuaauuauucuagaauucacuauucauguggcugggcgugguggcucaugccugucauccuagcacuuugggaggccgaagcggguggauaacaugaggucaagaguucaggaccagccuggccaacauggugaaacccugccucuacuaaaaauacaaaaauucgucaggugugguggcacacgccuauaauccuagcuacucaggagguugaggcaggagaaucgcuugaaccugaggggcggagguugcagugaaccaagauugugccacuucacuccagccugguugaaagagugaaacuccaucucagaaaaaaauaagaguaauaauaauucaccauucauaaagcgucucaucuuuucucuacuucugauucucaucccauguuuuuguuugugagaaaggagaaaagugaaauaaagacucuaccaaguacauauuuuauacuugacaucuggaaauaauaucgugaaauagacucucacauuguuguggaguuccaacacaauaaacuuaaggugauuuauacaucuuuuauuuauuuuauuuuauuauuauuuuugagacagaguuuugcucugccgcccacacuggggugcagugguaugaucacggcucacugcagccucgaccucccaggcugaaguaaucuuccgcuucagccucccaagaagcugggaccacaggcauauaccaccacgcccgacucauauuuugauuuuuuuuuuuuuagagauaagaucucccuauguugcccaggcuggccuugaacuccuaugcucaagcaauccuccugccucagccucccaaagugcuaggauuacaggcgugagccacugugucuggacuauacauuuuuuaauagcauuauugauccuggcaugagaggagaaaaaaaaaugcugguacuaauaauaaaauuguuugcaacgcagccaaaguucuuuaauauggcucuuggcccaaaucaaacaagcaacagaaacucccaguccuuuuuuuuuuuuccuucuuauguuuucacaaaauaggaaaaaugagguuaagcaagaauuuugcucaguuugcagaggcaaagugaggcuugccagggccgggugcuguuggggugcgugcagcauaugacggggugucucuaacacagugacugaacuguucaccuucugaagugaggcuccugagucacaccuggggcugucuugaugagucaccagccuuccaaagugguuuucucugggaaguggcacuucacagugccacuuuuuuuucccaccccagggacaaaacucugguaaaugaaucccugcaggaaccacggguauuacaguccugauuuggcucaucugcucuuuggggcugacagcagcuuugcuugacucagcuucugccugacugaguagguucagacagaaugagucugcagaaaagucgguggugcucagugggaaggacgugagggagauggaucaccacagcuggccagggcagaggcacuaggagaccuuucacauggcugcugugccuacugcugcuaacuuaaacaaguggaaacuucuuggcaagucugugagggaagucgaggauuagagccugguaguuaaaaauacaaucccugccauucauucagaauuccagagaaugcugaaauuuuuugaauuggcaagugaaugguagagaccggaaccauacacugaaauaacuucucuggucuuguaucaucuuuuauuagaggauccuaaaaaaauccccuauuuauauaucaguuauuauuucugugucauagacugcagcuauguuugaugagcugcuuaagugaaaaucugaccggaaacuuucaacuauaaauucuuugugguuucaaagaaggaugaacuuucucaucuaacacauuucugcugugugaagagucaccuuuauuauauggcaugagucuuuuuuuuuuuuuaauagcuuugggguuuaaacucugaaugcuuugcuaauagaugugucagcugugcacauuggcagcuugacuuuuaccucuuuguaucuucuauucugaugcauuaaaaauagcaggagauggugccguuuaggauuugggcagaauggaagaaucauuauaaccaauaauaguguuuuaaaagcugccuugggacaaagaauuauuaauuagggugguagaaagaaugacaacgugggaggaagauugauuaggguuucuagaaauacaguaaaaccuaagcuauguaucucuucaaccaugugaagagcuauuacuuuauuucugauugucaacauaucgaaguucaaaagccgacuccacauuaugcaaauagacugauaacguuaagcagaggagaucaauguacuggauggcuacuaaucuuaauauugucgccaggcgcgguggcucacgccuauaaucccagcacuuugggagccugaggcggguggauggccugaggucaagaguuuagaucagccuggccaauauggugaaaccccaucucuacuaaaaauacaaaaguuagccaggugugguggcacacgccuauaaucccagcuacuugggaggcuaaaggaggagaauugccugaaccggaaggcagaggcugcagggagcugagaucgcaccauugcacuccagccugggugacaagagcgaaacuccgucucaaaaacaaacaaacaaacaaaaaaccuaaucuuaguauuacaaacaugaucaggucggguugcuaguuuagauguggguggugagcugagcauccacugcgauggggcuucuacugucaugggcucccucugugauguggccucccuucugugaugagcucccugggguuucuccugcaaugggcucccacugcaaugggcuuccacugugcucagcucccauugcauugugguuuuaggugacagcagagggacuaccuggagaaagugugcaucugggccugggagaauuaguaagugugcauaccaccccugucuuuguucuugugguuaagacucaucucugguguugguuagcagagcuaaguaccguuggcaaaacaaaagguacuacuaaaagaaauguaagauaugaguaagauauaugucauuuccuaggucuugaaaucuaaauaagaucacacuaauagaauguuuaauuugauuuaaaugcaaacaguauuuauccccaacauacaacgagaaaguaaaccaccuuuugcauacuuguauucuaauuccaguugaggaaaauuuuaaaaguuuaauauaagucuucggcaagacuccuugccaucugguacaggauuaaaaauuggcauagcauuuguugucuacugacagugggucagauuuacuuggcaggcccuaucugggaauuuaucaaccucauccaaaucuguuucaguuuccauuuuuaacacuagugggucuaauuggacugagucacaagaagcaaguugcaaagcuguuucauuuagcaaauuuuaagcuaauugucuucaguauguacauuuguuuuaacauuaagaggauggugaauuggccuaguaaaucaaaaaaguuuuaaaaaucugauuuucugaaauaagacaguuugcuuauacuuaaauggggauuguaaauaucauaggcuuggcagcuuuuuuucuuuuuuguuuuuuaagagcuagggucuuuuuauguugcccaagcuggucuccaacucuggggcucaagcaguccucccgccucagccucccagagugcuaagauuacaggugugagccaccacaccuggcuagcauuaucuguggaacauuucuucuggaagagcuuguauucuacuggaagagaaaaaaggagguaguaaggacagaggcuacagaggaauuucacugaggggaugaagacagggagcagugaguaugauugaguuuuaaaccagucugccuugguuuuaugaccccaggcugucuuuaaauucucaucucauuggugugguucucuuuaacugcucagcuagguuguggcaaaagaagaggcaguuuggaggcugcuuccaggucccguccuaaccacucugcugauggaggggagcccugaugucugacacuguaugaaacucucauuuauuaaauaaauggugggcagaaaaaagacaaaacacuuauguuugaagacaaaaucuuugcccauagaaauaagcaacaugcugcuaauaguuuuaaauucuuucaaaaugaagcacuuguaaucauuccuauuuuuauaucuuuguaugcuuccagcaauacaaaauacauuacaugggauucucuauuucagaaaguccuuguuauacggcuuccuucaucauaaaguuaguguggguaaauucauccaaaaacaccaggccuuuuccugggugguaagaagcuggaggauucuauuuuauuuuauuuuuuuugagauggaguuucacucuuguugcccaggcuggagugcaauaauggcgcucucucagcucacugcaaccuccgccuccccgguucaaguguuucucuugccucugccucccgaguagcaccaccaugccugucuaauuuuguauuuuuaguagagacaggguuucuccauguucgccaggcuagucucuaacucccgaccucaggugauccacccgccucggccucccaaagugcugggauuacaggccacugugcccggccugauuauucuauuuuuacagauaagauuuuuaucuuugccuuuacuauguuugcacaauguuuuugauuuuuacaccuaaccaguacaucacccaucaugcauaauagguauacgaucuaugguuguugaaaaaacuugaaccaaguguugccaaccuuggaaggccagagcugccuucucugcacucacugcugagugaguuugggaagccaggagaacuggccaugaaaucuguaagugacuuugguggucauaauauucccagaacagaccugcuuuauccucacagugaggaaccaguauauuguuagcuuuuuuaccccugucucaugcauauggguagugugacuaggauauccaauuagaucacacagggucagagcuaauauuaaacccgggcacccagguauaugugacuccacaacugcguguggucuuugcagagcccacagagucuggcaguaggcugcugugucugggagaugccuaugugaguugugcuguuauuucaugggccauggugacccagggggacuuggauaccagguguccuugggauaugugccuggaggugagauagugaauggauugucaggcagagaggguggggggagggaaggaggaagggaggaaaaccagaaagauuggcagaagggaagcccagaggccauugcccucaucaaggugaaaggucaugaaggagguagaaggagguagcaguggcuugagaggaggaaacuggagcaaaguuaacacccccuccgcaggcugauggggaggccagucugaggggagggugacuuggagggugggagugccaccccaccaauuucaaaacauuuuaaccccaaacacacaauuuaccuguuaaauaaaauggcuuucuacauuugcgucuuucuggaggaaaauauuaauccaugagggaaaacugauuucacacgacaugguuuuucauaaccuaccauuuccagccaaauaucuucucagagacguggugaccuuucuugccccuuagcaaacuccaugcuuuuguccaaccugggcaguucucuaagcagagacucauaauguaauuggaggccaggaauugguuggucuuucugggacugagagaaggaggcugucugggaaguagugguccaaggggcucuugaaggaaggggaaaaagcccacucccgcuuauauuuguuacagguaccguuaaccccacauaccaccagggcucuccaugggaagcacuuguagaggauuuuucuuuuuuuuaagucgaggaaaaaaauguuuacugucaagaaaagcuuuucuuccccguaggaacugcuauucuuuuucuuuauaaacagcaugggaucaggugauugauuccauuuguccccugauuugagccacacgaagauaggagccaaaaguguaguuuaucuucaggaacucuuuuuguuuguuuguuuguuuguucuuugagacugaguuucucucuuguugcccaggcuggagugcaauggugcgaucucggcucaccacaaucuccgccuccuggguucaagcaauucuccugccucagccuccugaguagcugggauuacaggcaugugccaccacagccggcuaauuuuguauuuuuaguagagacagggcuucuccauguuggucaggcuggucucgaacucccaaccucaggugaucugcccaccucggccucccaaagugcugcuuauaccuuaugaccuguguauucaugcaucaauuuucuuuuuugucuuuuuguaccuucauuaguauuuuuguuuuuacugguugugaaaacaauacauaaucacugcuaaaaaucuggaaaguacaaagcaguuuagauaagaaaaaaaaaauuaccagugagccuguuauuugcauauaucaccauaaauaguuugauauguuucuuuuuccuuuuuuguuccauuuucaaauaugaaaccuguacaguguauguauuuauacaauacacauauauaggcagguuaaauauauuuguauaugugugugcauuuccaagggaaguuauacuuuuaaaacagcagagaguuuuucuugaaguagacuaagcaagggagugaagccaggaaggaggugggaguagcggggaaguggggauuaaucuagcuaaauuguggguccuggcaaacacugagauuacacugugaaauacgagaaaggaaaugacucaguaacauugagagagggagcagagaugagacagcagagugaaagagugaauggcguauccuggguuugggaaguggugggaaguagggggagcuggagccugaggcacuaagugauuagaacaauaggagaauuuaguuuucagaugaaaucaucaaggcuguauuaagugccucuugugagcaauagcucacucuuacuuguugcauucagccugggagccacucuugacaccauguuagcgcagccuuacagcugaugucaggucgacuggucugcagagccaggaauuugggcuuucuucucagaguuguuuuggagcaaugagaacugcucacuuaagaaaggcucccucuuguacuccagccuuuggggaaugcugugagugacacuuuuaauuaacaaauccacugggaacaaaacuccuuuaaauguguuggcuggguguggaguuugaagggugggccguggaggcucccacugcacugcaggagugcugggacuucaagccauggguaagcucggucagaacugucaggaugagguccacccagaaggccccacacucugucccaggggauuuaggcuggcaagcugugcuggcacuccuggggcaagaugagcucaucugccacuucagaugcugggcuuccuaugcuagauguuccugcucuugccgcauucaggagccacagcccacuuguucagaacgggaggggagagugggggacgagcauuuaggaaugcaucauuccagcuccuguauuauuccuagagcugguagcugaaauucugaccacggaaguguccuugaacaucuuccagcaaaugauguauauuuccacaucucaccggggccugugcugauguugguucuagcacagcaucaauauccaugaugucagagagucuaagaaagguuuaugaaagagagaaggauucuuuuccuucugguaccagagugaaaacuauuuauguagcacaugucugccuuggaaaacaugcugcuuuaauagaaugaguucugaaggaauaaucaaagcauuucuuaggucuaauuauuuugcuaaagggaguuacuuaauuuugacauccucaucaauuaguuccucacuuggaaggccugugacaagccugaggcuggcuaugaguuuccaccugcccagaaguugauggauuuuaugaaagcuuuaaacagaacuacaauugugaaacugaaaguguaaacuaaaacuauuguuuuuauuauuauuuacuuuauacuuagggaaaugauuuucaucucuuuacuucaguauuuccccaucuuuuuuuuuugggggggauggagucucacucugcugccuaggcuggagugcaguggcaugaucccaacucacugcaaccuccaccucccggguucaagcgauucuccugucucagccucccgaguagcugggguuacacgcgugcaucaccaugccggcuacuuuuuauauuuuuaauagagcugggguuucaccauguuggccaggcuggucucgaacucuugaccuguggugauccacccgccucggccucccaaagugcugggauuagaggcgugagccaccgcccccggccuuuuuuuuuuuuuuuuuaaucacauuuauucuaaaaccuuagaccuuuagacccaaguuuucacgcaaggcaauggaugaguuccccuuggcaauaccuucaagucuugcauuaagaaaucugaauaacaauuuuagcagaggaagcauuuaaaaaugaggagacagacugaaaagaaaacaagacaaauacaacuucaaugcaaggaaguuucuagacugauuaaacauaacgaaaguaaaagugguuuccuaccuuaaagauucaaaggaggccauuguuauucaaaagugagguguguuuaacagaaacaacaaucaugcuccuuuuguuguaugucuaaggaaggucaauggugggggccugacuggaagagacccaccugguugugaggcccaaaacaaagggcuaacauucaguuucuucuaucauguuuguugucuuugauggauauggaaagaucucugauacugggcugggugcgguggcuugugccuguaaucccagcacuuugggagacugaggugggaggaucacuugagcucaggaguucgagaccagccugggcaacauaaggagacacccaccucuacaaaaaaaauuuuuuaaaaaaaaugagccagguguggucgcaggugccuguggucccagguacucaguaggccaaggugggaagauugcuucagcccaggaugucggggcugcaaugggccaugauuaugccacuguacuccagccuggguaacagagcaagaucaugucucgaaaaaacaaaaaagaaggagaaggaggagaaggaagauuucugauacuguuuauaaaacaaaguagaggaacgggaugaaucuacucaucauauauauauauauaucacaaacuuucacuaaaggaagaguuugauggagugggacagagucucuaagguaccaggagugaccugcaaugugauuuggaaggugguaggcaaagcuggaggccauguccaccuuucuuagaauguacuggaaacucugagcagaagcucauguuucauguuggguuaguuucucugugauuaagucacaguaacaaacuggaaguuguaugugaucaaacauguaaucaugucuucucccuuguaaaccuucaugccucaauaucuaaguuucuccauaagcuggcacuaguugacuuuccuacuauuauuuucuaauacucugccuuccagcuacccuauugucaccuugcuuggugacagugagcuucuugaggguuuuaugugucaccuuuggggaccuugaaauaccuuacacuccuacugugagagcucacuaaugugguguucagaagcugguuucaugggcccaucuuuugcuugaugacagccaaagggauccucauuaugucaauucuaugagucaggagaguaugggguacuggcugggaaggugagcauggcuccccuuccaggaaggagcucacacuauggcacuccagugauuggauggcugagaagcaacugaggugcuggggaauacaagcuccacgggccgaggggaaguucacuggggcucacugcaugcaagggcugucuggacagcgaugucuugggcuuguguuuagagagcugcuugcagaauccccaguguggccuaaccaggaugcagggaaaaauaggcaaguauguccuuggaugaaaccaagcacaaucuaucaaccacucaagcagauccuaagggaagaauuagugucauuaacuauuaugcuguuguuggugaugaugauaaugaugcugacaauuaaaaagauaauuaauuguuuuccuucuuuuagucacauagaaaaaaucaccacauggcaagacccuaggaaggcgaugaaucagccucugaaucauaugaaccuccacccugccgucaguuccacaccagugccucagagguccauggcaguaucccagccaaaucucgguaagccucaagcuuuuuuaaaauuaaaaaagauauuuuuuuuuuguagaguuggggucucccuuuguugcccaggcugguguugaacucgugggcucaaacaauccuaacaccucagucucccaaagugcugcgauaacaggcaugaaccacugugccugguggagccccaagcuuugacuccaagcugaagaaaugguguucaaucaagggguggcggggcucauaagugguucuggcuguuucuaugucucuucaugcacccagacgguguuugcuccuucuucuuggcugcaauaccguguuacccuucugccggcuuuuucuucuuuacuuggucucuuuaccaccaacucaugauacugcugccucaguuuuaaacuacaguucugaccuucccuccaauggccuuaauugggguagaaaaaucaguuaggccuccugucuucaucuagccugaggcaaguaggacacauacacgcuuugggugacuuuggcuccuggcgacugccuacagguacaauucuagucucaaaucccuauccuuauuucccuuuuuuccuuuuuuuuucauaauugcugcauaacaugugucagauagcaugccaagugcuuccaugccuuaccuuaugaaagccuuccaaaaccccugcaaaaaguagcaggcucuccaguuuauacaugaagaaacuuuccgaaagucuugcagcuuguggagagcagagcuggagagcaggcuagucugauuuuagaagggaguuaaccauuacauaaccugcagguggcuucuccccauaccugccgugggauaauauggcucacuuuuuacuucauuuacaauacuuaauaagugcgauuuuagacuugagaagagaauauuuucugcuaaaauuauccccacuagagauaaucaccagugaauuaauacacugcagcaacggaaccagucagcuuuuuugguaaucauucccuuccuucucccccagggcuaaaaauaaaaaagggccaauuuuaaaguuuuagaaaaguuggugccauuuucagauaacauuuccauuuaagaucagauauccagauaugcuuuauacacagaacaguuaauuuuagggagugaaaagaaucuccuguuggauuuucaggaaugaacaagauaaaaauggaagcguuauuccuggacacccuucccucauacuguggcuuagccaaagugaguaugaacucaaguagacccuagucagcuucaagugucaguucuuccaggaagucugaaccuacugcuuuaaagcuugcagauguacaguuuccaaaaagcaaaugacauggaacaaccucuguggaguuccuuaucuaaagggcagaucaaagaaaaugcaaccaguucugguaccagcagugguaaaccaaagccuccagugaguuauuuugucccaaauauacaggagcucguguagaaaucagaugccacuguaguaaagagaccccaaauuagguggcauuagacugguuuuuacaguuuguuuaaccauuuaauuuucaucgaaaauucuaaaaacugauuauuaaaguuuuaacuuuaacuuuguaaucaauuauaaucggaaaaaaaucuuucaugaacccaguuuacaaaaaaaaaaaaaaaaaaaaaagaaaagaaaaaaaaauucaaacacuuccuccaaucucccuuuccucaguccccaaguuuguuuccuggagccaaccaguguuucuaguuguguguguguguauguuuaaucauacuaagguuagcauaucauaaccacuguucuguaucuugcuuuuuucaccugccuguccauacauauagagcugcuucauucuuuuaaaaauuugccuauuagucuacuauauuaauaugcuauaauuaguuuauuuaacuaacuccuaucugguagauauuuagguuguuacuaguguguugcuagcauacaaauacuggaguggauauccuuugucauguucuuuuaugcauucuccuuaauuuuuaaaauuugugcgauauguaggaaguggacuaauuaaaagaagcuugaaugcuuggaacuagauauugaaggcacaugugagucugccuguaugugcauacaugcaugcauaugcacacacacacacaaaguccaauugcacuaguaaaguauaucuaaagaaguuguaaucugaacauucugaaacaaauuuaccuguagcucaguaaaauaccuuaguuuccagauuucuauuuuuauuuaauuuuuguuauuauuauuauuauuauuauuauuauuauuauuuugagaaagaggcucacccugucauccgggcuggagugcaguggcacgaucucagcucacugcaaccucugccuccugguucaagcaauucucaugccucagcuuccccaguagcugggacuaugugcauguaucaucacgcccagcuaauuuuuguauuuuuaguagagacgggauuucaccauguuggccaaguuggucccgaacuccugaccccuggcgauccgcuugccucagccucccaaagcgcugggacuacaggcgugagacccggcacccagcaguuuccagauuucuaauaaggcagugaauuucucaagacgcacauucugggguuuuuccaacaauauuuguguauuugcccauugcaaaguguguuucuagcuuauggagaaucacagaugugucugaaggauggaaauacaacuuggaaugccaaguaaguuccaaagaccaggacuuaauuuagagagucucaauacagucagaauaauaaaugauuuacucagacuauuucauuucaagccauaacucugccugugguucauagucuuuauuauauaucuuuaaacauauaaaaauaaaaagagcagagcuggguguagaggugcaucccuguagucccagcuacuuggaaggcucugaggugggaggaucucuugggcauaggaguuugaggccagccugggcaacauagugagacccccaacucuuaaaaacuagaaaaagaaaagagcagauucuucuccucccacucuuccuucuucuuaaaucuagaacuuugguacuuuucaauggaauguagcugucaaauaagugaacuaaagugauaggucuucuuuaaugcaaggcauuuauauacaugugaaaaggaugucaaaauacaguuaauagcauuacuaucagaugauagaauaguaccuuuuauaacuaauuuuauuuauuucuagagccgugauauaaucaguggcauaguuaacuacauucagaaacaaaucuuguauuuggucccuguauguuucuguagguuagguacauggacuugggugucugacugccagaauuugaauccuggcucuguaguuacuaguuuggugacccuuaaguuauuugucugugcuuugauuucaucauauguacaauggggauuauuaauauaugaggaacuuacgaguuuauauaugcaaagugcuuagaacuaugauugccacauaguaagcuaaaauauauguuuauuaucauuauuuuuauggcaaaaaauauuuuauauuuuauuuaacuauagcauguuauauuuuaagacaauuuaacuguucuuuauaagugcuuucuagaauaaaaaugauuuauuuugggcugguuagauugcaaaguguuuuaaauuaggaacaauguauucauuaccuucagugaggauagugcccucugguggaaauguuuaaguuaccucucccaggagaaacuucuuaucacuagacaccuuauuuuuuauaagagcuuuagaugccgggcgcgguggcucacaccuguaaucccagcacuuugggagaccgaggugggaggaucacgaggucaggagaucgagaccgugauggcuaacacggugaaaccccgucucuacuaaaaaugcaaaaaauuagcugggugugguggcgggcgccuguagucccagcugcucgggaggcugaggcaggagaauggcgugaacccgggaggcggagcuugcagugagccgagauugcgccacugcacuccagccugggcgacagagcgagacuccgucucaacaacaaaaacaacaacaaaaagagcuuuagauguauuccuguaaugcgacuuguaaaucaaaccauauuuuuauugcaagaggaaagacccauuacuuagucauccuggagugagugacuuuguaaaaacagaggauucuuucugcagguuggcagauuuguugaacacugagucuaaguaaaaugaaauaagcucugaaggggaaaauugcaaaaauaugguuuuuuuuuuuuuuuuuuuuuuuuuuuuuuuuuuuuugcacuuuaauucaaauagccaucuccaguuucgucuagcuuaaaacuaaaauuuuaguuuuuguauuugccaaaucaggcuuuaccaauuuggauucugucugagcagaguaauggccuuuaagccugaauucccagacauaugcaauaaauggaagaagaaaagacgaccuugggggacuuuagacuuggcucacugcaaccuccaccucccagguucaagcaauuauccugccucagccucuggaguagcugggauuacaggcgcccgccaccacacccagcuaauuuuuguauuuuuaguagagaugggguuucaccauguuggccaggguggucucgaacuccugaccucaggcaauccgcccaucucagccucccaaagugcugggauuacaggcgugagccacugcacccagccagaaguuuguauguuuuaaguagguugugggccuuccuuacuauuaauacuuacuaaaauuuuaaaaaagagaauaagagggaaacaaaagagggaaaaaaauagacugccuacacaggcucuguuauaauguauaaaacaaugggcuugagaaaaugaagccugcugcagaucuuaguccuugguuagagugguggcgaagugggcauggaagugggauggaggguggggacuguuuuggaagaacuugaagucagaacugaguuucucuuaauuuagacguuuauguauuggguuauuuaaccucugagucucauuuuccuuaucuguaaaauggugauaaugauaguaccuaucugauaacguuguuuugaguauuuagguaguccaugucuugguaccugauguauaguaagcugccagcacuuguauuguuauagcuauuauuguuagccaguugccucauuuuuccuccccuuucuggcuccuguguaaucagaggaagauccuuugauaugcucuguuagaaagccauuccauuccuccuucaggaagacccaaccaugguuacugcaacuuauauuuguuugggcacuuuugcuuacaaauugugaaacuagcuggugugguaccaaaaaauaacauuuaaccucggacagcaauugugagaagaugaagaggagcaagcuugugacugucaggucauucacagagggaguuugugaagagcagucacacuucugaguucuaagugaagaacauuuuccccucugcaaguagugaaguguuagauuuucccauuccucagcagacaaauacugaaaacaugcaacaacuuaaaguagcuccauauuuuaaaauguuuuuaccaaaagaaagugucaugcuuuuuuccuuucuuuuuuuuuuugccuuuuuggugauaauccuagugaucauaaaccauggugugcugagcugcugucacacacuaaugaggcuuuuuguuggaaugagacccugaccugagaugcuaguauccuuccugacaguacaggaaaaaauaaagacuauaacaacuucaccagccugcgaacccuagccaauucagaaacuuuugguaaagugcaacuagaguguauuuucaauacuauaggaaauuuuuaaaguuacauauacacacaugcacacacacgcacuuacuuaccccuuugaagaugugccauccaccagcccagagucuaaguccuccaggucugugucucgagcuguacuucaaauuauaaacacauguguguuuuuuuuuuuuuuucuuuucagggcauacuuuucaagacaagauggaaaaucuugucugugcucaguuugcuaaguuggcuugcuguucucucuaggaaguauacaaagaggcuuagcauuguaucaagagcaaauaaaauagcuaagggauaucgaagcccuggguugcuuaaagcacuuggaaagacaugcugaaaguucacuagaagucagauuucuacuuaggcaucuuauguuuuccuuuuuuuccauuaguuuuuuucuuaaucaaauuuacauggugaguucacggcagacacaucuggcuacugugauuuuuccagcucugauguucucacugcuuuuggaacuuugugguuuaugcagcauagauuagccuaaagugcaccggcacauacacgcacaaacccagagacaaacaaacaaaaaaauacccauacacuuuuugggagaugguggaagugaaguguuggguguuguggguguuguagguguuguaggauuguugugguggaaaguuuguguuuauggaagaaaaggaacacuggugggcacaggacagggggaaagguuucuauuuaaaaaugauuuucuugauuaaaaaaaagaaggaaaaguuuucuaaacacuguagaaaaucaauuuucuuuuuauuuuguagagauuggggcgucucaccauguugcuuaggcuggucucgaacucuuagucucaagugauccucccaccuuggccucccaaaaugcugggauuacaggugugagccacugugcccucaauuuucuuagauuuugaggaagcuaucuauugucaaauacacucuaguuaaucagcauuauugaaggcuaccuucuuugggguuucgaagaggagauucuuuuuuuuuuuuuuuuuuuugagacagaguuucgcucuuguugcucaggcuggagugcaauggcacaaucucagcucaccgcaaccuccaccuccccacaaccuccaccucccggguucaagcaauucuccugccucagccucccaaguagcugggauuacaggcaugugccaccaugccuggcuaauuuuguauuuuuaguagagacgggguuucucuguguuggucaggcuggucucaaacuccugaccucaggugauccgcccaccucagccucccaaagugcugggauuacaggcacgagcacccggccugaaaaggacauucuuuauaguuccuuucuuuuacgguuuuuaaggaauaugugaaaugagacugaaaaaaauuaccaaaucaacggauugaguuccuuuuauguaauaaagcaggacauaauagcauauaaaaaauaaaucuuauguuuucauggcuauguuccacuuaucuuaauguggaugagucuuuauuaagauuaggugauggagacuuauagguuuuauuauaugaaauuuagaaauuuagguagaaaauuucuucuuugauaagaaauaauaaaagccaugaaaaaugucugaugccacaauuuuccuuaaaaaaaaaaaguaguaugcuaggugaauauuuugggaaccauacacaaagauguguuaguuauaauagccaguaaauaaacaaaugccugaaauaugaaaauaaauaaauuuauuuauuuauuuauuuucugagaugcaaucuugguccguugcccuggcuggagcgcaguggugugaucucggcucacugcaaccucugccucccagguucaagccauccucccagcucagcccccgaguaucugggauuauaggugcccaccaccacacccagccaauuuuuguacuuuuuaguagagguagguuuucaccacguuggccaggugagucucaaacaccuaaccucaagugacccaccugccucagcuucccaaaguaagugcugggauuacaggcuugagccacugcgccuagccacaaauauauuuauaagcagugaaauaauggauauagaccauguagacacauggaaaacuuuguuguaacauucuaauuuuacacagcaugacaaauuguuuaugcuauaauuauacuucuauuuuuuugaaaaacacauugcuuagauucuuuccauuuuuucacaagacuaagcuucuugaggacaggaacuugaucuccaucuguguauuucuagccccaagcaaagcucauuaggcaucauagguguacucuucuguagaauaaauguguugaguaagucaguuauguauuuuuaaauguuaauagugauuauaguuaagccuuugaguuaagggugauucccucuauuuucucuguaaugcgguuauauuacuuuuguaauagccaaaaggagaaaaaaaaaaaaaaagagugagaacaacaggggagaaccuugagcuuuuugugguggaagaggagaacaguguguuggaaaaaaggcuccaggccccauguguauuaaagacaaaaccaagaaugcucaggccucugcaguugagcaagucugccuguggcaaauagauuauucacuagucucuaagaucaguguuuauccaagcgugguccagaucuaccacuagcuggaucacuugggggcauuuguuaaacauacauuuuuagaauacagugguuuguuugcucccaaaagaauuauccugggcugcugcuaggaggaauaugcccuggaaauuucugugucaguaaauguaggguggaaucuggaaagguaugcuguuuucgagugcucagaugacucugaucaucagccaggugugggagccacaaucaaauuguguauguuaaggccaagugcagugucucacaccuguaaucccagcgcuuugggaggccaaggcgggcagaucaccugaggucaggaguuugagaccagccuggccaacauggcgaaaccccgucuccaccaaaaacacaaaaaaauuagccaggugugguggcacacaccuguagucccagcuacuugggaggcucaggaaggagaaucgcuugaacccaggagguggagguugcagugagccaagauggagcugcugcacugcagccugggugacagagccagacuccgccucaaagcaaagcaaaacaaaacaaaacaaaaaaagaauuguguacguuagcacagugaugggaaaaugccaguauaauaaaaauacaagaaccuacucaaucguucagucuuuaauuuaucugaaaaggacuuggaguaugcccaccaacuuuuuaacugauucuuugucugaaauagacauuuacuagggcauugacuuuugucauuuuggugcuugguguuagugcgcacaugagcauuggguaagugaaugcugaagcggcuucccagagcaucuugaccccaaauauuccaaguaaacuucaaaaaugaggaggaaaauuauagcuugggauccagauucuugaaauguauuguuuaauccacuggguaaauguacaagucugcuucaguuuugcuugcagagagugggccugagaauccaucaggccuucguaagccuaaaccgugacgaauuccagagaagcacccccacaccuggggaagagggaggccuuuuaggaaggugaaggcuaggucaaacuuguuuucuuuuuuaguccuuucuuuguuugcaccacauuaauuaauuaguuaauuaauuaauuuguaauggagucuaauuucuucaccgagcuguagaccucuguugagaguuuuaaaaauaauuuugacaauuuucauccuguuugcuggcugacuuccaaaaguuugcccucaggagcuuccuugcuauggagaauuucacccaguuaagggugaaaggcaggcagugggauucgaggugguuugucauucagccacuuguuccaaauugauaagugcugagugauauuuugacacuucucuuugaucuccucuuuggcgucccugguaauauugcucccgccugugugugaucaucaccucucccacccagguaccaacugauugauuucuucuuccuuucuggaagucuaaauuuauucccuggguguuuugcaguugcugguggucaagaacagcuguucuuccaugcuuuauucugaauaguucuccaggaugaagucagcaaaacaauaucauuuaagugaagccucaggaaaacaaaagccuugauugucuuucuccuuaagugcuaaaaagaagaucaccccucccccuuugugugugugugugugugugugugugugugugugugugugugugugucuguauuuuaaggcagaaaaaaaaaagguucuaaacauuuuugaagcagcaagauucaagaauguuauuuuuuuccauauuacauaauugcuauuuggucacuguagaaaaugcugauuggcaaaacaugagaaaauaaaaagccaugguaccauucaaaaugacacuaguguguuuucauauauuuucuugacuuucuucaaugcaaacauaaaaauaguuggaaacuccucuauauucuuuuuuguagcuuguuuuuaauauaccaugagcaucuucccauuucaguaauuuuuuuuuuuuuuugagacagaaucucguucugucgcccaggcuggagugcaguggcaagaccucggcucacugcaaccucugccucccagguucaagccauucuccugcuucagccuccugaguagcugggacuacaggcacacgccaccaugcccggcuaauuuuuguauuuuuaguagagacaggguuucaccauguuggcgaggccggucuugaacuccugaccucaggugauccgcccgccucggcccccaaaguguugggauuacagguguaagcaacugcgccuggccaguaaauauuuuucuauaauauuuuuugaugaguuguuuuaauuagaaaaguaacacacgcauauggcaaaaaauccaaauaguuccaaaggguauuuaugaaaaauuaggucuccuucccaccaugacccccagcccuuuucuccuuuccagggaaacacuacuaccagcuuccugagcauuauucuagacaugcucuacauacacaugcaugcuugggcauauacaguaugucuuuuuaaaacuuaacauaucuuagagagccuuccaaauuaguacuuacugauuuguucauuguuugucagcaauauguaauguuccacuccguugagauacuguacuugguuuaaccaguccugugugcuggauauuuaguuuauuuucugguuggucacuauuacuaaacaaugccacagugugcagccuuggacauaaauccuugugccauaugcuguuuauguauaggauaauuuugcagaaguggaauuccuggaucaaagaguauguacauuuaaaguuuuuaaaacuguuguuccauuucuuuccaaaaagguauaccaauugacaccccuaccaauaaaguguguuuucuuccccguacccuggccaauaauaucuaugauuaaacuuauagccuuuacuauucugauagcuacaaacuagauucucaguauguucuuuuuuuuuaacuuaugaauagacuuggacauacuucuuuuguucauaaaccaucacaucauguuaauggcugcacaguaguccuuuugugaauuuauuuaaccaauaaugccauaauuuauuuaaccaauucuucuauugagagacauauagguugauucuauuuuuuaucauuauaaaugauguuucaauacauuuucuugcacacacauacauuuuugugcccaccuuuaauuuccucacuuuuccaguuucuuuggaauguuucugaauaaaauauaaacauuucuuaaaaaauacaauuuugacaugguuugcuuuuaucaaacuaaggaauugucuaaagauccuggagcaggggauuuuuugcggggggggguguuacuuucuuuuaaaaaauaauguaacauuaccacaaaaaguguauuuuuaaccagccaccuagcuuucccacuaacucuguuuuucagcuuguauauccauauguuuuugacuaagccauaaauggaaguuucguuggaaguuauuuugcuucccaguacaugucaugcauuucauuccauauuauuuucguccuuuuccuuuucaguauuauauuucucagauaccagugaagagugaguugugaguuuugaauuuugccaagacuuaaauauuugcagcgcuggaaagaaagaaaguuaaaaaaaaauuaauguggcugauuuagucuugguucacaaggccuucauuuagcugcuucaaagcucacacuucaaaugucaagaaaaauauucucuuaauuucugccguaucaacugcuguaaugccugaauuaauuagaauggaacuauaauuucucuccaaauggaauuggaucaucccauccuaacaaaacaaaugcucagggcggcuccaugcuggagguuucuggacaccuucccuauaucauuucugccugggucacugcagccuagggcugccccuugggagacuucucuucugggauccucagcaugucuucuuugcuugugcuuucuccucuccucugugucuccucuaguuuuaaguacacauuauauuuuuccugcaauuugagggaaucucagugucgaaacuacgauauauuaaaaucagauggcuuucgccugaggcauucccuauuucauauguuugcauucacuggugccuucuccauccuccacucuuagcuugcucauuuuuccuccuaucaagaagaccuaaauggagcaaugucucagcucugacccugggauguaaggaccuuucacaacagaucucaagcuugacagucaacucucuuggugucccagguccuucccaagaaaaccugcaauuuccuauucugggugucugguccucaggggcagcuauccaguggcguuucuucugaaagaccuccaaccggucuguugggguagcucuuuguccugucuuccuaggcugucuauguuuuaaaauuagaaucauuuaacaguugggguuggggauagaggugggaggcuggaaggaacuaugaguaugagguaucagaauuauguagcacagauugcagcugggauucuguuccauccaaauuccaaucaguuaucaaaagcauuguuuaauaggaguuuccucaaaguucaacagugccacagaacaauggcccauacauaacacaguuucucuggucccugccggacugagaauucugucuccaggagguuugagguauguguagagagguuuuauuuuuuuaaaugucacuauuuauuuugaaagaauuguaaacuuacagaagaguuucaaguuuagucuaaggaauucccauauaccuuuuccccagaucugccuuuguuaauuguuugcuuauaaacauagccacgguugcaucuauccaucuauccaucuaucuaucuaucuacauauuuuuuuuucugaaccauuugagacaaaguuggagacaucauucuccuuuacccagaaauacuuauauuuucucaaaagacuuuuucuuuuuuucuuuuuucuuuucuuuucuuuuuuuuuuuuuuuuuuuugagauggagucuugcucuguugcccaggcuggagugcaguggcaugaucucgucucauugaaaccuccaucuccuggguucaagcaauuccccugcugcagccucccaaguagcugggacuacaggugugugccacuacgccuggcaaauuuuuguauuuuuaguagagaugggguuuccccauguuggccaggcuggucuggaacuccuaaccucaggugaucugccugccuuggccucccaaagugcugggaauacaggcgugagccaccgugcccagcuggacauuuucuuauauaagcacaguguagguaucaaaaucaggaaauuuaacauugauacaauacucuuaucuaauagcccagauucgaaaugucuucaguugucccggugauguccuuuguggcuauuuuuguuucuggcccaggaugugauugaggaucucacauugcauuuaguuguccuguuuccauaaucucuucuaauuuggaacaagucuucgguccuuguguucuggaccuugacauuuuugaggaauauauaggccaguuauuuugugaaucauuuuuaaauuuggauuuguccggcauuucuucgugauuuugguuuagguuauaaauuuuuggcaggaauaccauggaagugauguuguguucuucucauugaauccuaucaggaggcacacgauuuguuccacuauaggugacauuagcuuugaucacuugaugaagguagugucuauggaagguggggugggggcagcagagcaugcuugugccaaauggcuccucuaaugaauauguucuguaaagcuaaugaaauauguggaaaggcuuuuuggucuaccaggucucuauaagguauggccuaaaaucauguaaacucuuccccucgggaugacuaacaaguaaaauuuccaaccugcucaguuaagcuucacagaacauuauuuauuugacacauaauauaucugugcagcuauauacacacagguagguuuuuuuuuuaauuuauuuacaaaagguaggcuauguuuauuagagucacaagcaguugacugucucagugugacucaagaccacaaaaaacccauuucuccuucacuucauucugaguccuagacuggcagguguacugcuuggggcccauucacagguuuacaaguuucucauugagggcaaucugugacugacacacgaguaguuuuaaaaugaaauuaugaugcuuccauucauuuguucccuacucuugcaucuuaaaaaacauauaauucuuuuuuuuuuuuuuuuuugagauggagccuugcucugucacccagguuggagugcaauggcgugaucuccgcucacugcaacauccaccucccugguccaagugauucucgugccucagccuccccaguagcagagacuacaggcacacaccgccacgcuugucuaauuuuuguauuuuuaguagagaugggguuucaccauguuggccaggcuggucuugaacuccugaccucaggugauccucccgccucagccucccaaaguguugggauuacaggggugagccacugugccuggccaaaacauguaauucaaaaggauaaaaauaaauaauugaauuaaguugggguaaaggacuguggcugagaaaaaaagccagggaaaaaaugcauaccauggggccuugugugguugcuagagguaccuacagauuuggcugugagauuccugggggaucuuguaaagaagauaauaugcucuguuauaggagucagaucacucaagagauaaaggcuuucaugguguugaagagaaauguaguuuuucuagacacagagauguaagagggaguucuccuguacuuccccguaagucaucuagacucugugaucuaggggacaauguccuuaaaaaagaaauuacaguaguggccuggcacaguggcucacgccuguaaucccagcacuuugggaggcccaggcgggcggaucagcugaggucaggcguucgagaucagccuggccaauauggugaaaucccaucucuauuaaaaaauacaaaaauuagcugggcgugguggugggcgccuguaaucucaacuacuugggaggcugagguaagagaaucgcuugaaucagggaggcggagguugcagugagcugagaccgugccauugcacuccagccugggugacagagugaaacucugucucaaaaaaaaaaaaaaaaaaaaaaaaaaagaagauuccaguagggaacacuaggaguuuuauggggaaguuuucuauagucuuuuuaaauacuggguaguggcaugaucucagagcaccagccaguguucacagaagaccaaaaugaguguauacuacauaugcauuuugauucaaggauaacauuuagaaaauccagaacuguaguuuuuuuguuguauguuuuguuuucauuuuuaagaaggaagcuccuuuugacacaccuucucaaauaaaauuuagagcuacaggcuuuuauuuuguuuugcuugggaucagaaucuccucuuuguaaguguuuaaaagcagagcugcuuugguuucugucuguucccccauccuugccccaaaccuuauuccuuuccuucccaaagauccugaaccacuuuacagggcugagagacaacaaaccgagaggcauugaucccaaggaguggccucuuuccuucaugguuuguuuguuuguuuguuuuugagacggcaucucacucugucucccaggcuggagugcaguggcgcgaucucggcucacugcaaccuccaccuuccggguucaagcaauucucccgccucagcuucccaaguagcugggacuacaggcgcgugccaccauacccagcuaauuuuuguaauuuuaguagagacgggguuucacuauguuggcaaggcuggucuggaacuccugaccuugugaucugcccaccucggccucccaaagugcugggauuacaggcaugagccccugcacccggccugcuucacacuuuuugacucacuucacugugugcccccagagucucuggauuucuucagaauuuuaaauuuuaccauagagugugaaauaaucuggcaguuucccaugcaguccaggcagucagcuggaaggagauuucuaucagucuggaauagaggccaaccacagugcucaccacaggcaagaggccucaagggaccuggucccggccccucacccucugcuccucagccacaugggcugcucugauuuugcacaaguacuccaagcucacaguuuccaccuuaggaucuuuguacuugucccccacccugauuuccauacuucauucagauuuagagcacacaucacugcuucacagaggccuuucuuaacuucccugccuaaaauagcuccacauuucuuuguucaaaucccuuaucacuaaaauuauucuguacauuuguuauagccugucuuuucguuagacgauaaucuccuacagggcagggaccuugcugucuuguucaucauuguaucucuacuuccuagaaacaggggaaaugaauagcuaggugaaccguagaucauuggaaagaaaaaaaaucaucuauaguucuauaagcgaaacaccaccacuguuaauauucuaauacuuuuucauuucaaagguaauuaacuuuuugggggucacuagaaauccuauaagauauauggguacaguccucaaugaaaugcauauuuauacagguuuccaaaauuuggcauauacuucuaccagauuuccuaauccuguuaccccugguuacauucuucuuucguuuuuuuuuuuuuuccugagugguccuggcccaaugcaaagcaccuaaaccacacuauuguuuuugcuuauuugauugcugaaaaaggcuguuucuuuaauuugcauuagugugauuccuuacgaagcugauaauuugccauauuuuauuacuaauugcauguucucuuuuaugaaucguucaagucuuuugacuaccucuuggaaucuuaguaucuguuacaugaucuccauaauaaagauguuuacuaaaagggcaugcuauuaaaaaacacaugcacacauuaaaaacuagcaacucacgcuggcaacuuuucuuccauuccguguggaacacagcuguagauucguuuucucuuagcuugggcaacugccauacuucgcaccuggaguaguuuuaaaaugauucaggaaagcuaaccaauaaaaagcuacaauaaacucucuacugacuaaagaaaaauaaaugcaugaaucagaguuuccauuuccugcuggauaaaaguauaccuauugucugaagauaacaaaacaguuguaguuguacugcuauugcccaaccauggaauuauauucaaaaucacaaggacaacuuugugaagcagcaaagugaauaacuaaauuuccucuuuuucacaggcuagauaauuguuuuucuaaauucacuaacuccauagaggugcuuccugccacgggccacuugugauaaaucuugagauaucccugcaaucaaauggagucagaguagcacauucugaugcugcuuuagguggaagaaagaguucuuucuuuacaggaaaaaggauccagaagaaaucagccugccagaaagaugugauuuuuuuuuuucccuagacuucccuggauauauuauaaugaugagaacuaaugucugaauccuuuaaaugccaauaaaauauacauuugggguaaugcaguuauuaugaaaauauaaaagccaguguuacaggcauuucuauuuuacaccugaaaaaggagaguugccuagauacuugcacacugguguguggacuacauuauuguuuggaugggcaggcaggauagcaaguaggaaaaucauuuccuggugcuaaaaauucaggguuuccugugaaguaaacgaagcuuggguuacaagucuaaaacuagacaggcuuggggcaucuggaggaccggaggcccaucuggcaagcuuuggggcaccuggaagugguuuuaaggcuugaaacagugaagcugggaaaguguggcugaaucaacauauauuccagagcucugugccuuaucaacugagccggcugagaaauuuccuugcaguuauucucacccagaauuggaauaaagggcucagugugaaguugggauaguacaacuucucgguuuaauacuuuacagauuuuuggaaccaaaugcacccugaagugaaaagcugcuuuuuuuuugcugaccuuguuggauggcuaauacuguuucugggaaauaagagaaacaagcggcucauuguuggcaggagcugagagagacacaaggagggcgagagacgcgucugcagcccuuuuuuucccuucauuguaucgugacugagucaaggcuggauuguggcuggguuuuucuuccuaccucuguagacauauguuuuccaucagacagggcugcgugacaccugacguuggccaguucacaugaguuaagccauggacggcgcauaaacagaggaaaagacccgcagcugcacccagacacucuugaugcugaaauauuuuucaaagcuugauguggcugggucugcacauaagucagaaacgauuuacaccuguauguuuuggcuugcuucuuucaguugcauaucauuauucccacaaagccucuauggccagaaggucuaccauuggcugauggcagcaccucuccuucccauauauaagccuuucuaaauuaugaaaugugaguuuucaaaguuuauuugauuuuugucuuuuuuuuuuggaggauugaagaacaaaaugcucuaccauuucuauaaagugaggucacacaaauggugucaucaaaacaugcgauucacguugaucccaucauuuuaaaguaaauaaguuaauuaaaauagucuguuagacuuuuucaugaaauagggaaaaggaaacacuacuuggccucaucaccaaauuuaacuuaucacguauauuuugaugacuacgaaaaaggauugggcagugauuggugauccguuggugaucauugggcaguaauuggugauccaugcagcugaugccagcuguaguauucuagcaggcguuccggguuuccuagguuugucgcagccuguuccugagaucugggcugaggcauuuaaucuuccaauauucuucaucucuaaaauaacugaauuagucuaaaucauugguuuuaaagucugucccaaagucccaugcuagaaucucagggggaugugagcagaagcuaaccuuaguguucaguuuccaaaagcugggcccuguucaauguguuuuaaacauuuguuuaaaguuucagcaugacacuugagaaaugccugaagggaaagcagagugaaagcaagaccaagaugauuuagagaagacagucaaaggugcugacuuuaagugcuaauuuccucagcugaugaaagaacccugggacauaaggauagccucugcuucaagccguacacuuggcucuggagaaggauucuacuacuaaagaaaaguuugagaaccauugcucuaaauggacuaagacccuucuauccugaauuucuauggugauagcacaaacucggguaaauacauggcccucaccuauaaugagugcuguggggaaagugaugaguuuguaaaucaugugugaaacucagaaugaaauggggcuaagcaggcaacuaugcucuggaaguaagaggaagcagcaacuagaaugugguacccuuuggauauuccccuaugaaacucuagagguaaggguuaaaaugcauccucuagagaagaugaguuaugggugaggcguugccaguuuuuuucucaguucucaucuugauuauguuucuauuugaaauuuaaaaagccuaugaugaucaucuugcuauaaauggaacugauauuuuguuaccaauuucuaaccucccuuaaccuuacuuuggggagaauguauuuagugccuacucugugccuuaaucagauuugaaaugcacuaaaauuauuuuuguuccauuuuuguaagaaaggaagauccauaucauugugauugguccugagggguagggggagacuuugcucuuucccaggucuuguuuauaaagagcacaaguccaggaacaugagaguuaguucaaaucacaggaagagaauaguucaauguuucuuaaaagagcuuuacuucagauguauggcucaaccaggaguccaacaggaaagguuuuccugacuuuugcauuuaaccaagugcauguuuaugggugauauaaugcagucauaaaauaaaugucauaaauagugcuugauuuccuucaaaaauuacagacaaaaugaguauguaauauucccauuccaauuaucacauaauauggauacaaaaggacaaccaccaauuuuuaauccaaggaggacacacugacagcuaaucuggauagccugacaguucugaauaaugaaaggucauuuuguacuggcuccugguucucuuuuuaagggaaggcauuaggguggaaauaggaaauuugaguucugcugcccugaguuagcccuaggucuauggauggccauaggccuggagugaaaaaccaucccauuugccugggacuuucccagauuuagcacugugaccuguguucugggaaaccccucagucccaggcaaaccaggauaauuggucacccucugugacagagaagaagagaaugaggugauuguaaagcuuugcauucuaacuuuuggaagcuuuuaugcuccccucucauguuggguuuagguuccuggaaaguguuucugaugaaguuuauaugaacuuacuggcccaaauaucaaacugaauuaaacacuuguuccaaggaggaaguuucccagaugccauaucaaguguauuacccaguguaugccuuugaauguugcauauuuaccuauuuugaagagacugcauucaaguuuuaaaaacaaugucagccucuaccuguucuacucuuuuuuuuuuggagacgaaguuucacucuugcugcccaggcuggagagcaauggcguggucuuggcucaccgcaaccuccugccuccuggguucaaacgauucuccugccgcagacucccgaguagcugggauuaaaggcaugcaccacuaugcccagcuaauuuuguauuuuuaauagagaugggguuucuccauguuggucaggcuggucucaaacucccgaccucaggugauuugcccgccucagccucccaaagugcugggauuacugccugagccaccgugccggcuuuaccuguucuacucuuaaaggaugauguuagaaguguuauuuggaauaguugaugugguuuuauuauagaagcaagcuuuuuaaagaaaaaaaaaaacuaaaagauagauaauuuggaauauauguaacugaaguuaauuuagcaaggcuuugcuaacuaccugugaaaacugauacggaaguuaagccaucuuugaaauuuucuuuuuaaaucaucacgugcuuauggaaaaugucagcagauauucaagcagucuuuuauaacccuugcuuuuccuguauuuuguuuugcuuuguuuuucuauuacucuguaucuugaacagcagucccucauucuaggcacaugaaacugcuuuguucaacauucccuguccgcuuuuuucccuucucuggcuccguguccuaaacagcuucuuuaauuaauuuuaaagagcuaagcacacaguagggacuuaauauaauauucauucauauuuaauuuauaauucaguacucugccaagacauccacugaguuacaguggaccagcauuuccuaguauuccuauccagaagaauaucagccuugcaaguuugagaaacgaguuguugaauucauauaucucuuucagaaagucuugguacccccuauuacucuaaagacugacaaaucuuccaauaaaauaaauuauuuuaacuuucuuuagcccaacauuucccagucuuauuagaccagggaacacuucuagaagcaauuuaaaaaguuuuagcuuaauaucuauuuauuccccugggacacauuauagaccagauuuucucuuaaagauuguguccauuuguacauaccccaaccauugacuauuaaauuaauauugacuauuaaaaagagaguagccagcaaaguuccugguauucacugggcacguuaaaauuugcuguuuuucaaaccaguuuuaguuuuauauuaaaauugagaagagaguuccuauacacucacucacccaguuuccccuguuguuaguguauuacauuaauaugcuacauuuguuauaauuagugagccaguuauuauuaaauccauacuuuauucagauuucuuuaguuuuuaucuaauaucuuuuucuguuccagagucccauacagaauaccaaauuaccuuuuuguuuuguuuuguuuuguuuuuuguuuuuuguuuuuuugagacaagguuucacucuguugcccaggcuggagugcaauaguaugauuauggcucauuguagucucuuccuccugggcucaagugauccuccugccccagccucccaaguagcugggaccacgaaugcaugccaccaugcccagcuaauuuuuaaaauuuuuuguagagacagggucucacuauguugccuagguuggucuugaacuccuggcuuccagugauucuccugccucggccucccaaagugcuggcauuacaggcgugagccauggcgcucagcccccauuaccuuuacucaucauaucuccuuaggcuccuuuuggcugugacaguuucuuaaacuuuccuuguuuuugaugaccucaauaguuuuaaggaguguugcuuucguauuuuguaagaugccuuucuauugaaauuugucugauauuuuucucuuagguagacuggaguuauagguuuuuggaggaagacuacagauauaaaguguuauucuaauuacaucacaucaagggugcacaccauuaucaugacuugucacuguuaauguugaccuugaucaccuggccaagguaguaucuuccaaguuuuugcacaguaauguugccccccaacucccaucagccaccacucauucaauccuguguucuuuggaaugaacucacuauuugcaguuauguugccucccauccccccggccuuugagcauggugugucuacauaaaugauuuugaauuccucuguaagggagauuugucucuccuucauccauuuauuuguuuaauuaucuguucauaugaauauggauuuguggaaauuacauuuuuaguaaacuaaugaaccacagucuacagccugugaaaacucccuauuauuguuggaaccgaaguacuguuaggaaauaggugcuggggauggaaaaagucauggagggcuuggggaggccuuacccauucacuuaaauggaauugugccucugacacauuaacaaaaccacauauucuaaaaaauucaccucaaagugccaagaguagagauaccuccacugagaaguuuguugucgaaaggagagaggagggagauacaacaagaaacgcauacuagccgaagauauucuucuucaccuuccaagacucacaugugaacugaggagaaggauuugaagggagccaaguaauuucugugucuuccuagcacuuaggugugacuucuagccacugggcgccagcuguucuuuccaugaucuacucagagccagccccuugcaggccuguccgcuaugguuuucguaguugagccuacccuuaugguuuuguuuucuucacuuggcauuguauauguguauguguguaacuaaaaccuauuuuaaaaaugagggaagcaagcccaggacauagaagagcaagccacugaaaccugccgaggccaaaaagacguuugugaaacauuccaggaggugcucugggcagccucugauucacuggccucccucaucgucugcagcuccuggcuuagggaagcugccaaaagcacuuucucuacgagcuguggcucucuguuuccugguguugcaaaaggcaaaaguucaggauugaagccuuuaccuuuuccauguuugcuucuuauauagcaaaucuugugcuggcuuagaauugaguccgggcgacuuucuugccuugagcauacacuuagagcuuuguagaaaugaccaaguguauauugccccaggcagcacuaaccagagggucauguccuacguaaauaaccccaccccccgccccauucccguguugacuguuugcuucaccaaggacacagucauugaaucaaaaguguguuuguaucucagaugccuuggcacuggcgguuuugugugugugugugugugugugauuuuuuccuuuauauugaauaaugccaauuaaauguuucuggucacacaucugcagagcaugguuuuaucaauuuccaaacacagaagagaaagccaauuauuaaaaaaaaaaaaaagaaaaagggaaaaggagaugaaaacaaugaaaaagaaaaagauaaaugggaaucuaaauuuaaauucugacucucuuggaaggaaaaacaaaaaagaugucccugcuuuagcuuugaugcauuccugcuucuauggagaaaucuucuguuuggguuauuccuuucuggggggacuggcaacggucuagagcugacgaggucuuuagccuuuuugaggcaguuuguggcagucugcccuuaauccggcuuggccucagauacugcauuuggaauacucugccuuuucuuuucuuuuuuuuuaagcuggaguuucgcucuuguugcucaggcuggagugcaauggcgugaucucgggugacugcaaccuccacgucccggguucaagccauucucccuccucagccucccgaguagcugggauuauaggcaccugccaacaagcccagauaauuuuuuguauuuuuaguagagacgggguuuuacuguguuggccaggcuggucucgaacuccugaccucaggcaauccaucugccucgaccucccaaagugcugggauuacagacguaagccaccucgccuagcucuuuuuuuuuuuuuuuuaauggaacuauuguucucucccuaaaauguucuggaauauuaucccaaggaguauuuuguucaucacaaauuuagauguuuugccuucccaugcucugcugaggacuuuguuucucuuuuucucugccuuaggccuccucugcccucagugucaaaagcggugguuuuaaggaaccucaaccacaagugaagcucaugagcuccagugucaaugaugguucaguaugguuugaaauuaaacaacuagagggagcauaguggcaaggugaaugguggguuccuggguugagacaagucaccuggcuucuaggauaccgaccgguuuuaugaccuugauaaaauucacuuucucugaguuuugguuuccucaucuccauaaggagagguugcaccaagcagacucucagcuuugacagucuugauuauauccuaagcuguauuuguuguuuuucagauaauuuggggcuucuuucuuucacucuaccaacaaaauauugaguuugaagcuuacauggccauguuuuuguuuuaugcuuuaaaauuuuuauuuucacuuauguuuuacauuaaaugauaaauucaugugggaaaacuuaaaauaguacagaaaaggaaaaggaagaucucccaucccugauacccaguuucuucugccgaggugcucgcuguugccggucucaggugugcccuucuguggagauuugcugcacaugcauaacaugccccaccuuuucuaaccacaacuaguaacaugcucauaauacaguucuguccuuuggguuuuuccccuucuggacgaucucuaagaaacauuggaaucaucauacagaauuucucuaaauggguggaccauaucucccacugauggacauuaagaucauuuuuaaucuuuugcaauuauaaacaauacuguuuugaauauccuuguacaaacugcucuguugauaugugcuuuacuuugaaaacaaagcuaucaucuaaguuccacccuuuuccagacucuacaguuaauaaugagagauguuuagucugaaagaucaaaucuaaauuaaauggaagaaaccaguguuuccaccauuaccuccugugaaugucucaaguaggggcaaguguuuuaaagacucacauagauguggcuugggaagagcuccucuccaagucugaaacuccuccagauuaggauucagguauuaauaaaaucugcugagcaauaucugguugcuauguggcuuucaguaauacaguacacugcuugagaguacgcccaaugcagcauuuuguacaccgacaagggcagucuaccuaagugacugaugauaguccuacuagaauuuguuaugucaguaagucaccugagucaguuauaaaauuuuccaaaguaucuaaguuauaaaaauuaacauagggcugggcgcgguggcucaugccuguaaucccagcacuuugggaggcugaggcagguggaucacucgaggccaggaguuggagaccagccugccaacauggcaaaauccugucucuacuaaaaauacaaaaauuagcggggcaggguggcacacgacuguaauccuagcuacucgggaggcuaagacaggagaaucucuugaaaccgggaggcagagguugcagugagccaagauggcaccacugcacuccagccugggugauagagugacacucugucucaaaacaacaauaacaacaacaacauaggguuaacaaccugugccuuugaagccuuguuuuccuaaccuggguauuucugauaucagaacuauugggcaucuuuuuugucucuaguaguugugucagauacuaccauauuaaauauaacuacuaguaagaacauacuuuuauagaagguucagaaaugccuguuccuugaaauaauuaucauucuuccaucugcgccucucuucccuggcuugaaauagguuucaugaauuaaacccuucuggaugucuggauuuugucuuacuugaaucuguacuuaagggaacuuuuccccugcgacaccaucugugcaaaacccuuuaccucccaccccaggccuucaaguagaaguuguaauuauacuauaacaagcucuagaagugaaauacucaucucagguuuuuuggcaucaaucaugacugugcuuuuucucuuguucuuaaucuaagaguguaagaaaugcccaacugauuuuauucauucaucagaucguuuccugagcuuucccuguguaccugggauugugccaggaggugagaguccuugguggcaggcuuaauucuaagggggaaaccuaaacugucuaggcaauauacacugauaucuucccuuuuacuagcauguuauugggcccagaguuguaaaucuauccaggcuuuccucgagcccuuccucuuaguaacgcaagcaacauuugggucccuauuuugaugaccugcugugugugugguacuuucuugcaaacaauugaaggcagauugucuuuacaggguugcucugaggcuucagcaguuguuccucuucuucagucuaagaugugacagaagguggcuagggacaguuggacgggguacaagaggaucucgauuuuggucuuggcucuacuugccacuaaccagggcacaucccuuaaccuuucuggguuacagucccuauuccauaaaauaaggggauggacuagauaaucucccagguuccuuauguagccuaacaguuucauguuccauaagccacucauaaaaauccaucucauuucuucacaccucucuuccaccaguccguuaguucucaugaaggcaggagcuauuuuuccaaguuuaagcccagugcaugacacgcagcaggaauugcaauaacaauuucagugagcguauggacaaaaaagaacauuuuuaucccacccucaccuccauccuggagaaaucuuugccauugaauucuuccucaaagaaaucuauucuucucuagaaaagcuucaguguugguauugucuuucaaauguacauauaugucguucaaauauacacauauauuauacauuuaauacauauauuuaauauauggagauuugggcuacuuaaauucauuuaaggagauuuacuuguaaaucauauuucuacauaauaugcauagcaaacugaagaugaaaaguauuuaacuuaagccaccaggcgugguggcuuccaccugcaaucccagcacuuugggaggccaagguaagaggauugcuugagcccaggaauucaagaccagccuaggcaacauagugaaaccucgucucuauguuuaaaauauauacauauauaugaaauauuauaaaaaauauacauauauuauaaaauguuuuaaaguuaaugauaccaaauauagcaaaaauugagaauuuuuuucucagaaaugaagugaguauauaaaauuauaccuuguuuucuuugacccugaccuaggaggaaauagacugaaaagcaugguuuucuuuauuacaugacauugcccagcagaaguuaagcaaauuugacugguaaacaauuuugagaaaaacuagcacuuuuauaaaugcauuuuugcagaaauaccaauuauaaaauuuauuuaaggauuuuaaaauuauuuuuguaaagugaaguucuuuuuuuuuuuuuuuuuuuuuuugagacagagucuuucuuugucaccaggcuggaguguaguggcgcgaucucggcucacugcaaccuccgccucccggguucaagcgagucccugaccuuugccuccugaguagcugggacuacacgcaugcaccaucaugcccggcuaauuauuuuguauuuuaauagagaugggguuucaccauguuggccaggauggucucgaucuccugaccucaugauccguucgccuuggccuuccaaagugcugggauuacaggcgugagccacugcuccuggccguaaagugaaguucuauaugcugaaauuucacugguuguuaaaugcagauaaauagagcauuuuaaaaaaauugaaaauauuucucaugcguuuauccaggcacaacauguuuagcauuucugcauaauuucuuucucacuaauuucucccuuugaagaaacaaacauuuuuuucucagucagauauuuguuccugaguuuagcucauagcucaggcuuccuugcagcaugcuuuucaaacaaaggauuaauggaguccuccuuauaugucggcuccugaucuaggugcuuuguguuacauguuguuugucaauucacugguuuguguaccaaagaucacaugcccuccuuaccucugccauaaacacacaaauuaacugagaaaguauacacaugcacacacacacacacacacaaaugaucuggugaaauuaucucauaacuugugauaaccuuuguggaauuugcuuuagaccacuauguucuauguaaggcuuaaaauguacucuagacagggaggugugaaaugagauuuuaacagaaacaaaagccgaggcuagaugagucaggauuggggccaguauucgagccuccgugaauugaauuaagguaauaauuacuuaaacaguaaugguuaacaggaaaguacuuuggaaggaaucucaggaaucuauacuccaaagcagaaaacauucugauggucuauuuuugauaagguauugugggcccuggucauuaaucuguauguucuucccucuugcagugaugaaucaccaacaccagcagcagauggcccccaguacccugagccagcagaaccaccccacucagaacccacccgcagggcucaugaguaugcccaaugcgcugaccacucagcagcagcagcagcagaaacugcggcuucagagaauccagauggagagagaaaggauucgaaugcgccaagaggagcucaugaggcagguauggcuuuccauggugucugguggaggcucccuggccuuggugccaaagcugauggguagguagcugcuuaccuucaggguaauucuucuagagaagaagagacaauagggcucaaagcccuacuccaagccucuugauuaaaauccaguuucuucucucaguguucugccugccuuuucagaacgaagcuuaaggguacaaggacgagcuguauuagcauggcugccuuuggcuuccacugcuagucuuuagaaggagagaaaggagaaaguagagagacaagagucuguuguuguguaacaaauuaucccaaaauguaguugcuuaaauagccauuucauuauaucgcacaauuuugugggucagaauuuagaaggggcucaccugggauauucuucugcucuacauggcauugacugaggucauuuagugguauucaacugguagguggguuggucuggauaguucacaauggcuuuaccuaaguggguggcaugauggugaggauugcuggaagacugggcuaagcuggaacaaaagccugggaucuaugguguggcgaucucagaguagugguacucauuccauagcagcuggguuuucaagaaaaagcauucuaagagacaggaaguagaaguugccaauuucuuggggccuagcucuggaaacggucguggagucgcuuuugccacacucucuuggucaaaguagucacagagaaccccccgagauucaagcagauaguggaguggauguuccucagaagaaaugacaaaggaucuugguccaccacagagcaugaaaaagagggaagcugaagggagaaugagaagggaaagugguuuguauauggacuccaacagagugcucugcaaaacugccugggcaucaaucaggcacuuuuguaccauacuccauucauucaguuuucauuccgucagucaggaguguguugccgugugcccucugugggucaggcucagugcuguacuucaaaaacgaauacaagagaauuccuaaaagaacccacagugcucucccuguuucaguggcuuggucuauggaagagcagaauucuuucuucuguguugcuaaacuaauauaacccauguuuucaggucucaugcuuuuuuucuggcuacauuuuuggggagaaaagcuucaguuuauuguuuuaacuuuucagacuuuguuuugugacucacaugaagcaagauacaugaauaacuuccuuuugcuacuuuagagaaauuagagaaauaaguaguuuuaacauuccagagaacuuucuuggaggaaaggaccgagcauguuaggguaaaugcuguuuuuuuaaagcuacauuugauacuuucaaaaauacacauugacuuccaugaaugaauaauguauuucucaucaaauacauuccaggauauaagaaaucuauauugugugagguuuaaaaugcaugguaaauuaaaaucauuucucagauauagucuuugaaaauaaggaaaaugaauauaaauugugcuuuguugcucagcugaacuuuccuccaaauuugaggaauacaacuuaauaauuagguaacuacaguugugucuuuuacccugaggauuuauguuugaacuuucacgguuauuucaggcuaacgguuguuuauacugauuuuagauauauagugucauguuucuugaugggaaguaauuguauuguuaauuguuuucugucuuugaauaauaauuuuauuuggaauaauuuuucuguuuuauaauguaagguaaauuaaacaguaucccaacagcauuuuauacauucucaguuuuauacuuaaaugagcuuuagugaguuuuuucuuuacacaaaguugugaccauucugcaaagaaugacuugcuucucuguuuuugcggguguguuucucuuucucuugcuucuccuccuucuuucccacagaaaguauuucugaaaaggggugggaaaagugccccaaauuguuuccuuuauuccagcuguaggugccuuugaaccaggauguaguacugaugguucauauuacagaaaugccaaccaaguuccuuaaaugcugauccuuggaggcuguggaacguggggcguugugcugcaucauagugagcaauugcauuguugcauuguauaugaagcaggagaaaagauuguccagauuugcucacagggacucauguaguucagccuugacucuguguguguguguguguguguguguguguguguguguguguguguaguuaggaggagauggaaugguggagugguugguucugguguucugaugccuuuuuauuuuuguuagggaguacaggaaaaggucuaaauagacuuuuuaaucauggcagauuuuuuccccaugcagaagcagcaugcuccugauugucaaagauaugauuuaagaccauauaauaaauggcauuggaguguucuauaauaguuuucuggggcauuugccaggacaccugauuauucaguauucaggugugggcucuguguuucaucuugguggauuuuuugaacucuuuuggugauuuucugcuucacuuuuugaaccuaagccauggcagcagcagggaaauggacuggaauuaaaagugaucuuuggcucacuuguuuaguugccuuccagcaucugguaggaauuuggagagaugggggaaguggugguucuggugaaauuuaaagauuaucuguacacuucuguuuguucucucuguccuaccccuauguccuggguagucaacaacugccugaauaucccuugcucaguggacaguuuguaauuacacuggcucuccucuugcuuguaggcggccuuaauuguacagccugucuucuuggggcccaggcccugcagguaggccuagaccuaccugcccuucuaccaacugagccugucugggagcaaggccccaggcuaugcucucuuucuguaguagaaagggagguuggcaaaauuuaauaaguagaugaauuuauccccuaauuacuaauaaauuaucacgcugucuauaguuuuaucauucuugaaugauacgacgaaucugaaagaucccuguggagaauaugcuauauaaauauuguuucauuuuucuuccuguuccuucugcuaugccguuguuccacuaggcauauaguuugaugauguugugccaugaaaaaaacaacuccuugguccuuguugcaugauuugauguauaccacaaugccaaagggucaccuauuaacucauuggcauugaaaucaugcgagaacauuaacaaaauggaucugaggaaacuuugauuacaaaucuaaagugagccuucauuauuucaguauggaagcucauauuuuuuuuccuuccuucauuccuuuaucucuucauucauucaaucaauauuuauuuaguagaaaauaacagacagguaaaugggaugugacugccuucagauaacuuguauuuuugcagaaaaggaaaaauaauuaacuuuaauccaaguuaaagaccagaagaguaaauuaaaaccauucccugcuucacaggggcccaguggcuaccaucuuugacuuucauuacuggaacugagaccagaugcaccugagcagaguucugugaaagugagcaucagauacuccuuuuucuuuccagugaccccucagguuacuggcuacagaauuaggaucaaaagagccaguaagguuugguaucucugcugauaaggaaucuucugaagcaggagaauuuccuuaaaugcagucccuccaaucuagcauuggcugguguagcaacagagcugagcuacuuguaucugauaauugaugaauuaucuuggaaugcggcagacacuucaaguggagggguaccaggaaucuaacauggaagacauaaagagugcauuucugugaaaggaagucuuuugucugugauagaguuuucuuuuauuuuuacugaauuucccaaaggcugugaggcuacuucagguucaccaaagaaauggcaacucuagaaaaaaaaagcaauucuuauugaaguuuugcuuucucuucauuuuuuuaaggaaauuaaaauuugauuuguugaguuuuuuuaaguagaaaaaaauuuuaauuuuugacuaagcgugguggcugacgcguguaaucccagcacuucgggaagccaaggcgggcagaucacuugaggucaggaguucgagaccagccuggccgacauggugaaacccugucucuaguaaaaauacaaaaauuagccagacauaauggcgggugccgguagucucagcuacucaggaggcugaggcaggagaaucucuuggaccugggagguggagguugcagugagcugagaucgagccacugcacuccagccugggcaacagagugagacucugucucaaaaaaaaaaaauuaaaaauauaauuuacugaguuacuuuagugauuagcauuuaaaaaaguguuuuugcuaagugcaagaaaccagacuuccccccaaaacuacauccuguaugauuccauuuaugugacguucuggaaaagcaaaacuauggggacagagaagagaugagcacuugccaggguugacaguacagaaagaguagacuccaaaggggcagcacugaggaauuguggggcagauggcacaguuccgugucuugguugugguggcuauuucacagcucuacauuugucaaaacucagacauguauaccacaaagagugaauuuuacuguauguaaacaaaaagaauaauaaaagaaaacgaauugcuacacacaaaaagacaaaacguauguuuaugguacggaauguauaaaauacuaaacaacaaagaaggaaauuauaaucaccuauacucuuaccuagaaagaguggcuguaaauaugcugaugauuucuuucuagucuuuuuguauguaucauguguaucaaugugucuacuuuguuuuuuaaaacacaaaagugguagcauacuuuaauacugcuuuguugccucuucuuaauauauugggaagucauuuuuuuauucugugucagccaugaaguugugcugugacuuuguauguacccauuccaaagcgccuagaauccuuucuacaacaggccguacauaaauuuuuaaaugucaugagccacacacacccacaaugacuacagaguauucuguuguuacaacugaaaaauucaacgcaauauuugcucaguauccuaaaaggcacaauugcaacuuuaccaaaugaagugggaaaucguagucacaggucagacauugagaaacaggcuucucaaugccuguuuaucuaaaagaacaauuccuugacaugaaaacaggcauauggcuuuaccugaagagaguauuucuuuucauguguguuauucauuuaaauauaacgguuuggggccaucuuucuggaagauuuuaaccucgaggaccaggaccuggaagacgaguaaguggcaaagccuuggcucccccuugucccuucacgggggcugccuuguagagaaaucauuauucccaaagcaaauucagcccugcuuuuacccucaaccuuuucuuucuuuuuuuuuuuuuuuuuaauuuggggguugggggacaggagaaugcaguuugucaaacaaaaaugcugacuaagccuggccucgggucgccggggcaacagggacgagaaaagagggaggccucggaauucuuuuggcaggucugugggauuucugccaggcuugacagccaccaggcgcggcgggccagcuggcugaccucgcacagccauccugacagagggcuccuggagggggacacaccuggcugugagcagcacuggccuggggaagguucugaggccccccccuuuuuuuuuuugucaugcaaagaauagcuauuuagcgagcuaggagagugucguauuggagcagaucaugaagcauaaauguaggcuauuucauagccuuugcuucagaacaggggacuauuuaacuuuuagaaaagcauuucauagcauuagguuucagaguugacuggguuaacagaggucacguagucuaauauuuugugaaucuauaaaucccuccauauaagcuuggcuauuuaaguucauucguucauauauuuguuuuacaaaugcucuaggcauuaaaaguacagcugugaacaacagaccccagccccuucccucacagagcuuccauucuagcuugugucaagcguuuuauuugcuuacaugucccagaaauaauccauuuuccaaaaugucccagugugcccuuguuguugaacaauaguaucaauucaagucuuuuuuuuucuuuuucuucucuuuuugagacacagucucacuucaucaccuaggcuggagugcuguggcacaaucuuggcucacugcaaccuucaccucccagguucaagugauucucaugccucagccuccugaguagcugggauuacaggugcgcaucaucacgccuggcuaauuuuuuguguuuuaguagagacgggguuuugccauguuggccaggcuggucucgaacuccuggccucaagugaucugcccacccuggccucccaaagugcugggauuacaggugugagccacugcaccaggccucagccuuuuuuuuuuuuuuuaagugaagacagacgaguaucuaaauuauaauguuuucuuuaaugugauuugaaaggacaacagaaaccaguuguggaauaauacaaauuugcuuuaugcacucugaguaaaaagagcaacaaauagaccauagauaauaaugacaaacuuaguaaauggcuuccuaaaaguaucgcaguuucgauuguucuuuuguagggacagucuggcagcugagcauuagugaugaguuguuucaaaaaggcagucuccgggaagugugacagugcauuuuagaaucccuuggcaccgaauuaaaaagaaauauacaucaguaauuuuuuuuuguuccccccgccgucccccguaaagaagguaaauaauucggcauucucucucugaagucccucaggguuuuggcagagaaagcaauuucucugcauccagaauaacuauuuuaauguuaggauuucaaaauacugucuuuuuuuuuuucauuuucuuucuacucaccccacccuuuauaauuaaaacaauccaaucuuccauguuuguagagucccuggccacacacacuuaaaucaagcagagcagccucugaagagcugauugucauuuguuucccuuuugaagugcauucuggugagggcaggagcuggcuggcagaguguucccucagccaaggcgggacagagcugcagaugcuuucagcugccguuuacuuucucaccuccucuguugguuuauuccacaggcaagcugcaggccaaggaccuagaaggagaggagguuugagguuugcuuccugggacaccuucagcucacaaauaaucauuugucuuucacauccuuacuucuucagcuauuuuacacaucacccguccuccagcugcuaggaaaggguauuuuuuagcccauaaauaauuacucacuucagagagcuagauaguugaccacaaacucaccaagagauucuugagcccuuauuuugcaagucuuuccaccccaagcuuggacauagacaaaaauaaauuuguuggaggaggguugggucagggucagcagggagagcuuuccuucugaaaagugcccuugaaauuggaacuuguaacuuugcuugauggguugugaauuccuaggacaugagcuccacucauauacguugaaaacuaucauugaauacauccaguucauucuguugcccuguucagggaggaaaacuauguucaggaaaguuaaaucggcuguuucauuaaauuuccucugaacugucugagguagagggguuggucuuucuauuuuauugcugggaaaacaggcucggaaaagugaaguaacuugcccaguucucacagccagcaggugaaaggguugacaauuugaggucugucaaccucaacccucaacuuuucuuucucugccacacugagacuuugccacacucuuaacucugagccucaguuuccucaucuguaaaauggagacaauuggguugucacgaggaagagaugaaauaacacguuuuucuuuucuuuucuuuucuuuuucuuucuuuuuuuuuagacagagucucauucuguuacccacacuggagugcaguggcacuaucuuggcucacugcaaccuccgccuccuggguucaagcaauucuccugccucagccucccaaguagcugggacuacaggcacaugccaccaugcccggcuaauuuuuuuguaucuuuaguagaaacaagguuucaccauguuagccaggaugggaaauaacauguuaaagggcuuagaacaguguuucacacacaguaagcaauaugcaauuuuuagcuaguaucucugccucccacaccauuuaacacuaucagcagcuuguucuguuaacugcgucaaugugccagguccauuauaaguacgcuuucuaaucuuuauagcaucccagcaagaucagucuuauaaaccaccuuuuuuuuuucaggugaacaaacugucaagaaagguuaagaauuuaguucaagaugccacaacauguaguaacugaacugggauuugaacuccaaucuuucugguuccaaagacaguuuugcucuugugccaugcugccuuuucggugccaagcucuggaccccaacuuaaaccccaacuacuguuucagaaauccgguggcuaauagccuggagaauugagaagaaggcaguuccugcccugaacugauaaguaacuagaaagcccuucaucguaucugccucaaaucuaggcuagaagagaucuuccuucuuuccugugacaguucauuaauaauuugagagccacugugugcccuucuagucuuccccugugguuaaauagccccacucuucuucauaggaugugaugcccugaccccucucuauccugauuggucucuggucacucuuugaaaagauuucaguaagauaaaguguuggguagggaccuggaugcagccuugcacuugaagguugauuggaggaagaggucaguuggacuagcuagagaagcaaugaugaccugcuucuugagacagaaagcagguuuugagcuuggucuaggaaacugaagguuuguuuggagggcaggguggacacagaggggacccuggaagggaucugugaauauacauguuuaacuggagcacagugggaaaugagugacaagccagcuuagcguuuguuuuccugccucgacuagagggagcagaggaaggaaggggugcugagugaaggcagcugcaccaccgaugcucagcggcagaggccuugaguuaugcccucagccagccuugaccaacugucaccccucuguuuccauggaagcuuacuucauccagugccugucuuugucuuugcuucagcugcuuuaguuucauccauuuugacugcugcuguuuggucuaagucagacguuugccuuucauuuuuacccacgcaaggguaguggaugucauguggcaguccaaauccuacugggucugggcuuuaauuuuauaccuaaauuuaguuuaaaacaaaacccuccccuguuuggauggcaacauguuggugagguuagcccuuuuauuuucagaccucggguuuuguacaguuucuuuuucucuuucaguucaugaguuggaauagggaaguauuuucauucaaaaaaaggcuagaauuuuuaaaguucuaaauauagaacucguauuauaaaauuuaagugaaguaaaacaucucacuacuuuccauuuauauucgaacaaauuuuauguuauauaaaaaugguuuauaaaccucuccuuguuuaaaaaaaauuguuuucuuagccuuggugaccauuaugaugaauuucacacuuugguuuaaucccuccaaggugaaaguugaccaggaagaaaccucucaccacuuaaaguggaucaguuccacaugacagugugacuuuuaaaauuguuuauuuuguuuuuuuugagauuggaauucagaaaaugaaauaauaauaauuccuucaguauuuauuaugugaucuugagugccuggcacuguucuaagcaccuuguaguguuaucccguuuuaucaucacagcagccuucuugggugggugcucuuauuauccccacuuuacaaaugaagaacagaggguuaaauaacuuucuguuagauagcaggaccagguuuccaauucaagcaucuagcuccuggccacucggcccuccuguucauccuaugugaggagcaggaaagagugcagcaggaccauuucuugaggauggagccugcaccuggcuaguuggguuguauacaauaggcuauuauuucucucauauuuguggcugaggugagauugcauguucuuaguuuauauuuccaaguacccacuguaugccuagcacuguuaagguaguuggguacaggagugaacaugacaaacaaggccccuucccucguggagcuuacauucuaguaggaaagacagagaaugaaaacuuaaguugcacugaagaaaauuaaugcagauuaagagacagaaaaugacaggggugaggccauuuuagacaggggugagguaggagcaucucugaagagauggcgucuguaggaggcaggcguuaagugagggaauaagcuuuaggaagacucgaggaacaccuugcaagcagauagaacaguuggcgcaggugcaggaggugggaggagcagcagagaaaccaggagacuggaagggggugaaggaggggagcacaucagagacaugggaggaaaggguggccagggcuguuaugcagggugugguggucugcagugaggaccugccucuauuuaccauccagguggaacaagaagcaggucgcuuuagagcagggggucacgugagcuucacuuuggcugcuauguggaauaacuugugaccuaagaaugauuuuggaauaaucuuagacaaaguguccuauuauaaauaauaacuuucuaacucagacuggccuaauuuauauuucaaagcuauuauucaggccgggugcaguggcucacgccuguaaucccagcacuuugggaggccaaggugggcagaucauuugaggccaggaguucgagaccagcaugggcaacauggcgcaaccauaucuccacuaaaaauacaaaaauuagcugggcgugguggcacaugccuguagucccagcuacucgggaggcugaggcacaagacuugcuugaacccgguaggugaagguugcagugagcugagaucacgccacugcacuccagccuggcugagagagugagacuccaucucaaaaaaaaaaaaaagcaaucauuccggguacauucaacacccuuucugauuuuucucuuauuuguuagucaguugaagguagaaaaugauacugugagcccccuacagacagaaggcggcauuugcccuuaggaugacuuggugauuaagucuucaggguaguuagggaaacaucagugcuggagacuagagcuucuguucucuuugauuuagaacagauggaacaaaugugaaauggcacagugaaacauuuccuccaauauaguauagguuuuucagcuuugguuaucauaaauaauccuuuaaauuuuauuuauauauuuuauuuauauauuuagacacacacaagcauuauuuuauguuuuauuuacuggaaauagcuaggaguaauuuaaauuaauaggaaaguuuagaacuauuuauuuuauaucuaauuuuugauauuuguucuuauaauuuuauauauuauuacagauaacaauucauguguguuauauauaguguauuuuuuuaucccaugaaguuccagaaaugauucuuaccauauauaaauuuagaacuccuggaaauugcagauucaacuuguauuuuuuuuuucuuuuuuugagacagagucucgcuuugucgcccaggcuggaguaugguggugcaaucucggcucaaugcaaccuccgccuccccaaauucaagugauuuuccugccucagccuccugaguaucugggaccacaggugcaugccaccacacccggcuaauauuuuguauuuuuaguagagacaggguuucaccuuguuagccaggguggucuugaucuccugaccucgugauccacccgccucagccucccaaagugcugggauuacaggugugagccaccgcccggccucaacuuguauucuuaagacauauguugauaaaguuuuuucaauacaaaggaaugcagccaucucaucaacuuuuaaauuaaaaguguauuuguuuagagguaaacucccacauuuauucagaaugguugaaaaauggaauauucuaguaaaguucauguuuuuggauaaugaggguuaugagucaaaagauucuugcauuuaugguuaauaaaguauuagaaauuuaccauugaugagauacauuuuuucaaacuguggcucaggguguaugagugugcuugagggauggggacuggugggacucaggcuuuuuaugccagauucaaucccuguuguuccuucugaggcuuucaggaaaacuuugguuggauaauaagguuucuaaugcacccugccugccauguuaaaaacaacuaucagaaaauaauuugauuuuucuagguuuauucagaaggcacuuccaagauuuagaugaugaaaaucacuuuuuaccaaaaaaaucuccaguuuuugguuugcuuuuuguagauuccugaauaaaauuuguuaguuaaguauuugauuauuugcaaucuagaugaacagaagugagccaaagacccuuuccagcuagauuuauuucaguauaaguuaacaauacaguuuuuuuuuaaaucaaucaggucucucaugguuuguaacagugcaaccaacucuaguaacugaaaauuuuuauagccgaugacuucacuaggacuugucuagacagcagcuacccucuaaagucacaucauguuagggcuggaagagaucuaacgaagauacuguaauuuagaaguccuaaauguucuguuugccauuguagccaugguuuuaggguuugagggacagugagaccaaugacuucagcauggaaagugggaaacugauaggcauaaauauggggaaaggccuaaccuugguuugggaugcaaauguaaacauacaaaaguauucucuggaaacaucagcaaauuugaaaggaauuugaugucugguuauguuugucaagauggagagacuccuggagauuauaccuagagaaaguaguugcagucaguaaauuuguagccuuuuggauagacucuucuuagcaauguaaugcuagcuuuuauaaaauaaugcuuguauuauuuguuucugcuaaugaaauccauaugcugugaaacaguuacuugucugugggauuuggauuggaucuacaugguuccccaaccuucagcauuuuagucaacaaaguagucaaauagauugacuuuuuuguuuuuuuguuuuuuuugagacagcgucucacucugucacccaggcuggaguacagugucgugaucucugcucacuuuagucucaaccucccaggcacagggcuccuccugccucagccucccaaguagcaccacacccaacuaauuuuuguauuuuuuguagagacaggguuucaccauguugcaggcuggucucgaacuugugggcuccagugauccgcccaccucgaccucccaaagugcugggauuauggacgugagccaccaccccuggccacugauugacuuuuuaaaguaaacuuucaacucauuguuuugcuuuccugucuguaaacauaaaacugccagaugcaauuuaauguagagccuggacucuguaauuccacaguuuuacuggccuguaaguggcaaagaccagaauguacuuuauaguccagaggagucugauugcuuugauugauguagauuugguuugagaaccugagauagaaaaagccuugucucugacaaaguguuuugagagggcuuucuaugauuuggguguuuaaauaauugcaugggugggaugauugcaacauuaagugcccuuagaucaaauaauagcugagcuucccauuaacuuugugaaugugaagugacuuaugucuguaagacuuucuucggagaaagaauacuaaugguugccuggugauuuugacuugcugggaguaaauacacagugcuuuguauuuggugaaaaguuuugaugugaaguacacuuugcuccaugccuugugacaaugagugcaugacucuugcuucccauucugacuguaggaagcugcccucugucgacagcuccccauggaagcugagacucuugccccaguucaggcugcugucaacccacccacgaugaccccagacaugagauccaucacuaauaauagcucagauccuuuccucaauggguaaguuaauauuugggggccacuuauuuuuauucucuuuauuaugugaucuagacuauaauaggaucuuuguuuacauugggaagagguggggagcuugaggguugagggugagaauaaagggaggaagugggaggagcuggcagaaaaaagaaaagcaggggaaaucaucugccuguuaaaaaauuuccaaauuaaaaaauuggugauaggacguagaguaaaccccuagucaagaauuugaaaaugggcaugaacuuauauuuuuaaacaugauggugucgucuaguacuuauacuuggaagaaucuucugguuuuauguaaccaacaggggauaaaagcaugccauauggcaaauugagaacagaacaauuaagagauuauguucggccaggcaugguggcucaugccuauaaucccagcacuuugggaggccgaggugggcagaucaccugagguugggaguucgagaccagccugaccaacauggagaaacccugucucuucuaaaaauacaaaauuagcagggcaugguggugcaugccuguaaucccagcuacucgggaggcugagaauugcuugaaccugggaggcggagguugcagugagccgagauugcaccauugcacuccagccuuggcaacaagagugaaacuccaucucaaaaaaaaaaaaaagaaagaaaagaaaagagaugauguucagggugaaaugugaauaagaucuauaguuuaguaaauaauauucuacagugucagauuucugauuuugguaauugcacuaugguuauguaagauguuaucacuggggaagcuggugaaggguacaugggaacgcucuguacucuuguugcgucuucuaugugaguuuaaaauaauuucacaauuuaaaaaguaauuaaaacaaaggagcaaaagggaaagagaauuuagccagaaauaucuucaugagcagaaguaguuuuuaaaucaaauaaaaagggcaauucuguauuuccugugccuuuuauucugcccuugcagagacgucuggcaaacaaacaauacaauuaugaacauuauuaaagauagagauaaaaacaaauaguagcugaaauaauaauuaauggagguuuuaaauuguugauuuuaaaguauuugaaacacagagaaguacaaagaauaacaugaauuacccauguacccacuacccagauuugccauaguuuuauuuaaucuuacuuuuuaacaaauaaaauauuacaauuaauauuugaagccauccccccaccacugaaaucucguuucuuuucccuucuguccccagugguagccacuauucagaaacuggcguguguccaucacacagacuuuuauaccccuuacugcccguuaguguauguauccauaagcaauauucaacauaguuuuuguuuuuuuuuuuuaaaguuuuacauaaauggugucauacucuguauguugaagaauguucaaaugguuauuuugaggugaaaaggaaaucaaugucaauuuacugugaauggccacacaugauuauuuucauuuucaugaggguauguauuucaaaauuaaaacuuuccuuccucccuaaccuggaaaguugggcagcauggcacaacugcacuaguuuagagcuuuugugacuguguuuuaauuuugagauuuauuuagugggcucauauugaaguuucuucaucuuuugcuuugcagagggccauaucauucgagggagcagagcacugacaguggccugggguuagggugcuacaguguccccacaacuccggaggacuuccucagcaauguggaugagauggauacagguaggagcaaagccugcaagcacuuacaauggguuuguguuuuuuaaaugaucucuucgguuaucucaauuuuauuuuucuuuuauuuuauuuuuauaauuucaacuuuuauuuuauauuuggggguacaugugcagguuugcuacaugguuaugugaugccgggguuugggauacgauugcucucgucacccagguagugagcauaguacccaauaguuuguuuuucaccccuuguuccuccccacucccaguagucccgagugucuguaaaaauguugaaaaaaaaaaaaauggaaugcuucaugaauuuacaugucauucucaugcaggggccaugcuaaucauuccaguuuuaguauaggugcugccagagcgaguacggucaucucaauuuuaaaauccaaccagaaacacucaaucucaacgacaacauaaaauaacagcugaaaagccacugaacccccaggcacuauuaauaaacuguagccccuuccucauagauuauacaaguauaguuuuacaucugggcgcaggauuuuaaauucuguuguuuuuuuuuuuuaauucaucuuugcuccauauagucccuuccucacaauugcaucaagacaccacuguuuguuugccauguuuccacauugggguauuuaugcuguucuaguuuuuaguuguaauauaugggccacccuuucuccuggaaagugacacugguuuauaguucuaguauccaauuuuuuucaugucauucacugcauuugaaaagcaauuggcaguggguauuuggaaugcugagcaacucagaggauucaaaauugucacuuccaaguuccaacaugguaacgacauccucccucaggaauuaaagagaagagagucaggguuacucuuaccuuguccccagccugugcauccuucagguccagccucaccaggcuucccgauuaccuuucuuuuucuccuuuucucaaggagugagacuuccaauugcagaaacugaaguuagucuuauuagccuuaccuagacuuaauuaugaaagucauaaacucuaagaagauauucuagaaccaaaaauaaaugacagccaggguguccacuauuuggaguuauucaugaaaguuccuucuccauuaucauugacgaaaguaauuguuuuguguugaaaauaaaaaauuccuucccccaaaguguuugccauagugccuguaguuuuuuacacucuacucuuugauggcuucucuuuguguugugagucuaaauuguuggaaagaucaagagucaaacucauagccaggugucuuacaaaugcaguacauuaaagcugcuccccuggcgucuuucguguagguugucaucuuugcauugagaagauugcaaagacuaucuugugaggagugacacaggaauaguuugcacugauuguuuuacuguucuucaguuuauuacuucaguucuucccccaccaccacccccugccaccuuuaucucucucucugcuuuuugagugugagauuuauuuugcuaucuuuggaauagccuuaggaaguggcuccuuccuauguuuaauaauucuuuacuuucaucuucuaaacacugggaagccaguaaggauaaaaagcaaaguuaaggaaaaaagcucaggagaucuaaaucuaaguuugacauucaaaaaaaaaaaaaaaaaaccauaaaagaggauggauucuacucuaugucucuuuaaaauaaccucaaguggguaaguagggaguguuuuauuuugaagccguaauguggaauuaaaugacguccugaaaagaacauaguuuuagccaacaggcagccugauuugaauccuugcuucuccauuccuaguagcgccuuuggguaaguugcauaaccuccgugagccucagauuucucacccauaaagugggagugauaugcucacggcagaguugugaggagucaugagaucacagagaccagcucaaagugcucuucuccaguaagaagacugaugucauacauacaauggacuugauaaugucagagugccacguuaaccugguuaagugagaaucagcucauugagugugggaaugugagugccaaguuaaccugguuaaguuagagucagcucauugaguguggggccaccucugugaagucuuuguaggaacuggacauacaucuucucaaggggagaaauguuaauuauacaguagcaaaaugagggaagcugugggggcaggcagagcucaaguguggcuagaaaagaucuaucaggccuguggaccacgcgcuggccacaugcugaagggaaacgagccagcugagcacuccauuugcaaaacauacauggcagcaacagcugggcuuggugcgaagauccaguaaagggaauaacaugagcaaaggcugggaaaucauccauccuuccagaauauucugcaguaaucacacccuuuuaagaauugccuuguggcugggcacggugguucacaccuguaaucccagcacuuugguaggccgagguggguggaucaccugagguugggaguucaagaccagccugaccaacauggagaaaucuugugucuacuaagaauacaaaauuagcugggcgugguggcacaugccugugaucccagccacucgggaagcugaggcaggagaaucacuugaacccaggaggcggagguugcagugagccgagauugugccauugcacucuagcuugggcagcaagagcgaaacuccaucucaaaaaaaaaaaaaagaauugccuuguguuugucucuuccacuuuuuaaguggauaaacugcaaagaccaaaaagauuacuaugagauugcagagcugcuucuauuuuaagauuguuaacuuuaaugaagaagcuuagccaguauccucaugccuuccauccugagaagaaaggauaagaguaauuuuuuuuuuuuuuuuuaauacggggucucauucugucacccaggcuggagugcaguggugugaucucagcucauugcaaccucuaccuccuggauucaaacgagucucgggccucagccuccugaguagcugggauuacaggggugcgccaccaugccuggcacuguuuuuuugggguuuuuuuguuuguuuguuuguuguauuuuuaguagagacaggguuucaccauguuggcaaggcuguucuugaacuccugaccucaggugauccacccaccucggccucccaaagugcugggauuacaggcaugagccaccacacccggccuaggaauucuuuaaaacagagauuuugcuuggcuaaaaauuauauucuugaguaucugaaaguuaaaaugggaaauuaguaaaaaugaaugauucuaacuggagaugaagagaaaaaaaggcauccagcacauuagaucagauuguuuuuuagacacuuuuuaaagccucauuuuuaucuguuacacucuaguaaguagaagaaaguuauuuuggauuuuguuuuuucguuuaacguuauuuuucaauaucaguaacacuauauugaggucauauuguugaauuugauuuaauuuuucaguuuacuacccuuugcaaugaaaauacuguaaaauguuacccaggagucauuuauauuuugugacuucuagaaaagccauuguguuuugcuaucaccaaaauccaaauuggaugaugguuccuucaucauuuggaaggauauaauuuuucucccuggaaaacacagauugcuaaagugaacuuucggcaauuuugcuuaaaauagugaaacuucccuacacacguuucaggaaggcuacugcacuuguaacacacaaaagauaauuuaacaaguuuuuaaaaaaugacguuaugguggaagcuggccuuaguuaucaaugcuucucaauuuuugaaguagauauuaucucuucagaaaauuguuugggacuuuuugaauuaaccuguuguuuugauauuguguaauuaauaguggcugaagaccuggguuuuucuuucucucaggacaaugaacauuuauuauauuuuuguauguauauaacuuuguauauaucaaugacacccagagccauggauauguggcagacacuauauggcacuuuacucuaacuuuuguaaaaggagcauaugaucccaauuucuagauggguaaacugagaaucaggcagguuaagugugucuaagcuuacacagccacaaagcucgaucuaaugacaccaaagucaguagugcauucugucccauacuaugacacauaaagaaccuauauucuucaugucauaucccagacaccuacuuuuccucuaguacagcauuuucucaccuguguucuguagaacuucaguuuuauuugaauacacauacugccaaaauagguuuaggugauuaaauggguuuaggaaauagugucuuaaagaaaacaaaagauuucuuuacucuaagacuuaaagccuuaacaugcucauaugcacugugcucauaugcuugugagaaaggcagauaguuguaggguguagguauuacagaaagagggaaaacgucugcagaacugccuuuauaaaugaugccuaaagucaucaaugaagacaacuuuuuaauagccugguuaaaagaagcuucacaccauucucuuugaacauaaagaaggaugguauggguaaaccuaagcuuacaaugaaaccuguagauuauaguucuguaauaagcuguuuauuacagacaaggccucucuacucuuuuguaaaacaguucuucacaccuuugucaugggaaggcacagaucauagaucagauccacagugccuuucacaugcuccuuucuuaucuccuuggccuuuuccauucuggaccacaccuauccagaaauaauuuucgauuucuuccacaucucuguaccucuuaugaguaagggucaauaaugugguaguugaagacaugaaggugaggguuauguaaauacuugaacuguuccuccuucaagagccuaaaagaaggaauuaaaaugguuucuuuucauuuuguuauaggagaaaacgcaggacaaacacccaugaacaucaauccccaacagacccguuucccugauuuccuugacugucuuccaggaacaaacguugacuuaggaacuuuggaaucugaagaccugaucccccucuucaaugauguagagucugcucugaacaaaagugagcccuuucuaaccuggcuguaaucacuaccauuguaacuuggauguagccaugaccuuacauuuccugggccucuuggaaaaagugauggagcagagcaagucugcaggugcaccacuucccgccuccaugacucgugcucccuccuuuuuauguugccaguuuaaucauugccugguuuugauugagaguaacuuaaguuaaacauaaauaaauauucuauuuucauuuucugcaagccugcguucuugugacagauuauacagaauugugucugcaggauugauuaugcagaauacuuuucucuuucuucucugcugccccauggcuaagcuuuauggguguuaauugaaauuuauacaccaauugauuuuaaaccauaaaaagcugaccacaggcaguuacuucugagggcaucuugguccaggaaaugugcacaaaauucgaccugauuuacaguuucaaaaacuguauugaugacaguaguaccaaaugcuuuaaaaacuauuuaacuugagcuuuaaaaaucauuguauggauaguaaaauucuacuguauggaauacaauguaauuuugaauccaugcuggcucugauggcucuuauuagucuguauuuauaaaggcacacaguccuauuguagcuuaucuuucguuauuuuacugcagagcaucuagacaacuuagucccuccagcgggaaaguagcagcagcagcauuagucacaggucuuacacuacagaucuugugaaagagaccaguuugguacuaauuaugagcauuuuauucaaacaaaaguuuuugaaauauuacaacuggggauuuaaaaaauugcagcuuagaaucugaugguuuuuuuuuuucuugauguuguuuguuuguuuuugagaucgaguuuugcucuuguuguccaggcuggaaugcaauggcacaaucucggcucacugcaaccucugccuucuggguucaagcgauucuccugccuuagccucccgaguagcugggauuacaggcaccugccaccacguccggcuaauuuuuuguauuuugaguagagacgggguuucaccauaauggucaggcuguucucaaacuccugaucucaggugauccacccaucucggccucccaaagugcugggauuacuggcgugagccaccgcacccggccuugauguuuauuuuauaaagcacuguaauuuuguagcugaugacaaaaggcagccaaauguuuuugauaaaucaguggcaacuguauuuuugucuuuugaaauaacucugaaaacaucaggacaacauagauuucaaccugauagcacaccacacacagugagcuguugcuuuuuaaauucugaagccuugucagguuugcuuccuagauuucaaguguuuaaaauaauucuaucuaugaaacugaaggaugaagcagaucucugacugacauguaaaaaaaaaugcccuuugaggguguaugguggagauaaauguuucugaauucaguaaaauugauuccuaaguauauuauccuaauccuguuugcuacaguugguauaaaaaggcaugaaauauguauucaauaccucuuauguaaccaaaaccauuuuuaauuagcuuuuaaggacugagagagcaucauguucaacuggcaugcagucugccugcauugccaaugaaguccucaacuguuuaauauuuugaacuaauauuauuuauaaucuaugaauuuaaucuuuuuugaaagacuuuaauaauuugagucucugagaggauacuuucaauuuccaugggggacuuauuuguuggggaucuuaaauaagauuccuuuugaucuaccggaauauacauguacagaguacauuggaucauguuggaaagaaggcaagugaaaaggucagagaugaaguagcaaaguuauggaauaucguggaaaggauacuaguugugaaauggaaagagacaaguuauaguaccccaaaagcaaaacaagcaggagaugcaagagaugccccaaaaggacaaagcaacaauuuucuguugccaccuuuauaccggaagacucuguuguagaagaaaagaaggcuuuggugcaccuuaugugggaggaggaggggcagggcaugcugaugcugagcguacaggcagacaagagcguagccugcuguugccuccaucacuaugaaaugacuuauuuuaccugaaggacccaugguuuauguuccucuaauuccuuucacucucccuaagcccucugagagagaugaagauagaugauuuuauugcuacuaaauugaagggagcacuauuucuuuuugucuuuuguuagcaaaaaauugcaaaaagaauuguacauucuugcuaaaaauaaauaaauaaauaaaaaauuaaaaaaacaagggaccuaacaaaacucagcaguguuacuguauuuuuaaaaaauauuuuuauagacucauuuucagguuauuaaauguaagagaaacagauaccccucuuuuuuaaaguagguaaaucauugaugauuuauauuaccaauuuuuagaaguaauuuucuaguaagcuuguggcaucagaaaauacuagaagauuuuuuuaguuaaauuaguuagaacauuuaugaaugaauauaauaaauauuuuuucagaauaaaauauggacccuuuguguuuacuaauagauaaagccagauauaauuuuuuguuuuuaaggccacaaaauauggccuuuguuaaagaacacuaaaguuagaaaucuaaaguuagagcaacuuuuuaauggcuauuuccuauuauuguaaguguuaaaaccccugcagaauucuugauaaggugcuauuuauacuauauuucuuauuauaagauaacugucuuuagucuucuuaguacuagucuuuuuaguacuaaaucaaucaguaaacaucaucauuucaccccaaaauuuugucacagaaaaggcguaucaaaugaaaaauaauuucagagaucuuucuuucaagauauuuuuuccugauaaaauacauugucuugaaguaaauacauugucaaaaccuaauugcaauucuguuaaaucuaaguaauuuuuagacaguguuucaccguauuauuuaggaugugaaaugccauuucuuucacugauuacaccauauacaggaaacagguaaaacagugaaaacuuuauugugcugguugaugccaacuugguugaaaagcucucugcagaagaagugaucuagacugacagaaguguugcuaauuacaaguuguguucucaugacguaauuagaaaguaacuucucaaaguacaacuuuuaugaaaaaaauaagcuguuaaaaaaaggaaaucguagguuaauuuaauugggaaaaugggcaauugacagagaccauuuuccuaacacauauaugugcuaguacuuuaacuuuuuaaaauuuuacuucuacguuuuguaauauaaaaauuucuauuuuaaguuuagaauguuauacguaccgaaaguaugcagccaaaucgaucagaucaaaccauuuuaccuggaguuugguacugguuuuuacuucucugaaucuguauaagaaaaauaaagacaauugaacuuccacuugga

SEQ ID NO: 13626 - RNA, 593 nt, Homo sapiens
cucuuccaguuucuuuuuuuuuuuuuuuuuuggagaaugagaaaauaacuuuauuucauuguggggagcgggcugauguccagccucagaacuucuggaacugcuucuuggugcuggcagccuuggugaccuggagcacguugaggugcacugucuugcucagaggccggcaaggccggcacucgcccacugugacgaugucaccgaucuggacgucccugaagcaggggaacagguguacagacauguucuuguggugcuucucgaagugguuguacuugcggauguagugcagguagucucggcggaugacagugguccucugcgucuucaucuuggucaccacgccagagaggauccgcccucgaauggagacaucaccagugaaggggcauuucuugucaauguaggugcccucaguagccucuuugggugucuugaagcccagaccaauguucuuguaguaccgcaggagcuucuccuugccaguuucucccagcaggacccucuucuuguuuugaaagauggucggcugcuuuugguaggcacgcucagucugaauguccgccaucuucccggccacugaaaaaagg

SEQ ID NO: 13627 - RNA, 6617 nt, Homo sapiens
gaguauuugguuggaauaaauuuauuucaucugucuguaaacaagguguuuaauaguuauggcauuuuuuuaaaugcauauuaaaucagaugaguuagacuguaucccagauguaacaaagugcagggaaagaaauggacaaaucagcaacaagauuuguuuuuaaaucuguacauuauccacaaggcccaaacaauagaagcaaauacuagaaugucccuaaaguagugccauucgaaagaaacccuuaauaggucaguuaaaauccaucucacaauagcaacaguucauuuuaacaauaguauggcacagaauacauaugaaaaaaauucaucacaagacagccaaguccacaauaaugcaacuucauauaaaaacucaagcugcaaauaaaaauugguccuaugaagaacaaacuggacacacuccagaugguuauguugggauaccuaauguccauaauggcagccuuuuacaauuuuacuaaagaguagagcuggugugcaaagaaaaaggaagaaaaaucugagcuauugcaaugauggaaugucccuggggauucaaucaguaugguuacuguaaggucaugggaggaagugcuuuuugcucuuguuuugccauugcacucuucauauguccuguagacacuaugaauaaagguuugucucugcucaagugcaacaacaauacuaaaagcaaacuacugcagcucucaauagcucaucaacaaaagggauuuuaauugguuaaaaaaaaacaggcacugcauaaaaaaagauggaagcaaaccaaaugccuaugugcgaagggagggggggcgggaaaaagagaagagugaaggaaugaugcaugcacuuuuuccucccaaccaugcgcuacaaaaggaagacuaaaugagccaaguaaaugcucaaagugcugaaaagacacugaucagagauuguacaaccggcaccuugcuuaauauuaacuuauuuuaguaaucaauaucccauuaauugcuaagacaaagugaugcccaacuuggcaugcccccuccccccaauuucaagguaucaugcaaaucauuauugugcugcaauuauguugccagauaaggguugguuacauacagugguuaacauacaaaugauccauugggcaaacaggaaucaugacauuagaaaauagguaaagaaaaauuagcuaccaucuacaguuugguagcauugugaccauaauuaggguuguugaugaagacaguugcuagguagauggggagaggcugcuuacacaucagaccuccucagguauaaagcgaguucauaugcuuucuuguuaagugugccuccguggacaccuuccuuucccaugacuauaaccaaugcuggaguacacaaggaaacaaaacaaaagugaacagaauuauuuuggggggggagggcagaaagaaagacaccuuuccccaccaacagagggauacaaaggagacacagguucauaccccaucacccugcauugcuaauaaaauuuccagaauuaagacuuaagcuuauagcuaggaaaguuuaagagcaauuuuccccuaauacuuaacagucugccuagcagcuagaacccagagucucucaaguauuuugccauugaguaugccuucuuauucaauccgccuccauggaccccuucuuuucccauuacaaagaccaagacugaaagagaaagaagaaaaguguuucaaaagaaguguuaaucaagaaagucacauaaguuuuagcagacagaacccggauuaauaaguuaacauuaaguuaguuuuccaugaacugccaagcacugaagucaaguagguuuccaaaaagaacuuucaaacuaguaauauacuaaacagaaaauaguaaacuugacugcaucuuggaagccaaucaaugcaagcaaaaguucuauacaacuaucuuuacacuagcuacagaaaaaaaaaaaagugaccauuugucuucuauuuuagggcaaaaaaauucuggcugaugucaaguacauguuauuacuugcccccaaaauauaaacuuaauaaaccuggggaguuacuuacuuacaaacucuccccaaauuuuaacaugcuugauaaguuuaaacuauuaaguuuuaccagugaggcuaaauguaucuauuauuuccagaggaaaaugaagaucaaauuuuaaguagcauacucaguaucauucagaaaaggccaaauuaaauuauuuaagguguuugcuuacugauaacuucaccguaguagccuuguuuuuaauugcgucuaaaaaaauagguuuacgauuucuaauugcucuucuaugaugcaauucaaagguguauaacccaaaauauauguauaugucaaauuuuauauucacuaccacuagaugucaguagugcuguaucguauaaaauauucugguuuuuugucuuguguuugacgcuucuuuucagcguauagugcagcuaagguuuaaagagauuugucacuauuucaaagucaucuaauuuucuuauaaauccuuauaaacaucaacucacaccagaauacgaguaacuuuuaggauaaucacagggagcugguagagccauagcauuaauuauaacucacagcagcuucaacuccccucacaugguagagcuguuauuaaaauuagaugugccaagucagcuaugugaggcuacagaagcacucucuauuuacaaaauauucguaugcguuaacacauuaaaauguauuuguaaaucaauuagaugucauaauaaaacucaauuucaaaaguuuauuuugaaaaaguagggagacuucuuuagugcaauuaagaguuucuauaaugcugacaacagucuggagacaccugaauuucuggaccaaguauacaaacuaaauguaauuuccuacuuuucaaaucuaagucucagacacaaucuuugaaaauauuucagugaauggacaacuuacuccaaaauccucaucuaauuaucuuuuccccagcaaaguuccuaacugaaaaaugaacggauguuaauuuuuccuucuuuaugcugaguagugaaaugguuagaauacaagcaagaaaaaaaagaaaagagauccaaaggucaaacacacaccaaaagggacuaaaauaaccaagugauucgaacaauuuaacaaucugaaacaccacaggauuaugauuugacaugucaagcaguuuaagagacuuuuaaguuuaauaaagcugaaagugaguucauacgaauauucuaucguagaaacaaaaucaggaucuaagaggccaggucauagaugcuguagaguagguaaaacuaaagcagugcuucuccauagugcugggcaguucacaaaaaccaccuuaauagccauuauggacuaacuuuuauucaaaauguuaaaagaaacugcuuaauaaguuguaauguggcaugcaacuuuaaccaaaagaaugccuuacucaccucuaccagcucugccgacagccacauuguauguuggcuccccaccuugacucuuuguccggauguccauugugcagucaccaucgacguauagacuaucucugaucacugagcauuucuucgcgccaagagucaaaccguugguaaagaaaccuucccggucuuuuccuacaaucauaucuauuucuauuggcugccccccaccaaaaagaaaaaaaaaaaacacacacacauuaaguuguaguuaacuccuuuuagggcuugauguaacaggaagggcuguagcuaggcuuaugcuaccacugccagauagccacauuucacuaauguaaaaccaagauucagucuuuucuaaauaauuauuuaauccuauauaaucacauauuuuacaugaguugauuugacuucaguuaaugaugucgucucuuaaccaagaccagucuauacaaagaaacuguaaagaguugacaguugacacuagacaaagugcaaacuuaaagaguuauuuauaaacuguauuaagucagcuggugccugaaaguguucacguaaugguaaaaauucagcuaucaacucugaacaaagcuggucuaucauauucagucccauuacaguaaaucauguuucaucaaauuuaaaguugcuucaaagucucccaaaauaaagccuguucuuugauguguucacuucucugcuuagaguaacuagaaauauacgugaugagauggacuucaaccccuggacaucagugcuuuuccaaauucauauuucccuccuauuuuucuagccacgacucccguuucuuuccaacuucccuuccccucccaucucaguaaucaguuuucuuucugggcaaacgcaaaguggauucugucuacagcacugcgguaggcaauaguaaaacagaaaaaauggagggagauugggaaagaaacugagguagccaccagaaccggaaaggagaaaacgugcauucuaacauuccaugaauaagaaggaaggcgucgcccccaucagaacugcagagucauagcaggccccagccauuuccaagcacacucccgcaaucuuccuagucagacagcgggaacucacacacaaagacaagaggacugcaggaaaaaaguugaugaccagaugccaauucccuacaagaauuguaguccacugcggguauacgagaccuuaaaguacuacuaucaaggacugaguucuaaaguuagacuuuaaaccauguuaagugguaaaagaauaauuagcacccuuaauaggggaccugaauuuuggugcuuaauggaaagggagcguggugcuaagaaauaaagagaauggucucguauuuaguacaauuaucauaauuuuagaaacagccuugggcagaaacaggcaaaacaauaagcuggagguuuuguggcaaauauucuccaaacauauugcaaccaacucaaaaccaucaagucucaagaaaaucaggcaaugugaagcauaaaacugcauuaguuccuuuacugccaccacuaaagagggagggacuuagagaagugaagugugcuccuggucuucgcagauaauugaaagcccccgaaaagcaccccuuuuuugagcuauguugcauaacuggggauaaccguauaucgaugaaucuccauaugagaagagaaaucaauggcaguucgccaucuuggagaauuuaaaaaaaaaaaaaaaacaaccuauagagcuagagcugaagucgagauucacgaauccaccuacgcggucggcguacaucucucgcaagccccagaggccuggacaucgguaaaccuacgcaaagucgcuucgagaaucccgggggccgggccggggccgccgccucccacagccggaggcgcgggaggcgcgcuguccgcggagcaagagccggccagagagccuagggaccuccacccggggcccgcgcgccccagcccggauccccgacccccgcuuccaccccagaacgugcauagcaaaccucagggcuucaagagaaccuaggggaaccgcacuaggaggaaaaaaggaaccccuccccuugcccuggccggugcgugcccccucccccaacccgggcaccuggaccgacgcugggaacgccgggggcgcccggccagggccagcaaggaguccggccgccgcccccagccugucagcgcagccccgggugagggggcguccccgggccucggccuccccgcccgcccggcagccgcauccucggcgcccgcugccuagcacaccugcgggcucggcccucaguguuccagccccgcgcugcggugcccccgcggccggccaccccgcuccggugcagggaccaggguaccggccgccacugguccucaccguaaugcucugaaagacgcccccggccguggcugcccagacguauuuggcgucgcaguagccgacaauggcggccuccuggcagcagccaucgcacaucagguuauccacguagcucugccaaccggccaucuucgagcccuucgcacugcagcgcggacggcgaggagcagcaggcgcagcggcggcggcggcgguagcgggcggcggcggcgcggggggaggcggggcgggggcggggaggaggcggcucugcgcaggcaccgaccgccccccuccccgaggagcugcggcgggaggacgcggguucagcgaugagggacgaaccucagagcgcgcucggccgcccggccgcccgcagccgcggggcugacaaaccagcggcgggaggcugcgaagcggcugugccuguggcggcugcuccuuaccgcagcgcccuccguuuuccgcggacacggcugggcgugcgcgcgcgcgugcgugcgauccuuccgcggcgcccgggcacggagggucccgggaagggcggggggagacugaggcgggggcgcggagggauaccgccccgggacaaucacggccgccacgugcgggaggcgccggccgggagcgguggcgggccgagcuucggaccucgggccggcggagaggguggaccccgcgucgcucucggcaccccaggaacagcggcggcacggacgccuuggagccccgcggccgggccgcgaugugcuuuucuccuguguucgcugcccgggaugcggaaucuugagccucggugucggguuaca

SEQ ID NO: 13628 - RNA, 6617 nt, Homo sapiens
uguaacccgacaccgaggcucaagauuccgcaucccgggcagcgaacacaggagaaaagcacaucgcggcccggccgcggggcuccaaggcguccgugccgccgcuguuccuggggugccgagagcgacgcgggguccacccucuccgccggcccgagguccgaagcucggcccgccaccgcucccggccggcgccucccgcacguggcggccgugauugucccggggcgguaucccuccgcgcccccgccucagucuccccccgcccuucccgggacccuccgugcccgggcgccgcggaaggaucgcacgcacgcgcgcgcgcacgcccagccguguccgcggaaaacggagggcgcugcgguaaggagcagccgccacaggcacagccgcuucgcagccucccgccgcugguuugucagccccgcggcugcgggcggccgggcggccgagcgcgcucugagguucgucccucaucgcugaacccgcguccucccgccgcagcuccucggggaggggggcggucggugccugcgcagagccgccuccuccccgcccccgccccgccuccccccgcgccgccgccgcccgcuaccgccgccgccgccgcugcgccugcugcuccucgccguccgcgcugcagugcgaagggcucgaagauggccgguuggcagagcuacguggauaaccugaugugcgauggcugcugccaggaggccgccauugucggcuacugcgacgccaaauacgucugggcagccacggccgggggcgucuuucagagcauuacggugaggaccaguggcggccgguacccuggucccugcaccggagcgggguggccggccgcgggggcaccgcagcgcggggcuggaacacugagggccgagcccgcaggugugcuaggcagcgggcgccgaggaugcggcugccgggcgggcggggaggccgaggcccggggacgcccccucacccggggcugcgcugacaggcugggggcggcggccggacuccuugcuggcccuggccgggcgcccccggcguucccagcgucgguccaggugcccggguugggggagggggcacgcaccggccagggcaaggggagggguuccuuuuuuccuccuagugcgguuccccuagguucucuugaagcccugagguuugcuaugcacguucugggguggaagcgggggucggggauccgggcuggggcgcgcgggccccggguggaggucccuaggcucucuggccggcucuugcuccgcggacagcgcgccucccgcgccuccggcugugggaggcggcggccccggcccggcccccgggauucucgaagcgacuuugcguagguuuaccgauguccaggccucuggggcuugcgagagauguacgccgaccgcguagguggauucgugaaucucgacuucagcucuagcucuauagguuguuuuuuuuuuuuuuuuaaauucuccaagauggcgaacugccauugauuucucuucucauauggagauucaucgauauacgguuauccccaguuaugcaacauagcucaaaaaaggggugcuuuucgggggcuuucaauuaucugcgaagaccaggagcacacuucacuucucuaagucccucccucuuuagugguggcaguaaaggaacuaaugcaguuuuaugcuucacauugccugauuuucuugagacuugaugguuuugaguugguugcaauauguuuggagaauauuugccacaaaaccuccagcuuauuguuuugccuguuucugcccaaggcuguuucuaaaauuaugauaauuguacuaaauacgagaccauucucuuuauuucuuagcaccacgcucccuuuccauuaagcaccaaaauucagguccccuauuaagggugcuaauuauucuuuuaccacuuaacaugguuuaaagucuaacuuuagaacucaguccuugauaguaguacuuuaaggucucguauacccgcaguggacuacaauucuuguagggaauuggcaucuggucaucaacuuuuuuccugcaguccucuugucuuugugugugaguucccgcugucugacuaggaagauugcgggagugugcuuggaaauggcuggggccugcuaugacucugcaguucugaugggggcgacgccuuccuucuuauucauggaauguuagaaugcacguuuucuccuuuccgguucugguggcuaccucaguuucuuucccaaucucccuccauuuuuucuguuuuacuauugccuaccgcagugcuguagacagaauccacuuugcguuugcccagaaagaaaacugauuacugagaugggaggggaagggaaguuggaaagaaacgggagucguggcuagaaaaauaggagggaaauaugaauuuggaaaagcacugauguccagggguugaaguccaucucaucacguauauuucuaguuacucuaagcagagaagugaacacaucaaagaacaggcuuuauuuugggagacuuugaagcaacuuuaaauuugaugaaacaugauuuacuguaaugggacugaauaugauagaccagcuuuguucagaguugauagcugaauuuuuaccauuacgugaacacuuucaggcaccagcugacuuaauacaguuuauaaauaacucuuuaaguuugcacuuugucuagugucaacugucaacucuuuacaguuucuuuguauagacuggucuugguuaagagacgacaucauuaacugaagucaaaucaacucauguaaaauaugugauuauauaggauuaaauaauuauuuagaaaagacugaaucuugguuuuacauuagugaaauguggcuaucuggcagugguagcauaagccuagcuacagcccuuccuguuacaucaagcccuaaaaggaguuaacuacaacuuaauguguguguguuuuuuuuuuuucuuuuugguggggggcagccaauagaaauagauaugauuguaggaaaagaccgggaagguuucuuuaccaacgguuugacucuuggcgcgaagaaaugcucagugaucagagauagucuauacgucgauggugacugcacaauggacauccggacaaagagucaagguggggagccaacauacaauguggcugucggcagagcugguagaggugaguaaggcauucuuuugguuaaaguugcaugccacauuacaacuuauuaagcaguuucuuuuaacauuuugaauaaaaguuaguccauaauggcuauuaaggugguuuuugugaacugcccagcacuauggagaagcacugcuuuaguuuuaccuacucuacagcaucuaugaccuggccucuuagauccugauuuuguuucuacgauagaauauucguaugaacucacuuucagcuuuauuaaacuuaaaagucucuuaaacugcuugacaugucaaaucauaauccugugguguuucagauuguuaaauuguucgaaucacuugguuauuuuagucccuuuugguguguguuugaccuuuggaucucuuuucuuuuuuuucuugcuuguauucuaaccauuucacuacucagcauaaagaaggaaaaauuaacauccguucauuuuucaguuaggaacuuugcuggggaaaagauaauuagaugaggauuuuggaguaaguuguccauucacugaaauauuuucaaagauugugucugagacuuagauuugaaaaguaggaaauuacauuuaguuuguauacuugguccagaaauucaggugucuccagacuguugucagcauuauagaaacucuuaauugcacuaaagaagucucccuacuuuuucaaaauaaacuuuugaaauugaguuuuauuaugacaucuaauugauuuacaaauacauuuuaauguguuaacgcauacgaauauuuuguaaauagagagugcuucuguagccucacauagcugacuuggcacaucuaauuuuaauaacagcucuaccaugugaggggaguugaagcugcugugaguuauaauuaaugcuauggcucuaccagcucccugugauuauccuaaaaguuacucguauucuggugugaguugauguuuauaaggauuuauaagaaaauuagaugacuuugaaauagugacaaaucucuuuaaaccuuagcugcacuauacgcugaaaagaagcgucaaacacaagacaaaaaaccagaauauuuuauacgauacagcacuacugacaucuagugguagugaauauaaaauuugacauauacauauauuuuggguuauacaccuuugaauugcaucauagaagagcaauuagaaaucguaaaccuauuuuuuuagacgcaauuaaaaacaaggcuacuacggugaaguuaucaguaagcaaacaccuuaaauaauuuaauuuggccuuuucugaaugauacugaguaugcuacuuaaaauuugaucuucauuuuccucuggaaauaauagauacauuuagccucacugguaaaacuuaauaguuuaaacuuaucaagcauguuaaaauuuggggagaguuuguaaguaaguaacuccccagguuuauuaaguuuauauuuugggggcaaguaauaacauguacuugacaucagccagaauuuuuuugcccuaaaauagaagacaaauggucacuuuuuuuuuuuucuguagcuaguguaaagauaguuguauagaacuuuugcuugcauugauuggcuuccaagaugcagucaaguuuacuauuuucuguuuaguauauuacuaguuugaaaguucuuuuuggaaaccuacuugacuucagugcuuggcaguucauggaaaacuaacuuaauguuaacuuauuaauccggguucugucugcuaaaacuuaugugacuuucuugauuaacacuucuuuugaaacacuuuucuucuuucucuuucagucuuggucuuuguaaugggaaaagaagggguccauggaggcggauugaauaagaaggcauacucaauggcaaaauacuugagagacucuggguucuagcugcuaggcagacuguuaaguauuaggggaaaauugcucuuaaacuuuccuagcuauaagcuuaagucuuaauucuggaaauuuuauuagcaaugcagggugaugggguaugaaccugugucuccuuuguaucccucuguugguggggaaaggugucuuucuuucugcccuccccccccaaaauaauucuguucacuuuuguuuuguuuccuuguguacuccagcauugguuauagucaugggaaaggaagguguccacggaggcacacuuaacaagaaagcauaugaacucgcuuuauaccugaggaggucugauguguaagcagccucuccccaucuaccuagcaacugucuucaucaacaacccuaauuauggucacaaugcuaccaaacuguagaugguagcuaauuuuucuuuaccuauuuucuaaugucaugauuccuguuugcccaauggaucauuuguauguuaaccacuguauguaaccaacccuuaucuggcaacauaauugcagcacaauaaugauuugcaugauaccuugaaauuggggggagggggcaugccaaguugggcaucacuuugucuuagcaauuaaugggauauugauuacuaaaauaaguuaauauuaagcaaggugccgguuguacaaucucugaucagugucuuuucagcacuuugagcauuuacuuggcucauuuagucuuccuuuuguagcgcaugguugggaggaaaaagugcaugcaucauuccuucacucuucucuuuuucccgcccccccucccuucgcacauaggcauuugguuugcuuccaucuuuuuuuaugcagugccuguuuuuuuuuaaccaauuaaaaucccuuuuguugaugagcuauugagagcugcaguaguuugcuuuuaguauuguuguugcacuugagcagagacaaaccuuuauucauagugucuacaggacauaugaagagugcaauggcaaaacaagagcaaaaagcacuuccucccaugaccuuacaguaaccauacugauugaauccccagggacauuccaucauugcaauagcucagauuuuucuuccuuuuucuuugcacaccagcucuacucuuuaguaaaauuguaaaaggcugccauuauggacauuagguaucccaacauaaccaucuggaguguguccaguuuguucuucauaggaccaauuuuuauuugcagcuugaguuuuuauaugaaguugcauuauuguggacuuggcugucuugugaugaauuuuuuucauauguauucugugccauacuauuguuaaaaugaacuguugcuauugugagauggauuuuaacugaccuauuaaggguuucuuucgaauggcacuacuuuagggacauucuaguauuugcuucuauuguuugggccuuguggauaauguacagauuuaaaaacaaaucuuguugcugauuuguccauuucuuucccugcacuuuguuacaucugggauacagucuaacucaucugauuuaauaugcauuuaaaaaaaugccauaacuauuaaacaccuuguuuacagacagaugaaauaaauuuauuccaaccaaauacuc

SEQ ID NO: 13629 - RNA, 1723 nt, Homo sapiens
aauggacacuuuuauugucuauuuaauggaucaucaauuucgucucccuaccuacaaauggaauuucaucuuguuuccacgcugaguagugaaacagugacaaagcuaaucaggauaagcuacaucaaaagagaacuaagcuaacacagcucacuuuuuuuuuaacaggcaaaauaugcauauaugcauucuagaaugcacaaugguuuagucacuaagaaauucaaaugggaucuugaagaauguaggcaaauccagggugcaguaaagaugagcugagaugcugugcaacuguuuaaggguuccuggcacugcaucucuuggccacuagcugaaucuugacauggaagguuuuagcuaaugccaaguggagaugcagaaaaugcuaaguugacuuaggggcugugcacaggaacuaaaaggcagaaaaguacuaaauauugccgagagcauccaccccaggaaggacuuuacuguccaggagcucuaaacuggcaccacccguagugcucacaugucugauuuuauccucuguguuccauuuggcacagcaaguggcaguguuuccaccaccuaugaugguaaugcagccccuagaaguggcuuucaccaccucauccaugagggcuuugguucccugggcaaaagcuucccauucaaauaccccccacaggaccauuccacacaaucugcuuagcccaagugacagucucagcauacuucuugcugcuuucaggaccacaguccaagcccauucagccagcagguaugccagaagccacaguggcuuggccagucuuggcauucucaucaaauuucucagcagugacaaagucaauaggcaagguaaucuucacaccauucuucucagcuugggacauuaggucuuugacaaucuuggcucccucuucaucaaacagagaagugccagucuccauguuguugagcaccuuaaggaagguaaaagccguuccaccaccaauaaucaucucauugacuuuguccagcauauuauugaucagguggaucuugucugcaaauuuagcuccacccagaauggccaggaagggucgcuaugggcucuccaagaccuucacaaaguaguucagcuccuucuucaucaaaaaaccaccagccuucuguggcagacugacuccuaccauggagcugugggcucugugagcagugccaaaagcaccauugacaugcacauucccuagcuuggaaagugaagcucggaaagcuucuauuuuggcgggcucacuuuaaccuuguucccagaguuuucccuucccuucuucuuccacaugaaaguggagguucuccagcaggaugacagacccagcagcuggguuggcacaggcuuucuccacuucugggccuacacagucuuucaagaacagaacauccuugcccagcagagauuugaauucuacagcaaauggcucuaaggaguauugucaggcauagggacaccaucaggcuggccuagguggcucauaaggacuacugacuuggcuccauuguccaagcagaauuugaugcuuaagacaguagccuuaauccucugguuguuuguuaucugguuauucuacacaggaacauugaaguccacucucauaaugacccgcugcccuuugacgucugguuuguccaaugucagcuuguuagaaagcgacauuuuggaaauggagagaggucgaugauucagacaguaagggag

SEQ ID NO: 13630 - RNA, 1723 nt, Homo sapiens
cucccuuacugucugaaucaucgaccucucuccauuuccaaaaugucgcuuucuaacaagcugacauuggacaaaccagacgucaaagggcagcgggucauuaugagaguggacuucaauguuccuguguagaauaaccagauaacaaacaaccagaggauuaaggcuacugucuuaagcaucaaauucugcuuggacaauggagccaagucaguaguccuuaugagccaccuaggccagccugauggugucccuaugccugacaauacuccuuagagccauuugcuguagaauucaaaucucugcugggcaaggauguucuguucuugaaagacuguguaggcccagaaguggagaaagccugugccaacccagcugcugggucugucauccugcuggagaaccuccacuuucauguggaagaagaagggaagggaaaacucugggaacaagguuaaagugagcccgccaaaauagaagcuuuccgagcuucacuuuccaagcuagggaaugugcaugucaauggugcuuuuggcacugcucacagagcccacagcuccaugguaggagucagucugccacagaaggcuggugguuuuuugaugaagaaggagcugaacuacuuugugaaggucuuggagagcccauagcgacccuuccuggccauucuggguggagcuaaauuugcagacaagauccaccugaucaauaauaugcuggacaaagucaaugagaugauuauuggugguggaacggcuuuuaccuuccuuaaggugcucaacaacauggagacuggcacuucucuguuugaugaagagggagccaagauugucaaagaccuaaugucccaagcugagaagaauggugugaagauuaccuugccuauugacuuugucacugcugagaaauuugaugagaaugccaagacuggccaagccacuguggcuucuggcauaccugcuggcugaaugggcuuggacugugguccugaaagcagcaagaaguaugcugagacugucacuugggcuaagcagauuguguggaaugguccugugggggguauuugaaugggaagcuuuugcccagggaaccaaagcccucauggaugagguggugaaagccacuucuaggggcugcauuaccaucauaggugguggaaacacugccacuugcugugccaaauggaacacagaggauaaaaucagacaugugagcacuacggguggugccaguuuagagcuccuggacaguaaaguccuuccugggguggaugcucucggcaauauuuaguacuuuucugccuuuuaguuccugugcacagccccuaagucaacuuagcauuuucugcaucuccacuuggcauuagcuaaaaccuuccaugucaagauucagcuaguggccaagagaugcagugccaggaacccuuaaacaguugcacagcaucucagcucaucuuuacugcacccuggauuugccuacauucuucaagaucccauuugaauuucuuagugacuaaaccauugugcauucuagaaugcauauaugcauauuuugccuguuaaaaaaaaagugagcuguguuagcuuaguucucuuuugauguagcuuauccugauuagcuuugucacuguuucacuacucagcguggaaacaagaugaaauuccauuuguagguagggagacgaaauugaugauccauuaaauagacaauaaaaguguccauu

SEQ ID NO: 13631 - RNA, 58170 nt, Homo sapiens
cggcugcggcgcuggcgguggcugcggcagcggcggcauuuuagucggcagcggcggcggcagcggggcugcugcuccucccagcaucccuggcgcggccauuucagccccaucuuggcccagcggagggagcugcagccgccgcuucagcaguuugaauuucaguuucuucgggguuuaggaauugggcgcaccgaggaggagccggagaagccaccaccgcuaccucacacagccggggcgccuccggucccgugccagcggucugccgccgccgccccucucugagagaagccgcgaggggaggccgagaccgccgucgccgcccgcccgcaggggugguucccccuguaaggggaggaccgagccggcuuuccccucccccagagcggguuuccgccugaggcagucgacaugucccuggggcugagcuccggcuagagccggggagggagggccgccugcccgcgccacagccccaccgcccgcccgcggaccuucagccagcuccggcccgcggcucccggcugaauuaggcaucuccgacuccggacucgccgcuccuucccucagucagagagcccagcgcugacgccggcaccggccugaggagcccgagcggggcagcaccgccccucacgccgccgccaccgccuccuccuccuccucuucgcccucccacucccacccccagccaaggccugcugaccgcgccgagcgccgagcuggacugaccacggcugcccggagacgagagaggaagcagccggcccgccccuggguucgcgcucucgccgccucugagggaauugaauugaggcgccgcggcugcgagagcuaaaaaggaaggaggagccgccgcgggacugagacgggggcagagccgaagagaccgacacagagaaggaaacgaggaggaggaugucucaccgggcggccagcgccuggaucagcccgugacucuuaacagcggcgggccucagaccccagcgcagacucggacuuugucuuugggggcccgugcucugcccuccccgguuuccgacaggacccagaggagccggcgugccucucugcccuccagccuucuucaccauguccaagaugccggccaagaagaagagcugcuuccagaucaccagugucaccacggcccagguggccacuagcaucaccgaggacaccgagagcuuggacgacccggacgagucacgcacagaggacgucuccuccgagauuuucgacgucucucgggccacggauuauggcccugaggaggucugcgagcgcagcucuuccgaagagacgcuuaacaauguuggggaugcggagacucccgggaccgucuccccaaaccuccuccuagaugggcagcuggcagcggcggcugcugcucccgccaacggaggaggagucguuucggcccggagcgugucuggggcgcucgccaguacccuggcggcggcugccacuucggcccccgcccccggagcacccggcggcccccagcucgcgggcucauccgccgggccagugacugcagccccaucucagccucccaccacauguaguucccguuuucgcgugaucaagcuggaccacgggagcggagagcccuauagacgcggccgauggacguguauggaauacuaugagagggauucagacagcagcguccugacuagauccggggauugcauuagacacagcaguacuuuugaccagacugcggagcgggacagcggccugggcgccaccggagggucgguggugguaguaguggccuccaugcagggggcgcacgggcccgagucgggaacugacagcuccuugacugcugugucacagcuacccccgucggagaaaaugagccagcccacuccggcccagccgcagaguuuuagcguugggcagccacagccgccgccgccacccguagguggggcuguggcucaaagcucggcuccgcugccgccguucccgggagccgcgaccgggccgcagccaaugauggcagccgcgcagcccagccagccccagggagcggggcccgggggacagacucugccgccgacgaauguaacccuggcgcagccggcuaugucccugccuccgcagccgggcccugcagugggcgcccccgcggcgcagcagccccagcaguucgcguauccucagccucagauaccgcccggacauuugcugcccguccagcccuccggccagagugaguaccugcagcagcacguggccggccugcagccgccaagccccgcgcagcccucguccaccggcgccgcagcgagccccgccacggcggccacccuucccgugggcaccggccagaaugcuuccucggugggcgcgcagcucaugggcgcgucuucccagcccagcgaagccauggccccccggacgggaccagcgcaaggcgggcaggucgcgccuugucagccgacuggagugcccccggcuacugugggaggcguggugcagccgugccucgguccugccggggcugggcagccccaguccgugccuccgccgcagauggguggcagugguccgcugucagccguaccugguggcccucacgccguggugcccggaguuccaaacgugccugcagccgugcccgcuccaagcgugccuagugugucuaccacuucuguuacuaugccaaauguacccgcgccucuggcccagucgcaacagcugagcagccauacgccagucagcaggagcagcagcauaauccagcauguugggcugcccuuagcgccaggcacacacagcgcaccaacaagucuaccacagucugaccuaagccaguuucaaacucagacccagccuuuagucgggcaagucgacgauacuagaagaaaaucagaaccccuaccucaaccaccacuuucucucauugcugaaaauaagccuguugugaagccgccuguugcagauucccuggcaaacccccuucaguuaacaccuaugaacagucuggccaccucuguauucagcauagcuauuccuguugauggugaugaagacagguauggaaaucucuauuuuaaauauuugauagaaaugcuuggccaacauuguagcuuaggaugcaacuuugggagauuguugucaacggaggcccuuagcauuuuuaaauacaaaauuuaguuuuugguaaaauugauuuagauugcugaugcugaugucaaaggguguaaugagcgaauuggucuugucaccguuguuuaaaagcacuaaaauggguagggaugcaacauuguuuacucaaaaaaaggugaauuuaagcuuaaugcuuaccauuuaauggugguagcuaguguguuaugcucccauagaauuguccuuuucuuacauaucaaucacacuugaacacguaaggcagagagauuugucagugugaguuuugaggcugagacauaauaauacuacaaguuuuccuuucuggaaaaccagaagguccucuagugaaaaaaaaaaucuauguaaggaaucuucuccaguguaucuggaaaggcuggagacauaauggugaaaugucaaauccggcuuugaagaucauacuuaguucagccuuuugauuaaaggagguacaaggucacgagucuucccagggacuucucuaagauacuauuuuuuuguuguuaagcaaaaaauguacuggaaagauauucuuacuuuccaucagucuauuuauuauaggaaagggagguugagaucgauccuuuaacuguagugaaagcuauaguucuugaaauuaagaguaauuuuauaauaaaaguguaaauguuaauaauuggcucccuguauuuagggaugcuuuuuuuaauggccuaaauaagaauuaguguauugcuacaccagugccacaacagcugauguuugguuaugguuuagugaggauuuuugugguuuugaggagaugucacauguaaauuugacauacauauugcaaaauuuuaaaagcugacuuguugcaauguuuuaaaauuauauuuaaaaauuauagaaaaaguuucaggaauuucacaguuagacauuucuuugcugggguuuuuguuuagcgagaggcuaauuuuagguguuuuuaaaagauacaaacuaauauuauggauuuccagaauaauuaguauguggaagaauacaaugacauguauguuaaagcuuucucuuccuaugguuucuucugaguuccuucacauuucuuaaccucccauuucuaauuagccuuguauuuuuguuauauacuucuguugguuugaaaaauacucacugacugaaauucauucaucuucucugcuuuuuguaauuuaaaguucaucuuuuuuuguaggugacuugcuuauggggagucuuucuucacuugagaacgcuuagagaauaccacguguccauaagugagcucagcuagcuagucauugagaaauuuugugugugugggacuacuaaguaaacugacuccacaagccacucagaaaaaucccucuacuuuuauaguugcucccauugucacacacagggacacaccuguaacacagauugaguuuauuuuuucaccuuugguaauaaucaacaggcaucuucacuuuucuagcugccacaagccaauuuuuuccugauaaguuggcaaauaaccuuuugcuuuccucuguuccuguauacugcccauaucucuucaagaaaugaugacugguuuccugagcuaccccgcuuucuauacacacacacaccccuccacccgagaaugcagauuacauuuucccuucugugcacaccucucucaguuuacagcauccauacuuagauuccucagaacuuuaguacgaugauaaggcaugaagcagagacuucuguugauagauggaaacugaaauguauucuuuaggguaugacaucaaaaaugcauuuauuuuuuccucuuacuguauuaagaguugguaaucugaaaacucugauuuccaaauuugugaaugguugaacuacagauacuacuguaucaguguucuuaccaauugcaacaguuaauucagugcagggguuuugauguauguacaguccuauuuuaaacaugacacuucccucccuugccccaaucauuuaaaaucuacauugcuuaccaauguucauuucugauuuuuguuacagucuuucauugguuuuuaacuugacaugcuaguuuccaagauguaaucuuacacauuugacuguuuugucacugguccaacauaccuggugaaggaauaaauccauuagguagaaauaguuggguuuuuuguuuuguguuuuuuuuuuuuaauagaaagcuuugguuaaaaaaaaaaaaaagaacaggguauuuuaaaauuuuguguuugaaauuaaauaacaguuuuccaggcauauguuuaaauuacugagaugaguacuuuugaggagacuacuaucuuaacugaaaauuuuaauuuuaaugugauuuuggguugccgccuuaaaaucugcauguuuucaaauuugaaauaaaaccaacuggagugagaggucuugacuaauugugauuuaaacuuugcaaguaguuugacaaauuucagauccuaaggaaauauuuguaaauaagauauaugcuuuuuuuaaaaaaaaauuaggacuuuaguaaacagucuauuucuuugagaaaagaaaggaaaaugggaaauuaacaaaaagauugaggugguuuagguugauacauugaaaacucuuaucuugagauuuugguuccauuaccuaaugcaaaguucuauauuggcuuaauuuugagaucauuuauaauuaaagaaccgggccuuauaguaauacaucuuaauauuaucacaccuuuaaaaggcugaugguuguauaugcaaaaaguucucaauuagcauugccuauugacucuacauuauuaauuaccauaaaguuuaucuuucuggccauuuucauuagaaagguuuauggucaguuguugagacucuucagauugauuuuguguaaacucguggaugugaugguugaaaauacaguccuuaaauauguagcuacuuuuauagugaacuuuacaaaacuuguuuaaacuacguacacacuuaacagucuccuguaaaugagaggaggugcaaaauauuacuggcccuuuuggaaaaggaacacaguacagaucacuuuccauagauagccaaccaaugugaacucuguaggccgcauuccaggaacucuuaugaauggcugcaauugugagcugucaucuguggccaaaagacuguugaaaaccugauucuaaggauccuuugguggcagauauuucuaugucuuguuaaugguuuuauuugugugguuugcuaaugaucacugauaaaauauuauacauugugaauguuaagugguguguccugguaugugccauaaauacacauuuuguuuguacauuuauauauauuuuaaaccaaauucugcugcuuuuuuuacuugaaguuuaagugagaggauuaaguaaauguauaccaggaggcagaacugucucagucuucgaccucuguuguaugaaagucucacugaauugaagucucuaaagauggaaauuucuuacuugaaucucuguuucuuggaagcugacauuuaucuguuaaauugugaagguaauuuugcucuuguagguuuacaguugaugucugaaucacauacuagauacuauccuaugccuaucuacacguuuaagaguguucuuacugaggaguuaguaguaaaaauguaaauucguauauaugugucauuauuguuuagcauaaaaacugauacugauguauucaucagggauuacugauggauaccacauggauuacuaaaacauacuuuauucauaaacguggcuugaaauaaaagaaaugacagauuuccaaaaaggcuuacgauuuuccaaacuacccgaaauuccuaaaccaugagcuauaucuguaggaguguggccuuuuauauucacagugacacauacuguauaaaauuuuaugugcacuaaaucauauaggccaaacauugguaaauuuuuuuagaaaacaugauggcuuauaugugugugaauaauacagauuuccagcugacuauuuuaguaacacuuguuuuuucuuuuuaggagaucacaaccccugaacuaaaucaccuuuaugagaagucauuuuauauaggacuggugguagggguauauauguccucuacuuccugagaauaaauauaaugccaauucauuuguuauuuaagaauccugggccaggagcgguagcucaugccuuguaauccuggcacuuugagagaccaaggucagaggauugcuugaugccaggaguuggagaccagccugggcaacauagcgaggcuuugucucuacaaaacauuuaaaaauuagccaggucuggaggccaacaccuauagucuuagcuacuuggggaggcuguaggaggaggauugcuugagcccaggagcuggaggcuacagugagcuauauuauaauauugcacugaagccugggccacacagcaaggaccugucuguaaaaagaaaaaaaauaauucugauagcacuaauuuggaaauagugaaauaugguacuggaucuaugaaucugguacuuccuaauuaggaaugggagucuaucuuucucugcaccagaaaagaucagaagcaguuaugaacaaauagcagccccaccaaucaaguaguagagaaacccaaauaaaucuguuuccuaauaaaggaaugguaguuaggaaaguauaaaaggaaucugaccuuccuuuccuaaaauggcaggaguuggggaaggggaaguguagaaugauagcagauaaucaaaauggaagaaaguacaguggaguggcaugaaauauagucucaaaagaaauaggaacacuugugaauacugaggaaugguguucuaauucuuucuuugaagaauuguuuuaguccaguguguauuuccuuuucugaagauucuguuuauuucuuaauugcauuacucguuaaauacuuaaaguaugaggaaggagaggccuuacaaaagcaggucugucugguuaaacauagccugaaugauauuccguaaguaauuccuuaaauuggaaaagcagauuuuugguaagaaauauuaaucauauuuaaggaguauguguagcaaaacuccuaaauuagaauaaauuauuuaaguguaugguuuuucuuuauacuaaaccagugggcuugugauuugaggcuacuguuuucgaugguauuguauugaguccacagagaauauguauaccugaaucauugguauaaugucuuucccacagcaauucuugaacauaucaaauuacucgauauuuguuauauucuuaaucuggcauugcuuagggcaaaaacugggugucccucauaaaaagguaggaacaguagccaguuugcaccauuccuauacauuauuccaugacuuuaggaaguauacuuugagguauacucuucagauuugguuuaauaauauuaaagguauauugauggauuguuuccuguaugaaaguauugcaugauuucugcucuuaaaucaggugaauuaaauuucaucuggauugcuuaucucaaauuuaaagccucaaaucagacuuaaauaauuaguauuuaguauuuaguuugauuccuuuguacccaagcuaauuuuuguuuaaaaagaaaaagugcuuccauccuuuuaaguaguacauuuauuugugauguuagugaaaguucugcagguaacugaguuaauuuuauuaguguuugccugggacauauaccuauuauuaggguaggcaggacaaauaaguaaagucuaaauguuaaauuacuuaaagcuucuuuucccauaagccuuuccuaaaauuugucuaaagaauauugcuuuguagaagauggaguuugugauuaaugugucaauuauuguaaauaaugauggcauaguuuuaaauguuaguuuuaggcuguucaucuuauuacacaaguauauaauuuaaucugaauaaaggauucccaaagguaaguguaaagccucuaguuucuaaaguagaguuaguauuuaguuuuuaucaagugguuuuauauguuaaagcaaaacaaaucuuugcuuggcauaccgucuaccuagucuuugaagacaaaacaaaggagggaggagcuguuuugaucaaauaaaaccaauagcguguuuaauuauguguuaacauaugugaaugaccauuacagagacaguagagucagacauacccgggcuaaaaucuaacugcuacauuugacuuugagcuaguugguguagaugccuuguuuccucuuaugaaaaauggggauuguaccuaccugggagaguuuuaaggaauuaaaugaugugugcaaguaauuugaacagucuguaacauaauauauguggcaaacguguaucacagaaauguuaauauuucaguguccaaacugcucucccagaucaccccuuuacauguuauaaaucauaccaagaaucuuccauuuuaauaugaaagcguaauuguaugguauggauguagucagaaaaaaggagaugauguuuuagucuagacgagucaugauguuguaagaaguauagggaauuguguuccaguccuggcucuucuaucauuuagcugguuucuuuggucaagucauuucacuugucuguuuuucuuuuuugagacuuugucaaauuuuaagauuccuucuagccuuauguauaugagaccauacauucaagugugcuucaugagagaacugcaaacuuaaacuuucuucuuuuuaccccuuuccugccacuugacuauuguguggcaauaaaugaaguuuguaaauacucauuaaguagguugauugcccaagaaaacauuuaaaacagcuuaucagucauucagcuuucaugaugcucugugaguagugagcacuggaauacaaauaugagacuaugcugcccuccuagaucucaggcauuuucaucaucaugaaaaugaugaucagauguauacuuugacauacauuggagguggugauggaguaauauaaggugcuaaugggaacaauuugagacaucagaucagauugggauugggaggguaguagacugacuucuauuuaaaaauuauucucugcauagguauuuauauaguucaaaacucaaaauauauaaaagaguaaaaucgaaagccucucugcuaccucuguccuccagccacccuguuuguccuuagaaguaacccauuauuacuuguacauucuuuugaggcuaacucuugaacuaaaucuuaaaauggucauucagauuaagucacuaagaagagaaggggauaguuuuccaagcagagguaaaaggcaguuuguauaaugaugugaaagagugagaaucuaucauuuggaaaaugguauuguuaauuugacaagaaccagagugaaggacuuuaaaugucaugguaagaaauuucgauuuuuauaguaaguugcuguuaaagguauuucuggaagcuuuuauuguuaaaauaauauauaucuugaaacgauuucaguauccuuuuagugauuauugcauuuuaaauuauaaucuuaugauaaagcuguguuaagggaauaccuucagagcgcugagucccaaaaaucagaauucuuaccuaaugaaaugugcuaaauauuuugguaccccuggcucuaaguuuaaguauucuguuucccucaauauuaccuugauaaugucagaacauuugguacauguugagauacucuaccaaaauuugauuuauagguagcauaauuuggaaacuaaccuuauauuaaacacaaagcaagcuuacuugugucagguccuauguauauagacuuucauuugaucuuuccaacaauuuguaagaaagugguuucuucccuucccccuuucuuauggauuaaggaaacugagacucuuaaaauuugagucaccuagguauugggugacaaagccuagacucauauucagaccuuuaaccuaaagccagugcuuuugaauauucccagaguuagaaguuuguuuuauuacuuggcacacaauaaguuaggaagaaggaagaacuaccauagccacugauuuguuguauuguaacccuuuaccuaaaggauuuuuuuaaucauuuaaauuccccagauaauaauacuggagauggugcuuguugauguucuucauauuguaugucccugguuucuauuuagagaucucugaagucgaauuuuggcauagauuaagagaaagagguguuuguugagugcucaaguaccuuaugcuuuaagcuuugacaauuuuuguagcuuaguuuugagguauggaauguuuguuuuuuucucccuguuguacuuaguuacccuacaaagauagugucuugcaaaaacagguagacaugccacaugcuuugagucauuuucugauguaguauuuucacauacuuggaaauuaaugugauggacuauugaguauauaaagucagagagaaaagaauguauuuuguucagugauguuaaagaauauuuacaaauaggaaaacagcauuuuuguuuagguggcugaaguacaguguaaaccacaucucagucuuccuagaauugcuucguuggcucuauauuuagaaugguaguuuauauuaauaucaaauaaacuguuaaaaagcugguuucaaauuuuauuucuugaguggaagagaauuugugaccacagcugcauaaaaagucaguauuuccuucuaauaaaauuuuuaauuucaguugccucuucaugcuuucagguuucauggacuguaaccuugaaaugaucccauuaacagccuuuuccuugggcucuuaaucuccucaauuuuaugccauuccaaaauagaagucucucugaugaucaagccuuucaaucuuuacagauggcucuuuucccuucuacuuccuugaucagugauuucacagacuugacuccuuuaaucuguuagucaguguuuggagacuaauuauuguugcuguuugcuacaaaccccucaguuuauggauaacaucccaguuauaguaucccagaaacaaaauuucauagcuuauaagacuaucuaaauuuuuacccuuaaaaucuagacuguuuaaaguuuuauguaguacauagauuguguaacuguguacuauagaaaaccauguacuguggcuucuucacuuugaauguauguagaaagagugauuguuaauuguuagcuuuugcaaauuaaguguauucuaauaugugcugaaaacuuuagguccauuuauacaguauuuuauuucacagguucuuuccacaucccaguauuuacuacuaacuacaaauauguucguuuuucaccuuuacauuugacuuaagagauauugcacuauucuguaaaacugcuggaauuuuauaacaagucauaugacuucauuuggaaccaauuuaccuggaauaugaauuugauucaaauuaaauauuuguauuuccaaagucagaggaucuaaaggucuuuuaaagaugccaggugugguggcucaugccuguaaucccagcacuuugggaggccgaggcgggcagaucaccugaggucaggaguuugaggccagccuggccaacguggugaaaccccaucucuacuaaaaauaccaaaaauuagcugcgcgugguggugggagccuguaauccccgcuacucgggaggcugaggcgggaggaucauuugaacccaggaggcagagguugcagugagccgcgauugugccauugcacuccagccugagcgacaagagugaaacucugucuccaaaaaauaaauaaauaauaaaguucuuuuaaagaauaucauccuuauaaauauauugugaguacucuuuaaugaauuuugaauuguagacuugcagaauaacuuccaagauacucuuucuuauucuuuuguauauacuaccuuccucuuugagucacuccauuuaaacuggaggucuccaaacagaccuuugaggauagcaaacuaguucccauauguuccugggcaagccuguuuuuuuauaaaacaaaaacaacaaccaaaaaaaaaaccagauugaauguucaauugguucaguuaguuuucauuugauuuggcagacugacuucuaaguacagcgaaaaaaguggccugacaaauacaucuuaagaggauguaagccguuaaauaaacaguagguagaagccucuuaagcuuuucuuguuauuagcaggucuaaucagugccuuugauugccuuagaccuaguuaggagaaaaguggaaaaaggauuaaaagaauagaaaggaguugaaguagggcaagcaaugagaaauacacguauuagucuccuaauuaaucaaacaguuacuuuggugauucucuggcaucuuggaagucuuuuuuuuuuauuguacuaauaauucugcacagacuuuaaggcucuuaauaggaccccagaauugccauguuguaucuaaaccucauuuuguagauuaaaauaaugcuauugaugauucacuguaugccaggaacuuuacauuuagucucaguucuuuagccugcaaagcuagguaguaauguaaccaguuaacagauaaagagacagacuuuuaaagaggucaaacuuuaacacugcuauguguuuaguguagugguuuaagagcauaaacucuggaacuagauugccaccuacuagcucagugauguaaggcaaguuacuucuaucugacccaguuuucuccucuaugagaugggaguaauaauggugccuaccucuuagggcuguugucagaauuuaguuaaugaguguaaagcacuuagaauagugugugguaccuaauaaacacauucuuaacugcugcuguucugcuacagcaugggcuaagaauuuuaaaaguuauguggcaaaguuuuuuuggcuuccagauguacagguugaaggugggggagacuauggaaguugcugaggaggagggaacagguuugucaaaaguuuaaauccccguggaaccagucccuagauuugaggugaaucauacuuacugggagauaguccagaagagcccaucaguuaagagucuauggugaaagcccuagggaaugguagaaaugaaagauaauuaugauaaauaggcuuuuaccccuaaaguaacauuguaccaaugcuagaaucagaaagcugccaaacaauugcagcgccauuuuuugcccuagacgaggaaaaaacacauauaaauaaauggauuuugaagguggaaaugugucaaguccaacccaggaaagaauucuucauuguuaaucaaaccuuugcuacuuuuaacagagccuaagaaaaguuuuuauauugugaagauauagcuuaacuuaguuuauaugaauaccuaagaacagccuuguuaaacugcuaaacaagauagauauuuguaaaggcauuugauauagaagaguguugauuaggcuaugaauuugucacauuuauaugcacgcacacaaaauuggaugcuacuuaguauuuaguuucaucugccuuaccucuuuauuuuauaacugugauccugaauuauuguugaagucugcuggauuuuguccaguuuuuaauuucuucuaaaguguuguuuuaagcaaacuuaugugguuuuaaaaucuuuuuauuauuaaaaguuacacuguauuagaaaucuaaaaucuuccaucuucuuuugaaaaguagugauuauacuguacguucucaaccucauuuccauuugauucucggaucucacaggaauccuucaacugcuuucuaccaagcguuccauuugaacacguuaaaggaaucaaagagccucugggauagguaugaauacuuacauauggaaugcauacaugcaaaacuguaugcaugaauugcuuugcacuguacugguuucucauuaaaacugaucuuuguuauuuuaggggggaaaucacaugguaucuagcaugggacaaagcagcaaaauaaaccaaaaggacaaucucuauuuuauauagaaaauaaacauacuuuucugcauccuguguacuuuaaguauaucuauauuuuugaaggguucauacuguguugaauuuuucuuaugaaauagucacuuccccaguguauuuuaaugcaaaugcauauucuauaaaauaaacuauauuuuaauuuuugugcuauuuuauguuuuuuuucuguaaaagccauagugauucaaagcaaaauguuauuucaaauuaugaaauuggaggaggaacaagaccaagguaucaaaguaaucauuguuuaauuuuuggcaagaaacuuuaacuucaaguuuguuugcuagaauucacuaggucugcauuacugauuuguaagccccuaaaacaguuugcuuucuuacagaaauguuguauagauuuuacuguuaacuuuuaaaaauacagaaugaagucuuggaguucuuuuauggcaaaagauacuuugguuuaucuuucugcuuaacacacauuuuaaguaguguaugcucuguucaaucguuuugcugaauauuuauuagcauuccaucacuuuguguuuaauuaauagaaguugaguucaaacaauguuuuuaaaauucacacaaagcucguuagauucuuuuaacucugccuggcaacgcauuugugucuucuggcauaguuuuggauaacacucaugaacucaacuccaucucuuucauuagaaaagaguauugcuaagugcauguacaugucauauuaagacaugauacacauugccuagaaaugcuaaaacagucuuaauucuucggcuugauuugcuugugugugucacucuagggaaauuuucuaacaguaucuuuuugaugguguguuccagaaaucuuuuuaaauaguuacuuuuagaacaggaaguuuuaaaauuuguaguaccauguuuauaaaauaaauuuuuaaauaguucuguagccauuuaaauuaauacauaaauguaaauugugagaugagauaaacaugaagguuuaaucuuucaaauaguuuuccaaauguagccagaaugugaguacuuugggguaugcuuuauaguuucucuuagaaaaaggaaaaauagcacucuguuuagaaauguaauaagaguagcuuucaaaaguaugaugauuuauuucaaauagcuaacuuugagcugucaugauguugaugugaaugauauauauuauuuuuaucaguguaggaagguuugagcuauauuuuugauaauuugaauaugauauugaaagguuuauuuuguuucauaauaaaaccaccauagaaguugccuguacaucauuuguuguuacagcuaaauacuccuuauauguuuucuuuuuuuagauaccugaaacuuuuaagguaucagaaaugaggcaaguugcguaucuaugguuucucauggguugaaaauauuuauuuucucuccuccuuggagccuguuguucagagccaaagaaguuaguggauauuugucuguaguguguuaaugccaaaauauaauaaaaucaaaauauaaucagaucagccauucuucacuguaaguuggccucguugguacuaaggugacaaggccaacccaauggaaacugacuaguggcuuucuuuuaacuuuucaacuagcuuauuaaauuuuccauugagaggagcaaucauggcuaacuuuauuaguuuuaauagucuacacuuucaguuggcaacuaucuacagaauuacugauagguauaucagcuaauaaaguaucaugagaccguuuauuccaaauggguugaagauuuguguguguuaagcuuuaaaaaauauuaaauauaacuucugaccuugauuguucuggaaaucaccaaaucacauuguucauuuuuacuauuauaaauuuaggauuuuuuuuuuauuuuacuacuaauuuggcaaauagguauuuggcaggggugauucuccuauuaaagagagacauagacugggcgcaguggcucccgccuguaaucccagcacuuugggaggcugaggcaaguggaucaccugaggucagaaguucgagaccagccuggucaacauggugaaaccccaucucuacuaaaaauacaaaaauuagcuggguaugguggcacaugccagcuacucgggaggccaaggcaggagaauugcuuaaaccugggaagcggagguugcagugagcugagauugcgcuauugcacuccaaccugggugacaagagcgaaacuccaucucaaaaagaaaaagauauuuggaaguuuaagggacugcaagucccuaacguuaucuucuacauuaucuauuuauuuugaggcauaaauuugucucgcuauuacuagauaacagauuuuaggcuccuauuuaugaaauguuggaaaucauuuucaguaggggcagcuuuuaagugcccauuuucaguagaccuacccuaaauagcugaauaucccuaguuugauuuugucuaacuagaaagacaagaaucuccuuuuuuccucaggaaucuuucaguuuagcagaauaucuuuuaaucaaaauguaaguaacuaauauaccuuucucauauugacuuaaaguucucuaauggccccuuuguuuccuuccauauuuaaauuagaauuggcaaauuaauagacuuuucaccaagcagccugccucugccuauauuuagauauuucuccuuccauuuauauccagugcuuuacucaguuauuguacuaaaauugaagcuacccucaagucuuccuuucccuuuuucuguaggugccaucaugguuucugucuucucuguuugccauuugcagagcccucagggaaucaaucagcugaaccaucuucaaauguagggacaguagauacugauaacgcaaaaauaauccaacccuuucugcaguagcccaaacuguuuugaguugacucuuuauuaaaauaaauacuauaacuuacauaguuagcuuucugggagauuaucuuacuauggaggaguuaauuuuuccugagauccuaagccuacuggcauuugagaauaguaacuuuaaaauuugacuuccuauuuucuaaagaacaguuuuccaaaguuaauacuuggcauugcuuuguuaaauuggcagaauuaguuuagaaaccuauccugaugaucacuggggagcggcaagcagguucucauugggaguccuuuguuuacaaaagcucagcguaaggguuuauagcaaacaauuuuacccucuucuaaauaccaggucacuaaaguaaaggaguacuaaggggaagaaacuucagcuagacuaaaggaagaaaucagguagcuuguaaggcuuuaaccucaucgauaagcacuugcagggcuuuugucuucauuaagaaaugcauaaauguacuuaaaacaagugagagaacaguugcuagguguacauccccuugagucugcuugucuguccuuaugauagcaccaguauuuagagagaaguuaauaaggaaaguaguagacauggguuauuaacuuaaaaugaaagucuaguaaguuuauccuaaauuuuuuuacuagauaauugaugaucucucaaauuguuuucuacagugauuauucacuuauuaccucuaauuuuaaaauuauuggauaaaaaaagucuucuuauuuaaauagccucaaguauuuuguguagggaacgccuuccaguauuuccuaucauuguuuccuaugagauuuuuuuuugaagcuaggaauaaauuagaacuaagcuguuuaugucauaaauaccauugguaccauaugagacaauuuauuuuguuuugcucaucucuaagaaucuuggguccaucauuaacauccaccaguacuuguuaucccaaaugguaaaacucaaguuaugcaacuuagcugaucuaguuuuugaaugcuuggugauaggacuuguaaaauuuuuuuauugaaguauaauuuguaucggaaaagugcaccauucauaaauguauagcucaaauugaacacaccugugugggcagcacccagaucaauacauagaauauuauaagccccuuucauguccucuucaugccccccaucagucacuuccccucccaauccuaauuucuaauguguuauauauguaggaccauacacuauguguuuugugucugaccucuuucauccaguauuguauuugagauucaucuguaugguucugcauaguuguagauguggacuauauaauuuuaaagaaucacucaaguagcuuauuuguuggagauugguauugguuaaauguucucuccuagugauuaugcauaaguaucuugaggauauguaccugaaccauuuugugaccaaccccaauauauuccuuacuaauuuguaccuaguacuuacauaauuuauuaucugauuauauuucaaccuguuccacuaaaagacaucuaguagaggauaguacaagaagcuaaaaauuauagcauagcuuuuuaaugauugucaccuuuuauucuuccucccucccucccucuuuccuuacuucauuuccuccuuccuuucuucuucucuuccucuccuuccuuccuuuuauuuuacuuuuuaaucugaaauauuuuagauuuaaaguugcaaaaauagugcugaggcuucuuguauguccuuuaccuagccucccuuaauguuaacauguuguacaaccuuaguacaauuaucaaaguuaggaaguuaacauugauagaauacuauuaacuaaacuacagaucuuauuuuaauuuuaccaaguuuuccacuuuuguaaguguccuuuuucuguuccaggauccaauucaggauuccacauuguguuuagucauugugucuuccauuuuaauuuguaacauagcacuguuccuuuauugaacauagggaguagcaagucuggucuuauugguguggagagucaguuaacuaagauugccuacaaauuuccaccuuuucugcagugcuuacuacaguugcuauucucacaggacucuuucguaucacauauauaaauguuuucaucaguaguuuaguuuguaguucuuaagugggggauggggcaggcccaggguaggaggggcagguaaucacugguacuuagaggaugaaagcuuuauauauucccucuaaaacucauuuuuggaucccugauuuagauggaaaccucagggcgugguuauguucagaugacauuaaaucaaggaagugauagccauugugaaugacagcauuuauaaauuuaacugaaacaaauacagaaaucaagaaauuggaagaauuuauauguaaauucagggagguugaaaccuagguugacuggguauaguaaaaaaaaaaaaaaacauacuuagauauguguguuaauggcauuuuguaguauugguuagcaagugacagugcugccacaaaaacuaaugugauuuuaggugauguugaaaugauggugacuaaucuguuguacuccauuucuacagaacaguuguucuaaauacaaaacuaacuagaaaaccaaauuucuuuauacucuauuugcauauccagggguauuucaacaggcaggccugagcgagcuuacugaaaaguaaacagaucccuugggaaauggucuugccaucacuagaaauaauacaacuaucuuccugucuguuaaccagggaugcugauuuuaagugaaauuuaauuuuaguuacauuuaaaaugccuacucuggaguuuuauuuccccaacuuuucuaaauggaaguacaagcauuggaauugaacuccuuuacuucuguuucgucauuauuggcugugauuaucaguaaaccuuaaagagcuguguauuugcuuaaggaauggaaggguaguaaacuauucugcuuuuuuagggaagaauuccaugucagaggcaguaaauguugaucugaauagagaaaccaauggagcuucccucagaagaaaaugagugacaguaagcuuauuuggaaaugagaauugccauaggaguggugguaaaugaagccccacaaauaacuaggcaccaguuaucaccaugcugaugauuucagcagcaucuuaaaaacuagugaauucuuccuacccaggugccaaggggagguagaguaacucauggagaaaaauaacuacacauuacagacugacuggcagaauuuaagguuaacuucauuuagaaaucauggacuauauauauaaaugggcaucagucuaggucauagucauaggacuguagggaaaaccaggucuccaaguuuuuaaaagccacaugcuugguuaugaaauugaugcucucaaaauauaauucaaauucuuguugaucuggaaauaagaauagugugugggaaagaaagaaauuguauguagaguguagugaagguaggucauugggauuuuaauggaagaugaaagaagccacuuaaaacuguuugaaacucaugccuaugguguucuguaaagcuacuugggaaguucaguaaaguauuagaugccuggucauauuauaaaguagucucuuuaacaauacguguuuguccccaauuauaguuacuugcuauuuaaggcauuuuccuguuaccaucuucaguggucuuagaucaccuuuuccaaccaaaagauucuaaagccuuaaaaaucucacuuuuuuagaguaacucagaaugaagcugagggaaaauaccaggaacguuugcaauuaccugacucagcaaaaguuuguucuccuauaauuaaauacuagaagaaacaauaagauuuaguaacugcuuucagugagcuuggucuuaauauggaaaaugguaaauacauuaucacaugauugaaaguaauaacucauauaaaauguaagcacuucauaucucucaaguacagcuggagggauuggucaaagcuucuucaggagguggcuuuugaguuggaaacugaaagguggguagaauuuggucaagcagaauuaaagaacugaggggaagggaacauuccaguuagaggaaauauugugcaccacuauggaaguacuggccuuauaugauaaggauaaaguuaaauuugguagguguauaacauuugaagacaggagaggagagcaguuagauuagagacagagauucuagaaagguacugaagccugaauuaggcaauggggaugagauaggaauuacaggauuuuacaacugauuggucaugauaggggagcagucaaacuugacuccaaagugccaaaccuaauugacugagggaaugcugguacuguuagaaaguauuagugaaagaauuaguuugggaaggagaaaguagugaugagguuuuuguuuuuagcuguuuuuuggaugaguugauaagcugguacaaagucaaggugaaaauauuuggggugcagcugaggcugcagacuugcagguugguauagaaauuaaagcuaguugagauuuaagaauguuuuauuagaguucaagcuuuaggaaaggccaagauugccaaggauuagaguaggguaaagggucaagccaggaccuuaggcaauaccaccugcauuuagauaacagaaggaagucugaagaggaugauugguuuuagagauuagaccauucugaggauauuauuuucuaaucaaaaagaagagaaaggucugaaucuuuaauuugaaauaauuucaaauuuacagaaaaauuacaagaauaguacaaagaacucaaucuucuuaccaagauucaguguuuguuaacauuuugucauauuugcuuuaucauccuaacauauuauuuuaggaaccacuaacaaggugaaaccccaucucuacuaaaaauacaaaaauuagccaggcgugguggcaggcaccuauagucccagcuacucgggaggcugaggcaagagaauagcgugaacucaggaggcagagcuugcagugagccgagaucgcgccacugcacuccagccugggugacagagugaggcucugucucaaaaaaaaaaaaaaaaaaaaaaaaaaagaguagauaggaaauaccauauccauuuaacuucagauacuucagcuuauguuuccuaagaagauuauucucuuaccaacaauauaauuaccaaauucaggguaucuuauauuaaugugcuauuaucaaauaugaauauacagugcauauucagauuuugucaguuauuacaauaauguccuucauaaccauuuuuuaaccuguucgaagagccaguauagguucaccaauuauacuuaauuaaacaguugucuuuuucccuuccugucuuguuugaauauguaaguacuuguguuagucaccuaaaggauuauuuaaaauuuaaauauuuaauaaaaaaugcaguauuaauguuuuuggauaaaauacuaggaaaaaaauguacuugcuuagcuaguuuguacuauugggaguauucgaaaggcaagggaguacugccuaaaauccagcugaaacgacuacuagaguuggugaaguuuuauaaggggaggucuuuuauugcucagaguugggugguggguggcaagaguaggagaacauuuggauauuaaugugucccuuagaaauugaaguauauucauguacuucccuuucuguacugugauuuuuauauguauguauuaaauugggcuuuuaauuauuuugaguuggaaaaaauaguguaauuugaagacauuuuacaucaccacuuggguuugcaaauuauguauugcuauccuguauauacuguuguauccucuuaguuuuauucugguaguuguguuagguggcuugucugcugcgagauuuuuaaccacaaaucuaaaucucauuauucgaagugguguuucacuggacccuaaacaucucuucucuuagcuuuucuauggcuagcugaagugggacacuaaacauucugacaucuguuuucgacacauuaccagguuucagaauuggcaaagagaaauuauuucuuaacugcucacccaccauuauauaugcuuuccacccauauguuuaccaccuuccucuuuaguaaauuuaauauguuauuuaauaaauuucuaaaccuaagucaccccagccuauuuugagauguuuugauaauuauuuucaggugaaauuuuagaaacaguuuugaaaaaggugggaauagcugguaaggucucuuuauuauuuauuuauuuauucauuuauucaauucuuuuuuuuucuuuucaccaaauagauuuuagguaaaccaaggcuuugaauagaacagaaaaguguauguauguuuguacaugugaacuaauucgccaaauucgauguauuuuuuucuaccgaaucuaaaauucuauugaagagcuuuuuuuaaaaaaaaaaaauaauaaauaacugaacuuguucagacaagaaagaaauuuaaggaaccuggaauuguugaaccaggauaaacauagaacaucuuuuaggguuucgucauuguuguugguuuuccauucuaguccucagcaauuuaaaauuuuaaauucacaccucuucaguuguauuuaaauccgcaguugggcaaccuuuugggaagaaagaaauauuaauggaauuauuuuaguuuuuuauuuuuauuaagauuuggggugguagguagagguagaagaaagagaugacugacucuauucuagccugacauucuuuuuguuugugugcauaaacaugcugauaguaauauuccaaguuacucaaaucagggaauauauuaaauuuuugugauugauacagagcuuuuaaaugccuuagcuuaccaaaaauuagcuccuguguuuaaacuuuaguuggcuacuucuaaaguauuuuucauauuugacagaaauaaauuuaaauaagugauaauaauuuagaauguuuauccauuaguaaauauccucaagaaauaacauuuuuaugccaguuuaucucccaguuguuucaaaguuugaagauuguugguuauaaauacuaaaagauuuggaaggugcuauuguauuuuucacuuuuuaauugugugauauuuggcccaaaaauaguggugucuucacuaaguuaaaguauguaugcagacagcauggcugucaguguccccagcuguuuauguggccacauauugagaauuuuauuuguaauuucaguaucaaugcuaauggugguauccauaguagcuacguauuuucuaccaauagcaagauguucagaauauauguaaccuuugucguagaagacagaaacaucuuucugcauaucugccuggugauaaagaagguauauuuucccuaguccuacacaguaucggaaggggaacaaggagggaaaagaguugcagugucuggcugauaacacuccuguuuacagugaugcuaaccguuggucuucagaaaauuucugcguuuauuugcaguagcuguuuuuauuuuggauaguacuuaguccagaaaauguugcuaaauguauuuuucuagaguagucauaacuacuuuuguuucaagaaauaagagguaucaacucuucaaaaagcauaauauauuaugguuucuuuacaaguucuguuucuccugagcacaguggcucaugccuguaaucccagcacuuuggaaggccaagguggacagauugcuugagcucaggaguuugaguccagccugggcaacauggcaaaaccucaucucuacaaaaaacacaaaaauuagccgggugugauggugcaugccuguaaucccagcuacuugggaggcugaggcacaagaauugcuugaacccacgagguagagguugcagggagccgagauugcaccacugcgcuccagggccacagagcgagacucugucucaaauaaauguauaaauaaauguuccauuucuuuuauguuagcuauuauuaagcucagagucaaaaaauaggaggguuuuuuguuuuuuuuuuuuuugggacagagucuugcucugucacccaggcuggaaugcaguggcacaauguuggcucacugcaaccucugccuucuagguuuaagugauucucuugccucccgaguagcugggauuacaggcaccaccaccacgcccugcuaauuuuuguauuuuucauaaagacaggguuucagcacgcuggccaggcuggucucaaacuccuggcuucaagugauccacccugcccugaccucucaaaguucugggauuacacaugugagccacuguguccaacccaaauauucagcuuucuguuaacaaagcaugcaguuccuuauuauacauauauuugaguauuauguaacuggcuuccacuuccuuugauuuuccguuuuuagagggagcucuaccuuuaauuucaauaucuuuuuccuuugccuucuuucuaagcuguuucuacuccuuugaaaggaucaaguguauaaaucauuugagaguaaacauguuaaaaauaccaauagccugucuucuuagagcuguuuuucaaagguguauuaaugaaauucuuuaagcuguguauuugguguuucuucuaccaauaggugcauuugcuauaaugcauaacauaccaaacacuuuauauauguguauauacauguacuuaugcuuauauauguauguguauauauguacauaugcuuauauauguauacauauauauauuuaguuucuggcauagcuaauugugucuuaaauuauaucuuggcucaaccacagauauaugaaguuucuugucauuguguguuaugugucuuuuuauaugugucuuuuuauuuauuuauuuauuuugagauggagucuugcucugucacccaagcuggagugcaauagcacgaucucggcucacugcaaccucugccucccggguucaagcaauucuccuaccucagccucccgaguagcugggauuacgggcgcccaccaccaugccugccuaauuuuuguauuuuuuaguagagaugggguuucuccauguuggucaggcuguucuugaacuccugaccucaggugauccaccaccucugugggaucccaaagugcugugauuacaggcgugagccacugcauccggccuuuuuauauguuaauuuuuuggaacauacugucuuccuagcaguuuuauuuuauuuagguacauuuguacuaauuuuuaaaguaaauuuaucuuugauauuuuaaagcuuauuuuuucaauauauauaaccuauggaaugacucuguguaauuuauuggaggacauaaaggguugcccuguuuccccccuuucuccauuuaaaacuaaguauuucugaccaagcauugguuuaucauggcuaggauuucuccaaacaauguagugaacuuuuuugaacagcagguugaaaaucuggcuauauuaguggguagucuuauagaauuuucagaaucuuuuaaggaaaugugguuuaaaccugaaaacaaaauuuucuaucaaacuaagauaagcacauucauuaaaaaaccaaguuccuuuaggaacucuuuuagaccuguuugauuuagcauauccauuuucaaguaauuacuuggaaauuauaaaucaucuaccuucuuccccuuucacuguuuuuuuauuuuaauauaguuucaccuucucacaaaaggaaaugauaaauaacuguagggaauauuugggauuugguuuugguagcagucuugccagagauucaagauuaugauugauaauauuaguacaguuuucucauuaaauauucauuuuuaggaagaauucuaauuuuaaauuuugaaggguaucugguuaaucugaacgcuguucaucuguaacuacuuuaguuacccaauuucauuucagguuguuaauaaggauguccuacauguuggaauuuaaugacuuaaacucuugaaauaugacccuguacuugguaacaacuaauuuugaaaauauaugcuuaggaaaauuuugauauauaacuuuuguaucuuuuaaaacguauacagcucuaaaguccugauuuaaccauauauuuguguaauguauacacccuuaaaauuuuuuuuuguaaguuucguaguaaaauaacugcuucauaugacugguuuaauuguaucuuccaaaaagacuuuccaagcauuuaccguaacaaggcuuuuuuuguuggcaggcccuuuaacaaagggucaagcagucggcccuuuaacaaaaggucaagcagucggcccuuuaaaugaccuuaaauuaaagccuugcagacaagcagauuuaccagcauuauagauaaguauuucaggaaguauuuacuuuacuaaauaugacuguauauuuguccuauaaaaaguaaaucuucaaaagauuuuaaaaauuacaguauuuugguugauaggagauaagaauguuauuaaaacuuucuuaaaacauuugguaauacauuaaugaaaugaccacaacuuuaaacgaccacuuauccucauaaauauggauuuuugccuucaccaggugauuacauuauaaagcugugcuuucacagaagacaaaauaaaguuguaugauuuauauugaagucaaauguguugugagauuacauuuggaaagauuauauuggaaaaauucuaauaguuuuucagacuacgugagagacuuaagugaccauguguaauagaaaaguuccacugaaaguuaaaaucuguaacagcaugacccagccuguacauuugggucaaguaucuuuugagauagcugcagaguuuccuuuacaaugcugucuuucaguuuucuauagcuuuaugcguauugaucauccucaguaagggcccuuuucuuucccccaucccuuccaccccuuuauaguguuuuauuuaggggauuaauuuaggcaaaacuaugcccacaaaucuauggguuuccuuuccuauggguuacuggcaacuaaaaauauaaauguacauucuuaucagacagaaaauguuauuaaugauauuauucagugauuaacauagaugcccaauugaaagcuuucugguaaaauuuaauaaauuuaacaggauauuuuuaaugaagugauuuuugccauuauuaaaucuuccuaccuccaguuuucuuccgugcccauauacaggugagcaauagggaccacugcugcauaggauacauuguuauucgguuacauaaagcacauaauaaaauuuaauucuugccauuauguugucuauuuucaaaauuggggguaguagagacagaugaagauuuagauauagaaauggaauucugucuuaagcacuuaaaugaucgguauggauuguuacugauccagccacccaugcuauaagucuagaaacucagccaggcaugguggcucaugccuguaaucccagcauuuugggaggccgagguaggcagaucacgaggucagagaucgagaccauccuggcuaacacagugaaaccccgucucuacuaaaaauacaaaaaaaaaaaaauuagccaggcgugguggcacgugccuguaaucccaccuacucgggaggcugaggcaggagaauugcuugaacccaggagguggagguuguagugagcugagaucgcaccacugcacuccagccugggcggcagagcgggacuccgucucaaaauaaauaaauaaauaaauaaaauaaaauaaaauaagaaacucauauacauggauguggaccaaacaauauaacucaaaugccuuucuacaggacuacaaagcugucuguaucagguuaugguguuaaaucauaauuucuggaucaugaucuuaaaccuuuaauugguuccauuucuacuuuacucuuuacuaacaaguauccugauggccugaaaauccauguugaaauuugaaguuugaauuuuccagaucaaauaugaaauuuauuuucauuuuuuaaaguacaaaauaucaguuguauaaucaugguaaaacauaaaauuuugcuauaaaagauuuuuaaaggcuauuugauuaaaacauuuauuuacuuaaacucuuugcuagaauuuuuuuuagaauucagcaucggaggaggaaugugacauaauaaugaucgaaagccgaaaguuuaaaaguugugaugcccucacaugguuggaggguuauucuagcuucuaaggacugaauguuguccacaagagugucaucaggucauaaauugguaagacuuaauggcuuagauuuuauguauuauaccugauguuauuguauugagaugaauauuuaugaacaaaaugagcacauuguguaagaguauaguauuaaauauaaguuaaaacuuggaauuuuaaauacuuggaguauguaagccuuucgaagucucuugaggcugaaggccguaucuuugcagugguguuuaguaaauacaucaguuuaaaaaaagaaagugaaauccuguauuauaguaagauuauuaaaauauugcuauugcaucugcuguagaugccuacaauauagugaagaacccaaauacuuuuuagguguuauaccaggagauauuugagaaauaauauauucaucuuuucuuuaaaaaaaauccauuuucuuaauaacauacagcuuaauuuuauugcuuuggagauuuuauuucuuaauaaaagacauguuuccucuaaaugucuaaaauaaagccaagaaaauuuuuucaauucuuacauugagaauaccuaagaugccaauaucauaugaaaaugauauauuagaagucauugcacauuuuuuauauuccccgaaaauuaauuuucucucaguauucugcuuagaaaaaaacuacuuuguuuugugcaguuucuuauuuugcuuuguuuuacacagcuguauuuuguagggggaccauuggaaggauagaguuuagcucaggauaagaccuuauaucuuuuaaucucaagauuauaguauuuugcagaugaagaaaaggagucuggauuauuuguccaaggugauauaauuguagaauucauauuuucauuaaagugugguaugcauauccugcaugucagucaagaauuauuugaaauuauuuauuuuccaaaaaagccagaaggcauggguugauaucagcuaaacaggccacuauauauauuccaacuuuauccuuaaccagagauauguuauuuuauccuuugcccauucugccuuuugaauaauauucuaaauuguuucugauauaguauuccaugacuucauuacauucuguaagcuuaagucccuuaagccaguaauugcaaucaauaguagucuggaaggaaauacaacaaacuaauuaaguuaucucuuauuccguauacuuuucuauuuucuuuauuuucuauaaucuacauaacuuugauaaucaggaaaauaacuucuaauuucucuaguauaggauauccauauguaguagucaguggcugggguucaggagaucacgaaccaugugagauuuuggguagaauuuuuuuauguucacuuuucugugaaagguucagagcauuugucagauuuuuuuuucagagcauuugucagauuuucaucugucaaaaacaguuaagaaacauugcuagugaauguuuugugucaaaaggacaauccuuguuagacaccuaaguaugagucgugaaagaaauuucuaaugagaacauuggucauaugacuucuacugauguuuauucaaugcuggguuacuauaaaugcccauuagacugaugggacaaaucagagccaagccacauuuaguuuaggaauuucguacugucagucucugugcucaaaggucaauuggauuuuucugcagaguagucguguuuuggcuauugagugucaggcacugugcugaauauuuuuggcacauuaucucauuuaauuuucacaaagucauauauuaauagauauuaucaauauccucaguuuacagagaagaaaauugaaagcuuagggaaguuaaguaacuugcucaagucgcauagccauugagugguggagcuagaauucaaaucuuauuacugacuggaaccuggguaucaguaugcugguauccucugaaaauuugaaggauaagauaaaggagaauuuuacauuguaugaagaugugaauucauaaauuugauuuaucuugaacuuaaguagcaaugggucauccuccauuacaaaacuaucuuuuauuauuugccaaaaaauaaauguuggagguugcuuacuaucuaaaaguuaaguauuaauugcauuaaaaaauaaauucuuuuucagguuuaauacuuaugaauauaagcaaauauauguguauuuuuuuuuuuagaaaagucuuaguacuuauuagaauaguauuauuaaggaacucacccuuuaauauuuaggauuuauaaacagcaaacacuaggaagcauuaauuuaaaaagcagcuuugaacugcagauauuucuugggauagugggauauauugcauguaaaacccuuauuaaaugcuaugugagaguuuuccauuugccuuuaguugcgaauaauucugagaaaccuccuuuuuugcccacuuuuaaagcauuuaucaggcaaaauuaauuuuuugggauacaugaaguuuuuugguuuuguuuuccuuuguacuuugucauauccuuuuuguugguuuaauuuuacucuccaaugagcuccacaucuuauaaccuuuucccuguuuuuaaguauuaauaauaaaagguugaaucugcaauaauaguacugcuuaaaaccauaagaauuuguuugcuccugagugauguugaaauagucugcagagcuaguauaaacuguuucuuuagcaccacgauuaaaaaugcacaaacaacgugauaggucaucagaauaugagaauucuaucuaaaagucuuuuuauauauauauuaaaaaauauauauauaauacauauaaacauauaaaauacauuuguaccccaacuucuguaguaguaguauguuugccuuuucaaaauucaaacugggaaguuuggaaaauagaauaagaauaaucauacuuaauccaaguuuuuaacacaauuaccaucuuaguguuugcauauucccagacuuggaauacauauauauuaauaguugcaaucaugguagauaaguagauuuucaauaguuuuuaaacuguguaguuaaaacuaaagcuaauacugauaugugauacguuuuuaauuuugaacugauauuugauauuuugacaucugugauagcauucccuccuguuuuuccuucuaccuugcugguuguugcuucucagaccauuuggcaggcuuucccuucugucugcucuuuuaaauauuauuggaggccgggcaugguggcucaugucuauaaucccagcacuuuaggaggcugaggugggcagaugacuugagcccaggaguucaagaccagccuggacaacauagggagaccccgucucuacauaaauaauuugcugggugugguggugcacaccuguggucucagcuacuugggaggcugagguggaaggauugcuugggccugagaggucaagggugcagugagccaugaucgcaccacuccacuccagccugggcaacagagugagacucagucucaaucaaucaaucagucaauaaauagagucaucagaaugcugucuucuuacauucuucaucgugguaagagcuuauagauggcuuccaugcacauaucaucuuuaugcuauaggaagucaccuguaugcucuaaggugcucaaacccauuacuuccagccuaggcaucucuccuuacauucaaacuuaccugaucucucauagcugguuaaucacaaaguacugccauaucugccuccucaguguuuugccagccuauccaucucuuguccucauucaguguacuauccuuucuuaugugaaaaugcaacaaccuucugacuaguccuugucguuuaaguuuucuaauguggccaacugcaccuacuguucuuuuuacuuggaacauuuuuuuguaccuaucuuuuuuuucuccacccaacuguggcauuuccucuacuaauucuuuccugauccaagagcuaugugcccccagaacacccucuaaaaucuugcucugucuuagcacuuaucacacuuaacaucuuauauaucuccugcacuaauuguaaacucacaaacucuggaauuauguuuauuugacguuguauccccagggucugagaaauguuuaaguucauuacaaccccuuuggaauguggcaucacaaaauuuggugucugaaaauaauguuagagauuauuguauacaauuagagacaagacucaaauguaggaaccacauuaccuaacuccuaagucaguguuucuuguguauuucaugacauuuagauuuugaccacuauaaauuauuacggcaaguuauuagguaacauaguaaguguuuaccauaugccagauacuaaugcauuaucucacugaaucucaguacccgguccuauuauuguccuuuggggaggcuaaauauuagcuugucuaaagucauaucucgguuuuggugcaguggcucaagccuguaaucccagcacuuugagaguccaaggcaggaggauugcuucaggccaggaguuuaggagcagcuugaguaacccugucucuaccugcaaaaaagaaaaauuagcuagacaugauggcacaugccuguaaucccacugaggcagaaggaucacuugagcccaggaguuuaaggcagcagagagcuaugauggcgccauugcauuccaaccuggaagacagcaagacuauguguuauaaaauaaggugagagaugggauucaaaccuggguauaacuccagaaccaaugcccuuuuauuuaauaucacaucucagaauuuaucuucugaguuuugaauuauaaaacugaguuagaagggaauuuaauggucauuuauucuaaccaccuauccuauacuuggaucaugucuacaguguuccuuucaaguugucauccagccucugaauaccuccagugaugucuuacuuuugcauccuggucucuuuuuguauuuauaaaccucucauaaacccuuucuguaaaauagggaaucuuaaaaugugaagcagaaaaaucagaugauugccaucacuugaagcauauauaagcagcacuaaaaagucuguggagacauugaacuggguacauccucuagauauuucuguauuuucauagcugcuauaaucaagaaugugguuuccaguucauggccguaagucacugguuuuaguacauagucauaaaguucuuuuucaaaaauggauaaggagacauugcuuaauaacuuagagaucacaaggacguuucucuacuuauugauucuagugaugauacaaggacuucaugggaaaccuuuauaugugaccugauccucaauguaaaaagagugaaauaaaugugaaugacuucagacuccuggaucuaguuuacauauaacuugcacuuauucaugagucaugcuuaaaggcaugguaguuugaauugucuuuuuuaucugaccaaaagcauuuaggauuuuuaauucacccuuuagacuuaauuuugauucaguagagagugagauuagucagcugagagaacacauagauacuuaugaggcaugauuauacaaucaagcuuuucaccagauuuacaaaugguuucuccuuaaauccaugauucuaauguaaaaaagucucugucaagguuuuuaucuuaagaucauuaaguuuuuaacauccacuuuauuauccaugaagucuucuaugauuuagucaucaccaugaucaguauauggaguuaccaaguuucacuggccauggcagcaguaaccuggaaauucauagagccuagcccuuuucuguuacucaaacuugaacccguuuuucuauuuacaucaguugccuauauuacauagaaacuggcgcacuuuccuucuuucucaguagguaacaaccagaugcaaggaacaucaaaaaccuaccuuuauuggggagaaaaaaauucucgaggucugcccauauuuuacuguguuccagcgauacccuuaauuaguuucuaauaguuuaaauaguugguuaauuucuuagaucuuuguccuggcaugaugagcucaauauaacaucuguuuauaccaaacuuauaaaauauaauuagauaauauauuguaaguuguauucugucuuuuucuucaaguaauauguuuacuaucaauuauaugcagaguaguguuguaauaaguagacccuggagauggacaguuucugcuuuuaagguuuaauucaagagaaaggaacauuugauaaagacaaaaaaauuauggacgaaucagagaaguggagccuguuggcaagaaaggaagaaggcuaaggaaaauguagguggagcauuccaucucaagugacagucuuaucucuggaaucuaaaucgauuuaacaaauuucaggucaugauguaaguguagaauucaucauaaaagauuucacacaaacuauuguaaaauucugucauucaccaugucuaaauuauuagaauuauuaccuaaaagaauucaaggacaugaaucuagacugaaaugauaaaaacuuagauguuaaacuuuuugucucugaaaaugugccuacuugagugcaguuuugcuugagugaaaaaaaccuaaugacccuuuagauuuuauaguagugcuauuuuuuacuuuaugucagaaucccuuugaauaagguaauucuaaagcagugauucucagcuaggguaauaauuuguuuaaaagcaaacaacacguuauaccacuuuucuuauuugcuuuuaguaauauuuauuguugaauuuucauauaacacuacuaaaggaagaccugggauauuuuuaaauacucuuuuuggaaauuuuuauuugaauuaaauuaguuauauuucagugggcuuuggaaaaauuucccacaguaaguuaagauuauuuuacucuaaauaaugaaacaucgagaucccaaagaagauccguaagaauguuauuaauguccaguccacgggaauccuguguuuaauaugccuuguacaggagaaucgcuugaacccaggaggcggagguugcacugagcagagaucgcgccauugcacuccagccugggugacaagagcaagacucugucucaaaaauaauaauaauaauaauaauaauaauaauaauaauaauaauaagccuuguaaauguaaaucucaagucaaacaauuuuuauuaacauauacuuuguggcugcauuaaaucuuuaacauuuaauugaauacaaaaaaucaauuaaggaauaacuaggauuuuauuuugggugaaacauaaauauaaaaccuguuucuuaauacuaaucauaauugauuuuuauucauguuucacugccuugggagauuaacucuuauuuaauuuucccaagauacacugggaaaguagaccuuauaaagugucaaaguccaaauugauccaaaugauaaaaggaacuaauuggguuguuguguguacuguuguaaacagucucacauaauccuuauagccguccuuuaagauauguacaacuguaucccauuuuauaguugaggaaacuaguuucaguauguuaacuugcuaggaucaccccacuaguaagugguuggaguuuggauuaaaagucagcuagccucacgccuguaauuccagcacuuugggaggccgagacagguggaugacaaggucaggaguucgagaccagccuggccaacacagugaaaccccauuucuacuaaaaauacaaaaaguagcugggcaugguggugcacaccuguagucccagcuacucgggaggcugaggcaggagaaucgcuugaaccugggagguggagguuguggugagcugagauugugccacugcacuccagccugggcaacagaucgagacuccaucucaaaaaaaaaaaaaaaaaaaaaucagcuagucuaauucuaaagucuaugcuuuuaagccauuuuauuauucugugugaauucaacuuuuugcuuagacaacugcugagugagaaacugucuuaccccucagaaugucugaccccagaaugaaguggagaagaaaaaauacuuuagacaagagauaauaaacugaaacguagacaacuuuaauucuucagggccuguauuuagaguguugccuuuauauuuguugaaagugaaaaauguaauccuuggcuggguacgguggcacacgccuauaaucccaacauuuugggaggccaaggcaggaggaucacuugagcccaggaguuugaaaccagcaugggcaacagagugagaucugucuuuacaaacaagucaaaacauuuuuaaaaagaaagauguaauucuuugcucaaacccaagccacuauaauuuuaaaaaacauuccaaauggaaaacauucauugauuuauuaaaaauaaagacuaggcuuuccccccacccccaauaugauauauucuguucauuucauuaaggaaugauggccaugcuugugcucucccuuuagucuaaaucagaaucaagcaacugucucuuuaaaaaccccaugauauucuucugaguuuagcccuauuuugaaacggucccuugacaaccuuuauuuauuacuguacuuggacuuuaggagacagauuaggaaggagacuugguagcaaagaaaaauuaguuaauaacuuuggagcaaauucuagucacgaaaucccagugacuagccuaauauaauuuuacuuugucaaauauauuguucauagaauuaugcuuuuucuagaaagcuauuuuaacuaacauuucugcacuuucaagaaauaggcauaaagaaaagaaauaggcaaaaugaaaagaugagcaaaaauuaugugcuuuucacugguauuuggcuuuugguauauacauauaccaaaggggauagucucauuuuuacuuuagucaggccucacuguagaaaugggauugagaagauauuuaaacaaggcgucuaaacaagaaugacuuuaauaaaaagaaauaauauguugaaugcuugagaaagaggaggcaaaugugaggccauuagaugaaaagaauaaguagcauuccuaagaauaguuucuucccaagcccaucuuuuuccaugacucuuuacauguuaguguucuccaguguuuuggccccacuugucuuuucauuguuuaugcaaguuuguuuucuccuaugguuugagucgccuacugcauucuuacaacuuucaaaucuagacuucuaggccagagauuacucuggaguucucaauaccuauauccagcagccuucucucuauauuucuccaacaggauucuacauuuccaugucuccaaauucaguagucccaagugaaacuuaaauuucuuuucucgucuuuauuugcagugcuuuauuugcaccaccuacuccccaccccacuucauccccccaccaaaucuagccaccuuucugugauacaccagccaacuccuaguugcuccaagaauaaagccccaggcauccuuagcauuuucuuugucacagauagucucuuuuccuuaucaucucacugaucucucaagauucuguaugcuucaauugaaacuugaaauauguucuaaucccucucacccuguuuuuccucugagguaccaguguacaucuaagucuagguaacugucagucuuacacuauuuuuccagucaccaagaaauaauuuaaaguagcagguauuauagugucgaguuuuuaauuugggcuuacaucccuugguauguauuauucacuccucaauaaugugcugucaucagauuagguaguugcugcuauguaaacaguaaaaugaaaucucuuucaagagagccugcucuaaauguuaaguacuucaauaucaaggaaaaugccacccuccucauaccccuuucuccuguccuuucuuaggucuuacucagaggaaggaaauaaucuuuucaaccuguuaaacuuugccuauuguuagucuauuaagaaauaaugauuucaucuaauaagaaauaaugcuacguaggaugacugcuuccuguaauccuagcuacucaggaggccaaggugggaggauugcuuuagccuaggaguuagagaccaaccugggcaacagggugaggcccuguugcuaacaacaaauuuuaaaaaucagcugggaaugguggugcacaccuguaguuccagcugcuugggugacugcgacugaagcaggaggauugcuugagcccaggaguuugaggcugcagugaaccaugaucaugccacugcacuccagccugggcaucacaagaccccaucucuauaaaaacaacaacuagcuagcacacaaagucaaguaucuuaaauaaauguaauuccauauuauuauaacauuuaaguauuaacuugaaauaggauauuaauuaaacuuuguuuggaauauuuggacuguaauagugaaauugcugugcaaauuuuacuuuuguaucagucuucaauuucuccagacuaaauucuuaucucuuccauuuugaauguuuuaauagauuuuuaguucagcuaguuuuaaaacgaaguuucuuuaaaauggcucuacaagaaaaaaguaauuuuaucagaauuuuacuaccaaauauuaaaaugauccccccaaaauaucauaacuuggaaaugugaaagagaucuggaaaaagaagauaauguuaauuuuaaucuuguauauauauauauauauauaauuaggggauaaauuuuuaauguaacauuuuuauuguguaaguuuacaugacuuuuuguauuauagaucuuuaccacaaauuuuuaccauuugcuuaccagauuuacuuugaauaaacagaaaucgcuguacugggagcuauaaacauaauuuacaucacauucucagaugguuauaauucacucuaaaccaagaaacaggauuuuuacaaaucacaaauaucacuuauguugaucauuguuuuguuuguugaauauaguaccuuaucuugcagaaugaaauaguugcuagagaaaauagaguuggcaccucuucccuccuuucucccuuuccuauuuucugucauugcuuuuccugucugccauuuguucaugucuggaguuuacacuguaaaagauaacuccuucaugagucauuuucauuuuggaacauguuuuucauuguucuucaaaauguaguagaaguacucuugcuucuaucucuguccugcaucugccugccuucccaaacagccacuuucuuaauguguguauauccuucuuuauguguauauaagcaaaucaauguauauuaucuucuuuaauguaaauuauaauguauugugcacacaucuguaccuuuacuuuuaaagaucuccagaauacauuguucccaucucaguacuagaaaaguaucuuugugguuuuuuaauagaugcauacuauuuaauugaauggauggcuacaccaugauucauuuaaccagaagcauugcuguuauaaacaguguuguaaugaguagccuuguuaacauuauuugcuauguauauaaaauaucuagaggauaaauuccaagaugaaugauugcuggcucagagagugaauaauuaaggggaggucgggagaggagagaaaaggagagaaaucuguuuuggaaaauaguauuacauuauaguuuuaauuuguauuuuuauuuuaugauucagauguugaguauuuuuucaugucuuucuuguuaauguucagugugaauucuccccauuuuucuauugggcaucuggucuuaacagauuuuaggaaaauuuauuagagacuuuuuaacuuuaaaaaaaaauuagacaugcaguuacauaguccuuucccaccaaaguauuaaagaaauucuaauuaaauguguuuauuuaaaguucuuaguacagaugauaagacugacucuagacaaagggggucuaagguaggagauggacuucauauagauugcaugcucuuuaaucuacgcuuuacuggcuagccauuugacugaaauuaacaagauaaauauaaaauaugcugagggcauuggugaacaagguuuuuguagaagaugcugacaauaaauaucaauauauaaauauuuaacugaguuuuuaauaguuccuugguaaaggcauucaucacaccauugcgggacuggcuacuugagaaaaaguaacacuuaaguuuuguaaguagaaauuuuaccugcuugcucaggaugaauaauagcuuuaaaauaacuuauuuuguguuacugcuaauaauaaucucuauggggcauuuuggguuuuuuuuuaaucaugaaauuaaacauuauuuguuuuacauugguagaacugauggucaauaauuagaauaacauaacauuuugaguucuuaguuuaauuuauuauuaacuucacccaaguuuuauucuuaaccauagagguuugcauucagccagagguugucuauaugaauuuuauuuauuuaggcccuuuugaaaggaaaauuguuauuuguucuuaaauuaagcuguaaauauuuuuuagucuccucuuacagaagagugguggauuuuuaaaauuauauuuaaccucacaaguuuacugaacuguagauugauuagauuuauuccuuuguaaucagugacucgcauuuucuuaauuuucuuucuaaaaaaauaaaacaugcauuuguuagagaauaggcaaaauguuacccagguuagaauuaaugcauuuuaguaguaaugauguuauuacagugcuuauuuugggagaugggaguggguggaauaaaaguuauagaugauuuacuggaaacaguguaugauuccuuaggacugcccccaaagaaagguauagcuuccuucuacuugugaguuucugaagaaucaguuuuaguugguuugggcaagggggugugagcaugaaguaugccaaauuuaccaacuuaaaggaguuuguauuacaaaagauuugauuguguaauuuggagaguuccuguagugcauuuauaguugugauuguaacucaaugcaaaguuagaggagucuuugaguaaagcaaggcauuuauuuuauuuauuuauuuuuugcaguauuuuaauuaaagauacauaaaauuuuuaaggcaucuucagcuuucuaacaaaccagaagaacauuuucguucuuagcaauuagguaaacuguaucagcuauaaaaagaucacuaagcaagugccuuuucuaagagguucccucccuuauucucagagcugaaccucuucuaggaauuugccagauaagauaaauggcauauucugagcaugguuuaaucuuuggauccaugcuuaugguuucacaacuuaacauuugguacuuaguuaaagcacucuuaauaauacacauaauucuggauuuauuucaggucauuagagauuauuuuuucacagucuuaguauuauggaagaaaauauguguguuuugacauuagguccagguuugaauccuguuccuaguauugugucuuugagcaaguuacuugaccucacuuuccucaacuguaaaaugagaauguugcucaggcuuauuguaaggacucauuaagauaaaggugugccugcccuaaaauagacaaccauuaaguguucuuuuccucuaucuuguugauuuguuaauuagcauuuauaucuagggaaagacaaaguagucaaaauauguccauuuugaaaaagagaaguaguucucuuauuuuuuuuagagacagaucuggcucugucacccaggcuggagugcaguaaugaacccugagcuccugggcucaagcagucuucccacacagccuccugaguaacuaggaccgugggcuugcuuucuuuucucuuuucuuucuuuucuuucauggguucucacuauguugcccaggcugaauuuuuuuauuuuaaauaaguagucaccaugucucuguccacauuacuacagauaaagaaaaaaguugguuucucauaguuuuuuaaaaauagagaucaaggcugggcgugguggcucacgccuguaaucccagcacuuugggaggcgaaggcaggcagaucaucugaggucgggaguucgagaccagccugaccaacauagagaaaccccgucuccacuaaaaauacaaaauuagcagggcaugguggcacauaccuguaaucccagcuacucgggaggccgaggcaggagacucgcuugaacccgggaggaagaaguugcggugagcugagaucgcgccauuucaccccagccugggcaacgagagugaaacucugucucaaaaaaaaaaaagagagagagauuaaauuagauuaccuuuuucuuuagugauuuuaacuugugacagaguuggaaauucuucauccauccucuugcuuucucaguaauguugcaaguaaucucaugguaagaguaaggaaaccuaggaggaaaagcugugguggagagccaguuaggaucaauuaaaagaugaacagcauggaaagccaaccugccuuacuguagcauugauacucugaguuauacuuuuucugugaguguaaguauaauuagcuuuaaacacugaauucaagcucauuuaguuauuuuggagcagcaauuccaguaaauaaauauuuucuuguaggucuuucuuacuuuccacagcucuauauuucuguucauucucuccauauccacaauuuuuaaugcaucuguaaaugcuaauaaauguuugauuuuuauucuaagaaugauucauaguaaauagaaaguuuauuuuuaaaaauuaucuuuugacuuuauuuagcauuuccaguuuaccauaauaguuuaaaaaagaaaauucugaacucauuuuucccucaugcuucuguagcaguaauuguaacacuugauuuaaaauugacuuauuucaguuugaguauguaucuauacauacacacuaaucugaaauauuuauacuaccaccauuguaggguaccggguauauauacuuugugcuggaaguaaagacaggaagccuuuucuuagggagcuuaaguuuggaaacugguuaaaccaucaaaauauaaugugcugaauauaauaauuaaaaagaaaacaagguauauaguauuauaacauuaggugaaggaaggaaauuauugauucugcuucaguugaucuuucucauuuuaaaagagucaaaucucacuaugauaacuuugaacauaauagaaaacaucuugauacccucauugaaacaguauuuuuaaaccauauucugggaucuugaaauaaaauagucucuuauuugcuuaagacuaccauauugguaucuccaucguaaauauggcuaaagcagugguucucauacuuuaguuucuaucugaaucgccuagagaguuuguuaaaauagauuacggggccccgccccaagaguaaaucugggguggguccaaauauuuacauuucuaacaaggucuugguggguccaaauauuuacauuucugacaaguuuccaggugaugcugaugauucugguucagggacuacacuuugagaacugauuuaucugaacucaaaaaauuuuaaugccuuccucauaugaaccauuaauuguuucaaaucuaucauaucuaauuacuaucaguaugcauugaguuacuaugugcuaagcacugaauucacuuauucacaaagaugaagaaguuauggaaccuuucucaaagagcucaaucuaauaggaucaacagugguaguauuacaauacucaaaguaaucacugucuguauugagugcucagugugccaaguacuaugcauuauguaaacucauuuaauccucacaauuggcauauaauccuuauuuuaaaugaaaaaacugaggucuagaaagguuaaauaauuucccagaauucauauagugaguauauggaggagccagaauuugcuauucugccuuuuugcacuauaaaaaguuugcgaagauugguagaccccagaaaggauggaguaauuggcucuaccuuagaaaaucaaacagcaucacagaagagauggcacuggagcaucuuaagggacaggucuaagauagccagaugaauuggaacugugagcauuuccagcugagggagcaguuucugcaaagccaaggaaacccgagagaacauauguuccacagacuacaaauaguuguauaagaccauaacacaauaggcagauggaguauaagaggaaaacagacuguauaaggcagaggucaaagucauaaagaauuuuauaugccaggcuaaaaaguuuuaaaaauagaauuaggcuucuuaauuuuuccuccuauaacuuucauuuguaagccagcaguucucaaagcauagucagacaguagauuccacaucaucugggaacuuguuagaaaugcagauuccugguuccaugccuacugaaucagaaacucugagugggggagcccagcaaccugaguuuuaacaagaccuccagaugauucuggugcaugcuaaaguuugagaccccugcaguagguuauagaauucuugaauaauagccuucaagauaguuaaaggucacuauagugguaguaauuauauuugacacugauuuauucuauuagaguacaacaccuaacaguugaaauauuaacaccauuuaagggauacaucuucaucaugaucuauuuauaccuugcaaaccuguuucuucuguugucauaaaagagaucuuaggacaagaguuuguuaggucagcauucaaagaauagcaugcuaacuauucuuccuuagcuaugggaaucauucuaaaacucgcugacugauuuuaauuaucaaaaaaaaaccccaguaauuuuuguuuuuuuuacugcuuguuaauacauaaaacugauguuguaguuaguauuuaaggugugcuauuuaaaccaaauguguugaaggaaucaaaugauuuaagucaugacaugacuuaaaaguaauucaaucuuuccuugucaugucaauaaaaauauagaaaguauaaucugggauucccaagcaaacuaauuuaaaugccugucaccgucuuuuuugccaaaauguguucaguauuuguggugaauaugucugcaugguaucuggcacugaaguauauacuaaagcguuaugguugacuuagugguucuguaguuuauaguuacauauagucauacuuugcacagcucacuaaaagcauuuaaagcccagcacauauaaaguauuuguuaaugauccauaaauccuuucuagauauuagauauacaaaaccucuuuucaucuuagaaauaguagcagcaagaagugaagguaguaugcuguaauuaaugugguuaaugcucaaauaaacaaacguaguuucccauguaaugauucaagauuucaaggauuuagaaguggaaaguccauugaggcauugacaucaaccccuuguuuuacagauggggaaacucagauccagggaaguuaaauaggugauuugcugaugucccauaggaagugaauagcaggauaucacaggacaggauauuucugagccucaaucugauacaacauuauggguccacaccaucuaaaguaaaguaguuuccagguauuuuagcacuaaaaucuuagguggaguauacuuuaugaagaauauuuaguaacauauaaaaaauuaucuuuucguauugauacaauaagcuacaguaucagauuuuucuuuacaagaguaauuuuuaaaaaccuaauaacuguuuuuagaaauaaaauucauuaaaaaacaauaaaaggguauaaauuccagcuauucuuacuacuuaauacaugguagaauauaaaccaccaaagaggacaauuagccuucuguguuauuaucauacaauugcuaaggugauauuugaacuuggaaugugcuuacaggcuggauaacuuuucaguuauucccaagaagaacugaucuaaaccacacauaccuuauaggugauuuuugccagcaaguaaccuacagucaaauacauguaggucugccagaauguuguuucuuuuuguuuuuuuuuuuuuuguuuuuuuuugagauggaguuuugcucuuguugcccaggcuggauugcaauggcgugaucucggcucacugcagccucugccuccuggguucaagugauucucuugccucagccuccugaguagcugauuacaggcacccgccccaagccuggcuaauuuuuuuuguauuuuuaguagagauggguuuucaccacguuggccaggcugaucuggaacuccugaccucaagugauccaccuuccuuggccucccaaagugcugggauuacaagcgugagccaccacgcccggcugaauguugaguuucuuguuaaccaauccuacccaaagacuuucugaaccauuuuuagaagccauuaaguuuuuuuuaaaaaacuagauguuaaaguauaaaacuuauaccagaaaagucuuacuaagaggagggacuagaaaaaaaaaagucaagccaucaucugaauuuuacuacaauaaguaauuauuggaauuucuacaugaaaggcaauuagaauguauaguugguuaauguagaaauuuaagagauacggagaagacacugcccauuuaaaauguauccuuuuaaaaccacugaacagagaaauucuuaauacaauugagaguuaguuuuaaaguagcauacauguauuacaggcaaauuagaaauguuggcacuacaaaggaccuguagaaaucaucuauuuacugagacuuucauuuuagaaaugagagcuuugaguacugaaauugucagaacagaauaagcuauuuuaaauuacuguauauuugguuuuaagugaaacacaaaugucuuuuacauucuuuuaagaguuggaagggagguuaaauuuuuuagaauaauaacauauucuaauuuuuuccagugcaucugggggagguguuguagccauugacaacaaaauagaacaagcaaugguaaguaaaaguuuacaguucucccauuucauagauuguugguuguauggaacacuuagcuuuugucaguuuuagaaaacaaauaaguuauuuaaaccaaagaugaccaaaucauguuuuuugauaaugagauuuaguugaagaugcuagaacguugagaacuuuuagucuagaaauacuauuuaaguagauauuucuuccauuugaauaucucacauuucaugcauuaucauugauaagggccauuggugagggggcauacauauuuaaagacaauauguuccccagauauuucagcauugaaaauacuuuagagugaaaaagaguauuaaagcaaaaacagcuggaggucugauugaaguagacuguaaguaagcuauaaguaggccaggcacaguggauugugucuguaaucccagcaccugagcugaggugggaggaucacuugaggccaggaguuugagaccaacuugggcaacauagcaagaccccgucucuacaaaaaaaguugguauuuuuguuuguuuugagauagucucgcucugucacccaggcugaaguacaguggcaugauuuugggucacugcaaccuccaccucccagguucaagugauucuccugccucagucuccugaguaguugggagcacaggcacacaccaccacaucuggcuaauuuuuguauucuuaguagagacgggguuucaccauguuggccaagguggucucaaacuccugaccucaggugaucuacacgccucagccucccaaagugcugggauuaccggugugagaccuuacaggacuguuagucucaaacuauuuuuuuaaaaauaccaaaauuuuaaaguccaaaauuacagaucacuuuaaagcaguacuaugacuaguuuaacaucaaacagcuuuccguuggaauauuguuccuuuguucucuuuaucuaccauuuuaagcaugugauuuuaaacuuuuuuuuuuuuuaauucuaagcuuaguugacaauuuaagaagcuaguauuuuuuggaaaucgucccaaacuuugaaaagaaaauucugggcuuacugcucugguugggaacuggauuuuuuccaacccaucuuccauaggcucggucaagauaaagcagaaacauuaaaagcaagagcaggaaaacuaguauaaaaacuuagcaccaaguaggccagaaccagauagcaccaccuuuaucuuuucacucuuuugacauuccuaauuuuguuuuucacaggaucuggugaaaagccauuugauguaugcaguaagagaagaaguggaaguuuuaaaggaacaaauaaaagaauuaguugaaagaaacucuuuacuugaacgagaaaaugcacuguuaaaaucucuuucaagcaaugaucaauuaucccaacucccaacccaacaggccaauccugguagcacuucucaacagcaagcagugauagcacagccuccgcagccaacgcaaccuccacagcagccgaaugucuccucagcauaaagcuuucuuaagccucauuaagaaaaaaacugaaagcaaucuauccuugugugccacugguguucuuuccacuuuauacgaaagcaaguagccaugcuuugguuguguguuuggccuuuucaguauuagacaaucauucuacaagagcuuuuccucucucugagaugucaugcagcgcuguugauguccaguucuaugucaucaguacacaaggagaauaauagaugggguuuauuaaagcgagcaaagucugcauuuuaccuggugcgcaugaguggggucuuuaagaguuuugguggcucucccauguuuccuauuacccauggauuuacccugagccuuccuaucacauuauaaauaacaguucaucuaaagagccacuuuucuuucugauucaguaacauuugccuacauaaguuuucauuuauuuguguuuuauuuauuacagggcugcuauuuucauaauguacaugaacaaugucacagaacuuuuuuaauuuuuuugaauaauuauaaguaucaguaaaggaagugaaagacaggauugcauuuaauagauaaaacguuuaggcaauaauugaacaaaagaauccuggcauauuucuaacacuaauggcaauuuacuuaugguauuuauuuucaguaguaaagacccagcuugaauguaaauuuuguauaguguaaguaugaagaacauagugcaacuguacagguagucaccaguuauugugauaugauaaauaauugggcuauuuugaugaagaaaacuuuguucauuuguuucuacuuucuaagagaaauugccacgauuccucugcuuuucaacauuucguaugacuuuuuuuucgggugggaauaaaaagcugugaaauuguucaaccuacuuuguaaccaaagaagcaaagcuguguaauggaguuugguuuuuuuuuguuguuuuuuuuuuuuugucuuuuuuuuuuuuuauaaugcacauucuuuauguauuuuuauuuaguguuuucucagucacaauuuucuuuacugucuagcaugaucugcaugaccuauaaucuuugaaccacuuucguaccucauguuuuuauccagcacucuuauuguaauauguacuagucugugaacaaugucaaauaaaagagaacgaacagguaguuugguggagcugagcuaguguacaauacacuaguuguaaaaaaaaaaaaaaaaaaaagugagccaucuuuuguucauuuaaaaugguguuuugaauuucguaugcagaaaacguuuuguuacauugcagauuuuaauguauuuaauaaaugcaacaugcagauuaagugcaguguauacugaguauuuaaauuaaaauguacauuucauaaauacaguuucaaaagaaagcaucauuuuguguauacuaacacauuaaguguaugucagaaauugauguauaaauauauauuuuaacauuuucugaaauuaaacugcaguuuuguugaaauauuuggcucuauauguguucaaaauuugacuagauuuguauuuucacaguucaaaauacuccuuaaagaccuguuaauaaugacuuacugauaguucuuaaauuuucaaaguaaaacaauuuaaagaaugcaaaaauagugagcaauauuuguacucaauauucauauuauguuagugauacuuaaguaggaaauccuugucuaccaaaacuuuuacuugaauucagaaaggugccuguagaaauuaacaugcacugcaucuguagccagcuagcuaaucagaguuaaugagaaccaguaguuaguucuccguguuaaaagacuuauuugaaguaaaaauuuaaucagauuagccacaaacaaacaaggcauaaaauugggauguacaugagauugccaaauauuuucuauucuaguugugcugcaagacauugaacaaaauguuaaugaauaacauuauaaaucaaggaacuaaguacauaggcuugaguaagcaacccuaaggauguguaguaagauuccaaguagagcugcuacaggugagauacuuaauggaaugugaaacuucacuguuggacuguuaaccgaaaagguuugcuggcugugccccuccagugcuaacugugacaugugauauuuaauacagguggagaaaaacuagucuuagaaaugggauuuuugugaaaauagauuccauuuugauucuggggcuggaaaaacacuucauaaacaaaguaauagucuccaaggaaaugaauaauaagguuuaaaaugguaacagcaguuauuacuacuuuuauauuaagaaaaacaguagaaaaggagagaaaauauggguaguucacagaagagauaaauggcaguuucuaaagguucaaccucuaguaaccuaagaaaugcaaauuaauguuuuuggcgaauuguaauaaguguccuaaguagcaggacuuaacauagaaagaaagacaggcuuuccuguguacuuuuagaaaguaauuuggcaguauguaucuagagccuuaaauaauaagcuuuccaguguaacgacaggagaagauacucaacucaugguccauuguucaaaaaugcagaauuauuguggugucugcccucugcuuucccaucauccccuccccucaaaauccaaacuaucccuacugucaacccuucccccagcugauuguuuaggaucuuaaguaacuuccaauucagcuuuggagauuuagucuccugcuccaaauaguuguaaauauuaacugauugagaucccaauuuggaggcacagucuuacaggaaugccaucuaucuaauucugucaguguaaugcccauagagcaaggucccacauaagcuuuucuguuuuaauuuagccgguaaaucauaaguagaaauuuuucugauacgguaauugucuacaauucaaaccuaacuuuccccaaauaaaauuuaguuuguuccgaugugaucucacagcuugccacaccaaaaacaaauaguagggguuaggaggcauuaaauaaacaguuuccuuaacuccugauuguccaaaauagcugaauuuuuccaauucuauuuauaauauccuaugcuaauuagaaguauugagauaacguuuuauaaucaagccuccagugacuggggaucacagcugccauuauucacaagaauuuucacaggugaaugauuauauuucuccaaguugcaaacuccaguaauucauggaccuuuuuuuaaaaaaaaaaaaagucuuaauagaaccagaauaucucuguucuugaaaauuuaucuuugcagaaccagaaauagcuaauugucuggaaacaauuuuuaagauuugaagucacauuuuuaaaagaagcuuuauggcucaguggcaagcacuuugugacauuucuuuaauaauccuaugaaaaggacaaaacccagcccucaaaauugacaauuugaggacauaauaagccaacugauaaugcagugaggaauacuuguuacuauguacagucagggaugguuuugucaggguagguuuccucaaaaacaugacaccugagucuugaaggucauaagagccagagggaaggguguuccaagcacaagaaaagagaacucaauggcuuaaaaguauaaacaaggcuccuagggcagccacagaauugcauuggagacaggcaggcagugacuuccccacugaccuaguauuuuggcaucuauucagaaagcaagaaugauuuauugaaugguuuuaagcaaugggauacuaugcucaaauuaugcuggaugugcacaauuccaguggcagaugggagguagguuagaguagcugaaacuggaagcugagaaauaauuuaggagggaugacaauccggaaaauaaaugaaagggcaaaauuacauaggcaauuuugugaaggucaugaaggaaguuugucuugggucuuucuguaccauuuuccucuccacaaugaacaucccauucccagugucagguaucaggugccuauuuucuuuuuuucuuuuuucuuuuuuuuuuuuuuugagacagagucuugcugugcucaggcuggagugcaguggcaagaucucggcucacugcaaccuccgccucccagguucaagcgauucuccugccucagccuccugaguagcugggauuacaggcgugugccaccaugccaggcuaauuuuuguauuuuuaguagagacaggguuucaccauguuggccagguuggucuugaacuccugaccucaagucaucucccccgcccgccugggccucccaaaguguugggauuacaggcgugagccaccgcacccagcugccuauuuucuugucccuccaaaaaaagauuaaagagucccaacucauacuugaaaguuugacucggucuuuuccuuccaacaguuauaaaucugugaaaugaaagucuuuguuuccuuaaagggauuucaagaauuuaacaaaaggguuggggaauggaaccuuugcugucacuaugccugucucucaauucuacccuaaagguaaacuaaauggaauccuuuuauggugacuaggauuaggauguugauuccaaagccuuucccuaaaaucuauuccuugcucccuggaaaggauaauacagguucuggcccccacuguagguacugacagcccaaggcagaauagguuuugcuaggcuuuagccuuuuauucuuugacauaggucaguccugcaggcuucuuuuuucuaagucuccugccuauccaaaaccagaccuuuucucccaccuccuucugcuucaagccucuuaauaauccauauuucuauuuucuagcaauaguaauaguuuauuauuuagugauguauacuugcaccccauuuacuccuuuucaauauuucaggauacaucuuuguccuguauuucuguaccaguucacagaauuucuacagcaagaucccuuuaaauguauggcuuuccuucauagguugcaaggauuacuuuauacaagugcuacuguaacuauaucuuuuguggaguacaauugguaugacaugcuguguucauagaugaaaaugcuaagugaggcacucugaagcaaguuaaaguucacagacauucuugcuugcccaccacccccccgaaccccgccauggaaucaucaaauaagaaaaauaagacagauuuucagauuggugauggcaaaguaagacgcugguauuuugcacuggcgcaguccauuuaguuguugaauuuguucagcauaccuggauggugagugaguuagcuuuauuuuucauucucagcagggaaacugauagacuaggcaguuuggggaauuuucccauugucuacugucauggguccauaguauuuaaguuuacagacuacaacauuguccacagaagccauauuuauccccuuggagggaagggaaaggugugcuaacuuagaucauaaaaacaacugaauuuuaaaacaaggcaaaugccacaguucaacuucuccauaaaaaaguuaaguucaucucuccauucuuuugcaugccuacaauauuuccauauaacaacuguaaaauacucuugccugcugcaauccaaauguuauccggaucacaguucuugcugucauuucacaggcaugcaauguaucuauagauaggucauaucauaccugaggaagaucagagacagcaagggaacauuuuccccacacuugagauggaaauaauaacaggucaguggcuaauaaaaagaaacauguaugacuuuguaaaacccuaaaagugauguuuucaagaaauuuagguuucuuuuuuuuauuuuauaaaaaaaauguugacaugcaauuuaauucuauuucaauuuaggugcugcaaccuguacuggauguuuggggauagaaagaugaaugggacaugauuugugugcuccaaugagcucaguccaguguaaguguaaaaguuaaagugccauauuguuuauucagaguauauguuauaguuugugaaccuuauaucauuuguuaaaugaaagguuuuuauaaaucaacaguaauauugccaucccauguaaaaauccuuugauauugccaggaaacaacuuuaaaucaccagaaagcuuuaacaucaaauaauacuuuuagaaggaggggaaaagccuuccaccucgacaucgagccuaugaaguauucccuaaaaaagaggaacuaaucugagaaaaguuuacacauuuuuaauacucuaaguuguagauaaugaaauugauuuaaaucaaaguuaacuagaauaggauucaugugucaugaauuauauugucuauugucucauaagcaacaagugacacuuauuaucuuggcugacaaaaucagcuaccauuuaaugaaccaaguuaagaauaacucaggugacugauaccaaaaauaaaucucuaauacagcugagaauccagaaacacaaauaauauguugaguaaguaauaaaagugacauuucaaauuaguaaggaaaaaauggauuauucaacaaauaguaugggauagcauaacaauuuagaagaaauauaaaguuagaucuuucacaaaaauuaauucuagcuagacuagcaguuagucuucuacuuuuugguuacucccuuuuagaaauuggaagcuaugaagcuauauacccuguccauuugaaaaugcacauaagcaaagaacuuuacaaauagguuauaaagagaagcucaaucucagcaaaauaagggaagugcacauuaaaacacaagaaaccaucucagauccaacuaauauuuagcgugcauacaaaucaaaagcuggaaaggguguggaaaaacaggaauacauugcuagugagcauacaaauuggcacagccucuuuuaaagacaauuguguaucacccauuaaauuuuaaaagucacauacccugugaccuaacaauuccaacuuuuaauguccuaaagaaacauacauguguucacaagauagccuguacaaugaugucaauugcaccuuugcuuguacaguagacccccuuaucugcauuuucacuuuuugagguuucagucauccaaggucaaccacaauacaaaaauauuaaauggaaaauuccagaaacgaacauaaguuuuaaacuucaaaccuuucugcauaguauaauaaaaaucucucacuaucccucuccauccugccugggacaggaaucaucccuuuguccaguguauccacaauguauacacucauuauauacccauuuuauaaugcccauuagucauuucuauuaucagaucauaaaaaaacauaguacauagaggguuugguauuauucaugguuucaggcauucagugagggucuuggaaaauauccuccaugaugggggagcuacuguaauacuaugaaauuggaaaaaccaaaauacucaucaagaggauggacuaugguacacaugaugaaguauuaaguaucaaugaaaaagagagaguccuacauguccggcauggaaggaucuccaggagacaauguuaaaaguuugggggaaaaauugaaagacaauaccuguaauacauaugauacuagugauguuaaaucacaucacacacacacacacacacacacacacacacacacaaauacuguauaguguacuucuacaaguacauauuuguguauuauauagagagaaggucuggaaggauacuaaccaaacugucaacaguaguuugguagcgugcauuagcuuuaacuguaauguuugauguuuuugaauaugcauuuauguauuguuuguguaaugacaaauuaauaaauuagaaauaaaauaaaauaa

SEQ ID NO: 13632 - RNA, 4200 nt, Homo sapiens
aucuagggcgacgcuugacagagcuugggagggugcgccugcuuucgcccuccuucuccagcgggaggggcgcgcacuuccgcggggcggaguccgucuagugcugacguuggcagccgaacccaaaguagaucgaggcggcgggcugcacauucccguuguugcguugcguuuccuuccucuuucacuccgcgcucacggcggcggccaaagcggcggcgacggcggcgcgagaacgacccggcggccaguucucuuccuccugcgcaccugccccgcucggucagucagucggcggccggcgcccggcuugugcucagaccucgcgcuugcggcgcccaggcccagcggccguagcuagcgucuggccugagaaccucggcgcuccggcggcgcgggcaccacgagccgagccucgcagcggcuccagaggaggcaggcgagugagcgaguccgagggguggccggggcaggugguggcgccgcgaagauggucgccaagcaaaggauccguauggccaacgagaagcacagcaagaacaucacccagcgcggcaacgucgccaagaccucgguaaggaaagagcgggcgccccucugcguuccgcagccggagcugaguccgggucccuggggccgcgucgcguuuucucccggauccggccgaccgugggcuggugccguggagggguaggggcccgagucugcgaaccgccagacugugggggcucgggaacggaaggggagaccugugaggugagggggccggcgaccggcgugcaggcgugggagccugggguccgagugguuucucugcaucugaaaugguggauuuucgcuuuugcagagaaaugcccccgaagagaaggcgucuguaggacccugguuauuggcucucuucauuuuuguugucugugguucugguaaguggcuugggggcucccaucagguagagucuuggguugaaaggauuugggaugacguggugaccggucaguagugaguccuaccugcguaguucucaacccaccugccgaggacuccacauaauucuguuucgucugaaccaaauuacuuguuccacauaugcacagaggguggugcuccagaaacuucucccagcuuaauuuguacucacaggagaucaaaaaggaggucaggucuugguaaugauccaguuggaauaaauguuaagaccggacaaaaccuaacgaaaugagaauuuagaauguuuuguaacuccauuaucagucuuugcaaagaaaauuauaaauauguacuauagauguuagaacuugauuuaacauauaccagaaucuaaugucuuaaugucaaaauugaguauauuuuauaaaauaaagcuugugcaaagaauugauucacuauagaggaaauuaccugauuggcauuuuaaugugugagucaaauguuuuuagguuaauaaaagaaacguuugauacaugguuuaaaaaaaaagugucgggguagccugcuguccccuaagaguaacagacacuugccuuugcaaauagauuacaaaaaaaaggucuuuccucucuucauuuaucauuuuaauaugcaagcuguuaauauugaaguagauguuuguuuuccacauucuaaaauuacugagauuucuguuuaacguuucacuuugccuuucuucuucacuuaccaauuggaagcuuuccugauaaauggaugagagccaagcaguuuauauaaccugaagaugauugaauuucagcuuugugagaaugaggaaacaugcauguguuacaggccaggccuuaaaaggaugcuuauaaaccaaaauaauucuaugcuggaaaaaccuguuggcuuuggugcuuuaaguucuuuguaaaaugauuacuuaucugcaaguucucuuggauacuuagacauaaaguucagcgaagcuaagauaaaaaaauaacucagggauauuucauuguuuuauuuauucagacaggccugucuucacuucuuauuauacugaaguuauguaccauuugcaaauguaagaguaccuuuggauucuucagcuaccuuaauaaauauuuguuagacaccagaccuauuuuauucaaagcuuauuuuaauauuugcucuuucuuuuuacagcaauuuuccagauuauucaaaguaucaggaugggcaugugaagugacugaccuuaagauguuuccauucuccugugaauuuuaacuugaacucauuccugauguuugauacccugguugaaaacaauucaguaaagcauccugccucagaaugacuuuccuaucaugcuucaugugucauuccaagguuucuucaugagucauuccaaguuuucuaguccauaccacagugccuugcaaaaaacaccacaugaauaaagcaauaaaauuugauuguuaagauacaguaguggacccuacuuauucagucaauuaagaguaaguuuuuuuaugugguuauuaaaacaguaugaacaauuagucuaacucugcauagacagggucuagauuuuguuaacccaaauguauaacugcaguuagcuuaaauuacaauuugaagucuugugguuuuuauauagcuaggcacuuuauuacucuuuugaacugaaagcacacucccuuauagguucauguaacuguccuguaauaaggugcuuauaaauggaacaacuacacagccuaguuuugccacaaccuuuagcaucuaaaaaguuuuaaaagcuucuaaaugucuaauauaaagggagaugcuuauagccacaacaucuauuuuaccaauauuguuuccauuacacuaccuuggauuuugcaugagugaguauaguaacccaagaugccauaaaaaaaaaacuugaucguuuucugacuuaaucaguuacugugguuucacuaaaagcuaccgugguggagugaagucagucagggaagguuuguuuauguuacauuuauuucaccagaacuauuuuaauauaucaaagggguuuacuaugccaaacaaaauucuagggaaaaauacugcuaaaaauggaugccucaucagaacaugcuguugaguccaaugugccauaagacauuuuagcauguuaaauagcacuuuuaauagcaaaaaaaggcacaucaacugcgaaguuauccuuaguuugcaaaugcuuuuucuagauuaaugauuuuucaaucauuaggguacuagacacaucagccuaaaguggcaucuggaauugaauggauuuacugauaaugaucagucuuuagucuucccuuuguuauaugacuuuauagguuaugauugaucaaauuuacguuuuacuaaugguaagggugagggucauagggcagguuuuggguuuucuaguacuguugaaaacugcaaguauuggcuauuuguauacuuagccauaacuuggugaaaaaaaaccugagcagugucuauguauuaaugcguuggaaagaaagcugcuuguguuugcuuuguuaauugccucaggauauuucuuuuaaaauaagcuguuuuaagaggaacagaagggaaaucugcuaccuagucuauacacagcgugaaccucacagggggcuucugauacccucaaacauggagaacaguaagggagcagagugguuaaggacuuucaggaacuuaacuauucuggaauaaggaaugaaucaacugaccuugggccagcagguuuuuaacuaaauuguuacuugccuuucucacccaguuaaucagucucuguacuuguuucccuuuuugaaacaagugucuugguuaacuaauucuguuuuaugguugugcuaaauucauagcaggugccuuauucuuugcuuuuagucaaaccauuccauaucagaauuuuccuugguuuacuauagauauuuggcuuuaaguuguuguuuguguuuuuuaauguacaauguucugauaaauuugacuguuaaauugcuauagcuagcaaucauuuuacauauguaaaauugcauucccuuuguauuucauguguaauucaccaauuaagugcaguuuauauucagguuggauuaugcauguuuagguaaacgaaagcugugucuuacuugauuuauucuuuaaaaauaaaguucccugaauauuugaugcuuuucuucuaaacggaaaugauuuuacaguuaucugaguguaccuuuuauaguuaguagaaaaugauuuuaaagaauguuu

SEQ ID NO: 13633 - RNA, 1179 nt, Homo sapiens
ccacagccugacacgccgcgcggccccccagucucccgcggccgcucccccaggcauggcacagggccucgccucacuauggcagcagcacggcacagcacgcucgacuucaugcucagugccaaagcugauggugagaccauucuaaaaggccuccaguccauuuuccaggagcaggggauggcggagucggugcacaccuggcaggaccauggcuauuuagcaaccuacacaaacaagaauggcagcuuugccaauaugagaauuuacccacauggauugguguugcuggaccuucagaguuaugauggugaugcgcaaggcaaagaagagaucgacaguauuuugaacaaaguagaagaaagaaugaaagaauugagucaggacaguacugggcgggugaaacgauuaccacccauagugcgaggagagccaucgacagauauuggcccaccgccgaugggcgccugguugaauaugacauagaugaagugguauaugaugaagauucaccuuaucaaaauauaaaaauucuacacucgaagcaguuuggaaauauucucauucuuaguggggauguuaauuuggcagagagugauuuggcauauacccgggccaucaugggcaguggcaaagaagauuacacuggcaaagauguacucauucugggagguggagacagaggcauauugugugaaauagucaaacuaaaaccaaagauggucacuaugguagagacugaccaaaugaugauugauggguguaagaaauacaugcgaaaaacguguggcgaugucuuagacaaucuuaaaggagacugcuaucagguucuaauagaagacuguaucccgguacugaagagauacaccaaagaagggagagaauuugauuaugugauuaaugauuugacagcuguuccaaucuccacgucuccagaagaagauuccacaugggaguuucucagacugauucuugaccucucaaugaaaguguugaaacaggaugggaaauauuuuacacaggggaacugugucaaucugaaagaagcacugucgcucuaugaagaacagcuggggcgccuguauuguccuguggaauuuucaaaggagaucaucugugucccuucauaccuggaauuguggguauuuuacacuguuuggaagaaagcuaaacccugaa

SEQ ID NO: 13634 - RNA, 65353 nt, Homo sapiens
gcauggaaacuuauauuugaauuuuauugaacuaaauuggauggcagugcuagagaugauauuuaugaugagggcacauaucuuauugauuucuguuauguaauugaagaugacaacaugcacacguggucuuucuuuggaagaggguaggaacucacaaaguaucugugcuuucaaguguuguauuuccucuuuugauucuggaaaugucuaggucauucugagcuuuuaauggaaugugcaauuucuuacauaagauuucccuaaacggcuggcauagaaagaaauaaauaauaggguccaagcauacauuugcagcagauaguagcagagugaauucuuucauauaccgcaagauuucuuuugacuggcagcuguaaugagcuucggucugacucuuuguguaggggauucuggcaauaugguaagguacaaaacagacaaaaaacacaaacacgaugcugaauauguugcggcuagauuucuuuuugaccgaaguggaauuccgacuugacuuaaggugggacuuaaagauuuucuuugugauagcaguauagaaaacgauuaacaaaagaaacacaauccagaagauggccacgaagauguaguuugaugcuuugugccacuuccgucccaguucacuuuucaguucuauacauuuuauuuguguaaccucccuaacacucugguuggugagaauaauauuuggaacagcaaggaggagcaugagcauccauacuaucacugacagaaguuugcuguaacucacugacuggaugaaagaaguccaaagaggcuuuacaauuuuauaauaucugucaaagcugaugagcccaaagaacacaaugcugacguacauguugacguagaagagcacggcagagacccugcacacaaacacguucagcugccagggaccaaggccugagucaccaaggaucuugaaaggaaaagucaggcucaucacaaagucagcaauaacaauguucuugagauagaugaugaaacucuuagagcugggcacguaaaagaauauccauccugacacuccauugaguaggauuccugcaaugaagaccauacaguacagcacaggaaugaucugcugagugaucaggagguucugagagcaggauucaucuggaggcuguguggagguugaauugaucaucuuguaacuucugaaggcagaggccugaaaagaggugugaacuggucacucauagggcacuuauggccuccaagacauuugcugaguaauaaggcaaagggcaaugaauauagucaaaccuaccaaauuuuugaagccaccuuuuuacucuguguaaguuagacacucaucccucccucccucuguucuuccuuuucuuucuuuuggucuuccuuuucuccuuucccucccucuuucccccuuuacccaccaacccccacuccuuucuuccuucuccccucucccccucccuuuucccuccucuuccuucuuccuuuuuuuugggcaaugaaaagggaagaauggagcagacagguggcaguaaagagaaacuggagcagcagggcagucucugagaacuucuagguaauacggagaccagcaugccccuaaaauaauaaugguucccuauaaaacuccagaguucuaggaaauacucauuuagguauaaucuuaaaagguaguaacuguaaaagcagaauuaauguuuuauuuuauucagaaucccauguguaauguauuuuuuuaaaaccuauguuggaaaugugauuguuuuuuccuaaaagagaaauuuuuauggauucauaaaaaucauuauaaauguuuacauauuaagagcuauucagacggaccuuacuuuuagaaaaguguauucuacauauauguuggacaugaagacagugucuaacaaacauauacauucaaauguuaaccgguauuuuugguaugggauuauggguaccuuuucaauauugagcuuuuuuuuuuucccauugaaaaacugauuugcauuauuuuaauaaauuagaauacaaauacaaacaaaugauaaaaaguacuuuaagcauucugagaaaugcuucccaaaguacauucuacaucuguacuauucaguaugguagccacuagccauguguggguauugagcacuugaaauauggccaguccagauugagauguucuguuaaguauaaaaugcacacuagacuuugcagacuuggaaugaaaaaauguaaaauaucucaguauuuuuaauacugaucacauguugaaguaauauucuacaaaugcucuauuaaauaaaauauauuauuacucuuaaauuuaacuuaauuuuacuuuuuaagacucuggcuacuaggaaauuuuaaauuacauauguguuucacauuaugguuuuauugcacagugcugugcuagguguuauccagaacuucuauuguuuaggaauccuguauauucuucacugaugucggaaguguugauuuagggcagagggaagacuagaauuaaauucaaaagguuauuugauauaucggaacagauguuuacugcccaucuuauaugugaacaguaccaauuauccugcuuaaaacccuuuaguagucuguccuugcccucaggagaaugcccuaagucuguaauguugaaguccuuucuuguucugccuccugcuuccuccacccccagcacugaguuccugcuguccugggcccaucugccuccuuuuagguucugugauuucucucagccuggaccuuugcacagacuuucauuuguguggaaaacuguuuccauaccuucuuggcuggcuaacuucucuuuauccucaaggccucagcuuagcugucacuuuccuuaggaaaccucaacuuuccuagccugguuugggguggguugagugugugcuuaucauccugugucuuucuccuaucaacacuccucucuccagcuguuugucucuuccacuacuacaagcuccuucagaggagaaagaucaugucauuuuuuuacucuugaauucuuugcauaauauuuagggcauuagauaguuaaaauauuugugaaauaaaugaauaugcacucugggaauacaaggcaugaauccuugcucuuaagauuuauucagggaucaagggaaagaaagauugugggaacaguggguaccuugaugucagagaaugcaucuuuuucaucuguauuuguggugccagcacagugcauaucacagugaaugacaaguuagguugauacauuuaagcaugacaaagggauauuuugaaauauggaauaugaaauacagucacauuccacauaaaaaauaguacauccauguaaacuugugugcugcuuccuacacaagaauaucuuguuucugcguauuuuccuuucccauaugcuuuccuuuugcuuuauggcaaaacuagaaauauugauagacuugauuuugccagucuauggacuuccuauagaaggaaugaguaccccaaaucacuuccuccacaaaaccuuucacuagcacuauucuuccucuucccuguagccuugugugcuuggcucugggcaugauggguuuguacucauuugcuucuuuguaggucuucuaucgccuuucuccuuaugagccuguuucauauuuuaaaagauaagggagggggagcacauuuuccauuuuuagcugucuacugugacuaagagucuguggcugguaacuaauuugucugguaacugucucuugacaguuagaugcauuuugguuuaaaugccagucuugcagagcuugagagaaugcaugcugcuguauucccaggucuaauuugguuucccaguccuaagccacacaaccccccagcgccuggccauuguggugucauacucaugguagguacugaguacuugugggauucacuugaguuuaaaauauaaaaaacuguagcuguuauuuuggaaaacagaaauaauaacuguguaauauauaguuauauggugaaauauugaauaauuucccagaaauaauuuaaugagagccaaauuccuuuccuuuuagaaauauuguagaagccacuauuuauagaaauagugaaucccagaaaugauuuaaugagagacauaauuccuuuucuuauagaaacccuuauaaaauuauuuucucagagucuugugucuuuuguauuuuugagcugcaguauuucugcaugugaccuaaugcugcagguccagaacucugcucucagauuccucagguugcugggaaucugcauguguaugcccuggugauauacaccauuccccuucacugcucccaccacuuugaguuggauggaagggacugacugaccaagguaaacuucuagagcagcuuugccuccugaaauggagugaaugcacacagcuuaccugcgcccuuuccccaaacacugcuauuuuggcaguuuugaugcaauugcagaugagccuccaguuuagggugggagguuuuagacaugcugguugggugccucugcuacccugugccacugucugguuugauacagcagaggcucaugccaggacagauuucuucaucuuaaaggaacacucuaaaggaacaagcuaaagagaaauuccaagauacucuugguaguaauuuuugaacucuuaaauauugauuuuuuuuuaaaagcagugggguuaauggugagaacauacugucuuacggguucaagugucuuagagcauggcagccuuuucuguagggcagaucagagcaguaauagacugagagauguguggaaaagaagcucucuuaaggcaaguaagaccaaauuauauauugagaccaaaaggcaggaauauguguuggaugaaaaucaggacaaaaucauuaaaaaagacaugcaucauuuggaccucgugauaucuacucagucuccucuccuuaucuuuaguacagauugagaugauuuaauguccucauacagggaccuacagaaacuucaaaucuuucacaaaugaaggaaaucguuuuauucucaugcugauuuuauacaaaaauguaaaaauaaauaagaaccaaaagaaucagaaaagaagcuuuuagugugcucagcaacccucccuucccugcccacuucucaguugauucacuguuucuuaccagcucaugccaguccauuaaagaggagagauaggcaacagaaaaaaauuaaaagaugaacaggacuucuggaugaugauuaacuggauuacuggauaagcaggcagucuggugagccaguuuguguaggugucuguuuguggagcccugcucauugauaguuacuucugguauuaucacugaauuucugcugugaaaguugucauuauguuaaccuugaggcuuuaggaauauaaacaaugcuuccuaaauucuagagaucacauuuaagaaagauucauauauauagcuaaacuuuuuaaaaaggaauacuguggccgggcacgguggcucaagccuguaaucccagcacuuugggaggccgagguggguggaucacgaggucaggagauugagaccagccuggccaacaugaugaaacccugccucuacuaaaaauaaaaaaauuagccaggugugguggcauacaccuguaauccuaguuacuugggaggcugaggcaggagaauugcuugaaccugggaggcggagguugcagugagccgagaucccaccauugcacuccagccugggugacagagcaagacucagucucaaaaaaaaaaaaaaaaaaaaaaaaaaaaaaagaggggggguauacuguaauaguguaagucuugaaauuuucuucagugaaauuuugccuuguuucacaaauccagauauaugagaaugaaguggucugaaauguuuuagccuacauugucuacugucacuuuggagacuuugguaacauaauuaaagaacauggcagaaugagauuuaugaggcccaaagacaguuauuaaaguguagugggagcauuguguagaaagaaugucaaugccaaagauucaaucugauuuagauagugagugcacuugucccuuagugcaguguaauaucuuaggauugugcugcaugaaguguuuucaaguugucauguauuacagauaaccucaggguucucucuuuggacagaauuuaauugauacaaggcugugcaaagcauugcucacuccagaaauacguucaucuuaauaaaagcaggcuuagucagcucugaguucauuacucaucuguguaauuauauaccaugaccuauuuuccucuuguauuagaacaccuuccaccuuccuaauugugagcuguaauuccuucugugaagaaaagaauuuuuucuucauagcacuucgaugaaauuaacaaagcucuugauaauacuugagggauuuaaaaaauuaccuuuuaagauuuuuuuugcauaauaugaggucucuuuucagugaagguguuuugcccagugagcguuugucgucuugaaguggcccaaguguuuuuucauuaaagauccugcauuacacaaaacaaaaaaccaaagauuuaagugagcaccugacuuuuuauugggaaaauaugucuguacuuacuucuuaaauucagcuuguguaauugugaaauauuucaacaugugcauuuguuguuucacuauacuugcuauuuguugucauuauugauuauugauuugguugcagccucuugugggaaacuuaaacucugagagcuugggcaugaagugguuuugguuauugguuuauauuaccccccccccccccuuggauauggaugaucgaaucaauuuaucaaaugacugaauauaacaauucaucuuagccaugaaaucauaagucuaauugcagguggauuuuuuuaauuguuuuguuuuuuaaaaaccuuugucuuauugaccuuuugggccagauaauuauuuauuuuugggagcuguccuaugcauuguaagauguuuagcagcaguucugacuucugccuacuagaugccaguaacccacuacccaaguugcgguaaucaaaaauguuucuagacuuugccaaauguccucugagggacaaaauugcccucauuugauuaccaccaguguaaugagacuaauguguggacuuugcagagauaacaccugaaagccauguggucugauaggaagaggauagguuuagcaaaauggugguuggauuugguucugccuuagucuagguuuucauauuucugaauucuuuaaaccagugagugcucccuaaacuuuaaugugcauacacauuaccugggaucuugcuaaaaugaggacugagauuccauuaugucuggaguuuggcacgugauaugguuuggcucuguguccccaccaaaaucucaucuuguagcucccguaauacccacauguuguggaagggagccagugggagaugauugaauuaugggggugggucuuucugugcuguucuugugauagugaaugggucucaugagaucugaugguuuuaaaaacgagaguugcccugcacaagcucucuucucuugucugcugccaugugagacaugccugucaccuucugccaugauugugaggccucccaccauguggaacuguaaguccaguaaaccucuuucuuuuguaaacuguccuguuucugguacauuuuuaucagcagugugaaaacggacuaauacaguaaauuggugccaguagaguggcacauugcugaaaagguaucugaaaauguggaagcaacuuuggaacugggcaacaggcagagauuggaacaguuuggagggcucagaagaagacaggaaaauguagguaaguuuggaacuuccuagagacuuguugaaugccuuugcccaaaaugcugauagugauauggacgauaaaguccagggugagguggucucagauggaaaugaggaacuuguugggaaauggagcaaaagugauucuuguuauguuuuagcaaagagacuggaggcauuuugccccuacccuagagauucguggaacuuugaacuugagggagaugauuuaggguaucuagcugaagaaauuucuaagcagcaaagcauuaaagaggugacuugggugcuguuaaaagcauucaguuuuauaagggaagcagagcuuaaaaguucagaaaauuugcagccugacaaugcaauagaaaagaaaaucccaucuucugacgagaaguucaagccggcugcagaaguuugcauaagcaacaaagagcugaauguuaaucaccaagaaaauggggaaaauguauccagggcaugucaaaggucuuuacugcaagcccaucacaucgcaggccuggaggccuagaaggaaaaagugguuucgugggcccagcccagggucucugugcugugugcagccuggggaauuggugcccugcaucccagccacucuaguguggcugaaaggggcccuuguagagcucaggucauggcuucagagggugcaagccucaagccuuggcagcuuccaccugguguggagccugcgagugcacagaagucaagaauugggguuugggaaccuccgccuagauuucagaauauguguggaaaugccuggauguccaggcagaaguuugcugcaggggcagggcucucauggagaaccucugcuagggcaguauagaagggaaaugugggauuggagcccccacacagagugccuacuggggcaccaucuaauggagcugugagaggagggccaacauccuccacacuccagaauaguagauccccugacagcuugcaccgcuggucuggaaaaguugcagauacucaaugccaggagggaggcuguacccugcaaagccacagggguggagcugcccaagaccaugggaacccaccucuugcauugcgugaccugggugugagacauggagucaaaggagaucguuugggaaguuuacgauuugacuguccugcuggauuuuggacuuggauggggccuguagccccuuuguuucagccaguuccucccauuuggaaugacugcauuuacccaaugccuguacugcauuguaucuaggaaguaacuaacuugcuuuagauuuuacaggcucauaggcggaagggacuugccuugucugggaugagacucuggacuguggacuucugaguuaaugcugaaaugaauugagacuugggggacuguuggaagacaugauugguuuugaaaugugaagauaugagauuugggagcggucagagguggaaugauaugguuuggcucuguguccccacccaaaucucaucuuguggcucccuuaauuuccauguguugugggagggaccuggugguagaugauugaauuaugggaguagaucuuucugugcuguucuugugauaguggaugggucucaugagaucugaugguuuuaaaaaugggaguugcccugcacaagcucucuucucuugucugccaccaugugagaugugcuccaccaugauugugaagccuccucagccaugugaaacuauaaguccaguaaaccucuuucuuuuguaaauugcccauucucaaauaugucuuuaucagcagugugaaaauggacuaauaaagcaugauaugcugcugguccauguaccacucuuugaguuagcaucauuuuuuucccccagauccugugcccaggagacauuuaauaaaggugaugaugguaaaauauuuuuguuguagucgggacuuuagacaagaaaaauuauauuccaaguaggccugaaaucuaggaucuuugcccaaguuuauucauuacauuucaucauaaucuucccaucuuuauggucucuuggaaauguaaauugguauuuuauaccuauuugagagguggcgauugugaucaucuuauauuuacuuagaauguuccuaaaaagucaugagauucucuuuggaaagaaagagguuaaguucugcauggaguaauaaucucaguggccuagggcaguauggaacaugugcugguuguaaaucauauauucuaacuuuacaacauugaggcuuuuauuaaaaaguccaaaaaaaaaaaaaaacuagaugucagugagauugcagaaaaaagagaacacuuauguacucuugugggauuguaaauuaguucagucccuauugaaagcaguguagagauuucucaaagaacuaaacauaaaauuaccauuucacccagcaaucccauuacuagguauauacucaaagaaaaacaaauuguuuuaccaaaaagacaccuucauucacauguuuauuguaguacuauucacaauagcaaaggcauagaaucagccuaggugccuaucaaugauggauuggaugaagaaaauaugguacauauacacuguggaauacuaugcagccauacaaaagaaaucauguccuuugcagcaacaugguuguagcuagaggccauuauccuaagugaauuaacacagaaacagaaaaccaaauaccacauauuuucacuuauaagugggaacuaaacauuggauacacauggacacaaagaugggaacaguagacacuggagacuccaaagacggggagguaggaagcggggaaaugguggaaaaacuuacucuuggguuuuguguucacuauuugggugauggguucacuagaagcccaaaagcucagugucacacaauauacccaaguaacaaacuugcacauguaacuguugaaccuaaaagaaaaaaagaaaagaacauugccuacuccuggggagggaaguaggagcaaguccagccuccuuacacccaaccaaauaccucguguuuuaacuuacaagugggagcuuauaagugguagggugguuggacuuugcuguaucugugauauuuuauuucuuaaauucugaaucaaauaugccuaauauuacugccuauuaacacuggugacugguacauugguguuaucaacauuagugucugcacuucuguuuuuguauauuuaaauuauuucauaauuaggaauagaaauaucuauggagaauggauugccuucaaauaaugcuuuuaucaguacccacuuaugacgugcauuuuucuuccucuucuuuuuucaguucuuauaaagguacaacuuuuauauauuuuuuuuccuuccuuucaguccagacaucaaaagcuuuaauacacagugcucuggaucuuuuucuaugagauaaauacuuguuuucuagcugauucuguaucaauagaaaauaguauagauguauguaaucauuuauacauuuuuaaacuuacugaagccauuuucuugcugcuuuaaucucucaugccuuaauguuuaacacuuuuuuuuuuuuuggugucaaugugaucgccuaugcgguuuucauaguauuuaugugucguguauuuauaguuguguuauuacauuuuauguuacuaaaauaauuuacaaauaacugucucaucuguguucugcauuccuguggcacucuuguccgugcccucucuaggcucagucaaggagaaucucacuuucuucuucacccagaagaaggaauccuccucccacccccuaucuuuugucaucacccagagcauuuaaaguuugacacucaccacacuucucagaagcugucagggaccuaauuucuaagccuguugucuuuuucucaguuauccuauuuccugacccucuuugcagcauuugauaucauugauuuccccuuauugaaaucugcuguuuauauaguguaaccuuugccuccuguguaccccugauauuucuuccuuugccaaggccguuuguucauuugcucacuaaagccaucagaacaugcuuauuacauuuuauguuacuaaaauaacuuacagcguuuuacaucuuuaaaauauuuuauauuauuuacuaguguuauuuaauucucucugucaucagccuccuagcuuuucuuacccaagcagagcuggauauuuuagaacuucuuucacccugccuauugggcuugccuuucugccccagcacugugacuccuuagggcuggguaaacaauguccuauguuucuaagucauagaccuguccagggugcccucgacuucacagaaguugcuguucucucucuguaauuggcuacacuccccuuauuucucagaaauccuucuucugcuuagcuccuguguuagucuauugucugcugcuauaacaauacuacguauugagucauuuauaaagaaaggaaauuaauuuggcucaugguucuggauucucugaagcucaagauggaggggaugcaucuggugaggccuuccugcugcaucaugguggaagggcaagugagcaugugagaccaagagaaaaagagggccaacuucugcaguaauaccauuaauuugcucacgaggccuuugcuaucaugaucuaaucaucucucaaagguaccaccucuuaaugccgucacaauggcaaaucaauuucaaaugaauuuugaaacggacacucaaaccguagcagcuuucugucagauccuaucgguagcugucucauccguguucugcauuccuguggcacucuuguccgugcccugucuaggcucagucaaggagaaucucacuuucuccuucacccagaagaaggaacucucccacccccuaucuuuuuucauuacccacagcauuugauguuugacacucaccacacuucucagaagcugucagggaccuaauuucuaagucuguugucuuuuucucaguuauucuauuuccugaccucuuugcuugcaguuuuugauaucauugauuuccccuuguugaaaucugcuguuuauaaaguacauuguaaccuuuggcuccuguguaccccugauauuucuuccuuugccaaggccuuuuguucauuugcucacuauaaagccgucagaacaugcugccaugcccuauggaaacacaucagggaacucucaggaagauuccagucuagggggaggcugaacagagggacacuucaagguaugacauggggucaucauugaaggaggaagcacaggaacacagugagcacguaucuaguuucagaaaugguggcaucagggcagccuuccuggagcaugugauagugaagauugacaaaugaguuggcuuuagcuaggcaaagaagaaggaaggaguuuuggggugagagagcuauaggaacaggcaucaagacugacacgagaggcugucacagugggggaaaauggauggccuaagcucuuggguaacaugauggaaucuugccaaugaguaaacguuuacguuacaaaugaggacagugaugcuuaaaaugguuaagugauucaucaaagggcaccuaacacauagccagacaguauucaaacuaaugucugauugauuccaagccagggcuccccugcuccugaaagaaugugggggcagcauguuuuauaugaaugugauccuuuacacaggcccuucaacauuuugcuggagucgcaucuugagaagucagccaguguuuuuuuuucaagaaaggaaugugcauguguguauguuugagaguauauauauuauuuuuguuuuugaucugaguuuuaagguuuugcaugagguggaugccuucaguuucuucaguuaucuuccagauacugcggcauagagaaccuccuuuugauuugccaguuucuaaaaguauuuaaaaugaguuucugauuuuuugacucaguuuucuaucuccugcguugauauccaaagagagauacagagucggacuaucaugaauggugauuacaacagguaacguuaaccuauaaaugguggaaacucuucugcagggagaaacccagaucugcugcaugugguuuggaugccacacgcagauccccuggggccccuggcacaaggagagcucugcuugcugcuguuugucaccuucagccaguuuucucuggcaggagaugugagcucaagaucaggucacuugauccuaacuccugcugcugugacccaucgacuuuaccuucaguuagaauccaggucagugaccaacauguguuaauguaacuuaaaauuggcugaaugguguggccacauacuuucauugaggagcugugcuaaguuuucacauuagaaauaucuaaauauucuucuuaggcugaauugcagauacccaagaacuuccuccuccaccaaagcauaaauucggcccucucuugauucccucuugaucuucguauucacagucuuuacaacccauaaagauaaaagaaaucugaauuucugcuacaaacagauccaacucuugauuaugugugagaaugguaaggggggacggauuagguuggauuuauaaacugauaacguccaaacauagucuuuacuuuguauucuaaucgcuucccucaaaacacuuuuggcauagcuuguggcagacugcaagucuagcauauuggcaugucuaagaacuccagccugucuucacuuugugauuaugcaaauggaucaugggagcugucaguggagggugagguguggcauaggcaccucaugaccuccaauggauacauagucaugcagucuucccgaauggcaaacugggggccaggaaaauggccacccacuguuagccuuuacucuagggacugcaucuugguagucaggauggaccuguaauuuuuugccuauaaugauuggaauaguccaggguuucucagccuugguacuguuaacuguuuuuuucgguuucaguucuuuguggguaggcugucuuguguauuguuggguguuuagccgcaucccuggccuguauccacuagguggcaguagaacgccaugguuugugcaaccagccacguccccacacauuucuaaauuuucuugagaaccacuggaaugaccccuuaaugguagguauguuucagaugauuuugauacaggaagagaauuuagcuuucuuguuggggucagaccuuaacuguaauugaauaacucaucagcaguaaguaaucuguaugcuaaggucuaggaaugugaagugugcuuuauuuacugcucuguuggaauaguggacagaggacagacagugcagcauaaugauuacaugcaugcuugugggauacagugggccuuggcuacauguauggcgcuagaauauugcgauaauuauuaacugccuuuguguaucaguuuuuacaugucuaaaaugaggggagaaguaguagcuaccucagcuacaucuaggguuccuguucccauaagaaucaaauaccuggugugaggcaggcugugacucagugggaacauugcgcguacagggagugacucagcugauaacagaauaaacuaucaggcuccugacaguuuccccucuucuuuaaguugauuuaaguugacgcucuucuacacugaaauucagggcugcaggaggcacaguagacccuuugcagagugcucugagcuuccuccaguauguggcccagcagugcuugaacaagggacaaauugggagagguuuugcuucugaugaucccucuauucuagucacaggaaguggcacucaacaacagaguguauguaugaaguccagaguguuucaguucuaauuuaccagucccuacacaaugcuaaucuuucaugagaguggcacaaagcucugcaucacuccuggcuucaggguuuugggaaccaauucuuuuuucuccuggaacuagguugagcugccugaauuacugaauuuuuuccagccuguucuucugcagcauuguuuuggaauaugugguccuauucccuggggccaggcaaggaaaugaauccaugaccucuuuucgccucacugagaugguauuugcauuucucaggcaagcaguacucagaucugcagaucauggggcuguuagaccauuagugguuauccuuugcugugaagaugaagacaaauuuccaugugugagaaaacaacagcuuuaacugcuuagcugaauaucaaccacuuguguguuuguucaagauucaggcuuauauagccaaaggaaaagaauauaaauauccagaauuuuaagugggaguagaaauacuguacagaagugauucccauauacucucuaacccaaaguguuguauguuuccucccuguuuuguguauuaaucccuguuagaggguucuuugauuuuaauaaaacauacugugguaauaacuuauaaauucagcaauucuuuuuuuuuuuuuuuuuuuugagauggagucuugcucuguugcucaggcuggagggcaguuucgugaucuccgcucacugcaaccucgccucccggguucaagcgauucuccugcgucagccucccgaguagcugggacuacaggcucgugccaccaugcccggcuaauuuuuuuuuuuuuuuuuuuuuuugagacggagucucacuuugucgcccaggcuggagugcaguggcacgaucuuggcucacugcaagauccgccucccggguucaugccauuuuccugccucagccucccuaguagcugggacuacaggcgcccaccaccaugccuggcuuauuuuuguauuuuuaguagagaugggguuucaucguggucucaaucuccugaccucgugauccgccugccucggccucccaaagugcugggauuacaggcaugagccacugcgccaggcgaacugagcaauucuuaaacgaauuuguguuuuauuaacuagagcaugcaacaauggagcaacuguauuaguugcaaacuuaguaggacuuaagggugaaagaugcacuuuuaugcagcuugaagauguuguucaaguuguauuugaaaucaaagaccuuuacuuuuuaugaguccuaggcucacauguugggaucuguuuuuuuguuuuuuguuuuuguuuuggauauggagucucgcucuguugcccaggcuggagugcaguggugcgaucucagcucacugcaagcuucgccugcuggguucacgccauucucccgccucugccucccaaguagcugggacuacaggugcccgccaccacgccuggcuaauuuuuguuuuugcauuuuuaguagagacgggauuucaccguguuagccaggauugucuugaucuccugaccuugugauccgcaagucucggccuccuaaagugcugggauuacaggcgugagccaccgcacccggccgggaucuguucuugaauaugcgugucuguuuuagaacauuccacuugugauauuucaccuuucccaugaauuucaauagaagucagucaaguacaguguaagaaaauagucuuaugucuugcccugccccaggggagcuguuagaugccauuucauuauugccucagguauaauaccuguauguaaaaaaauucugauaaacacuccuuucucguuauacuauacacuacacuuugaugcucauugacauccuuggacugugaaacgugccaggacuaguuuuguuuuacuccacgcuuuuuuuuuuuuuuugaaugcacuuccacuuccuucuaauguuucuuugaacucuauguguuauugcuuuucucuuuucuauuuucaacgucucuuucuaagggcuacuucccuucaaacuuuaaaccugcucaaaguccuuaauaaaaaaaaguaauaaaaucuguaugucuguaagucaugacaccccaauagcuguaaacuugcucaagccauuuuuaaauaacaaaagugaaaccccccugccaaugcagaaguagugacuucccacugucagugagcucaucuuguuuggaacucucacuagccacugaaaggaaacagggcuccuuaagagaaauuacugauuuccgaucagguacaggaaaaguauaaguugaguugugacaucuuuugaucagaaagcaaggaagugcucagaccgauuaggaaaugcuaaaaaaggacacagaagccgacuugagggcacuccuagaucugggacaguuugggcauuaaugagaaugauagcaacaggugaaaauacauugaaaaccaaaacaaauucaggaguuuauggugauauuaaaaguacagauuacaaaaagguaggaugcaaaugagaaagcucuuguuuacaggagaaugcuggcuaguaaagguagaagaaggguagaauuuaggacaucaccauuuugcaaccucagugugauaacugauucaggcaauaagcuucaauuguggccaaaagccacugggugaaugggugugggagaauaguaucuuucagucugaaaacauacucccccaucauuuagaguaauaaaaaguauaccucugaagcagagagaucugguggucacugaaugauccaacuuaccaaaagugagauaaucuggcaucguaugccuccugauaugauuuaguuagauguacacaacauacuuuuguaauaaacuguaucaaaaaucuucaaugagcaaucagacaaauuuagaauaugaaacauuugauaaagcaaccagccuuggacucuuuaaaaaaaucaaugccacgagaaacaaacaugaugggcuggaaggggacagucguagauuaaaacaggccaaagagaaauaacaccguuaaugaguggugauuguuggcuggagggaauagccauacaaauuguuuugagacaguuguauaacucugaauacagauucuagauuagguaauauuacugaguaauaaucuucccagaaauauugauggugugguuaagcgagagaguauuuagagaugcuuauugaaguauuuagaagggaagggucaugauuaccugcaacuuauuuugaaaguacuucaguacaagaaaacaaaguguuauguuuguauguuuguauaaacuuguguauucaugggcuuuuuuugcugauauaugcaugccuauaugcacauauacauguauacacacacguguguguguugguuuugagggaaggguccugugcuccgugccugacagguaacgaaugccuaauaacagucuccugggugucucugcuauuuuucuuaccuuuccuucuuacuuuccuguggggucuccucugcccauccuuaaaauugauguuucuuguucuauucuuggccauuuucuuuucucuuucuauauacuccucuaugccaaaguagucuuuacuuaaaacauuguuuguagcucuuugagcaaucacaguguugcuuuccacaaugguugaacucauuuacccucccaccaauguguggaaguguucucuuuucucugcaaccuugccagcaucuguuauuuuuugacuuuuuaacgauagccauucugauuggugugaaaacagaacuaccauuugacccagccaucccauuacuggguauaaacccagaggaauagaaaucauccuaccauuaagacacaugcacaugaauguucauuucagcacuauuucauaauagcaaagacauggaaucaacuuaaauguccaucagugacagauuggauaaagaaaauguggcacauauaugccauggaauacuaugcagccauaaaaaaagaaugagaucaugucuugugggaauauggauggagcuggaaaccauuauccuuaguaaacuaacaaaggaacagaaaaccaaauaccacauguucucacuuauaagugggagcuaaaucaugagaacucauggacacaaagggaacaguagacacugaggcuuacuugaggauggagggugggaggagggagaggagcagaaagauaacuauuggguacuagacuuaguaccugacaaaaaaaucugcaacaaaucccuguggcaugaguuuaccuauauaaccuucagauguacccuugaaacuaaauuuuuuuuaauauuguuuaaaaccaucaucuguaaaacaaaauuuucuuuucaccuuucaaauauucuucuaacagcuauuaccagacaguguaugugcuauuggugauaaagcaauaaaaaaacaccaacauugucccugcccucuuggagcucagagccugcuguucuggcaucugagcagccccauuucuuuccccuccuccccugaacaucucuaguuucugcagaucugggucauuugcagcucuggauguugacgagcccggcugccucaccuccacaggguagcacucucgugcccucugaguuuagucaugccucaccuugagcuacgcugucuugucaucucuuauucucaucacauucuguagcaauagcuaccauucauuuugaguuuuguguuuuaccaaacacagacaguguuaauugcuuuuaaauauagucuuucuuuucaauggaauguuugauacuuugaaaagacuacauguaguauaaguuaaagcacaacaaaaagaacauagcacugggccgggcgugauggcucccgccuguaaucccaacacuuugggaggccgaggcuggcgggucaccugagguggggaguuugagaccagccugaccaacauggagaaacccugucucuacuaaaaauacaaaauuagcugggcgugguggcaggugucuguaaucccagcuacucgggaggcugaggcaggagaaucacuugaacccgggaggcggagguuguggugagccgagaucgugccauugcacuccaaccugggcaacaagagugaaacuccgucucaaaaaaacaaaaacaaaaacacagcaccgacuugagagcgagagucccacaggcauucuuggaucguuccuguuccuccucugccauccgccuuucuccgccuugugguaacucuguccugaauuguguguuuuuuauuuccucccuuuuaaaacuaaugauuuuaguccauguguacauacauuccuuuguaaaaauuguucaugcuauauguaaucuuuuaggacuuuaaaacauaaugcugaguagagaaauuuaaaaagucuaucacuuuggaaagggaauuggaaauacuuggugaagaugaacauucacucacucuguagcugagcauuuuaacuuuuagguguaugcccuagaaaacuccugcagaugcaugccaggaagcauguccaagaacacucauagaagcacuguuuguaauagcaaaaauauggaaauaacccagaugauuauugacaggagaauggguaaaaaacccauuauuugccuagugaaauuuuaugcagcagugagacugaauuaacuacaguuaguaacuuucaaagcuucaagugguccugacaagauaggaguaauccuguuuuauacuggaggauaacaaagccuagagagcuugaauaaauugucugucuagguauugcaaauaguuacguuguagagcugagauuugaaucgaggucauugccaguuuacagccuuaaucaauggaaaauauugcauccuacugaaaguauuuguuuuuacuagcuugucuguuuuacuguguugggagagagcuuuguauuuucaguuaacccagcaaaugguucauaguaggugcuguauaaacuuucugaugaaugaccaaaaauauccuuauuuuacacaggaagaaagaugaagggagcuuaauggguugaguaaguucccagauaugguaaucagagccccuacaacuaggacccaaccauucgaagccucaguuacuguaauauccaaccuguauguucuuaacuugguugcaugccucucuucuaguaaauggcugggagaagccuggcauaagugaugcccauauaauguggacuaucauuaacccugcugucaaguuccuuagucaggggucaccaucacucuccugguggguagcagaagccuauccucagcugugugacucuuuuaccuauaauaagaaucuguccagccugaagcagcaaacguuccagcgaacuuucuucuaucucuucuauuucuaaccacgucauggacgugguuaacuuguagaaaaagcucaggcguguuuuuuuguaugcgguggagguugugaagaaagcaggguagcagacacuuagugccuuuggcaggcaaaccaauauuccuuguagauguagauuauuaagcuacuuagguauuuugguccaguggaacaaaaauucaaaauaaaaaguaaaagcuuaaccuacccacuugagcuuuuuggucaucuaaugccuggcagaacucugagcaggugcauguuuuccucagucucauuaaauugugaaagauuucuggaccuuuguaaacugaugggggcagggcccugcaagcaugaccagcugaguuuugucaagcucugcauaagaguagcaggaauguucaggugaaugugaauauucccuauagugggguugaaguuugauucugaaaagaucuaaaagcaacucauggccuggcaugguggcucaugcuuguaaucucaacacuuugggaggcugaggugggcagaucaugaggucaggagaucgagaccaucauggcuaacauggugaaaccccaucucuacuaaaaauacaaaaauuagcugggcgugccuguaaucccaguuacgcgggaggcugaggcaggagaauuccuugaaccugggaggcagaggucgcagugagcugaggucgcgccacugcacuccagccugguaacagagcuagacuccaucucaaauaaauaaauaaauaaauaaauaaauaaguaaaagcaacucacuugggcagagguccuuggagcuggcuucugccugugauugucagucucugguaccuuuguguggcugccacaugcuggucucuguuaaaaugucaccuucucagcaaggccuuuccuguucauggcaucuaacauagccauucccccuaugucgcauucucuagccucuuaccacguuuguuuucucuugucucccuuuguuguuuaaaauauuagguuggugcaaaaguaauugugguuuuugugaugacuuucaauggcaaaaacugcaauuacuuuugcaccaaucuaauauuuuuuaacuuauucuccucucccccuauucuuacauacagcccuucuuaaagguaagcuuugccagaccagaauuuauuucucuuguuaacggcaaaauuaggaggucccagaauagagcuugcucuacaguuagaagcucaaugaauauuuauggaauuucagaaugaacuuacuuauacaacuuuggucaaauuaaggauuuccuuaacugucaaaugaugaguuuguucagcacuucuagaguuuuaaaauguacuuuuauauuuugaauugccacuucaaugugcauaguagauuaacauauauagauauccuuuuaaaucucuggaucacagaauuagaauaaucauaauucuugauucaggaagcauucuuguuaugcagcauucaagcaaggaugacuuuuuacagauuuauuuuguuauucuuaacgauguuaauaaucuccuucagacucaguaaccaaaacgaaagccaagaccuugacaguaagcagcugcucuugucuaaaugguccauccucccacccccaugccaucucucuggauacuuuuauuccacauuaccugagucauguguucuucaaucuuucacuuuuccuguuuuacaaauuuuuguaacaucuauauguauuccuaaaagugugugugaaugaaguuaugauuuuaaaacuguauguaaucucuucaugauuuuucuauauauuuuacugacauaaauauauaaaauuugauuucauauauaucguacacauccauguuauuaaguauugcuauaauuaauuuuguuuugguuacuguauagcauucugcugugugaccauaucauaguuaauucaguuucuuguauuugggguauuuccagguuuuugccauugugagucaugccgagaugcauaucuuuguugccuauugauggacauuugaaaauuucucguggauauaaaccuaggaguuaaauugcugagucaaggacagcaugaauguuaaacuucaggaagugaugccaaacuuuuuuuuuuuuuuuuuuuuugagacggaaucucgcucuguugcccaggcuggaguaccagucucggcuaacugcaaccuccguuucccagguucaagcgauucugccucagccuccauaguagcugggacuacaggugcaugccaccacgcccagcuaauuuuuuguauuuuuaguagagacgggguuucacuguguuggccaggcuggucuugaacaccugaccuugugauccaccugccucagccucccaaagugcugggauuacaggcgugagccaccacgccuggcuuuuuuuuuuuuucuuuuuuuuuuuuuuuugagacagagucuuacucuugucgcccaagcuggagugugguggcacgaucuuggcucacugcaaccuccaccuccuggguucaagcgauucuccugccuccgccucccaaguagcugggacuacaggugcccgccaccaugccuggcuaauuuuuuguauuuuuaguggagaugggguuucaccauguuggccaggcuggucucgaacuccugaccucaggugaucugcccgccucggccucccaaagugcugggauuacaggugugagccacugcgcccagccgccaaacuguuuuccaaagaaguuacacuaguuuauauuccuaccaaugauguguagugauccuguggauaucaguccucucugacguuuuaucuuuucagauuaaaaauuuuuuucuuaugaaauguuauuauauuguagucuucauuuguacagugaucucaaaugauaugggcaucucuucauaugaucacugguauuucuaugaaaugucuagucacauuuuuugcuuauuuuucuguuggguuguuuaugcuguuacugauuuguagacuucuuugaauauuguugauauuuuguuuggugucucuacuauaaauaggcuuucuagauugugacuuacuguuuucacuuuuaaaguuauauuucaagaagcaaaauuuaccaauuuuaaggaucaaauuaucguuuuuuucuuuucuaacuagugcuuuuuguaucuuaaaacuuuucuguccuaaaguuuagaacagugcacauuuuuucuuuuuucuuuuucuuuuucuuuuuucuugagauggagucucgcucugucacccaggcuggagugcaguggcacuaucuuggcucacugcauccuccgccucccagguucaagcaauucuccugucccagccucccaaguagcugggacuacaggcaccugccaccuuggccggcuaauuuuugcauuuuuaguagagacgggguuucaccuuguuggucaggcuggucucgaacuccugaccucaggugauccacccgccucagccucccaaagugcugggauuacaggcgugagccaccgcgcccagccuggaacagugguuuuuaaaauguggucugcagaaccacagggguuccugacacccuuucagagacacuaugaaaucaaauccaucuuuauaagaguacuaagauguugcuauuuucaucgugcugaaauuugcacugauggugcaaaagccaugauguguaaaauguucaggugucuuagcacaaaucaaggcagugcacucaacuguucauugcauuuuauaccuuacugacauacaaucuuaaacaagaaaagaaaaaucaguuuuaccaauugcuuaauaaagcaauacuaguuuuuauuaaaucucaaccauaaaaauaucuuuuuaauauuuugugugccaaaauauuaauuauguauaaaguacauuugcuacuuaugauugucuagaggaaugaacacuuguauaauugaguuauaagcugaauuagaugcauuuuucauggaacaccauuuuuacuugaucgaaugacaaacuaauaauuguacuuggguguuuggcaaacauuuucucaaaacugaaugaacugagagacaauuuuugacaaugauaaaauucaagcuuucaaacugaaagcagaauuuuggaaagcuucugucugcuguugugaguuucguagcuuuccgguauugacacugugaggaggggcaauauuaauuaguaugauuuuuugguacuguagaaugaaaaguguuuauauuuacaaauuucugcaugaauguauuuuaucuacaugaccaauguaugauguuauaaaauugggcauaaguaaaacacauagacuuaaaggucaagaccaaaagauuucaguguuacaaaguauaaaauauucauugacaugguuuuagauccaauauugcaaucaugcuuuaaaaaaccaccuguugaguuuugugcugucaaagaagaaaauccagaaggccauuauuuaucuguaugggauuggauuuucuucaacauacuuuuaaccuaaacauuuugcaagagauuggacauggaaguggauaugagaauccaacugucuucucuaggccagauguuaaagagauuugcaaaaauguagaauaacaugacuuguugacauaaauuuuuuugaaaauauuuuucauaaaaauguuacuuguguuaaccugcuauuuaaaaguuuuauaacugucacaauuuuaauuucuaaaauaauaaguauggauagguauacacaaaagcucuuugagguccucaguaauuuuuuaagaguaaaagggauccugagaccaaaaauuugagaauucuuggcuaaaauacauuuaucuauauuuucugauaagagauuuuguuaugguuguuaguuugcuuguuuuagcacuccagcucuuaagcuauuaaauauauguauuauacuggacugucuauaaauaucaaaaaaggacaccacauuuuaugaagaguaauuaaauuuaaaaauauaugaaacuucccaaguucauuuuuguaacuuguacagaacacauaucuuucacuuuguuuucuugagcauuuuuaagguuguuuaucuacccaccagaugugugaaucaaacaggaaguaauccugaugucuuucucccaccuuuuuuuuuuuuguguguguguguauggccaccaccugugggucucacagccccugaccuguaauuccaggcuccauaacugucaggaccauuguucuggccaggaaggaguggccccguuuuuuagaguguagauuacuuaagguaguagguagucaaugggccugugucaauagauguucacuaccuguguacugacacgacgcccaguuuuuugugggaaugauggcagguaaauugggagagguacuccuuacccuuuauuucugugauuucuuuuuuggaccucugacucucagauuacagcucaagcaguuuccagugggauuuuacacuuuuauccuaauaaguuauuagcagggaugggaaggaaacuccauuuuaauugaauagcugcugcgugccagguacuagcaugucuuguuuaguuucucagcagcuguuuggcuuuaucuguuuuaaaauuuauuuaauaggaagugggacagaagagggucacagaggugaaagagcuaaaaaacaaaacaaaagguguagcucaagaucauggcagauucaaaucuaguuguuuaucuuuaagcaucuccuuuaucuaccaugcaagauugcuucuaugaaaaucugagucccaauaauauugacuauuuuauacagugugauuauugcugcuguuauguaaauauccagucaagggacugaccaguuuugugcacucuugcaucuaacuuguauuuauauauuaaucaugguuuuuauuggaccuggucauuuccuuaggucagagacaaggagugauaggugaaaggguaguggauuugaagccagaugacuuuauucuucaaguaccaugcuuggucuugauuagcugugucaucuugccugaaucacugaaccucucuagaacccuauuugcuaauuggugaaacaggggcaagaauagaaggccuuuuccagugucuccugguugccaaaaacauccagugagaugagaguaucuguguaaaggcuuuaaaaacgggggacuauacucaugggaguuuaguacuuguacuuggaaguguuaguuagaagucuuagaucucacuaucacauaaaaauuauguaaaauaucauuagugguuuucuccuugcccuuuggcaucugggauugccuuuugagacuauaucucuuuaguugguugagugaucaaauuguugauauuuuacaauuuuuuaccuucaaaaauggcaauaccaaagguuauuaguaaaauuacaaauguuaaaauauauguauuuguaucaauaucaaagaguauggcaaaaggcaaguaagccuagauuuuauuguaguuuucaaaacaaacuuuuacucuugauuuuuuucuccucaggcuaucuugaauuccauguguugaucccuagcgacuuauuaaauguuuuguguugaagaaacacuaaaggcagugaagcaucuuccccuauaauggaugggacugauggacugauguggagagaugcaaaugcuagucuagucauuuuaauuauguuaacuggaauacauaugcacacacacuuucacaguggguuauauauauguguguguguauauacacacacaguaggauauuuuauauauguauauacacacauauauacacauacacacauacauaauuuuuuuucauuuuucucuugugaaugcuuucuuuguggaauacuggcaagaaaguugggagguauaaaaaugaauuaggggaggagccaagauggcccaauaggaacagcuccggucuacagcucccagcgugagcgacgcagaagacggugauuucugcauuuccaucugagguaccggguucaucucacuagggagugccagacagugggcgcaggucagugggugcgcgagccgaagcagggcgaggcacugccucacuugggaagcacaaggggucagggaguucccuuuccgagucaaagaaaggggugacggacggcaccuggaaaaucgggucacucccacccgaauacugcgcuuuuccgacgggcuuaaaaaacggggcaccacgagauuauaucccgcaccuggcucggaggguccuacgcccauggagucucgcugauugcuagcacagcagucugagaucaaacugcaaggcagcaacacggcugggggaggggcgcccgccauugcccaggcuugauuagguaaacaaagcagccgggaagcucaaacugggcggagcccaccacagcucaaggaggccugccugccucucuaggcuccaccucugggggcagggcacagacaaacaaaaagacagcaguaaccucugcagacuuaaaugucccugucugacagcuuugaagagagcagugguucucccagcacgcagcuggagaucugagaaccggcagacugccuccucaagugggucccugaccccugagcagccuaacugggaggcaccccccagcaggggcacacugacaccucacacagcaggguauuccaacagaccugcagcugaggguccugucuguuacaaggaaaacuaacaaacagaaaacacauccacaccaaaaacccaucuguacaucaccaucaucaaagaccaaaaguagauaaaaccacaaagauggggaaaaaacagaacagaaaaacuggaaacuauaaaaagagagcgccucuccuccuccaaaggaacgcaguuccucaccagcagcggaacaaagcuggauggagaaugacuuugacgagcugagagaagaaggcuucagacgaucaaauuacucugagcuacgggaggacauucaaaccaaaggcaaagaaguugaaaacuuugaaaaaaauuuagaagaauguauaacuagaauaaccaauacagagaagugcuuaaaggagcugauggagcugaaaaccaaggcucgagaacuacgugaagaaugcagaagccucaggagcccaugcgaucaacuggaagaaaggguaucagcgauggaagaugaaaugaaugaaaugaagcgagaagggaaguuuagagaaaaaagaauaaaaagaaaugagcaaagccuccaagaaauauggggcugugugaaaagaccaaaucuaugucugcuugguguaccugaaagugauggggagaauggaaccaaguuggaaaacacucugcaggauauuauccaggagaacuuccccaaucuagcaaggcaggccaacguucagauucaggaaguacagagaacgccacaaagauacuccucgagaagagcaacuccaagacacauaauugucagauucaccaaaguugaaaugaaggaaaaaauguuaagggcagccagagagaaaggucggguuacccucaaagggaagcccaucagacuaacagcggaucucucggcagaaacccuacaagccagaagagagugggggccaauauucaacauucuuaaagacaagaauuuucaaccuggaauuucauauccagcgaaacuaagcuucauaagcgaaggagaaauaaaauacuuuacagacaagcaaauacugagagauuuugucaccaccaggccugcccuaaaagagcuccugaaggaagcgcuaaacauggaaaggaacaacugguaccagccgcugcaaaaucaugccaaaauguaaagaccaucaagacuaggaagaaacugcaucaacuaacgagcaaaauaaccagcuaacaucaucaugacaggaucaaauucacacauaacaauauuaacuuuaaauguaaauggacuaaaugcuccaauuaaacgacacagacuggcaaauuggauaaagagucaagacccaucagugugcuguauucaggaaacccaucucacgugcagagacacacauaggcucaaaauaaaaggauggaggaagaucuaccaagcaaauggaaaacaaaaaaaggcagggguugcaauacuagucucugauaaaacagacuuuaaaccaacaaagaucaaaagagacaaagaaggccauuacauaaugguaaagggaucaauucaacaagaagagcuaacucucccaaauauauaugcacccaauacaggagcaccaagauucauaaagcaaguccugagugaccuacaaagagacuuagacucccacacauuaauaaugggagacuuuaacaucccacugucaacauuagacagaucaacgagacagaaagucaacaaggauacccaggaauugaacucagcucugcaccaagcggaccuaauagacaucuacagaacucuccaccccaaaucaacagaauauacauuuuuuucagcaccacaccacaccuauuccaaaauugaccacauacuuggauguaaagaucuccucagcaaauguaaaagaacagaaauuauaacaaacuaucucucagaccacagugcaaucaaacuagaacucaggauuaagaaucucacucaaaaccacucaacuacauggaaacugaacaaccugcuccugaaugacuacuggguacauaacgaaaugaaggcagaaauaaagauguucuuugaaaccagugagaacaaagacacaacauaccagaaucucugggacgcauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaaaaucggagcagaacucaaggaaauagagucacaaaaaacccuucaaaaaauuaaugaauccaggagcugguuuuuuugaaaggaucaacaaaauugauagaccgcuagcaagacuaauaaagaaaaaaagagagaagaaucuaauagacccaauaaaaaaugauaaaggggauaucaccacugaucccacagaaauacaaacuaccaucagauaauacuacaaacaccucuacgcaaauaaacuagaaaaucuagaagaaauggauaaauuccuugacacauacacucucccaagacuaaaccaggaagaaguugaaucucugaauagaccaauaacagcaucugaaauuguggcaauaaccaauagcuuagcaaccaaaaagaguccaggaccagauggauucacagcugaauucuaccagagguauaaggaggaacugguaccauuccuucugaaacuacuccaaucaauagaaaaagagggaauccucccuaacucauuuuaugaggccagcaucauucugauaccaaagcugggcagagacacaaccaacaaagagaauuuuagaccaauauccuugaugaacauugaugcaaaaauccucaauaaaauacuggcaaacugaauccagcagcacaucaaaaagcuuauccaccaugaucaagugggcuucaucccugggaugcaaggcugguucaauauacacaaaucaauaaauguaauccagcauauaaacagagccaaagacaaaaaccacaugauuaucucaauagaugcagaaaaggccuuugacaaaauucaacaacccuucaugcugaaaacucucaauaaauuagguauugaugggauguauuucaaaauaauaagagcuaucuaugacaaacccacagccaauaucauacugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaagucaaauugucccuguuugcagacgacaugauuguauaucuagaaaaccccaucguuucagcccaaaaucuccuuaagcugauaagcaacuucagcaaagucucaggauacaaaaucaauguacaaaaaucacaagcauucuuauacaccagcaacagacaaacagagagccaaaucaugagugaacucccauucacaauugcuucaaagagaauaaaauaccuaggaauccaacuuacaagggaugugaaggaacucuucaaggagaacuacaaaccacugcucaaggaaauaaaagaggauacaaacaaauggaagaacauuccaugcucauggguaggaagaauaaauaucgugaaaauggccauacugcucaagguaauuuauagauucaaugccauccccaucaagcuaccaaugccuuucuucacagaauuggaaaaaacuacuuuaaaguucauauggaaccaaaaaagagcccguaucgccaagucaauccuaagccaaaagaacaaagcuggaggcaucacgcuaccugacuucaaacuauacuacaaggcuacaguaaccaaaacagcaugguacugguaccaaaacagagauauagaucaauggaacagaacagagcccucagaaauaacgccgcauaucuacaacucucugaucuuugacaaaccugagaaaaacaagcaauggggaaaggauucccuauuuaauaaauggugcugggaaaacuggcuagccauauguagaaagcugaaacuggaucccuuucuuacaccuuauacaaaaaucaauucaagauggauuaaagacuuaaacguuagaccuacaaccauaaaaacccuagaagaaaaccuaggcauuaccauucaggacauaggcaugggaaggacuucaugucuaaaacaccaaaagcaauggccacaaaagccaaaauugacaaaugggaucuaauuaaacuaaagagcuucugcacagcaaaagauacuaccaucagagugaacaggcagccuacaaaaugggagaaacuuuucgcaaccuacucaucugacaaaggguaauguccagaaucuacaaugaacugaaacaaauuuacaagaaaaaaacaaacaaccccaucaaaaagugggcaaaggacacgaacagacacuucucaaaagaagacauuuaugcagccaaaaaacacaugaaaaaauccucacuggcaucagagaaaugcaaaccaaaaccacaagaagauaccaucucacaccaguuagauuggcaauaauuaaaaagucaggaaacaacaggugcuggagaggauguggagaaauaggaacacuuuuacacuguuggugggacuguaaacuaguucaaccauuguggaagucaguguggcgauuccucagggaucuagaacuggaaauaccauuugacccagccaucccauuacuggguauauacccaaaggauuauaaaucaugcugcuauaaagacacaugcacacguauguuuauuguggcauuauucacaauagcaaagacuuggaaccaagccaaauguccaacaaugauagacuggauuaagaaaauguggcacauguacaccauggaauacuaugcagccauaaaaaugaugaguucauguccuuuguagggacauggaugaaauuggaaaucaucauucucaguaaacuaucgcaagaacaaaaaaccaaacacugcauauucucacucauaggugggaauugaacaaugagaucacauggacacaggaaggggaauaucacacuccggggacuguuguggggucggggaggggggagggauagcauugggagauguaccuaaugcuagaugacgaguuagugggugcagugcaccagcauggcacauguauacauauguaacuaaccugcacaaugugcacauguacccuaaaacuuaauguauaauaaaaaaaaaaagcaaaaaaaaaaugaauuaggacuuaagaaguugcauuuucuccauuuagagagucauuuguugacaagagucacaguuuuuaaaaaagcucugccuucccuuaguugcaguguucuuauaauguauucagaagacagggcuccuuuuaaaaagauuuucuuuuguuuacuuucuuucuucuucuucuucuuuuuuuuuuuuuuuuuuuuuuugccugagaaauaaucuggaguagauucuaagcauguauauuaaguuucuaaauuaucuauuagucuagauuuuuggaaauuacuacauaauuuauagaaaaacuacacaauaauauuccuuguccuugccauccacaaguuaaaacaaaaaaugcuaugaauguuuguuauuuaaauguuuaacgcucagaggaagcaaucagaagaaccaaggaaaggaaaauuaaaaccuaagacacuaauaaaaaauaaaacagcaacuaugagaccuauuuaauuccuauuucuuuccuuugaaaauaaauugugacucaccauuaaauccauaccagugacccaugcauuuaauauuuuagagaagacaucacagcugccuugcaugaaguauuucaccuuugguuucauuauuuguagaguuuuagcauuuugugcuuuuaaaccaaacugucugguuuuuguuuucuuucuucaguauauucguucuuuauuggacugucuuugcccugagauuauauauaucauaacccagcuguacugguccacuuuaucauaccaaauacuaauuuugucacuacccacauacccauccgacugucuggauaauaaguauuuuuaaaauaggaauuuccuaaugccuaauguacaagccccaugaaaggaaaucaugccuuaucaaauuaaaaaaggauacuuacaaggaaaauuuaacuagacuugguuuauuacuugaauuuggaaaagucuugcauagccuauaacucugugacuccauccauuaaaaaaaaauuuaggaugucagcaccacacaaagccauuuuacauuguaaucacaaauauuauuuaacuguacucugcauuagauggaauuuucuuacuuaccaauuuuuccagucuuuuagguucucuguaggcaagauaggaucagcaacugaguguagcauuugauguugagggaaauagauuuugcucucugcuggacugcucguguugaccagugggaaacacugcauuagcuuucaaaucaaaacauuuaaagugcucucugaaauauugacaucucgccaaaugcuugaaugucagguacuacagauguccaguauucuuuggagcccagcucuaauauaugcuugcauaaguuggaccugauuuggauuugcuuaggguuacagauuagcacggcuugaccaaauaguaaauaguaugaaaccagcugugaaaagggagacugagcaagugagagcuccagccagcaggaagauagaucuuucccaugcuuguuuaugaccuuuuccugugaagcuguuguaauaauagcuucuguauuuauugggaaguauuuuuaaguuguaauucacaugguuucaaacuaauuccuugaaauuaguuggaaaaccaaaaaauauuugagaguaaaacaucugcacguuuccuucuuucaguaccaggggaggaggcaggaaagcuguuuaaguagguguuaacuugggggucuugauuggugcagggcaagauaacugucaaaugagaagagauauugaaaggaccccaagacuaugcuaucuccucugggacuugggggauuugcuccucuagacuuauccuggucuagggauggacuugaugcaugccaguaccucuucuacuccaucuguuauccugacacauuuccagccuugaaugggggcuuuugggucuccaaucauucuucguauuacuccuugacuuaaaucugguuucacaacauucuguuucuguccuggguuguuacuugaucccaaugccuggauauuuccuucuuuaacaaguucuuccuggggauuucugaaauuaugcucuggauuaauacagucauaauacaucuuucagaaggaaaggccugagucuccuauacuccgucuacuugaauucauccaguuuagggccuauagcaucaacuuuucccauuuuaccaguuucuuuccuucuguccuagagaggcaugcucacgaucaaucaugccuguuaucauuaucaaauaaaauaaagcgaaaacccucaaagcucucccuuaaaugugaauccucuuuauuagcaaucauccagucgguaccuuuaucuccuuauccaaacuuguuggaaauggucugcguuugcugucuccacuuucccauucacucuguaaucuaguccacucugccuucuguccucagcacuuaucuagaacugccaaagaccuccucauugcacauuccucaauccaauugacauuuugaaagauuuuuuuugucuuugagguagcuuuuuugggauuguggugaaauacacauaacauuugccaccuuaacuauuuuuaaguguucagugacguuaauuacauucacauuguuguguaaccaucaucaccaugcaucucuagaacuguuuucaucuugcaaaacuaaaauucuguacccauuaaauaauaauucuccauuuauccuugccccuagucccugguaacuacuguucuucucuacgaaguugaauacucuagcuaucucauagaaguggaaucauacaguauuuguccuuuuuugacuggcuuaauucacuuagcauaaugucuuuaagguucaugcauuuuguagcaugugacaauucauuucuuuuuaagacugaauaauauuccgcucuauguauauaccacauuuuguuuauucaucuguccauaguccuuggguagcauccaccuuuuggcuauugugaacaaugcugcuaugaaaguggguauacaaauaucugcuuaagacccuacuuucaguucuuuugguuaugugcccagaagcaaaauugcuggaucaugugguaauccuauguuaauuuucuaaaggaauugcuguuuuccauagaggcugaaugaaccaucuuacguucccaccaacagugcacaaaggugucacuuuccccacauccuugcuaacacuuguuuuccauuuguguguuguguuuguucuuucuuucuaguaguagccaucuuaauggguaugaggcauuaaggcagcuuuugaugaugauucucucugugguacuuuggcauacugcccuuguaccuuucugacacuguucccuccaugauuaagggcuugcccucaaauguugauguuuuauggauuccauccugagccccaugcuuuugccuuucucugcccuugcccugcccuguuagcacuugugacaucucugccagcaucucucaccaccuugcaccucuguacacuguuguuccuugcaccuuucuacccagaugcuucuuggguucuuccuacucaaugugucucucucaauuugugauaauaccaucuacccauuacccaagcugucaacaauuaaacacucugucucauccauuccuagccagucaaucuccaaagccuggugauuuuuuuuuuuaugcuuaaauauuucuugacuguuauucccaccaaaccucaggucauuuuuugucuguguucccugccuucaaucugccucccacccacaggguguguccuccacucacccgugagaggaaucccucuaaaauacaagcagcacugugucccuuuugugggucucuaauacuuaaaagauaaguucaugguguuuaauucaguagagugcucugugauuugacaccucuucuuccaccacuauuugccuuggucuguauaucacagcaacacucaauuguuugaacucucugugaauaucugugguucuugccccauugcuugggcuuaagaucuuuccucugccuagaacagcucucuggaauaauuucucuucuuucaccuggcuuauucugaauuugaauugcauuuuaaaaaauuucagcuauuuguguacuugcuucucagucuuuauuauauccacaugccaccugaucuguuuauaucugauauuuauguacauggaaucaccuuaaaaauuaaauguuuacccucauccuaaguaaaaauagcuuugaagucacagauuuugauucuuuuaacauaccuugaaauuauuacauaacuguguaauuugucugaguucuauuuaaccuguguguuuaucccuguggaaacauacuacuuucagaugcaguuggcccacccuuuccuaugggagguuauuccuggaccacccauccccucccucccuaugcaggauaaacucaccuuccuguguuaccaaaaaguacuauuaauaucuccauucauucaucuuucuauccaucuguuuauccagucacccaacuaauaauuuauuaguaaccuucuguauuaaauacugugggagguacaaccaggaguagugcuuaacuuguuuauaccuuguguuccauuauugggacacuaagcucaugggaguuauucauauccuauugcucauggucaucgcuaagaucugauuuuucauagaaaauaauugcaacuucuggcauaaauacugauuuuuaauugucugccaguuguuucucccaacuagauugggugagcuguugagagccagggcagugucuuaauuuugcaucuuuggcaccugacauuuuuauucauuuaauuaaaggaauauaaaaguaaagauguguugcuuccuuaauuuucucuuucaaguuuuacuuauacuuguguuucguaaaugauacuucuaaacauguucauaaaggccagagugaaaguaaaaaaguaaaaguuaauauguucauuuuuauuuuugaaggcuuaugaugcaugcaaauagacugucuuuuguacauauucaguuugcuaugcaggaguagguuuguucauauguaaucuacuaacuuaucuacuaacuagauaaguucuagaacuuaucuagaaaaccuugaguaaaauguguguauuuuaaccaaaacugguauuugggguuguguggaucaaaccuaguccaauuuuauugauuuaaagcaaugacuguaguguuaaaaggagcauguacuacauuaaaaugacauagggaauguguauacauuuaggagaauauuuauuuuaagggaacuugcccuuaaaauaaauauuacaugucgugagcuaaagggagaaauuauguugccuuaaacuaaagucccugucuuuugaguucaacacucuugggaaauuguaaggaaaauguauuaacagaauccacuagcaugcagcuaaggacuucuggagaucuggggucaugacaggcacccuguauagugauauaaaugucagugucugagauuuaagagccuguuccgagaaaagccaacaaauauggagaguauauuccuauaaaugaguuaauugagaggcacguauacugcacucaaguuuugcacugugccggaaaccauugacugucccaggggccuuccgcucuuaccccucacuccaguuuagaguggagcaacagcagcauaagauacacauuuuaauauggcuuagaucauguucauuuccaaacacaccuucuguucucccuccucuggccuuuguugggccguuuccuaagccuggcaugggcccucuuaaauuucaacuuuaguggagcuuuccuuuauguucuuacugagaaugaaugguuuuccucucucugaauuccuauagugcuuaauuuaauucuacuuaggccaccccucaggcuuuguacuguaucacagauggugauggcugugucuucugauuuuuucuuuuuuugugaggggguggguggguauuuugcugauguugccccagucucauucauggagucauuuggcuugucuggggaaugggguggggcaggugacuuuuuugcagccucucucauccauauugccaggcuguccaggauuacuuucugggcuugaaacauuguccuuuugcugagagcaauccauggacaccugacuccuaagacuuagcuccacugaaaaaggucuuucauauccaagaaggugauuuaauuuaaucagugaggaccuccacuacuuuuuuuuucuucuucuaguccaaggaauggauacauuugauauaccuucuuuuuguuuugauuuuuucuuguuuuuuuuuuuuguuaauuuaaacuuuuaagauuuaucaaaguuaugcauuuguguacuuuaagaaacaauuuaaaaaaacauauaaugaaaaaaauagaaguccauacccuuuucuuaugcccugguagccaccucuuuuuccuuuuaucuauuuuuagguauuagugccuguauuucuuauguaacuggagguucuuggcuuuugauagugucuguugacuuccuuguguggaagaugaggauuuagcucacugugcacguuucccuuuaccagauaauuauguccacaauuuuuggauaaaucagcaucuuucauucacguaacuagagcuauaugaguauuauuuauagcagaggcuuaacauuuacguuugaaggauugcaacucccuaauuucaucuagugaccaggggaaaccuugcugucuuggucuaaugagggcaggcuucccucuggguucugccugcccauuugcccauuuucccauuuauaauuaguugagauauguaaacaugcuauauaaauguuagcuguuauuauuucaauauuauaauuugaaccaaaccuuauuuaaucuaguucuuagcuauacguguauguguaagcuuaaaaguacuuuugugaacagcugcauuuagagagaaaugugaaguccaagugcauguuuaugcauaugauaaaacuuucgcagcauagaugcuucuuagcauuacaacucaacaggcagaggagauucguguugacaaaugugcuuguuauuaauaacuuuguguuacauuucaccggagagaccucuagcuuaccaguuuuaggccuuuugcuuuuggcagguugcaauuauugcugucuuauaaaugucacauacaugauauauauacacacuuccaaaacuguguuuuucauucuugucggaauaguugagacuugucugcuaccaaaagucugagucagauucugauacuuugccuugcugcucuuuuuuuuguaguuuucccagaaacuuuauauuauacuuaacaauauaaauauaguauuauacucauaauaagcgaggccuuugcuuguauucauuuaaaaauguagagaagcgcuuaaaagauaggaacuuucgagucacaaauaggcaggcugaagauugacuuauggaauugaugaagcuguugggagaccaauuucauguaagaaggagcaaucugaggauagaacuaucagccauauaacaggggaugugagagggauacagugacuuccauuuguuuguaaaaaugcuguuuugggauuuauacuaauggguacccuucaugugugacaugcagugugacuuaaauaucuaccuuagcuuuugccauaguucaaaaguugggggagggaguuucuagauaaugagcauccaguagaguagacggaaaguccacggcaguuaaauugcucagcagaaaaggccagggggagggggcugggggugcgggcaggcgguuuggguauaaaugcccaccaacuuugguucugccauggcuggggaggagggucugugcugcuaugggccuuuucagacaucucuaacugaacacacgcgauuuuuccugcagcuucccuucuauaguggagcuuagaaagucuugucaaaacuggccccugagaugaaaccuuuggccaucuuaagcuaguguuuuauccaggacaaaugaagaaaaaauacagcgaacuuguuuacuccagcauagagacaaagucaggauuagauuaauugugauucuuugcaguuaaugcuacauaacguggcauauggaguuaaauuuggauauacaagccagcagcacugccuuguauaaaccaggagaccucaggcugguaauguaaucucucucaaucuguuuccccaucugcaaaaagagucuaguacuaccugcacuauuaaaguuguuggaaaguuuaaaucacguaagguguauuuucuuacuauaaugccuagcucuaaggucaguaaaugguagggucucuuuuuacuaugacaggcuaauuguuccuuuacaaugcuuucaaaacugcaugguucaacauaugcuagauagaaauacagugcuaugcuuuguguuuuuaaugaauauuaauuguuauggaaagagccaaauuugaguaggucuuugacccagccacugugguuauaggaaggcucuuuuagauacauagcaauacauaacucauggaaaguauuuucaaauuauaaaucuaauacaagaggaaauaagaucucauaugcaguacccugguaaacucaaacuauuacggauggggcacacaugauggagugcuucucggagcuuuacauuuuugccucaacaugccuaagguaauaggagauauucucaucugugcuuuacucuguggucucaguaaggaagggauggagacacauccaggaucaaccagagcugguggucuuucccuugguccccauugccagucccacccugucuccacagggagugugaaugaggauggcuccaucuuucuucccucuugucaaccacagaaauuaggguuuugcuauuuuuuuccuaauguaggcaaaacaugugguccuaaaguaccucuccauugccagaaaucacaacagacugcuguccuacaggaaagacaaaagcuuauuacacuaaagaugaguuucucguauuuuaagaucuaagagaugcuaaauaauaguaaaggcaggaaacauuuauuuuucuuagguaaggagaacaaaaacucauacaagcagagcauuuuguuaauacuuuguuaguucagcugacugguuauuaauccagucuguuuuuuuuuuuuucuuggugggaaaugacagagguuuuuuuuuuguuguuuuuuuuuuuaaaugggucauggggaaaauaguguuugaauuugcuaaauaaucucuugccauuugccaaaucaaauaucacuuaucaaguccacauaugaaguauguaugauuugccaggaguuaggauacuuaacccuguauuagaagcacauggauuugaaaacaacagaaaagcagcacgauacagcugcuucugagauacaagaaaugguguaguuuuaaaaagaaaugcuuaugagagauuuuagacauuuuugagcuguuaaguuuucuagaaccauuuggaaugauuuugaagugaccucgccuggaaagcauauuuauguaguuucuuucucuguaccacuuauucuucagcuucaguguaauucucaguuuacuguaugccaguuggcauguuguaguuuaaauauuuucagaaccuuuccacugcguauuaaucucuuagacaguugaaacauuuguugaccuguaguccuguuuuuuuaaauuguuuaugugagaaacaauauaucugaaugauuaagagcauugucuccagaauagauugccuuaguuagaauaccggcugaguuacacauuagcuuugugucauggggcacauuacuuaaccucucugugcuucagcacccucaucguuaggagaaucuguacaaaagugauuauaauaucuacuucagaauacuguugugaggaauauuguucuguaugccuggcacauagaagagaaaaauaaauauugucugucaucaguauuauuucguauauggagaacugaaaggagcuucaagauuugcauugugugggcuuucauaccaucuucaagagaugauuuuuuggagaaaacaugcuuuugaaauucaguguaaacaugguauuuauggagcuauaucucacaacaauuuuccucuggcuuacauuuuagaccaccuuuuguucaagugucauguggaccacuuggcuuagaugagagucacacaaauuuuuauauuccaaguuccuccuucucucucccuacuacagccuuugaauggcaauuaauauugcugcuuccuuccccaccuucccucucuagcuucuuuuaggcauuuuguaaauagauaacauaagaaacaauuuguuuuggccacaaguucaauuuuucuggcauaaagcuguauuuauuuuugauauuccugauuaguaaaggugcaagcccaguaucuauaccauuccaaucugugggucccugaguugcuccaaggcauuuacaggcaaacuccugggauucauuuucuuccacaggcccaaagugggaguuccgauaugguaugagaccacugugagauggauuagaaagaucuggaagcuagaugggaacuagcucgggcauaaucaaguacucuugacccucacaauuguugcuuucuaauauaauuucacuaguucuucccacuuucuuuaauucuguuuguugucuuguugcugacaaaauaauuuuuaguacuuucuaauguggucauuguguauaaaccaggugaagaaaauuuucuguuauuuucuugaagaauaaaauaaaaagacugauucaugaaaugcuaucugaggcuggcccuggguuaaauuccaggguaucccuugcaacagaacaaugagaauuuucacauucuuagcuguuuuuuugaaugacugcuaaaucucuagggcuguggugcauccugaggaacuugaggauuuuccuuuucuaccuuuguucacuuuagaucuagccucaacaaauaaacauccuugggcuuuuuaagaguccagccugaucaacauggugaaaccccgucucuacuaaaaauacaaaaaaauuagccaggugugguggugcaugccuguagucccagcugcuugggaggcugaggcaggagaaucgcuugaacuugggagguggagguugcagugagcugagaucgugccacugcacuccagccugggcgacagagcaagauucugucucaaaaaaaaaaaaaaaaaaaaaaguccuucccuacucuaagguagaggaggcuuuguggaugggagcuguggauucagguugugugugcuguuagccucugcaggcuucgccuuugccaccugugaaauggugcugauaaguggugcugcacacacauauguaauauguauguauuuacuauuagcaauaaaucaaauuuaauuuuuaaacgcauuugggaaaugacauacuuuaaauauacuggaauaaggagaaccuuuuuuaacacauggacugaaagguucaccuaagguggugccucugcauauuucaacucuuuguguuugauuaguuauccugcuguaggauuacggccacacaacucucugagaacaaugguuucugugaggugcuaucaaccucuggcuuuccuucagaaauaggcacuccuuuugaacuaugcuauauuuuucuuaaagccuuuaagauuuaaggaggaauuuucugaucugagguacagaaccccaggaaauacuuucagugagauuuuauucaccaaaugcuuaaccaguacugauuuggauaggguggucuucuaacuuauuagucaaccuggacacuuuugagaaugaaaagaggacuuaauuacauggggacagcaggagugaacugggucugucucaggcaaacugggguauguguucacccuaagaauaaguagacacuggauaaucagaauaaacuuuucaaauacuaaaaauuuuuugcaagcucaggucuucauaaacaucugaaaaugagccucaagauagguagguuuuacuuugucccucuuugcagugaaugcuacuaugugcaaauuuauugagcuucuacuguguauaaauacucuguguuaaucuuucagagaauucuuccacuuaaacgagcucauagcauuuccaaacaaaaguuuagaguccugguuuauaguucuugccccagugcauucuuuuuucacucuguuuauucuauuuuaaagcugauuccuucaugacgucucugacuguguuaguucauccuguucuguccuuucuguaauccuuguauuuuaauucuaaguuuggaaaccaauccccuuuugguaugugguaaauauuuucuucaugugauacauaaaagauugguaggcauugugaaguggggagcucggguuauuuuguauuuuguuuuugucaaccacagcauucagcucacugcuggggauauggugaugggugggacuggggacaccauuggugggcuuaggguagcagaucaugaguguguuucaguuguggaaagaaugagggcuaguaaacuuaauggacacgguguuuaaaaauaaagaaaagagccgcaacgucaccuuaucuagccuaauuaaauuguauggacuuucuguuaagaguugauacagccaaaaugcauuaugaacuuauguuaaccucucauuuccuucuuaaucuaggucuacuaauaucuuuuaaaagccaguuuuuguuguuguuuguuuuuugagacagggucuugcucuguuguccaggcuggagugagguggcaugauaguggaucacugcagccuuaaacuccuggguuuaagcaguccucccauauuagccucccaaguagcugggacugcaggcguguaccacuguguccagcuaauuuuuauauuuuucauagagauaggggucucacaauguugccguggucggucucgaacuucugaacucaagugauccuccugccacagucuaccaacaugcuggaauuacagaccugaaccacugcaccuggcccuaaagcugguuuuuaaugacauuuuacauaaguacagcucaaugcugaccggcuuuguuucccagugaucacuuuucugagguuuguagguauuuggaccuagucuuuaaaagguaaauaacuguauucuuguaaauaacuguaaucuuuuuuuuucucuucagaauacuguuccugccuuaguuguauucagacuaaauuauacucaaagcugagacguuuccaguaaagucaacauuuaucuuuaucuugacggcgucacauccauuuuucuggccuuccaguuuccaucuccccagacugauuuccuugaugguguggauguguauggugucuuugguucuguguguugcagggcaagcauggccugaggaucccuguguguuuaacaauggaaugucaucggcuuuuguuuuuuuggaggggaagcaucuugauuuucagggccauguuuauuuaugcauuuaauucugaaauaagagggggugcaauuuuauaaacuaaauuauacuguuccccauucucuuuuggaaaugcccaugaaugagacagauuagagagguauuuugcaugaacgaaugauggagagaccaaaaaaaaaccccaaaaggcagagguggagauacauucacagccacaguuuuauccuaauaucaaagcugguuucuaaucuaauaggauauaaggaauaugauaauauuugcaggauugaacugauagucaaguguagccuaccuggaauuguggaggguaagagggaugguggccauggcuugcuagguaauuccuggguaaguaauggagaaacagccauuaguuuucauacauuacuuccguuagagagguugguugcuuaucuucagaauaaaguaaaaaugcccacauaacuccuuaagcuggugguucucaaagugugguuccugggccuggaucagcaugaccugagaacuugcuggaaaugcaaguuacccaagacucccagacaccuccauuccugaaacucagccucuggggagggguccagugguacgugguguuuuguuuuguuuuguuuuguuuuguuuuguuuuguuuuuguuguguuguguuuugagacagagucuugcugugucauccaggccacagugcagugguaugaucuuggcgcacuauaaccuccaccuccuggguucaauacauucuugugccucagccucccgaguagcugggacuacaggcguucgucaccaugccuggcuaauuuuuuuguauuuuuaguagagacgggguuucaccacguuggccaggcuggucuugaacuccugaccucaagugauugacccgccucggccucccagugugcuaagauuacagguaugugccacugcacucagcugaagggguagauguuuuaacaaacauguuaaaguuugagaaucacuguuaaaacuacuauuuuuuaauagcuuuggguuaugaauaccuuucagaauuuauugaaaguuagauagcuagaaaaauguacagacacauuuuauacacuagcagggaauucaugaacucuccugauuaaguccccuguuauaaaggaaacauuuugguuucaggauguaucccaucagaaguauuagauuuuaagucacacuagugauaguuuggauuugagaauuugauuauuguucaucuccaguagcaugaguagcccuggacugugguuugcccccaacuuuuugugggaagaauuugcacacugagauaucuccagacauuaaugcugggcccuguggugaauguaaacaugguaccuaugggguggcccugacaccuggcuggcaacagugggugccugcuugcucagccauagacuuuacauaguucagccuuuuggaggucccugugccagccacugugaaggaaauuuggugaggccuauguuaaaagcuuaguuuguauauguguuuuuuaaauuuacuaagggaugcaugggcaauguaaauacauuagaaaauacagaaaaguagaaagcagaaaauuaaaaucaccgacagauuuauucuuggguaaccaguuauuuuguugcaaaugguaaaaugcacuaggaagauaacaggaauaauaauaauaccuaagacuuacugaguuuuuauuguaugccagauacuguucuaaauuccuuauuuauauuaacucauuaaaaccugauagcuucuauauaaaguaaguccuguuaacgucuccucaguuaaaugauagagggcaguaaggcuuggugagguuaagcauuuugccugaagacacguagcugguaaggauuugaguugaggcaggggaagccguaguucucuagggcaucuuaacauguacccucugcuggucuuuaggaggaagagaaaacacugcaaugaaugacugucgcgugggguggcguuggggaagagacccauguaggaguacaugggguugacgagugaggauuaggacaugucugcaugggcgaagugggugcagagauggaucaacagcugaggagugugcacaggcccugugcuuuuaggauggcccagcacccuuuagugauuuggcuaaucagccucaccuucagcuaucuuccaguccuuugucaucagcacgugaaacugcugaaauaaugccagcugaguggaccuccccagagugucuuaaacuugugagcaucuguuucauuuuaaacuggauaacauugcauuauuacaaacauguggaaccagaaggaaauguacaaaugugguguucacaauuugcuaucauagugaaggcugacagaauuaucauaagucacugagccuuuaaauaacauuuguuuguaaaguuguuuuguucuuugauuuugaguuuaaugccaacuugggucauaucaacuuuccaaaauaucaugagcuuuacguguuuuaucguuaauuuaauuuuccuugaaauuauuucccagaacaucaaaugggaguuuuaaauuuuuuaaguguuauuugaaagaaacaauccaagaaaaaauuaauuuaacauguucagugaauaaggacucaucucuaagagauuaauguaauauagagauuaagaaugcaggcuacaggguuggaauuccuggauucccguaccaccccccccacuuaucagcucugugacucuugguaaaauaccuaacucaucuguuaaaugguaauaauucucuuuaccccauaggguugugguaagagugagacaauacaaagcaguguugaagucagugcaggguaaaguguggcacagccuucaguuaauguuaggaauuguagaaaggcagauaacgauggacagaggcugagaucucuuaccaccacuccuucccucuccccuacccacuuaacaguauaucauggugacuuuuccauuucaguuuuuaaaguucugccuuuuucuuuugaguaguucuacuucauuucacugaagaaaagaaucauaaccauuuuucuguuacuggacauuuggguuauuucauuguucaguguuuaaagaucucuguacuuguauuuccuuguucccucccacauuccccuaaaaucuuugaagguuguguuuugagguuggucuucaguacagcugcuguaauugauuucauuauuuuguaagcacuuguuugcugugacaucaaaaagaguuugugcucacuuagcauaaaauuaaguaauuauuggacaugccaucuuuuaaauggaagaacugaacucuucucacgagggcaguaggaguguauuuugucaguuaggaaagaagaaacugcuuaagagcuuuuauugaaaacgccuuauggccugucucagaaauucaaaccugagcuuauuaguugguuuaugauuguguaaagcgcacaucucuaagauaaccauaacccaguauggagaguuuucucauuuauaguugaugggguuucuuucuccugaaauuguuucccucaaauugcaguuuaauuuguguauuaaaaacugcucugucauaaucaaugcugggagcaggagccuccugugaccuuccagccugugcccccuaccccagccagcugcaagaaggagcucuaaaaacacaaauuaagucuugcuacucccuugcucaggcccacccagugcguguguguguauguguguguguggucucaucacacuuagaaaacauccagaguuuggucauggccugcauggcucuacaugaccagcuggcccugccugguucucugacuguaccuccuguggccacugccuugcccuucucuuguagccacacuggccuucuugcucuugcuccuccacuucaaagauaacacacccaucuucuccauuugcucuuucucccucuuugucucccuuauuucuguucugaucucucaucuucaugaugauuucuuccucucacccuauuuuccagaacucgccauuauguccugccuccagccugcuagauuauucuucagugcagaaccacuuguuaugcugugugucgccagcaccuagagcaguaucuggcacaguggaaguauucaguuaauaaugguugagccaaagacggaauaaacaaaggggagcuacucauagaauauaauguacgaugcucuauucugagacuuuaaauagucaucauggaaacugaguagaucuuuuggcuuuuaaaguuaaagagaucaggaaaauaaaacuguugaguuuauuuuucccagcacagacguggaauuucugagaauuuuuuaaaaagcagaaguuucacagacugauuucucuuuuuugaguaucauuaucuucugcuucuuuacucuuauauuugugucuuacaccaugagagccuuuucgagucuuuauucucaacugcccacuugccggucacugccaucauccucccuaucuccucucaaaucacugaugacagauuuucaguuauauucaggguuucucucuaagaaaauaggcaguauacagcaggcucaucauaagaauauuccuuuuuauacggaggaaucugaguagguuuuaaaauguuucuuggcuggcuucuggcaguccucauaggccuucugggguuccagggagacggaugguguccccaucucagccucaccaagaguauaguauuucugguucugucuuauguauugguaagauuguguuuguauaaaaaaauuucucccugcaaauuaaagucagaacaccuaugaaauuggaagggucucuugguccuuuucagggaaucauggaaaggcuuggagcagagucuugcggcccugagaauugaagauggcaggcaaagggcaucagcgcugggcaagucugauuaguucugguucaaagaggcauuuaauuguugucugugccuucagguugcucaguuacaagaguuucugagcuacugacuuagauucgacuuggcagugugcacaggugcccuuggcuuugcugccaucuuuccccuuucaguuccccuuucuccuuagugcuuuuguuugcagcacaacguuguuacggcaacuuuaugcuaaugaugcugcugccucugugccuuugaggaaggcucaucugauuucuguuaaauaaguagaugucccuucaugaccucaauuuccaagguauucaacaucuucuauuaaaaugagaacaugaacuuaucaaagccaaaauguuaacaaauuugugaaauauuugaacccuaucacugcaugugucuggaaaucucaaacagaagagacuuuuaggaucacauuuacaguaucauccagauagaaagcaguuuaguguugagcgaacggacuuaacauuaaacacagguugccuagacucuagacauuuuuuaaauuauauuuuuacagaagcaguuguauaauagugcaguccuuuuuaaaaaucgcguuucaauuuugacuuccaccuuagcguuagcuauaagagauggggguugcugucuuauuuuccuugaacauucuuuccuauucuaguaccuugaagauuuuaaguaaaugaaggaguggaugagcaagugauaugaacauaucaguggaaaggaacuccagccaugggaggaaagcuuugggacuugguggcuuggcacagggaaaaauaaagcauacaugcaggaaauaguuagcugccugguaagaagaaagacuaaggucagagcaaaaaagugcuguagauguccuacgaagggaaaacuuccuucuccugggaaggaauugguaugcugucaugcccagcauguuguaggagucuguaacuuuuauaaacccccaccuucacaugaagucaauccauucuguccuggaguguuuucaguaugguuuaaaauggauuuuaugggauguuuggauuuacuuuauacauaguguugacaaauuacaucuauacuguaaaguacaaaagacuuuuuccuaauuuaaaauugucugggcagcucauucuagaguucauuucuugcguguuagaacuccuuacauucuugaagugaaguuuauuuugacuguuuacaggaacuaucaacuaaacacuucauggaagaugugacuuaugacaguauuccuuacugggagauuuuugcuuucuuuauucuuuuugaccuuuggcugugaaaaggauuguacauugucauuuagaaaggcauaacaauaaugaagugcuauuaaggaaaugguagucauugaaauacuucaugagaaaaggaauuuaaguguauaauguaaucaaauuuaaguagcuaaucacaaauccccuuuucuuuuuagaaagaaacaauaucaagguuauauguuacuuucucuuuuuucacccuaaauucuaagccacuauugauuaucccugaaauguuagcuugugaaucuggguaauuguuaaaaacagaaaagugcaagcuacaaaugagagccucgguccuugcuuagauguaaauaguuuuccuaugaauuuaaaacauuuuuuuaaagccaccuaaauccuauaaaauaaugccaguguuucaggcuauagaaaaugucucuugagaguaauaucuuguaacauguauuacuuauauauauaagucaguuuucaacagagcugcugugaauuacuguuuuauggccuaauucauuaaaaagaauugccuaauugugguguagaaacuuaggcacuaaggcagaguaauaagaaaggaaccuugcuaaaacauggagcauguuuuggcugaauaauaucaaggaaacagcugucaaaauacaguguuugagaauagcuuuuuaaaauuucuuuguacguagaguauuuuaucaguugcuaaguacuuaagaaaugcgcuauuauccuaauuuaugaauuucuccaaaugccaguaaaauggacaaggguaauuuuugcucuuuuuagucuuaugcguucuuaguaaagucucaaggaaauagcuggaaaugcucuguuuuaauaugcaucggugguagucuuuaaacagugggaauacuucuuuuuauguuuucagcuuacauguuuucaauacaaagcauuaauaaaacauuuuuuaaagcuaccuaaauccuauaaaauaaugccaguguuuuaggguauagaaaaugucucuugagaguaauaucuuguaacauuuauuacuuauauauauauauaagucaguuuucaacagagcugcugugaauuacuguuuuauggccuaauuuguuaaaaagaauucagucuaugcuaaugacaugguaauuuucuaacauauauacaaagaggaagaaaauauggugagcauacugcucuccauuuucugugcugaguuaaacugcuauuuguacagaaaugaaacuggauuaucccugcccuagucaaggcauguccuaggcagaaccauaacaugaguucuaaauggaagcuuccagguuucuccauuuugucuaauuugugaguuagacauuuugucaaauuuugccuaauuuguuucaaauuuugucuaauuugugaguucauucccauuagugguuuuuuaaaucuagaauguuacugaggcugagcauagagccuuuaguaagcuuugaaaacacauuucuucuaaccuauagggcauuuauaagugagucagcaguguuuacaaagcacuuguucucugcagagagcuacuaacagaugaaauggaggaaucaaggaagcaauuuaagauguaucauagaccuaaagguaaaacuaagaccacaaagcuucuagaggaaaauguaaaauaccuucccaaccuucgguugguuuuaguaugcaaaauuuuuuagccacaaaacaaaaaaaauuaaguuuucugagcgucuuccugacgagaaagaagaauuguggucugguucuugaacuuuccuagcggugugacccccaaaaccaagacuacuuccugcucugagaccggaggagacauuggccucucugggcuugcugaagaagggagaaaaagaacagaaagaagcaauugaauauauugacgacguacaaaaggaaauacaggcugggcgcgguggcuuaugccuauacucugggaggccaagguggguggaucaccugaggucgggaguucgagaccagccugaccaacaugcagaaaccccaucucuacuaaaaauacaaaauuagccaggugugguggugcaugccuguaaucccagcuacuugggaggcugaggcaggagaaucacuagaaccugggagguggagguugcagugaccugagaucgugccauugcacuccagccugggcaacaagagugaaacuccaucacacacacacacacacacacacacacacacacacacacacacaaaauucagagacuuaaugaacaagccaguggggagauugugaaagcagaacagaaguauaacaaauucugccaaccauuuuuuggaagaggucaaaauugauugcccaaauuucaaauuuuuggguaacagcauuugucagccauccacaagugucuacauuacuuggggaggaagacaaagaggcacuguauuauuugacgaguugaagugacagaauuuggagguauuaaaucagguuacagaaagauuuuuauuuugaugaaaaucuuuaguuugaaaauaaaguucucuccaaggaauuucaucugaaugagaguggugaucuauuuuuagaguccacugaagucaaaugcaaaucuggaaaggauauaaugaaaacguuccagucaaacgcagaguaaagucagcaggaagaggcagcacgaagaaccagagagcuucuuuaccugguuuacugaccguucugaugcagguguuguugaguugggagaguucaucaaagauaauacuuggacaaauccauuacaguacuacuugguuuucaauauggaugaugaagaaagggaaggagauaaaugaugaagaaggaugggaagauauugauaaagaaaggggauaaggaugaagaugaagaagaugaagaugaugaugaaagggaggaaagaaagggggugaaggagaaaaugacuaauagaacacugauagguuccaaccuuuuuaaaaauuuucuccaguuccugggagcaagcugucguguguguguguguguguguguguguguguguguguguguguguguuuucuuuugggcucagcugccuuguucuugaggucuuuuuuucucuacaccacagcucucaacuuauuuggggggaaaauaacuugagcagaauacaaugggaaaaggaucucuaccccuuucuguuccaaauucauuuuuaucccuucuugucugaacaaaaacuguauggauuuaauaccacugaacucucuggggaaaaaagaaaaaccucccuuugcucugcuggaauuugcauggugcuaagccccuguguauuagugcacagaauuuuagcgcuuuucuuccuuucucuguguauuaugcucagaacacugugucucugcgugaauauggauaguuagcauuugccaacauguaucugucuacuuucucuuguuuaaaaaaagacaaaacaaaaaaugggacuauguaaggucagcaaagggugaguuugagauguuuggguggguuaaguguguauuuugacaacauggcuucuccuuuggcauauuuaauugugauguuuaaugggcaucuuugcaguuuaacaugacacauuuaaaauaaguucucuccagugaugacucuugcccugccacucgaugggacaauccacagaaccugcaggauauuauuuagaauucacauucucuguuguacuuuuguaccugucuauuuuaaaauuuucuuuuuauuucacuggaaaggaaagaugacacuuaguuuuaaauguuaaaaguguacaaguugcuuuguuagaauaaaacuaaauguguacacauacccaaaaaccaaaaaaaaaaaaauccccaaauuuaaaacuuucauuuuuuuuguagacaccauuaagaaaaugaaggcaagccauagauuggggaguaaauauucacaaaaguaucucuguuaaaggcucagacuauuuaaauaauuuucauuacucuauaauaaaaagacaaacucaguuucuuaaaaaaaaugcugaaaagaugcaaacaaauaauucacaaaggaagcuguuuggucaaggagcacaugaaaagauucucagccucacuugucaacagggaaauacaaauuaaaauaauaagguaguacuuucacccauuagaauggaaaaaaacuugacaauguuaagaauugacgaggaaauagaauaauugauacuuugguauauuuuugguuauaguguaaaauaguaaaucuacuuugaauaacgggucacuucuuaucaaguuaaacauguugcuuccuugugaccuaguaauuucacuccuagguguuuacccaggagaagugaaaguguauguccauagaaagacuuauauuagaauauucauagcaacucuuuucacaacagccaaaaguugggaacaacccaaaugcucaucaacagauuaaaauggguaaacaaauugugguauacucauagaauaccauauggugauccggaggaugaugcgggcccacaauauagguaaaucucaaaacaugcugagcaaaacaaguuaaaucucaaaacauguugagcaaaacaagucagacacaaacgacuauguaccuugugauuccauuucaguguaguucuaauacugguagaacuaagcucuaaugagagaaauuaggaauguagauggcugugccuagaaaagagaaugaugaaauuuuugugauggaaauacuauuuaucuuaauugggguggugauuauauggugucaaaccucaaugaacucuacacuuaaaaucuaauuuucauuuauuguaugugguuuauaccccaauauaaauuaggggaaaaagucaaaggcacaaaacuugcucuugaagcaauacagauguugagcauacacagagcagauuguaauguguguguaaaugguauagggugcuugaaagagggcagaagugacaguguguaccacaugagcuugcaggaaaaggcaggauaaacagaaaaggcuuucuggacaauagaugguuugugcuguguuuugaagaugcaaagagguaaauguuuuuaggacuuggggauaagauuucucaaauagggucaagguuucucaagucaagaggucaagauaaaaauaaaacaggacauguuuuuggacaaauaaacauaaauugaaguuguuuuucuacucaguauaucauucccauaguuaucagucuaucauuucccauauauauguaucaugucccucuuacaagacucaucuuaauucugcuucuucuguucuccaggugcaccagcacacagugguauuuccuccucccaaauucccauuuucuaacuuauaaauuaaaagcaccauuuaauuuuuccuagauuauauccuguuuuucaguguggauauucuuacaaagugcauacucgggaaagguuguuuguccucugccccaaguauaaaauauugaguacacaaccaaauccugguuaauuaagauuugguggguagagguugacagaugugcaggagguggggacaucuguggauauggcuugaaguguggaguuguagauuuucuuccuuguaugaguguuaauggcuauaauguuuugacucucaacuauguaccaggcaugauaacucuuacagccauucuucuaggugguuauuuuuguucuguuuucuacagaugagucaacugagcagggagagguuaaggaacacacuggaauuuugaauacaaguugaguaucccuaaucccaaaaucugaaguccgaagugcuucaauauccgaaacuuuuugagggcugacaugacucucaaaagaaauguucauuggagcauuucagauuagggauucucaucugcuaaguguaaugcaaauauuccaaaaucugaaaucugaaacacuccugguccaaagcaguaugaucaaggaauauucaaccucuguaucucuuuggcuuccauuguucuuauagucaucagagcaccacacuauguuauugggaaagaagaugaugcuggcaaugacagcaauaaacauuguuguguucuuuuuuuuuuuuuuuuuuuuugagauggagucuugcugugucacccaggcuguggugcaguggugcgaucucagcucacugcagccucugccuccuggguucaagcaauucugccucagccuccugaguagcugggauuacaggcacacaccaccaugcccggcuaauuuuuguauuuuuuuuuuuuuuuuuuuuaguagagacagaguuucaccauguuggccaggcuggucugaaacuucugaccuugugaucugcccaccucggccucccaaaguguugggauuacaggcgugagccacugcgcccggccugauuguguucuuaugccaauuacuguucuggguaauuuauguauauaacucauuuaauccccauaacucaguaaggaaaaugaggcauagaguuguuaagugacuuuauuaagguuguauuagaauaagugguggagucaagauuugaagccaaaaagucugauucuagaaugcccacuuuucauuauuaugcuauacuacuuggcauuguacacauagggacugguugucuucuuuagaacaaggcauauaccauuucuuaauugggguaggaguggauuuaaauaaaacuuggugaugcagacuguuguuuucaaaucauauuuaagacccucauuuuuguccauucauguaacauuuauugaaaacuucacuguguuaugaggcuaagacagagucuuuucuuuugagggacuuuaaagucuaggacugggucuggauuuuuuaaaucguguggccucuaaagcauuuuaaaguucucacacuacuugaacuaaacugagaaacuggauuugacuggcagugugcuaaagucguggcucaugaaagaaaauuggugcagauaucugaugaaccaacccauauucagaaaaaaggccucgcugccacaaaaccaaaagauuaagcaauuaaugugcacuuuguauuucaaauuaaaauaauguauuuaagguuucuaaaaauaauuccuacuuaaccuguuauuuugguuaaccuguauuuuuccuuaacuaacuugccucagugguaccaguuauaaggacagcugcuguguaucaaacucagugauaacagggacagcuggucugacaucuuagguuuucuuuuuaucucagaccauauccucccucuuccuuuuuucacuucuauaaagguagugcuuauaggcauauuuauaguggggaaagaggcagugaaauccuugugcagaaacauagguaggcaguuuugggggccaggagagaaagaacauucaacacuaaaggccaccuccuaggacauuuaacugaacuaaguaucauuuuucauauucuguuuuugucaucuguacaugcagggcuaucagcucccagcuggauuaagguuagggauuuggaucuagucaguaaaugacuucugaugagauuagaaucgucuccaaauccccauuaaggaaauaaaaauguaaucuuauaaguuauaauauguccaaagauuguugucauaauugaaugacuaucaauuccuaggagugaugauguuaagguuuguggauaugucuguuagaauguaagccaccagaggcccagaaccuuuucaucacaccaucucuaccauuccuagaauguuggcugccucauuguaaggaaucaguguugaaugaauaaauggccaaaauaucccuagagugagaaggggauuucauucaucaucuguagcaggauggaaauguucuuagaugaaaccuugugugagcucuccuaccaaccuuugaccuuagggcucgacucacugggaagaucacaucagcaacaggugaguucuuuccagccaggugucucucccacuauagaagguggcacauuucccaucugcuugguauaaauggcuccuagagucuagaggcuauaagugaugugaugaaaauaauugcguguguaugauccuggagaguaucgaggaucagauuuuuuuccccaagugaucacaccacaaguguacagaucgcuuugggccaaccucagaagccaacuaacugaucuuuuccucuuuucuuugguaucuuaaccucaaaagcagaugucauauaauuggguagaagccagcacccgucccuggcuguucuuuuauuugaaugaugaggggucagaacaugauaucuaaggccuuugaugcuuuucaaaaacaacagaugggagguuucagugaaaaauaaaaagcuagcaauuuaauuuauaccgaguaaagacaaaaauuucaaaggaaucuaaucagaucuaaaagcauaugaccaguauuucacuuugacuuuaaagaacagguggauugagaagcuuugcugugguaaacuugguguuucggugaauuaauguaaccaaaugauuacuauaaaaauagcauucauuaauuacuagauuuauccuuuuuaagggugcuagggaggaaaagaaaauucccuguaaagaagaaccagaaaauuuaguaaagaggguuuuggagaccugauucucaugcuacuuaggaagcugagaauuuaaaauagauuuuacauaguuugguuguagguauuuuuucucauuaagauaggauauuuuuacugaaguugauuuaucuagcugugcugcucagacuuuuaggaggcaaugcaucuuuuaguauugcggggugaugguggggaggcuauggguguagcaccagacuugaagcuaauuugaaaucccaaguaguagacagcaucuggccaaugaaaugccuucuuagcauccaguaugaacuggcagggugaucauauugaugaucauaauuaauuuauuauacaaucaaggacacuuuugagauagaaaggaggcacuauuuucaauuaugcccagacaacaggugaaaacuggaucugucccaggacauggggucacccaaaacugaaugugcaacagaauuaccuggagggcuuguuaaaagagauugcugggcuccacccccauuguuucugauucuguagguuuggggucaauaauuugcaugucugacaagcucacuggugauguugauucagcugguauaguaucugcacuuugagauccacugcucuauccaaacaaacuuggcacucuuguacugauauaauuuucaauuaaaggaaacacuccuuauuguccaucauccuccacuagacagccuucugcaggugaggaugcucaugaugauggcagaauaugcuuguguuggugucagccuaccuccuggacuggucuguuuuugguauucuagagacugcucacacugggagguugaaacagcucacuugugaccgaccuaacuucuaaggauauccuggggccaaauggaauaaaccugugacuucugaguucauagagccuuaggcuuagggaagccucaacaucuaaauucacucagaagcacuuuauagagugaacguucuucuagggagccguguucuucuucuguucagcacuuuagaagcaucauagguggccuugcucaggauagucacacccucuguaccugcuucaacugugaagugggcaccguaauacuucaggaaauuauacuucuuccucugcacccggcccacuuccccugugucuucaugcuuugaguaccuuggaaucuccccacuguucuuuugguuuuauuuuuguuuguuuuuguuuuugagacagggucucacucucucgcccagacuggagugcaguggcccgaucucagcucaccacaaccucuggcucccagacucaagcgauucuccugccucagccuccugaguaccugggauuacaggcaugcaccacuaccacccagcuaauuuuuguauuuuuaguggagauagggguuuuaccacguuggccaggcuggucuugaacuccugaccagccucuccugaggccacucaccuuggccucacaaagugcugggauuacaggugugagccaccaugccuggccuccuuguuuuuuuuuuuuccagacaugacaauauagaguucauucauauauaccaauguguuaauugugugcacacaauuguaugcauguuuguauauauaguauucauaaauuuuaccgaaauauaaaauucauugcauguuuacaaaucauaaaauaugccauuuugguauuuuccgagugcauuguuuucuuuuuaacuuaauggcuagguuuuuuuuuagugcuaaaacugauuaucaaguuuguauguuuuagaaagaugaauauacaaacuauuuauuuuuuuacuagugugaucuuugauucauuuucuccguaggauugauuguccuugguuaacaaaguauauguagacaagauggauugcaugggcuugguugaauaagcugacauugugggucugugcuaauucuccugaauguaauuuaauuuauaauguuuaaagaauuguaaguaauuuagcugauuagucauagacuauaaauaaguagcauaugaacucaaauauuugcuaugccuaggacagauauuucugugauuuacaauuuaaaggcauuuuauuuuaguagguguuaaugggguuaacuuauccuaauaaugacaaagauaaaaacuuuuaccuauauaaguguauguacaaguaaaugcaacuauauaucuguacacauaugcaauugcaaacaaagacauacugaccuaaguauuaugcuaaucgauuuuguaguuuugagaagcaauuuuaauacacauuuacgagcuuuugaaauguuuguccuggaugaauaccuuuuaaacauuuuccuugauaucucuucaucacagauauauuuugacagccacgauuggaaauccuaaaucauaaaugauaauauuucaguauuggauccccauauuagcauggggaaauauauuaauauaccaauuauaguugucaaacaaaaaguaaccuacugagaaaaaugugaguggcaaugguucaguguuccucagcuuuguugcugcccagcucagaaaucuuuucuguucccaugcaccauucacauacaugcaagucauuucauggaaaagcuguuuucuuaccugcgucuaggccuucaucugugagagucaugcuucacucauuuugaaauaccucucauuguaggcuccaagguaacacuguuacagaguucuugcucaucuucaacuacggaugaaaaucaggaacuugacagaaaccacaagauagugggucccucugcugcuguugucagauagaauuuauugaagacugggacguggaaacaaagagg

SEQ ID NO: 13635 - RNA, 27676 nt, Homo sapiens
ggaaagggcuggaaccccacgccggcuggggcuuggcgugggaauggagcgaguaccguggcugcagaagcgggcgcuggggcggggagggcugagggugggggagggaagacgcacccggagaaggugggggcaugaaagcacacgacaauucuucggugacuggugccaggcaaaaaaaaaaaacacacacugaggaaagacaaucaauagauggagacaucugugacagauuuguccaaaaaagacaauuugaggagaagcucuugggacuuuggagcaaaauggagugauuaguaguaguuaauauucaagugauaacuuuaaggaguauuaaguacacuacugagggaggagaaaggaaauuuaaaaaccuccacuuagccuuuuguuucugcaacagcaagcaucauaauaaaagaacgcuucuggguuaaugugguuaugaguuauagaacuuugaagcuguggaagcggcuccaggucucccugaagagcauuacuccuggcuguaagccaaaaagaauaaggcuuuuugcucacuuuggagcagagaacuuuuccucccucagguuuggacacaauuuuccauuuccugggaagauuuucugucucugccuaugucacaagaggacucaggaccugaaagaagagcucagguauugccaauuccuauuucauuauguacauuuucagccuuacguuugugagaaucccuuauucauguguugucuuaugcuauugauccucuuuuaaauaauuugaacgugggcauacccagaacuuuuauuuaagcugaacgagagaauuaccuucauccugcuguuccuuccuuuguuuaucuaaugauaagguggaaaugcugucuccaaucauacaaagcuuauuuaaaauuauuguaaccaggugguuacgauggcaaaaguggucauaugauuaauccuaucuuaaauuuuaauuuggacuaaauuauaauaauacauccaucaucuuuuuaucuguaugaaaauccaagcaguucagccccaguguuauuucucaguguaguuuguagcuaaagggugguugcugguggaauccaacaucaugcuguuccacagaacggugggauuuauuacaaauuaugaaggucauuuugcuuggaaaagcacaauaaagaguuuauuucaauccugcauuucaggagagaauuagguuugaauuccugggcuugccccacauauggguaacagauaccauuuuuuuuuuucugacaagcugagcauauuucuucccugguuaugcuccccaccuccuguggcagccaugagcuggaggagggaccaaggaaaaaggcagagagauguccgaagcugagcaaaagcagacagcaucaugccugcacagggucagcauggcucaagcccucucagcuggucagucgcuguugcuuauggucauuacuuggcagugaaguguucaaugugucuuuuuuuuuggcagggacuugaaaaccgguuagaaagagauuuauucucccuuccaguggauuauuacaaccuuuaaaaaauguuucugaagaagguuuaauaaaaugaaaaaacauuauauaugaaaugauaaaauguguuacaaaauugaguuugaucacauguacacauauacacguaaauguauguacaccuauacauauacacacaauagaugaaaaaggcuggaaaggaauacaacaacauguuuaaggauuauauaaguggugagauugaguaauuuuuuuccuuuuuacugcuuaauuacaguuuccaaauguuuuauuaugcacagauauuacuguuauaaucaguuucuugaaaguuacucuaaaagaauuaauguauauaaaggaaacuaaauucuauauauuuuaguugucacaaucuuucuuaugguuuccaguuucccuuuuaaugaaugccugaguaauagggauugcugguuuucauaaagaagugagaagcugugaagaaauuuucacaacaguaaauaucccacuugaucauaaagcgcagugugaggccagcagcacacacuauaguuuuguaaagagugcauaugaccacaaaggguaggaauggaauugaccacuuacgacccuuaaagaaggucucccagauucccagagugaguguguggugguccugggacuuugcuccaccacucuuuauaacucugagguaugauguuuuuucaggaugaagguaaaaggcagaggaaucaccugcuugcuggucuccuuugcugugaucugccuggucgccaccccugggggcaaggccuguccucgccgcugugccuguuauaugccuacggagguacacugcacauuucgguaccugacuuccaucccagacagcaucccgcccaauguggaacgcaucaauuuagggugugugagaccucauguuuccucuucucaaagagggaucagucgcagcagugacuugucccucaaacaucuaugacuuugggagaugaaucucaauuguuuuaacaauauuucuuuucugaaaugagcucaugagaauuuuguuuguugggggcaauaagaaaacuuuuccugguaaacuuuuauuaggagaaaguucuucuagaauuugaagucccucuugguagguugggagacucaugacgguaaaaagcuucuuucuggcuacauuuuugcuggaaaaugauauaguuucuguuaacuauugggguuaugaucauucaucauaagagaugacaggguaacuggaagugucugccuauauaauacacacacacacacacauacauacauauauauauauauguauccuuuuuauaggcccuuugguuucuuuccauacaaacuuauuuaaaauggaugccuaauuaaauuuuuaaaaauaugacuguauuuuaaacguucaugaaaaaaaagucugugugugucugaauacacauguuggacuuagcaucguuuauuugacauuagugagcauguacuaugcacuggggauacaaugguaagauauacuauucacuucuaggauguguauugaucguuaaaaagaccagacaaauguacggucaguacaauuaauaaaaacuaauagagcauacaaaguguuuuagagacagucacuaauauuaagagcuaacauuaagguugugcucaguaggugcuggcauuggguuaagcacugcauccauuuaauccucauaaccccuuuggagugaguucuauuauuuacauuuuauagaugaggaaacugaggcacagaaagccugcugauuuuacccaggguuguaccacuacucuguugagccugagcucguaaucauacccaaacgagacgcccaagccuggccuccagagcccaggcuucuuaaccacugcugacgaauuccaccugggggaguggugaggagauagugucaugaaagaaugggcuagauauuaaguguucacaaauagaaaaaggugaggucaagggcauuccaaccugagggaacagcauauauauaaaaguuugaaaaugauaagaaaugugacaaguucccagaauaugaggggggugauuguaacugaaauggcaagaacuggguagagagccgaccuucuguggcaucuggugaauuucaguuuuugaagcauuugauugucucaauagaguacaguuauaaagagagguauugaguuuucuuguguuuauuuugguuaugacauuugaacuuuaguugacagacuuagcuuaugccuagaaugucauuuuuuauuucagauacaacagcuugguuagauugauggaaacagauuuuucuggccugaccaaacuggaguuacucaugcuucacagcaauggcauucacacaaucccugacaagaccuucucagauuugcaggccuugcaggugagacugauggagagagggggcagguuaaagagguaaggugggaccugugagauagaccuucaaaggcugccuaucucuacacaauacgaaaaucaacauucuguaaauuagaagcagacgucaauggagaauguuaacugauuuuuaacuguggaacuguguguauaaauuagaauaauaagaacucugaggcaaguuuucuacuaccucaagcuaauagaaaaaaaaucaauacccagagacgauaaaccuucaaaauuuaauccuaaaaggacacuucuagucauguuuaucugggaauugaaugugguuccuaaaaguaaugacuaucuuagacagauaauaguuuuauauaaaucaauguacuauuuucaguuucauuuuauuuacuuauucauguucuacauuguucaauuuuuuaaaguuaagaggacucccaagaaugcauaaaaucaugcaagaaugaucacaaaaguaagugagaaaguaaaagguaaaauaagccuagagaaaagaauaaagggaacaugaggaaaugcauacauagagaccuuuaagucugcuauaaguaggacuugaagcuuucaagacgcuaacaauacaugacaucuauuaaaacuuaaacuguucaggaaaagcacagccauguaugauuuuuaaaucagaaagaaaugucuuacaaagcuccucauaaaauacagugccauaaaauaaagucaauaauauccuuguaaaagaugaaguaccuguguucauagagccuucuaacauauaccagagcuauguaagggagguuauaaccauggugagagcaauagaguauaauguagcuaugugauucuguugauuugguuaaucaggcucuauuuggaauguaugucuucggaggaauagauggauugcauguccuuuauagaauucucuacauauauuuauucucucgaccaaauuuucaauggcuguugaggaacauugaguuggagauugaacucccagguuacauuuggggcaaagcucuucuauguugccaacuuauauuuucuuuucuuauuaggggucuuggcauucuagagaagcauucucgacagagaugauaguucaggccaagucaggaaaauaugaugagaaaugguguuuacuagcauuucuuuuuucuuuaugggagagaguauguucaacugguaauuggagagggaauuggagaauaccugagcacuauugaaauauucaaaauuauuuuaauugcaacucaaaauuagucauauuacucauaaccaaaaaguauaagacaccucuuaauguccaucaaccaaugauagauaaagcguugugcauguauacaguagaauacuauucagcaaagaaaggaaugaagggcugauacaugcuaugagagggacaggucuugaaaacauuuugcuaagugaaagaagccagacacaaugccauaaaguguaugauuccauuuauauaaaauguuuagaauaggcaaauccauggaaacaaaguaaauuagugguugugaagggcuaagaggauaggaaaaaaugacugcuaauggguauuaguuuuuauuuuaaggugcaaaauaaaguuuauuagaaacuuuaggccgggcgcaguggcucacaccuguaaccccagaacuuugggaggccaagggggggcagaucaccugagguugggaguucaagaccagccugaccaacauggagaaaccccaucucuacuaaauaauacaaaaaauuagccaggcgugguggcacaugccuguaaucccaguuacucaggaggcugaggcaggauaaucacuugacccaggagauggagguuguagugagccgagaucacuccauugcacuccagccugggcaacaagagugaaacuccaucucaaaaaaaaaaacaaaacgcaaaaaagaaacuuuauuuagaaguuucuaacaguggauaugguugcacaacucuaugaauauacuaaaaaccaauaaauuguacacuuuuaaauuauuuuuuugagacagaaucuugcucugucacccaggcuggagugcgguggugcaaucucagcucacuacaaccuccaccuuccaaguucaaaugauucucaugccucagccuccugaguagcuagggaguaugugugugugccaccaugcccggcuaauuuuguguguguauauguauuuuuaguagagacaggauuucgucauguuggcuaggcuggucucaaacuccuggccucaagugaucugcccgccucagccucccaaagugcugggagccaccaugcccagccaguuguacacuuuaaaagguggauuuuauggcaugugaacuauaacucaauaaauuaaaaucaauagucucucuuaugaaaaauuuauguuuaagaaaucuuaaauuuacuugaaauacuaagacuuaaaaaaaaaaccuuauaaaaauuuucaaccauggacaaaaguagaaagaauauaaugaacuguaauggaccauuacccagcugcaauaguuauggacucauagcagaugucucaccugcaccucuacccacuauucuccgcuccauucaacuauuuugaaacaaauccaaauuuucauaauauucaucuguaaguacuucuauauaucucaaaauuaagaaaucuuuuuaaaauaaccacaauaucauucauauaucuuaaauuuuaacagucauuccuggcugggcaugauggcucgugccuguaaucccagcacuuugggaggcugaggugggcggaucaccugaggucaggaguuugagaccaaccuugccaacauggugaaaccccaucucuacuaaaacuacaaaaauuagcugggcaugguggugggcaccuguaaucccagcuacucaggaggcugaggcaggagaaucgcuucaaaccaggaggcggagguugcaguaagcagagaucacaacacugcacuccagccugggcgacagagcaagacgcugucucaaaaaaaaaaaaaaaagaaaaagaaaaaaagaaauauauauaucucauuccuuaauauaaauaggcaaauguucaugaguguucuaauuuuucugauauugucauauuuaauuugcaaugaauuugauugaauugggauccuaagaagguauauaaauugcacugaauuaauuucaacauaaguuuuguuauugauaggacuuuucccucuugugaaaauuccuuugacaacauaaauauguucuuuuuuuuaauucauaggucuuaaaaaugagcuauaauaaaguccgaaaacuucagaaagauacuuuuuauggccucaggagcuugacacgauugcacauggaccacaacaauauugaguuuauaaacccagagguuuuuuaugggcucaacuuucuccgccuggugcacuuggaaggaaaucagcucacuaagcuccacccagauacauuugucucuuugagcuaccuccagauauuuaaaaucucuuucauuaaguuccuauacuugucugauaacuuccugaccucccucccucaagagauggucuccuauaugccugaccuagacagccuuuaccugcauggaaacccauggaccugugauugccauuuaaagugguugucugacuggauacaggagaagccagguaucuauauuguuuauuuuuuugucccaauuaaguggaggaaaucugcuuggagguauuauauuaggaaguggagagcccaggguaauuuaggagagaaaauaacaucucagaaauaauucaagaauaaugaauuauuuacacaucaucuauggcuguguuuuggcaacuguggcagucaaguagugucacagaacuguuucacaaagccuaaaaauccuuacuaucuggcucuuuauaaaaauguugcugaucucuggcuuagagaauaaaucucaugcuccuuaggcuacaagccagguccucauaguguggugcuggccuauccucagccuccuuucccuccucuccaacccucagcccugcccaucccaggcacacaggcaguuuuugcucuuaacaacucuggacaacuuccugccacaccacaagcuguuuuaccuccucguaccugcugcugccccugccuggagcccuuccuuuccuuuucugcuugaugguucucagccagccagcaaacugcucagccguucugagaagucuggcugcuucuccacccaccccaucuccaucagaauaaccauuucaccacuuggguuguuugccuauacuuccauucuugaauggauaacauuugguuauaucuacuccuauuagaagucuuuugccuuuccugcaucuaguuuaucuuuaacugugguuucaauaugucccaaacuuacauauauguauaaaaacacaucauauaugcauuuauacaucugucauauguacauauacauaugcgcacacacauaaucacacacugcauacugacaucucagucaacaacagauggcauauauaaugauccucccauaagauuuacaauggaggugaaauaaaacuauugccuagugacauuguagccaucauaaagugguagugcaauauguuaccuuuucuaaguuuagauacauaaauaauuacaauuguauuacaauugcuuacaguauucaguagaguaauacacuguaugggucuguagccuaggagcaguaggcuuuaccauauagccuagguguguaguaggcuauacuaucuagguuuguguaaguacacugcauaauguuugcacaacaaaauugccuaaugaugcauuuuucagaaugugucccuguuguuaauucauaacucuauauguguaaaauaauuaaacccauaggggcucacaucuuucagucuuaauaaucaaguguuauccuuuugacugagaugacuuaauaauuuuuacgagacccaugggucagucacaucaaccucuucugcuuugaaaaauuuucaugauuucaagagauucgacaguuguucauggcuucaggugccucacuuggcaugugguaggcaauccuuuugcacugaucucaguaguuaaauguaacacuccuuuaucuacuuguggguaucuucuauucuuugauucugcaaagauguugaugcagcauuucuauaaaaugaauuuguggcuguuucucuaaugagcauucauuucaugaauaugaaauuuauguucugcugcucuguuuccauucuuuuuuacauacuugacaaccuguuuuuaugcuaaaucauaguguaaucuuaauugaaacauuuuaaaggcaaauuuaauauaugucauagcaccaauacaugugauacaauggaaagcaaugacaauagcuaugacagucuuuauagguauacaagcugugauagcuauauugauugccaauuugucaguuguuacuguaaaacauccucaauuguaaggcacaucuuaauuuauaaguugaaaugugaaaaaacaaacaaaaaaacauggucacagaauuaggcacuuuuucuugccugccugucugccuuucuuccuucugcugaucuuuccugagcauccauuggccagggcuggggacauacagaugaacaagaaugaaguuuauaguuucaugggaagacagauaaguaaacaagucauucuaauagugaauaaugaaaaaguaggauauaagaagugaaggguacccagagacuauaaaacagggagcccacccagaagaagugcuguucagacuggguucugaaggaugauugguaaguacuugggucaugaugaaagacaccaagugugcgggacauagaaggaacagcguaugccagagccaauggggcauggcaggguugaggaauggaaaggauuuccauggggcuggaaccgagggaaugggggugauauggucagguuugcauuugaggcaaaauaccugauguccaaggccugcuaacucuggcucagugcaagcaauaauaagcaugccacagugugagcauagucuaugaugagguuucauuaagccagaagucugccauguugucuuagcccaggguacugauaaguagguaaaggaauacagcuuguuggcaagugggugauggggaggcaacucuuuuuuuuuuuuuuuuuuuuuuugagacagaguuuugcucuuguugcccaggcuggagugcaauggugugaucuuggcucacugcaaccucugccucccggguuaagugauucuccuaccucagccucccgagcagcugggauuauagacaugugccaccaugccuggcuaauuuuguauuuuuaguagagacgggguuuuuccauguuggucagacuggucucaaacuuccaaccucaggugauccgcccaccucggccucccaaagugcugagguuacaggcgugagcgauugcggccagccaggaggcaacucuuaugauuguucaaagguuucccaacuugccagccaccuccucugcauagguuuagacuauaaaauuugcugaagaaugcccacuggucaggcaucugugacauuaccugucacacuguaguacacgcagaagaguuugguguccuuggucagagugaguuucuuaagccuuugagaggacaugugcacacaugggaaggagauuugacccuaucuagccacucugacaaauuagaucuucuaagaaguacaaugcuuuuguuaagugccauguccagugcaucauauaagagcuacuauauggaacagcauggaugucucaggcuguauuuuguguaagggaaaagucuauaccucuuaccaaguauuccagugaccagccauuuuaaauaggcucaccagagcagagcuuuuaaaugguaugugauauccaaauauuugaaagacaaggcaccuaugacuuagaaaugcugguccuuauaaugcugguccuagugcuguaagacuugcaaccucugacuucgccagaaugucagaccuuuaaugagccuccccacugccuuggcaaaauguucuucccucccccuuaaaccugaaccugcucuagugcaucuaccucauccaagggaaccaucaaccauccaguuuccaaagucauaaaacggagucuuccuugacccuuccuuuuagucacuguccauauucagucaauccucaccuccuauugauugguucuaccuucuucauugucuccugcauccaucugcuucucuuaauuccuguugcuacuaagcuagaccaggucaagguacccuguaauucagucaauauucuuuuggauaauggaaauaaacuuggguuuuuuaaugauacccaaggaauuauaaauaauccuuuaauaaacagcuuaucuuuuaaagaacagugagguccuguggccaucuuaaaauguuaaaaugaagaaauagaacuaaacuguuauuaauaaaaacugacaaacaugagcauaucauuuuguuucccuagauuuaaaaaaaugacuuauucaacuaauauuuacuggguaccaaauauauaucaggcauuugcugaacaugggaaauacugcagugaauaagauagacaaaauccuaugucuaugcauauuauguuguagcaggguauacagacauagcuuuuuaaaaaaucaaauucagaagcaaaaaaucagaaaacuuuccauugaacacuaaaauuuccaaauuguuucagcuucuagcaaaagcuauuucuucaaaauguuugugucaauucauaaagaggucacaacugauaauucaauugugauuuuuuuccagauguaauaaaaugcaaaaaagauagaagucccucuagugcucagcaguguccacuuugcaugaacccuaggacuucuaaaggcaagccguuagcuauggucucagcugcagcuuuccagugugccaagccaaccauugacucaucccugaaaucaaagagccugacuauucuggaagacaguaguucugcuuucaucucuccccaagguuucauggcacccuuuggcucccucacuuugaauaugacagaucagucuggaaaugaagcuaacauggucugcaguauucaaaagcccucaaggacaucacccauugcauucacugaagaaaaugacuacaucgugcuaaauacuucauuuucaacauuuuuggugugcaacauagauuacggucacauucagccaguguggcaaauuuuggcuuuguacagugauucuccucugauacuagaaaggagccacuugcuuagugaaacaccgcagcucuauuacaaauauaaacagguggcuccuaagccugaagacauuuuuaccaacauagaggcagaucucagagcagaucccucuugguuaaugcaagaccaaauuuccuugcagcugaacagaacugccaccacauucaguacauuacagauccaguacuccagugaugcucaaaucacuuuaccaagagcagagaugaggccagugaaacacaaauggacuaugauuucaagggauaacaauacuaagcuggaacauacugucuugguagguggaaccguuggccugaacugcccaggccaaggagaccccaccccacacguggauuggcuucuagcugauggaaguaaagugagagccccuuaugucagugaggauggacggauccuaauagacaaaaguggaaaauuggaacuccagauggcugauaguuuugacacaggcguauaucacuguauaagcagcaauuaugaugaugcagauauucucaccuauaggauaacugugguagaaccuuuggucgaagccuaucaggaaaaugggauucaucacacaguuuucauuggugaaacacuugaucuuccaugccauucuacugguaucccagaugccucuauuagcuggguuauuccaggaaacaaugugcucuaucagucaucaagagacaagaaaguucuaaacaauggcacauuaagaauauuacaggucaccccgaaagaccaagguuauuaucgcuguguggcagccaacccaucagggguugauuuuuugauuuuccaaguuucagucaagaugaaaggacaaaggcccuuggagcaugauggagaaacagagggaucuggacuugaugaguccaauccuauugcucaucuuaaggagccaccaggugcacaacuccguacaucugcucugauggaggcugagguuggaaaacacaccucaagcacaaguaagaggcacaacuaucgggaauuaacacuccagcgacguggagauucaacacaucgacguuuuagggagaauaggaggcauuucccucccucugcuaggagaauugacccacaacauugggcggcacuguuggagaaagcuaaaaagaaugcuaugccagacaagcgagaaaauaccacagugagcccacccccaguggucacccaacucccaaacauaccuggugaagaagacgauuccucaggcaugcucgcucuacaugaggaauuuauggucccggccacuaaagcuuugaaccuuccagcaaggacagugacugcugacuccagaacaauaucugauaguccuaugacaaacauaaauuauggcacagaauucucuccuguugugaauucacaaauacuaccaccugaagaacccacagauuucaaacugucuacugcuauuaaaacuacagccaugucaaagaauauaaacccaaccaugucaagccaaauacaaggcacaaccaaucaacauucauccacugucuuuccacugcuacuuggagcaacugaauuucaggacucugaccagaugggaagaggaagagagcauuuccaaaguagacccccaauaacaguaaggacuaugaucaaagaugucaaugucaaaaugcuuaguagcaccaccaacaaacuauuauuagagucaguaaauaccacaaauagucaucagacaucuguaagagaagugagugaacccaggcacaaucacuucuauucucacacuacucaaauacuuagcaccuccacguucccuucagauccacacacagcugcucauucucaguuuccgaucccuagaaauaguacaguuaacaucccgcuguucagacgcuuugggaggcagaggaaaauuggcggaagggggcggauuaucagcccauauagaacuccaguucugcgacggcauagauacagcauuuucaggucaacaaccagagguucuucugaaaaaagcacuacugcauucucagccacagugcucaaugugacaugucuguccugucuucccagggagaggcucaccacugccacagcagcauugucuuuuccaagugcugcucccaucaccuuccccaaagcugacauugcuagagucccaucagaagagucuacaacucuaguccagaauccacuauuacuacuugagaacaaacccaguguagagaaaacaacacccacaauaaaauauuucaggacugaaauuucccaagugacuccaacuggugcagucaugacauaugcuccaacauccauacccauggaaaaaacucacaaaguaaacgccaguuacccacgugugucuagcaccaaugaagcuaaaagagauucagugauuacaucgucacuuucaggugcuaucaccaagccaccaaugacuauuauagccauuacaagguuuucaagaaggaaaauucccuggcaacagaacuuuguaaauaaccauaacccaaaaggcagauuaaggaaucaacauaaaguuaguuuacaaaaaagcacagcugugaugcuuccuaaaacaucuccugcuuuacccagagacaaagucuccccuuuccauuucaccacacuuucaacaagugugaugcaaauuccaucuaauaccuugacuaccgcucaccacacuacgaccaaaacacacaauccuggaagucuuccaacaaagaaggagcuucccuucccaccccuuaacccuaugcuuccuaguauuauaagcaaagacucaaguacaaaaagcaucauaucaacgcaaacagcaauaccagcaacaacuccuaccuucccugcaucugucaucacuuaugaaacccaaacagagagaucuagagcacaaacaauacaaagagaacaggagccucaaaagaagaacaggacugacccaaacaucucuccagaccagaguucuggcuucacuacacccacugcuaugacaccuccuguucuaaccacagccgaaacuucagucaagcccagugucucugcauucacucauuccccaccagaaaacacaacugggauuucaagcacaaucaguuuucauucaagaacucuuaaucugacagaugugauugaagaacuagcccaagcaaguacucagacuuugaagagcacaauugcuucugaaacaacuuuguccagcaaaucacaccagaguaccacaacuaggaaagcaaucauuagacacucaaccauaccaccauucuugagcagcagugcuacucuaaugccaguucccaucuccccucccuuuacucagagagcaguuacugacaacguggcgacucccauuuccgggcuuaugacaaauacaguggucaagcugcacgaauccucaaggcacaaugcuaaaccacagcaauuaguagcagagguugcaacaucccccaagguucacccaaaugccaaguucacaauuggaaccacucacuucaucuacucuaaucuguuacauucuacucccaugccagcacuaacaacaguuaaaucacagaauucuaaauuaacuccaucucccugggcagaaaaccaauuuuggcacaaaccauacucagaaauugcugaaaaaggcaaaaagccagaaguaagcauguuggcuacuacaggccuguccgaggccaccacucuuguuucagauugggauggacagaagaacacaaagaagagugacuuugauaagaaaccaguucaagaagcaacaacuuccaaacuccuucccuuugacucuuugucuagguauauauuugaaaagcccaggauaguuggaggaaaagcugcaaguuuuacuauuccagcuaacucagaugccuuucuucccugugaagcuguuggaaauccccugcccaccauucauuggaccagagucccaucagguaugugaaacuuuuucuuuacacuuaguuuuuguuagaaaacaagaagaagauuguuauguuuugggauuaaacauccaaagaaucaguaucaguuucaaauuuuucuaagacaaagaaacuauuaauauccucauuugacacuggcauauuuucacucaucagaagggauuaaauauguuaacuaagaacauuuuuuggaaugccucaaaagcugauucaaaguaauaugauuugaaaaagagagaaugguuauuguguugaaccaucuggcuuuuaaaguaaaauuaugugaauaaaaaaauccaggcugagcacaguggcucacgucuguaaucccagcacuuuggggaggccaagguggguggauuaccugaggucaggaguucaggaucagccuggccaacauggugaaaccccuacucuacuaaaaaaauacauaaauuagccgggugugguggugggcaccuguagucccagcuacucgggaggcugagacagaagaauugcucgaaccugggaggcggagguugcagugagccaagauugugccauugcacuccagccugggcaacaagagugaaacucucucaauaaaaauaaaauuaaauaaaauaauccaggaauaauuuuagcaaucugaagacuagauguccuaauuuuuuuuuuuuggucugucaccuaggguggagugcagugguacaaucaugucuccaggggcucaagcaauccuccuaucugaaccaccugaguagcugggacuacaagugcacaccaccauaccuagcuaauauuuuauuuuuuguuuguagagacagggucucacuauguuuccagggcuggucuugaacuccugggcuuaagugauucucccaccucagccucccaaaguguugggauuauacaagugagccauagggcugggcuuucauuuuaauuuaaauguauucuuaguagcccaaaaaacgauagcuuuauguuuucuaaauaaacuuugaugacccguagcaauaauuuucuuuuuuucuucucaggacuugauuuaucuaagaggaaacagaauagcaggguccagguucuccccaaugguacccuguccauccagaggguggaaauucaggaccgcggacaguacuuguguuccgcauccaaucuguuuggcacagaccaccuucaugucaccuugucugugguuuccuauccucccaggauccuggagagacguaccaaagagaucacaguucauuccggaagcacuguggaacugaagugcagagcagaagguaggccaagcccuacaguuaccuggauucuugcaaaccaaacaguugucucagaaucaucccagggaaguaggcaggcuguggugacgguugacggaacauugguccuccacaaucucaguauuuaugaccguggcuuuuacaaauguguggccagcaacccagguggccaggauucacugcugguuaaaauacaagucauugcagcaccaccuguuauucuagagcaaaggaggcaagucauuguaggcacuuggggugaaaguuuaaaacugcccuguacugcaaaaggaacuccucagcccagcguuuacuggguccucucugauggcacugaagugaaaccauuacaguuuaccaauuccaaguuguucuuauuuucaaaugggacuuuguauauaagaaaccuagccucuucagacaggggcacuuaugaaugcauugcuaccaguuccacugguucggagcgaagaguaguaaugcuuacaauggaagagcgagugaccagccccaggauagaagcugcaucccagaaaaggacugaagugaauuuuggggacaaauuacuacugaacugcucagccacuggggagcccaaaccccaaauaauguggagguuaccauccaaggcuguggucgaccagcagcauagguaagucuauaccuuuggguuggaauuaucugcuuuauguauuuagcuguacaacuucugaaauggaaaaagugacacagugaggcuagcagcaguuuuagaguacacauagacuuuggacauaaaggaaacucucucaaaaaaaacuaaucuuuugagaucauuugaauacaaaaaccauucuuuucacaugcuuaacucaaagggucaacuucuuaggguuuuuauauuuuaggcagaauuaaaaaaucucauuuaucuccauacuuggcacaguuuuaaaauaguaacuguaggacaggcacgguggcucacgccuguaauccuagcacuuugggaggccgagacagauggaucaccugaggucaggaguucaggaccagcucggccaacauggugaaacccuaucucuacuaaaaguacaaaaaaaaaaaaauuagccgggcaugguggccgggcgccuguaaucccagcugcuugggagguugaggcaggagaauugcuugaaccuggaaggcagagguugcagugaaccgagauugcaccacugcacuccagccuaggcaacagagugagacuuugucucaaaaaaaaaaaaaaaaauaguaauuguauaaauauauucacacucucuguaaacaaaacagagaagggaauuuuuaugaugcaguggagauucuagagagagacacuccguuauuuuacucgucugaguccccuauucgacauuuuaaacuucauuauaaucaguacuuaauuuuuucuuuccuaaaauuacaaagcacuuugugaaagucacaauauuaagaccuccaccaagugaaacauauucagggcccccgcauucugaugugaugagacacauauauacaaauacacacuuucucuggucuguuauaggcauaugaauauauauauuuuuugagacggagucucgcacugucgcccaggcuggagugcaguggcaggaucucugcucacugcaagcuccgccucccagguucacgccauucuccuaccucagccuccugaguagcugggaccacaggcacccgccaccacauccgacuaauuuuuuguauuuuuaguagagacggaguuucaccauguuagccaggauggucuugaucuccugaccucgugaucugcccgccuuagccucccaaagugcugggauuacaggcaugagccaccgugccuggccucaauauucauuuuauagcuggcuuucuauauaaauuauaucuucaaaaaucaauaauuauagcuuaugagguuuuuuuuugcaaguggcaugacuuuacacaaugguuuuccauuacaggacaaaaaaugaggaugagaauuuccaucuuauauaucuguuuauucauuaauagaaaacauccaugcaaaaaaauuacacauaguaaaugugaauuuguacucaugcuuaggaguugaagauuuucuucuaaugacacgaguugauacugaauacagcuaauaaauuuaacuugugaucuuuaguucaaaaguaaauguuaauucucaaguuuuucaaaugucaucaaaaaucaccuaaauuaaauugaaauuuguuuagauuuagaauuuuuaaaugcugaguuaugaaaugugaguuuugugcuuuggagaggcugaagaugccucugcauuaaucuuuauuaagaauucugucuuccacucugggaaaccuucuauuuucaaaaguaaauuaucucucucaaaaauauuaguuuauaaaaagaaacaucaauaguucugucuguuauaugucacaaucuccaguugcaucagaucuugggugcaggggauaucacucuaagccaguuuuucuccaagggaagacccccuaccaguagcauuagcauugucugggaauuuguugaaucaggagcucugauuuuguuuuaauaagcaaucuguucuuaaaagcccuccaggugauuuuguugcuaaaauuugacacuuguguucaaacuuaauuauuuauguuagcugggaaguuuuuuaaagaguggguuucuacauccuuggcgagaccuauugaagcagaauuucaggaaaccaaagccggggaauaugcaucuuaaacucgacccauguaauucuaaugcagcugaugagggaucuucauugagaacccaguuagaacagugguucuuugcugcacauggaaaccuuuaauccggaaaauucuaagaauccugaugcccaagccaugcugcacacauauuaagucaaauucuggaggugagacucagacaucauuauuauuuuaaacuccacaaguguuuuaauguuuagccaaguuuaagaaccaauacuuuuagaaagcauuaggaaagaaugccaguauagcaugguggaaagcguaaggcuugagaaccagcccugugaccuaaggcaaguugcuaaaucucucuaaauaccaauuuuucagcuguauagugagggaauuacuucaagauuaaacaaccagugcaaagcaccuggcaguuucccuuccuuuagguguauuuguauugauuuuacuuugguuuauaugccagagaacuuccuuccauacuuggggaaaaaaaaauuuucucuaauauuuuacuauaauacuuuccauacuuaccuuugcuggagaauaacagugacuugaugacuggguguggugguucacgccugucauuccagcacuuugggagaccaaggcgggaggaucgcuggaacccagaaguuggagaccagccuuggcaacacagugagacccugucucuacaaaaaauaaaaaaauuaggagggcauaguggugugugucuguagucccagcuacucagagguugagguugguggauugcuugaaccugggagguugagacugcagugagccgugaucucaccacugcacucuagccugggcuccagagugacacccugucucaaaaaaauauaaaguaaauagaaaauaggagagagagaaaugacuugaggcuguuugacuugguuagcacuuaugcuaugaaaacaguuuuuacuuuccucucguuuuaucuaccugcuuagcccauguugcccaaaaauaagaaagacguuuucucauauagguaucccugauagcacuuuuagcaccaguugagucuccacuggucuaaaaaaguagauuuaguuuuaccaggaaagaucugccaucuggugguuaaauuugguaaugauaggcugugcagccacuguacaucuggagaaaaaugguauuccacacagcucaaucuagugcaaaaacuagucacuguacagcugcccauagagggcagaugcugcaacaaccuucuaaggaaccuugcguugguauucuaacaaaguaaaauuuauuuuuuucuaaaacaguuucauuuuugucacccagacuagaguguaguggugugaucucggcucacugcaaccccagccuccuggguucaagcgauucucaagccuuagccucccgaguagcugggaucacaggcaugugccaucaugcucagcuaauuuuucguauuuuuaguagagaugggguuuugccauguuggccaggcuagucucaaacuccugcccucaagugaucugcccacauuggccucccaaaaugcugggauuacaggugugagccacugugcccagccaaaguagaauuuucuaaccaaaugauucaguaauuguuuuguuacuaauaacuguuuagaaaguaucaucuggcaucuuuucugagcaacugaguuuaccuauauauauuacaaaaucaccauguuuguggauccaauuaguuuacuugguaugugaaauggucaaggaagucauggugucuagaacucccauauuucuagcaugugccucuucauuaagauuuuuuuuaaaaaauuacuauguaacggagauucauuugaauuccaucugagaaauacuuacuugcacuaaauuauaccuguucaauuagauaauuucaucuuucagcaaauggcuuagaagacaauaagcugguaguaauuuuauuuuuuuauugcaacaauuuaaagcuaaucacacauacaaaaacagguaacuaugaggugauggacaugcuaguuaaucguggucauuucucucucucuauauauauauauaccucaaaauguauguguauauauauauaucucaaaauguauauauauauauaucucaaauauguguauauauauacacacacaccucaaaauguauauauaucucucucaaaaugucauguucuacaccucaaagauacacaauuuucauuggucaugcuucaauaaagcuggggcagagggaggcaauccugaguaaaacaguuucccucauugcuaacagcugcacacucaaaugaaucucuuuucuccuuagagugggcagcuggauccacgucuacccuaauggaucccuguuuauuggaucaguaacagaaaaagacaguggugucuacuuguguguggcaagaaacaaaaugggggaugaucugauacugaugcauguuagccuaagacugaaaccugccaaaauugaccacaagcaguauuuuagaaagcaagugcuccaugggaaagauuuccaaguagauugcaaagcuuccggcuccccagugccagagauaucuuggaguuugccugauggaaccaugaucaacaaugcaaugcaagccgaugacaguggccacaggacuaggagauauacccuuuucaacaauggaacuuuauacuucaacaaaguugggguagcggaggaaggagauuauacuugcuaugcccagaacacccuagggaaagaugaaaugaagguccacuuaacaguuauaacagcugcuccccggauaaggcagaguaacaaaaccaacaagagaaucaaagcuggagacacagcuguccuugacugugaggucacuggggaucccaaaccaaaaauauuuugguugcugccuuccaaugacaugauuuccuucuccauugauagguacacauuucaugccaaugggucuuugaccaucaacaaagugaaacugcucgauucuggagaguacguauguguagcccgaaaucccaguggggaugacaccaaaauguacaaacuggauguggucucuaaaccuccauuaaucaauggucuguauacaaacagaacuguuauuaaagccacagcugugagacauuccaaaaaacacuuugacugcagagcugaagggacaccaucuccugaagucauguggaucaugccagacaauauuuuccucacagccccauacuauggaagcagaaucacaguccauaaaaauggaaccuuggaaauuaggaaugugaggcuuucagauucagccgacuuuaucuguguggcccgaaaugaagguggagagagcguguugguaguacaguuagaaguacuggaaaugcugagaagaccgacauuuagaaauccauuuaaugaaaaaauaguugcccagcugggaaaguccacagcauugaauugcucuguugaugguaacccaccaccugaaauaaucuggauuuuaccaaauggcacacgauuuuccaauggaccacaaaguuaucaguaucugauagcaagcaaugguucuuuuaucauuucuaaaacaacucgggaggaugcaggaaaauaucgcugugcagcuaggaauaaaguuggcuauauugagaaauuagucauauuagaaauuggccagaagccaguuauucuuaccuaugcaccagggacaguaaaaggcaucaguggagaaucucuaucacugcauugugugucugauggaaucccuaagccaaauaucaaauggacuaugccaagugguuauguaguagacaggccucaaauuaaugggaaauacauauugcaugacaauggcaccuuagucauuaaagaagcaacagcuuaugacagaggaaacuauaucuguaaggcucaaaauaguguuggucauacacugauuacuguuccaguaaugauuguagccuacccuccccgaauuacaaaucguccacccaggaguauugucaccaggacaggggcagccuuucagcuccacuguguggccuugggaguucccaagccagaaaucacaugggagaugccugaccacucccuucucucaacggcaaguaaagagaggacacauggaagugagcagcuucacuuacaagguacccuagucauucagaauccccaaaccuccgauucugggauauacaaaugcacagcaaagaacccacuugguagugauuaugcagcaacguauauucaaguaaucugacaugaaauaauaaagucaacaacaucugggcagaauuuauuuuuuggaagaaguuuaaucaaaggcagccauaggcauguaaaugaauuugaauacauuuacaguauuaaauuuacaaugaacaugcaaaauaaaaggacuuguaaauaaaugcauuaugaacugaugauacugauuuauuuaauggaucucaaaacaaacuuuuaacuuaaggcacuuuuauuuugccaacaaauaacaauaaacaaacauugaaacgguucacuauaaaauaacaaauggcuaauguaccugaauuuuucaguaaaaaaaugaacuucuaauaccaguugccuaguguccaccuccuaucaauguuacaagcauggcacucagaacagagacaauggaaaauauuaaaucugcaaucuuuaugauguaaauuuaccauccugauguauaaauauuuugugguuuauaaauuuuuuugcuaaaaccuacagaaaauaagcacugaacugucuuaugauucaccauuuguucacacugaaaauuuucauugauggggaauacaaaaauguuuuaauaacugcauuuaaaaauaaaugcaggcucacuuuuccacauguaaaaagcaauguaauaccugcacaucauaaaaugugaaaaggggguuauuuuuguccaaauacacccauuaaaaagguuuuaaaaauacaaugaaacuucuuuauaacuuuaaaaucuagcucaggcaccccugguuuggagcuguuuauaaggaaauuuuucugagcaggaaucguugcucuauaagcauuucauuucauuaauucuuuaugggaugggaaaaugcuugggagggucuaggucuauuauauauaaugaaguuucacuguauuuaaaaucugaucaauccuacacaaaauguguuuuuguaauucacugaauuuauauuacaugcuuaauucaaccugaauuaauuuggggaauauuaaaugauugaucuuaucuaaaucuaggggugggguuuuccaguguaauuucuccagcaucuauucaaacauucaccuaguacuuacuuaagaauuauaggagcuuuauaaaugggaaaaaaaugccauaggucuuagauaucucagugcacaaaaccgagaauuacuaauaaguuagccccugccaaucauuugagacauguggaauagcgcccuuggguuuucaucacacugacuuucaguuagccccaucucagccuaaaaugugaccugguugcaacuuaugucugauguuaguacccuguggcuggaaguggucaaagcuacgcauugaucuccucuacuuccaggccaagaaggguaaaugcaaugacugacaaaugcaacccuauuaagaaaaagccuacaguguaaacaagagagucuaugggcuucuuauauccaagaacugugauugauugauagguauagcugacuccauuugauuucaaggucuugucuuuaaggggagcuggggucucgcuccaucuuauucuaagguaauuuccucugguaagguaaaguaccagguucugccacagggcuuuaccuugugaccaucuuaaugcaaaagaaugcauuugcaagaaaagaaaaaaaaaaaaaaaaaaaagaaaccucucaagauacagaauuaacagggagaaaaucugaagacuaaaguaauucuaguuauuuucuuuauaaugcgcagggguaaaacagcauuccucaacuuucaauagaaucguggaauuaauuagagucguagcauaacuuccucaccuaaaaaaagaaaaaagauaugccccacagcuuucaugugcaaaaugauuaauaauuuaacucaccucugcaaaguauaaagugcauacaaaugcuaugcaauuauaacacucauucuuaaaacaguauuacuguuguuugcaaugcugagcuacaaaauauaugguucaaacugaacuggcaaagaaauuuggaaagaaauaaugauggaacaugacucacucacuaggcacaacauucacauuucgguugauuugccaaugcagucauuauauagauauauuacuuugaagaaaacaacuucauuagcuuaucuaaguauguuucuugagaggaaaaaaucugauauacaaaaccagcaaaaauguguacagauagaugauacaucuucugaaagcagauagacuauuaauuuagugaaaagaauaguuuuuaauguuuuggcaaagucuuuuccagcccagaguaaacacaaaaugggcaggcuggagugaaauauuuucacaguguacaaagcaguucacauggauguugccacagcaaaguaagcugacauguauuugaggucauuugcaugagucaaacuuugcaaugaguaacucacccaggaagauauaaauuauuuauagauaaugauuugcaaaagaaaaugucuacuaaaguuguacuagcuacauuuuaaaaaaaguagauuuacauggucugcucauuauagacaagucuauucacaguaugcuugacuauauuauauguaaaaucauauggcaaaagaaaaugaaauaacagagaacaugggaaaauaucccccacauauguuuuaaaaugcccugcaauuuucacauucaaaauuuuaugcaucuaaaucuaaaaaaauauuauauagaauacucuuaaguuacacaaacugauaauuuacugguuucuuuuuuacucuaauaggagcaaauuaccacauacuugaacaaaguuaaaauaguuacuauuucuuuauaauaaauuugauguauaauuuacuugugcuuuuugcaccaauuuauaaauacaguauaugcaauacacaaccaagacugacacugacaguaauaauuaaauucaaaagagcaaauacuuaccauacaaaauaaacagcaaauacaccuuuuaugaaaaccagagccuucuggacuuuggggccagauucucuggaaaccaugucaagugugagcacuggaaucucaagccagcuacuggauuuuuuuuuccccuuaagguggcauaagguucaggagaaccaaaacuggcaauaaauaguuggacgauuccacugcaguucuuucaggccuuuaggauuuacauguuguaccuucacaaugacucucaucaaugaucuugccucaaaacaaauuugaguacagcuacuucuaacagguuuccgcacaucuuagggcggcucucaaagaaaccuugguuuagguucuugguuuaagaaguuuaaguacgaagcaacaaucuguuucagcaccuuuugaccacaacaaaagcaaagaagaguccuacauaaauaagaacaaaguuuauaaagugcuuaugagauuacaaacauuucaaauuagagcgaugcaaauaaauguccguuucaccaucacaggugaaugcagaauaaacaggccauguuucugucaagaucu

SEQ ID NO: 13636 - RNA, 963 nt, Homo sapiens
cauggacguagaggccuccgaguucuucaggucuggaaaguaugaccuggaauucaaguuucucgacgaccccaccagguacaucucaccugacugucuggcugaccuguacaaguccuucaucaaaaacuacccaguggugucuacugaagaucccuuugaccaggaugacuggggagcuuggcagaaguucacggccagugcaggaauccagguaguggaggaugaucucagagugaccaacccaaagaggacagccucggccgugaaugagaagaagugcaacugccuccugcucaaagugaaccagauucgcucugugacugagucccuucaggcgugcaagcuggcccaggccaaugguuggugugucauggugccucaucauucuggggagacugaaaauaccuucaucacugaccuggugguggggcugugaccugggcagcucaagacuggugccccuugcugaucugagcgcuuggccaaguacaaccagcuccucagaauugaagaggagcugggcagcaaggcuaaguuugccggcaggaacuucagaaaccccccagccaaguaagcugugggcaggcaagcccuucagucaccugguggcuaauuagaccccuccccuugugucaacuccggcagcucaagacccccgagcaacauuuguaggggccgcugcuaguuagcuacccuugcccaccgccguggaguucgcaccucuuccuuagaacuucuacagaagcagguugcagugagccgagauugcgccacugcacaccagucuggagacagagugagaguccgucccagaaaaaaaaaaaaaaaaaaagaacuucuacagaagccaagcucccuggagcccuguuggcagcucuagccuugcagucauguaauuggcccaaaucaccggagccacgugacccuccagugucaucuccgggguggccacaggcaaga

SEQ ID NO: 13637 - RNA, 2313 nt, Homo sapiens
cucuaagagaaaagcuuuuguuaaugugucauguaaaaauacauuaacuaguaacuugucaagaagugcuagauuccauucuugugcggguccauuuauauauguuccugaacagcuaauauuucauuuaguuuccaauuaaacuugcucaaauacauuuuugaagugcauugcuuaaaauuuacauucaaggcaagaaaacgaguuugucaguaaauguaguaauuaaggaagucccaagucuguauuuuuaagauacuagagguaauuguaacuaaucacuuuaacuuaaagaaauagaauuggaaauaccccccuccccccgccacccccuaccaaaaccauaccuuagucacuuuggaauuauaaccgucuuuuacgucuaucaauauaaauguauugcauuuggcauucaaauuacuuucaaagggauaaauuucgaauuuuuuuuuuucauuguagcuucugaucuuuaaauguacugaacaggaggauuuggggagcuugucuugucugauagguguuaaguaucuaugacgacaaauuugagcugaagcaaugugcaauauggacuaguaauaucuucacaagacuauuuuggaaauucucacguugauguuauuaaugacguggguuuauuagcauuuggguaauuaagaaaaaacaguacuagaauuuaaaaaaaagaaaaaaaaagguaagaagggcgaaacagaguucuccacuccucucccaacccucauuccuuuggaggcucgcgcccucuuggaauagcagguuccugcaugugccagaaauccggucccggcaaagcuagacgcucugcaaugacaggcguucccagcuagggacuccuggcugcuuggagcuugaaaacaccuggcgugguucucgagggcccuagaggcuccugcuacggacuggucggcucugggguuguaggcagaaggcucuaagcggucggaaggguuuccugugugucagcaacuucacuuugccgagauagcuggcggaagagggaaggagcgcucgcgggccaaucgccugccagcagccaccuuggagcgcaccccucucccucgccgccgacuccgguagcagcgugccggcagaggcugaacacacucggccucggcggagaccugcuccccagaagacgccuccugcuucccacugcgcccuggaggacgcgggcuggcugcugggcgagcucggcggaggcacgccccucgccuccccgcggagugcggacucgccccggugcccaaacuccgcccacccucuagggagcuccgcucucccgccuaaccccggcacuccggacagagcugggccuggggaagggguuccugaacuacgcggacgccgaacgggacgcgcugcagaagcgcacgagucugcggccacgcgcgcuccgauggcugccaggagcugagcucagggugggcggaggaagcgguuagacgccccgaaacugagcugcacguuucuaagguagggaggaggaagaugcccccaauuaaguugaucuuugagccaaggaggcuggggagcagccuccccaagcuagagcccugcagagcgaguuucccuugaccucgcugcgccucuggcgcgcucugcagcgcggacccgcggccccucgggaaagcgcagucggaaaguuauccgcggcgguucccugcgcgcccuguuguguaagcucggcguugccagcggacggagaaguugcuggcuugcccgauagcccaguucgguggcggcccggggcggauuucauggcccgcggcgaacgcggggccagagcuggcgugggcgagccccugcgcgcccccucccgcggggauccaguucgccugcucccuuccgcucgcuggcuuuuccgaugcuugcugcgccccuggccgccgcugcccucucgccgccuccuaccccucggagccgccgccuaagucgaggaggagagaaugaccgaggugcuguggccggcuguccccaacgggacggacgcugccuuccuggccgguccggguucguccugggggaacagcacggucgccuccacugccgccgucuccucgucguucaaaugcgccuugaccaagacgggcuuccaguuuuacuaccugccggcugucuacaucuugguauucaucaucggcuuccugggcaacagcguggccaucuggauguucgucuuccacaugaagcccuggagcggcaucuccguguacauguucaauuuggcucuggccgacuucuuguacgugcugacucugccagcccugaucuucuacuacuucaauaaaacag

SEQ ID NO: 13638 - RNA, 1434 nt, Homo sapiens
cauggcguugucgaugccguugaacgggcugaaggaggaggacaaagagccccucauugagcuccucgucaaagcuggcagugauggugaaagcauaggaaacugccccuuuucccagagguucuucaugauucguugacucaaaggaguuguauuuagugucacaacuguugaccugaaauggaagccugcagaccuacagaacuuagcucccaggacccacccaccguuuguaaguuucaacagugaagucaaaacggauguaaguaagauugaggaauuucuugaagaagucuuaugcccucccaaguacuuaaagcuuucaccaaaacacccagaaucaaauacugcuggaauggacaucuuugccaaauucucugcauuuaucaagaauugaaggcgagaggcuaaugaagcacuggagaaggaucuccugaaaacccugcagaaacuggauaaauaucugaauucuccucucccugaugaaauugaugaaaauaguauagaggacauuaaguuuucuacacauaaauuucuggauggcaaugaaaugacauuagcugauugcagccugcuccccaaacugcauauugucaaggugguggccaaaaaauaucacaacuuugauauuccaaaagagaugacuggcaucuggagauaccuaacuaaugcauauaguagggacgaguucaucaauaccugucccagugauaaggagguugaaauagcauauagugaugccaaaagacccaccaaguaaaauugcauuuaugaaagagaugucuucaugucuuccccuaagaauaugcuuuuccuaacaggcuacucuucuucuuauagaguagaaauuguauuuugcacgaacaugcaguuauugaggauuaggaucaaggguagacaagguauaguaguuaucuuaaaauauacacuccuugaccaggugcgguggcucgugccuguaaucccagcacuuugggaggccgaggcgggcagaucaccugagcaggaguucaagaccagccuggccaacauggugaaaccccgucucuacuaaaaaaaaagaaaaaaaaaauuagcaggacgcgguggugcgcaccuguaaucccagcuacuugggaggcugcagcuggagaaucgcuuaaaccugggaggcagagguugcagugagccaaguucacgccacugcacuccagccugggagacagagcgagauugcaucucaaaaaaaaaaaaaaaaaauauauacacacacacacacacacacacacacacacacacacacacacacacuccuaagcaguauuauuuuaaaauccuuuuacccugccuaccucuguacccguguuccccucuuuuuaauuuggagacacuccaccacaaacuuuucacuuuagagguagcuugccaucuuucaggagcccucaccauuguguc

SEQ ID NO: 13639 - RNA, 75168 nt, Homo sapiens
cgcgccgcgcugacgggucguuagcggauacggcggccgcaggggcggagucaagggccuuugcccgccuuggcggccggcucuacguucccuguucucgccugcagcuccgccauggcuccuaaaggcagcuccaaacagcagucugaggaggaccugcuccugcaggauuucagccgcaaucucucggccaaguccuccgcgcucuucuucggaaacgcguucaucgugucugccauccccaucugugagugcugggagcgaggcggguuaggcaggccgccggcuagucgggcugggcggggacguggcaggacccggcgagcagggaaggcgugggugccggccgggggucggcaaucucuccagcuccccugagcucggggaggcacggagccucuucuuugggcacaguguugucgcuugggauuguccugugcagcacucggggaggucacuuguuaaaaguacgcacguucccgagcuccaccccaggagaaggugguuaacuaguucugggguggcggccccgaaucucuauuuaaacagacaaacucaagcauacugccucugcccuuuucuauacaacuguugcuugccguuacgaaauuuuaaacuuauuacuuauuuugcauaaauuaguuaggugagaaacccaugaagugacccacugaauuauaagugcaucuuuacgugagcuacuucacaccauugcauaauuuuccugguuuuugcaaaaagagagagguugaagugccagggguuagggaucuaccuuauuuauacuuuuuaauaauccuacuggaccaauucuagaauucucacuugguugggaaacugcagacuuggacaaggucguuuuuaguagagcucaaguuuccagaacuccugucuuuugcugcacuguuguugggcauuuaaaacuaaauguauuuuucucuuuuguccuuauacaacccagcgugccauuaacgugaugugaagccauaugauggcucacuaauuggacauagcacugcuuggaguucugauaacagccacgucagcaaggaaacuaugguuuggggcugcacguggcauuuuggaauggccuguguuucgcaugcuaguacccugaugaaugaaauuugaagucugacuugugauuacguugagccagaguuuguucucauuuuagaaguugaaaucucaucuggacuaguaauaggaaggugauguuuuucaaauguucugaacuggaaagcuugagacuauacuguuacugguuaucucgcuucugaagauccucagauacuauuggauugcauaacuaauaaccugguauuuuaccaggcuuagcuauaauuaauuucgcaggcuuuuguugcgggguuguaauguuuugcuucuuuuuguacccuucccccuuuuauuuuaauucaggguuauacuggcgaauauggcauauggaucuuauucagucugcuguuuuguauagugugaugacccuaguaagcacauauuugguagccuuugcauacaagaaugugaaauuuguucucaagcacaaguaaguauguuuuucaagugaaaguacguacuacauguuauauuuuuauaugucuucuuaaagaucauuuguguguguugguuuuaauaagcauuaauuugagauauauauauuaauaaacauuuugggggaaaggaacauugaugcuaggaagaauuauuaacuaacugaaguagagacaaugaucauucugacacggcuacagaagcagauuuugaggguggaauuagaacacuuaaacacaggccuuaauaugagguucaucagagaaacaaacccaccaaguaaguuaacauuucagaagcuaaauguaauuccuuauggagagaauuguucugggcucuucacguacuauuuuuggaaguuaaagaaaugaucuuuuugucauuauuauuuuuugagacaaggucuaguucuugcccagucugcagugcaguggcaugauuaugguucacugcagccucaaccuucccaggcucaagggauccucccaccucagccucccaaguagcugggccuacaggugcaggcuaccaugcccagcuaauuuuuuuguagagacaggccauguugaccaggcuggucuuuuuauuuuauugcuuuuuuuuuuuuuuaacucucugucauuuucaaugcuaauuacguuuguuuucauacaaguguauaaaauguaaaggauuaacauagucuaagaucacacauacuguaaaauacagcuuuuagagaagaaaacucaagccucaccacaauaaacuuauaccuuaauuauaagcaauuaaauauucuaguuucauagagguuaaaaugcaggaucacguagacuuaggaaagaugguaacauuuauuauuucucagcgucaugguccucauugucucauuggaagugguauaaauuguuuaauugacgcccuuugauguugcuuucauguacacugugauacuuggguagggauagcaggauuauuucccuccuuccuugauggggucaucuaggugcuguauugcuuugaaaguaauuucuuaaaaggcaauuggaauuucacugagacuuaguacgaacauacuuuguaugugcauuaucuuuucauccauaguucucacucuaguuuggaugcuguuuuuacuuguauugcuguaacaaccuccaucuggucuuuuaaaacaaguuuagggcccgcccugccaugcacuguaugaagcacauugcccuauguaauccuuauagcauccauaugaggugcagguauuuuccuuguuuuauccaaugaagaguauguauuucuccuuaugugacaucauuuuuaucaugucauucucauaacaacucaucauggcuuuuuuuuuuuuuuuugagacagacucucacucuguugcccaaguuagagcgcaguggcccaaucuuggcuuacugcaaccucugccuccugggcucaagugauccucccacaucagccucccaaauagcugggacuacaggcacgcacuacuaccacgccuggcuaauuuuuguauauuuuguagagauggaguuuugccauguugcccaggcuggucuugaacuucugggcucaagugauccgucugccucggucucccaaaguucuaggauuauaggcgugagcugccguguccagccauggccuguuuuuuuuaaauguauuaaagccaaauucuucuagaccccuggaaugcaagucaucugcuuccuuccuaugagucuggccucaucuuucagaauuaggcuuuaacccuucugacucagcccucacaucauccuuugaauaugucuugugcccuacccuauuuaggauuaacuuacuuccuuuccauucuuaccuguguuuuauuucuagaccuaggaaucuuuuccagagaaauccuuccugauuuugaucauuucuuugcuuuauugucccuguguuagacucuuucggggaaugaggaauagaaacauguugagaugaucucaguuaacagggguuuauuuuaagaaaugucccaaaauggccucagugacugaaguggccuuagcaguuuccucccuacuguucuggacacaaacgagcucagguuuucguggcugcuguucugauggaccagcagauaaauuggguuaucuuuguuaucuuucugcuuggcagccccucaaccagcugcuauuccaggauucagcucaugugggccuccacuguaugggacuguuuccugugaggcauggccaucuguguaucgggaagcccucacaagugggcaucugguaugacccauccuuuguaauacucuuggaacucagucccuuugagacucgucauucuuuacuuauucuucauaacauuuuucauucaucucuuuagaaucaaagucauguucuuuuuaccuuuuccuuucuacuuuaggcuucuugaagacacccgccauauuuuauacuccuuaaaacaguuaaugguacauuuaguucaguaaaauuucaaugacuuacugacuuaauagacucagaauggagguuuuuuuuuuaagucauaguuuuggcuuuauauuaaauaugcuacugacuuugaaaugccuacagauuugcaagaugguuaagguucaaagauccagcaagaugcugaguguggguagcuguuggcaguagaaggaagauggcuucagcguugacagucuggguuccagugccagcucugccacucuuaaauguguggccgugggcauaauuuuaccuauguagacuucagauuccucagcuauaaacuggggaugcuaguggaauuucagaggguggugaggauucauuaugaucauacauguuaagcauagagucuggcacauaauaaauguuuaugugcaggguugaagagguuggggcuaagagagcccuuagaaguuguuuuuguuuuuuaacguggcauaauuuaaaccauguuugcaaagauguuuuuauuuuaagaaaucagguagugucuuuuuuuauuuuuaauuuuggaaguguucugacauacugaugugaaagaguaaaggaagaaaaauacaauugauuuuauggguuaucuuaguugacuaagugcuaggucacuagcgugaccucuauuuuguuuuagaguguucagcacugagugagguuuauuuucugagagcucuaagacagaggggagggcuuccuccucuugaguugcaguaaaccugcagugugguuguuaugccccugguaggugaggauaaaauucuagaccuagaagagaaauugcuuaguuaucugguguaaugucuucaugaggauuuaucauguggacaaucgguugacuguucguccuaaagacacauagugacaaccaacucuuuugaaaaugcaguaguuuauuccugugugcuaacaacuugauaguugggguguguguauauauuuuuuauauuaagcuaagaaagguuucugcaguaaacuguguccauuucuuuucaguuggucuuuuguggaaaaaaaaguugucugauguuaaguucaagaaacacauuuauuuauuuuuaauuuuucuuauuuuuccuguucucacaaucuguucucaugaagaaacauauuuagugccuggucugcuaaagagguucagagagaagaaucucugccuuuggagcugaguguauccgaagugcaagaagcauaugaaaaaagauaguuuuuauauaaugaaaugaaucaaaugaaguuggaucuucggaguaaaaaguucauuuuaguguccuaaagugucucuuaaaaagacagcucucugcccccuuagcagccuuuuacuuuagguuucagaauugauuuccucuuaauuguguguguuuuguuuuguuuuuuuuuagaacuauuuuuuccucuuuccaguuaccaauuugugugggguaacaagguuuaaaaaguaacuuuguaaaccuuuuaaaaaauacauuauuugaaacugacuaaacguuuucuuuuuauuaauaacaaugucaauucuaacucaguucuugagugagagagcuaaagauggagacagguaaaaaaauagguaaaaucaguugcaauuugugcuuaacuuguaucccagacacccuuguaguugaagaucaagauugaaaacuccugccuugaaugaccuggggcuuucuguccaucacacccagcuuaaauuguccuuuggaguaaaguuaaaauaauuacuuuaagauauuacagcuguuauuuccacuucguuuaagccuaguuuucgcuccuguuauguacuuggaauugaaauaauacaucauuuacuaaugccuuaugaaauuuauuaguugaacaguuagaugauagguuaaaacaaaauguaguuaaaaugauucuuaacuaaauuguguuaauagcauuugacuuuauuaaccacauuaauuccuaaacuguggaaaauucuucuuuuuaaggggaaaucaaaacacgucacuaauaaaccacaucuuggacauuucucgaacuucucuuuuggcuagugcaguguaauaaacuuggaacuuucugcucagcuucuuuucuugaaaugugaaauaucauucuguugccaguacgaaauaugaguacgguguguuucugagagagugugauguucaccucuguagcauauggaaacuuuuucuuuuuuucuuuuucuuccagaguagcacagaagagggaggaugcuguuuccaaagaagugacucgaaaacuuucugaagcugauaauagaaagaugucucggaaggagaaagaugaaagguuugacuccuguuuaaaguauggccaucauaaaaggggguacuuugaagagaauuuuuugauuuuugcuuaaagaauuuggauuuuggaauugucugagguaaauuuuggaauuguaguaguaguaguaauggaaauaguaauagcugacuuuuagaguuuuuauuacaaccagauacuuuuaucugugcuguacaauaguugauuuauuccucuaaagaguccugugaaguagguacuauuuuuaucuccuuuuuauaccugaggcaacaaagguacagaaagcuugaguaacuugcccaggguccugaauuaguacaugguagauccaugauaagaacacaggcaguuuaacuugagagcuuguacuuguaacugucugcuggaauugaggaggcaacagagcuuuguacagagcaggcuuugucuguuaauaggugcacaaccuugaacauaucgccuaaccccucugggucugaaggguuuauguguuagcaugucuauguggugguauuucuguuccugagcuucccgagggauaucccauaauuaguuaucuguauugguugggaaaaagaaaauaacuggguuuuucuccuguugcccaauucugugccacguuuguuaaccccuagucccaauuuuuucugccggcugcucuuagaaggcuuauuggacaaucuuaacaucugaguagcagaagucccugaguaaacuugugcugaagaauugccacauaguuuaauaguuguggaucugcugguuuucauggaucuuuuguuucaguaucaagaagaugcuuuguuggaacauauuuuuuaccccacuuugcuccagaacuuugugugaacuuccauuguuaaagugcauauaauauauuuucuguauuuaauacgguuuucuuaaaaugcauauaaaacaaguaacacacuuuuaaaggaccagaaaccauuuaaaaggaggaaaagguggaugagcaaguaccuuagaguuaguuacagcaacugagcacugaacuuaguuguggguuuccaggugucaggggaagcaucugaggucacauagcuuucauugucugacgagaagcagcaugcaaguccuucugaaaagaaacuuuccuggcacuggaucuuggaaauacuuuaucaaguggauccuuauuuaagggacacugaguaacuuaaugaacaaugucuucuauagugguuuuggaaagguaccaaaacauuauuaaaaugauuaucuucuauggcuccuuuauaaaacugaaggcacaguauuaugacaauggaggccuuucugcauggagcagcuuuaaugaggucgggcugcauagcuuuccaauugcuuguuuuuugcauagggaucaagguuagaaaaucuagguaacuguuuuagaaaaaacuuuuuguuguauuuuucauuacagugguguuucuuaaacuaggguaugcauaguuaccuaaauuucaaaauguuuguuacagcuuuuaaagguuuucagugauuaauuaugucagggauaguaaauggguuuccucugcccacugcagucuugggcagauuuggucuggcacuuguucuugauccuggguuaugucucggaaucuuucucaguuuaguguucagguagucacuacuagugacucaguugaaauugggaaugaaaccuuugccauuugcuggauuagguauuucaaaguggggugagguggagguuucauggauauauauaagugcagagugucagaacauuauaaaauuucucuucuuuucauugguagaaauuuggcuguuuuuauuuccaccauaaaagccauacgggauacaguuuguacuguauugauugaccuugauaacugggaccagagccucucauuaagaucuagcuuguuucucucugaaagaauuccaggagauuugauguaagaagaaggcuuaucagcauuucuuugcuuagauguguaucucucaaagcucugucuacauucauuuggaauauauacuccaugccgcuuaaaaguacuuuaaaauguucauuuauccaaggauggaaauaagcagaggagaaugugagauucauuaacauucauuccagagugggagugugguuucuucuugauuuacaggugaucuaucauuuaacaguugcuuggucucaacauuucucuuguaggaagcucuuccugaaaacauccuuaagauauugagaagugcucucccaaaccacguucccuacuaggaagaaaaugucuucuacuaggcagaaccguuggcaaugagggcauuuggggguccuaaauuuaaaacagaaacaaaaacaggauauggguggacucaguaaaaguucuaaaggcugucaggcaguccugacuuuauacacugauguaacuaacacguggucauauugggaucuagggaaaucuaaaggauugggccacuucuuucauuaaaagcuuuuugaaaaugguucuuguauuagucgauuuucacagugcuauaaagauacuaccagagacuggguaauuuauaaagaaaaguuuaauugacucacaguucugcaugacuggggaugccucaaaaaacuuacaaucaugguggaagguaaagaagcaagugccuucuacacaagguggcaggagagugagugagcacaggggaaagugccauuuuuaaaccaucagauuuugugacaacucccucacugucacgagaguggcaugggggaaaccacacccaugauccagucaccucccaccaggucccucccucaacauguggggauuacaauucaagaugagauuuggguggggacacagagccaaaccauaucacuucuuauuuagggcuugacagaaaagaaguuaaggagaagcacugugaugcaagugagauaauuuuaucaucuagaguaaagucagccuaauaaccuacguaagcaaccugacuucacugggucucaugccggagucuuaaaaauggaggcaguuguccugaguguucauucuaguguuaaaccauguugagacuaugcaucuuacuaggcugguaucauugaucaguguuagaaugacauguuuccuggaacuccaacucuuguguuuuaaaaauuuacauuuaaacuucuaugaaauuagaagguguuuuauaguugauggcugcacuuaauguccuucccuuccuccaaacuuacaguaaauggaagaguuauuaagucgauggugucuguagaauugaggaaauauggcaucuguuagagacuacagauuucuuaagaugagcauaagauguuaauuagccuucauuuagcuccuuuccggcaaaacuuguuuucuuuggauuaguauacuuaaugaauauaaugugucaguuaccaaugacuuacuuaaagugcuguccuuaggguugaggggaugugucaucugacuccagaguagguuuaucuuuuugggagacaaagugucuacaaaguggccuucaaccuuuuugauaaugaccuacaguaaaaaauauguauuuuaccuuuugaccagauaaacucacacguggacacaugcacauguuucauaaaacgauaauuauccuacucugugcgaugugcugcugauguuuuucuauucuuuccuauuucauuuuuuuaaaaugcuggucucaacucaauuaauuucuaugggcauucgauccacuugauugaguucacaucccacuaaugggucacaaccuacccuuuuaaaaacugcuuuacaaaguuaauuaaccaacaagaaugaaggcucccuuauucacaggcauccuauaacuuccuuuugcaugugugaagggguaaaagaaaagauggaugaaauaccaguaaauuaauaagauaaacuaucagaacaaguaaaauagaauaaaaaguagaaggauuuuacaggcauuaaaaaguccuccuaaugauuaagcgcucuuuuuuuguuugaauuaauaaagauggcuaacaauagccuacuucugugagaccacagguaauuuuugucauugggauugucuucugaaggugugauauugaagucugaaauccguaggcuguagaaagccucaagcccaagguauagccaaggaaacuccacaggcugcuaaucauggaguuugaguuuuagguaagggccaagagaaagauauuugacuuagcugcugaugaaaccgugcggguugccauuaaugaguccuuucuuccauaacccugguugccugggaaaaaugguaacauaaccagcaugauguuuucuucacuaucauagagugacauauuuuuuuucaguggaagaaaggggacaauucugacuaaaucuaauauuacaaacacauucuuacccuagaacacucaaggaaaaacuuguuuuaugaugaacuagagccauaugguacuuaaaaguuuuuuuaaaucauauuuauaagcuuguuugacuuguuucugugucuguagaaucuuguggaagaagaaugaaguugcugauuaugaagcuacaacauuuuccaucuucuauaacaacacucuguuccuggucguggucauuguugcuuccuucuucauauugaagaacuucaaccccacaguguauccuuuucaagguugauuaucuuuuuuagaagucaagaaacaguaguucauuuugguuuugacuugucuggauauuuuaguggaaagaaaaacugcucugggagucaguccauuaaauagugcugacuuuagauaacuuucuggacauuuaaaauaacagcuauugguuuaagauucuuuuaaguuuaugaauuaugacuguaugauaaaguauuacaaaguagucuaugggaaucuguguccuugccuccuuaaaaaaaagcuccaaagagccaaagcaaaccugucauuuuugauagcuucugaaauaauaagccccuguaccuguuauuuuugggcucuggggguuggguggauggccaaugcaguuaaauagguucauuccaguguaucuuaauaguguuucaagcugcuguuaaguugagcuuuugggcaagaaucagucuucucuuauuaauuuauuaaagauguuauccaggaaugugcagccaagauuuuaacaauuggugauuaugauguaauaaaauaucagauacccuccaacguguaccuucugggaaugcuggagugauuugcugaaaauuguagaguucugaggcuaggaguagcuucgaacuuuuagaaccuccuugcuguugcaagccaacugcagcaaaacacugauuugcagggaagacuuauuuuuccauugcucuuaggggaagaaaaggaaaacaaaucucuuuucucuccauguucuuugaucagcucuucgugaagguuaaauggaauucagauuauucuuugugaucauguguucuagguuucugucuaaaguguuuuuuuuaaauuggaacacauuuccugugaauguuuuccauuuuuuuuuggucuucugucuugcaaauuguguuugcagacaauggggcugcacaucauuaugauuacaccaagugucaggaaggaagcaguacauuccaaagagaugggcucuuuauuuucucaaaaaaccaauuuggaguuacucauuuuuccauaacauuaaauuucuuacaggaacuacauauuguccauaagugcuucaucaggacucaucgcccuccugucuacuggcuccaaauagaccaugucagcuucacccccuggcuuugugucuauggguggccugugguauauggaaaaguagcaggguggucagggugggagacacaagauguuuuuauagucuagagccuuuaaaaaacccagcagaauguaauucaguauuuguuuauuggcuguuuuuugacagauuguugaaauuaaaugaauugaaagggaaacucagaguacuaggacguuuauuaaaaggaaaaaaaugucuugcaaugugcuguaaucacaagaggagaaaauaacuuguuuccuugaucugucagaggucacaguaaccugggccgagcuguuauuauuuauuauauaauaguaguaggaaguuaauaacugguucucuguguuccaagcacaauauuacaacuucuuuugaaccguaaauaucagaaugaauccucuucccaggggauugaacagaagcuuaauguuuacaaguguuugaauuugugaucugaaauaacacaaaauuaaaaacaugauuucucuaauuuuccaacuagaggaagagaaacuuguggaaaaguucuuuuuuuuucuuuuuuuuuucuuaaagaagggcagccaagguaguaaccuaaaaauagugcccaggcauaugagaguuguccuacgagguuaaagaacacacuguuccacuguauggcuuuggcccugaguggccagggaggucaacuugacccugccauguugguuugacuuacuaagacacaggaaucacuguuuuccuugaccagggucucacacccuggaggaauguuaaguaagagaaagaaccucuuuccugaauauugacauguaaaagaccaaaguaauuuuucugaacuucugcaauucugagaacucuccaaggaauuuacagugauuuuagugcuugucagcauuuuuccaugaggacuuucauacauuugacucuuuaguucacagguucccauugauugugagcaagauauuuaucucuuuagcccuuggggauccagcugagagcaaucucuugcauuuuuuuacccguguauguacagauaucauuucuuguguaugccaugacuugaaaaaguuugggaagcucuuuagcaauaucagcuaaaaggauaugaaaucacaggugauagcaguugucauucaguaauuuccuacaagcagcaccccaaaggaaauauaguccuaaucuuuacuauccacuucuaaauuuaaugugaauuucauacauguuauuaguuguuuucuuuauaauuuuauaaaaauuauucaucgggaguuuaacuuccacuuccaugcuaucggauguguugggcuccaugcaagaacuuggaagaaaaacaggcaggaaugcauuugcauaaugacccagaucaucauuuucugcaacugagaauuauauuucaucauugcuucuagaagucugcaauucuuuacuuuucuuuggugcauuauuaucuaggugccaucacuggauaauguggagugacuagagaagucacauaucacuguaagguacaguuaggguaacacuuuagagguuuauuauuuuuaaaaaacuuuucuugaacuccuggccaacauggugaaaccccgucucuacuaaaaauaccaaaauuagccaggcgugauggugggcgccuguaaucucagcuacuugggaggcugaagcaggagaacugccugaacccaggaggcagagguugcggugagucgagaucgugcuacuacugccuggguggcaagggugagacuccaucucaaaaaagaaacaaaaaaacccaaaaaguuuucuuuacuguugguuaaaaaaaaaagccagaccauaguuugacugguggcauggaauuuguguaucaaauaaaugcauuugcuuauuugacaaaccaucaguguccacuauuuguuaccagaguugggccacuaucuuuuaaaauugcuggugaaaacuugccacuagauggcagugccuguauagauggggaaaaaauugccaccauucuugguauaauacaguguagcuuagaugagguggugaaauagggguaucagccgaauauuccuaauauaguuucucuugaauuaauaaacugaagauuuguaggaaaaugagugagcaaaauuuguuuacuguugugaauuuuuccuacagcacuguuuuuaaucuugauguuuuccaacuuucuguacuaauagauacauuucugugcauaagauuauaaagcauauacucacaguucaguaguuuucguuaaggauuuacugugugaguacuuuacugugaggaauugcagaaccuuuuccccucuacucuugucuaaaaguucuguguggcacacagagaugcgaccuacucaaucugacuuaguaaaaccaugcuguagaauuuuugucuuaaaaagaccacauacccagcacccaugaaauaaaagauucaucuguaauugggauucaaagugauuaaauuccuuuguucauacucauaaauagcacuaaaguguuauaacauuuucauuuaccuauuuuuaguuccuucauuuuaacuuaauaaaaaucuuggauugauauucuuuuuuuuuuuuuuuuuuuuuugagacagcgucucgcucugucacccaggcuggaguacaguggcucuaucuuggcucacugcgagcuccgccucccagguucacgccauucuccugccucagccugccgaguagcugggacuacaggcgcccgccaccacacccggcuaauuuuuuuguauuuuuaguagagacgggguuucacccuguuagccaggauggucucgaucuccugaccucgugauccaccugccucggccucccaaagugcuggaauuacaggcgugagccaccgcgcccggccuagauugauauucuuaagcaauaaaaguuuacugguuguccuauuugccauauuauugaaacuuggaaaggauaauuugaaacaagguuugaaguuaacugaaauauggagauugaauuuauacucaauucuugugaaaagucuugcuuaauaaguaugauuaaacuuugcuucuuaaaauuuguauuuucccuacacuucuuuauaagaauccuaugaugaaguacguaaucuuuauuauauuauuuuacauuaaccaucuuuuuuuucaaauuguuuuauuuuuuauuuuacuuuaaguucugggauacaugugcugaccaugcagguuugguacauauguauacauguaaccaucauuuuaauaucucacacauguaaaugcacaucuuuguaguuaccaaucaaauguaugugaggcaaugaaaggcauugagcaguuacaguaaagggcagacaucaggccucugccaguauguaccugcugugccuuccugccugcccuauuucuuuguuuucagugugcaugccagucacugcugcuucuggagacaggauggaaggauacauguauguguacauuuauggagaaaaccaauuuauagauguaucagagcucuaagggauucucuuucacuuccuugggacucccaagcagaggaauuaauagauuaggagggucuuuugggggguugguuuaaauuuucagggcgauagaggcuaacuucucguuggccuucaugaauuuucaauauaucaucuuuucgcugacuuaucccuguuugauuucugaguuuggauuaauaacuauguuuuuuaacuucaacauucucacaaacaauuucugcauaaaacuucuucuuuaaagcuuaaaaagaaaaaaaaaucuaccuaauggagcacugaacuagaacacaaaauacuuggguucuaggccugguucugccaucaacuagcagugugugaguuugggcaaguuuuuucaucaucuguccaggccugcuuugcucguuugucaaagagggauggcuuugcagauggcuaaguuuccuucaggcucugacaucugccucaugacuuuggcacucuugucaugaagaugaagugacaguucuuuuaaagugggaagccagacacaggguuucuaguuugccugagauuuccauauagggauggcugguacccagguuaccuuuuggaaugauagauucucugccagggaauucuuuuuggaagagaaaagaaaauaauaagagugcguggaauuuuuucuuaaggacauaacuaacuaacuaacuaacugugaaauacauuaguauauuuaccaugacagauucgcauauaaaaaacuggcuguucccacagcuaagccauaauauuuauauuugguuuugauuugcaaguaaguuuuuaaaagugaauuugugaagccuuaaccuuagugcggaguguucuaaaacccagugagaaaugguaucuucaguaguuaaucuccauugauugauugaugauagaauauguuuggauugcaauuuaaaucucagacuuuugaucacuacuauuucuguugaguauucagugcagcuuagcugccaauauaauuuuuauuuagaugauuauugccuaauuuauggccacauauauuuuacauguguauguuuuacauauauggaaaauacacauaagccuuacagugaaagaucagauaaaaucuauuguaagauugaaugcacaaaaugcuuuuauuacucuaagcaaauaaaucaaucaaaucacauuucccauuagacagcaccucagcuccucuauacauacagcaguucgcuggauugaauacacaaugaacaacugaaaaugaucaauuuccaucauucugauaacacgggcaaaaaauucaaacucucuguuagaauacagguacuaguaaucaaaaagaaaauuucuugauaucucccacuagcauuuucagauuuagaauuuaaccaugaaguacauaucuagaacuaaugacagaaaaaucgcauuuuaaaauaauauuacaguucuucuguaaaccucagagugauuucuguguggggaacuugcugaccagaaaauuaaaugagaauuuuguacauccucagauagccaaauagaguuaaagggccacucccacaccacccccuucaaaaaaaaacaaaacauguuuucucucuuuuuacagauauugacacaguauagucucacaauuuuucucaagugggauauuaaugaggguaaguagccaauaguggcagggcuagauacaccucagauuucgagugcaacaaggguaagccccauuaauccaugcaaagaacuuucaugcauauaguuuagugcauauaauaugauuauagaaccagaaguucuuucuuuaacauuuugcuuuucacuaggcaagucaauuuacccagcauauucugaauagugacauagcauuuuucacaaagccagugguugacuuucauguuaacaaugccucaaaaauaccaaacauuauauuauaaaaucccagugcuaauuaaacaaugaacauuugccuuccuggguauuuuacagguuuacuuaaaaaacugagcauguguauguuuauuuguaaagcucaaauauuuaaacuugcagaaguugugccuacaagcaguugaaaguauaaagcagguuuuaauaaaauguaguaaaaaaugaacaccuaauugcagauacauugcauuuucuuugaagcuaaguuuccauagcaguguagcccucucuuucauaaaucagcugcauugucacuaaagauuggguauucauccuuuuacugucucuacuuguaaguggacauaacauuagaauccuaauagacauucuggauaaguuguacaaggccauucuuggggccaagcaacaguaaauauuugaaagguaauaaagcaaauaccuagaaauuuuuguuuuauugaauaacaaauggaacaaaacuuguuaguaugaaugugaaaauagaaaaaaaauauauaaaauuauuucugcuuauucuuccaagcaagacuuuugagugaagauacugcuuuuuuuuuuuugcagugagauauauuuuuaauaacuauuuacuuaacaauaaucuauuuacuaagaaaaaucucucaauuccuuuccuucacugaauuuagucuaucuacucuguuucuuacgcaacucacauugcaucuguggauuuuguucuuuugaaaaaauauaucuguacagccuucuuugaguuaccaaaugccugaagguaguaccacacccccuggcccccauauucuucccauugcauaagcaugagguguauacagcaaugcaagaauaggugacuccaguccaagauaagaaaauagaauggauuuucuugguugugaguuuucagaugugcacagugguagcgacagcagacaccucaaagaauccagggagggacacuagagguugagcagcaagcugcuaagugauucaaaagacugguuaguaacaccuuucuguacugggcacaggccgcuauuuuaaccaugcagcuucugugguucaugcauugccuuaugaucuauaguccuucuugcuguagggcuuguugcgcaguauguuaucaaucucauuuaccacaugugaugucaucuuugggagaaccugagagcaggaggagaaguacaaaggauauuguuagcaguguugaucauucgguuuuuugugcucuauauuuagcaaaguaaucuagaaucauauaucuucauaaaccacagcugaaaucuaagccccccgcccccaacaccaucacauuguaagcuccuugaggucaggggccuuguugauugacugcauaaaugaaggcauaaaggcauaagugaaggcucauagaaauacagagcagcucuauccaacagaaauauaaugcaagccacauuuguaauuuaaaauuuucuauuagauaccuuaaaaagaacagugaaauuaauacauguuuuuacuucauuauauccaaaacauuauuucaacauguaaucaauauagaaaagauacuugacaguuguuuuugguacuaagucacaucuugugaacauguuacacuuaaagcacaucucuguuuggacucaccaucuuucccgcauacaauagccacauguggcuagaaccauaguaguacacagcacaggucuagagacuaaggagagauuuauucugacugguggucuuaucccuggugaaggauggcugggguuuaacaggcaucccagguagauggaauagcauggaaaagugaacuggagugauaguauacagugauugguguagguguggggaugcuaagaacaggauacggaugguaagaaugggauaagaguguggaaagccuugaaugccauuuuauggaguccccacuuuaggcaguggggaaccugucaggacuucugaucuaggaguaacccuaucagacaccuggagguaguuugaaggaugagcuggaggagguggaaaggggacacagauauuagauauguauuacaauccaagccaggcaauagggccuuaacuagggcaguggagcagaaaaguggaccugagagacauuuugggggaagauggugguuucaagacugaguaacuagaaguauauugguauugauuauugagauuagaaaccaaaggagaaguaguuuggggaauaagaaguugggagagaauaggauguguugaguguaaagugccuguggaauauccaccuaggagugacugagcagcugcaagugcagcuguggagcuuaguagcugccggaggacuggaguugaggguuugugagucauuugcaccgacaugcugacugaagccccgggaaaggaugagcucauccaaggcuagcauuuacugugagaagugggccaaggguacacauuacaccauaagacaagggacaaaggcagacuuucucacuggaaaagucugacccuguguggagacuguggugaaauacaauucugacgaccaauucugagguuucaaccucauucuuccuuuguugcaauccugcuggccaaggugaccuugucuccagucaagugcuauccucagaagccuuaggguuuggcaaaauagagcugccagccugggaaacuucauucugguuaauguuuuacugucugaagcugaaggaagaauuugguuucccacuagcucuggaauuucaguguccaaacagcuaauguguuauuuaaaaugagauuguaacaaugagaccaaaaaccuagaaacuggauuuguuggauuuuuuuuuuugucuaaaauacagcggguuagccacgugaggagaagaauccuucauucauuacaccaaagcaaaucucuauaggaaagagauuuaaacauuaaaaaaaugaaaccauaaaaguacucgaauaaaacaagacauaguaucacaagaccagaauuuucaagagaagccccacuuugaaacauuguaaacuacuacagauuuuacaaacaccccacaggcuacuaguuuugcaaacuugauguuacacugccugggauaggugguggguugggggaggucuggcuaauguugcuggggcuggcugggcauuaguaaaguccucccaggauuggguuccuauugaucuggaacuuggggauggaguaggauuuugcuaggcugggauaguggucaguuuguaggcagagggccacuguuaucgccgaagcucugagugguugagagcggcucaagauucagauuccaggaaggugugguggggagugaugaggcccgacugcuguggagccuggccuucucugaugggugaugggaagccucagaaggguuuuaaggcauguggggaggagggggagaggcgguucucccaccuuuuaggugggaguggggaggauggaaccugugcaggugaaggugggcugccugcagcugugguuucuccuccugucucucccaucugucaggcucugauuuauauacgccccuucguuccugcacaucuuaggcacguggcaucccuugaagcagcugccuucccagccuacuagaaauauuuucuuacaacugcuggugcuccguauuuuccauccuuuugcagccagugccaccacugcugggcaccccuagucacccagucugcuuuucaccauguuguggggcccaaucacaacucgucuuggguggacuuuagugcuggguaugggggaggugaaguagaacaggggaggauugguaagcccgcaaugguagcagucuugcugcauggauaauguccccuuuaggauaggcaaagccucauccugcugccagccaaagccuugcuagggaggaaauguuuugggaagaaaaauuacucaagaguuuuccucugaaauguguccccuucccugucagcugccuugccuauuuccacagcuuuuaaaacucagcccuagacuugccucauaugccaucccuaggcacuaugacugcccccaggaauggcagugaucucccuguauuagcaugauaaaaauccucaauuccucccucuucugccaagccauggugucucucuuucccaaaccugcagaauccauccauuucucucccccuccauggccacuacccucauucaagccaccaucgccuccugccuggaugacugcccuugcccuucauucuacuuuaugcauggcagccagagugaccuucagacauucaaauaggagcaugucccuccucuuaaaacccuccacaaggacuuguuacauguagcaugaacucuaaccccaugguguccugcgagaccuggcccugccugucucuccacgucagugcaucugcugucccugugcucaacuacguguugaccacauuggccuuagcuggcaguuccugggaaaagucaaggucuuucccaucucagggccuuuccacugcucuucccugucccuggaaugcacuuuccuggacucuucacaugcugugugaagacuugugaaugguugucaaagaauguaaaaaaugaaggcacaugaagcccucggaauaaacauauuccagaggggcuuuuugcaaaaacauuuaauguaggcucacccauuucucagucucaguaaaauaaacauuuauuuacuuaauagcccuuuucauaaccugaaaucauuuugcuauuuaucugucucuccuacuggcacguaaaacaucccuugaagguuagacaguguuuuucuucuuuccuguguuaucuccaguaccugguauacaauaggcucucaaagaucuguugaaugaauuaagggauagauauuuuaauucacuguuucucagccagcacaugagcucuuugaaggccagguccuguucuuacucaucucaguccucccacugccuagcacgaugccaggcauagaauaagugcuccauaaauauuagugaaacugaaaucauuggauugaauuucaguucuuuuuuguacaaacuguucuguccccucaucacuguguacccuuaucuuuucccagagcauaaaugaacauaagagggagaauuccucacguagcuacagggaaccucacagaauccaguaggaguuauggggcuggauaugggaguuguuagaagcagagaggcagaggugauuacacggcugcacaguccuaagaaagguugggggaaugggcagggaucuauaccauuuauuccacaguguauucugggcuauuuuuaaaaaagauuuuaaaucauguuuguugcuaccuccaccuguuuccuuuugggaaugguaacagggcugugugcuuguugcagggacagguagauagggaagaagcugugagacaguucuuuuccuccaugagcaagagaaaaauagauaaccuuaccagguaguggcuauggcaggaauugugggcaggaucguuccuagggcuuuuagcaggguugagaguaggauaggcucaggacuaguuguggccuuuggggaaaggagguggucacaauagauacuaaacuccaccccucuaguuagagcucccaggaacauccuuucaacccacccacugccacuacaggcuccccagaauauggcugcaggccccaucuagugcccuggaccaguggccaucucaugggauagggaauggggaugggccuccuaaauuugcuucuagggagaugugauccuggaaguccaaaauagaauuuugagcccauuucucuuaaaacauggcaaauauuuauucaauagaucuugaguguuaacuaagggacauguaguaaguacccuaggaacuggaaaaccguggaaaagcaaagacacaggucugaccucagagggcuugcaguccaacaggagagacaggcaguuauacuacauuaucauaaaagaucaugggagggggaauacaagauguucagggaacagcaagaaggggcucagcacacagcaggugggcaauauuuguggaaagaacaaacaaguaaaugauguauguauauuguccuaugacuuaaauuuccaagcaaguuaucaggccggcuuuuauggcgaggccugggaagucaguugccacguauaacacugcaaugcacucuuccacagaaacaaaccaucccaagaaaugagcuuugggaauacugccuguucauaggcagaggacaacccuggauccauguacugggaaaguguucuguugccuuuguucccccuacucuugccccacccaggacagagagggggagagaugggacacugccuggagauagccucaaaggcaccauuaaauucccugauguuggaaggggcugcaguacuugccugaauggcaccaagguuuucaaugaguuguucaggaguggaugaucccaggagcacagaacucacaccuucauuucucaggcaccacgcugggaggagaggacacugggucaguuuaucaaagcacuuccaaucguugauuagcuuauaaacaccugcuacagcuguuuguugcagccaaaauuuauuaacuucuuuuuguggaggauguacagugcuuccuaggauuaaaaaccugagcagcacccccuguuguguagaagauuugacagaaucugucaaagcccagcugggaggggaaaugcaaaugcauagaggcgcuggacaauggauuguaagauucucuccagcacgcucagcugcccucaaguagaagcagaaaacacagaugcacugcugucuuucuugcuucuccgcugguuuuccaauugcuagccuacuauaugucucuuaauuaacacucaaugcauuuggguuggcucggggcuuaaggccuuuuugcuuuccacauaaggcccugucaccucaaccagggcauucaagcuacccacccuagaaacacauuguuccuggaaacaccuaacacugcucaccagcagauggcuggauuccuguuucuaccuuggcccacaaccuccugucuuuccacuguauucauggucucauuuuccacaucuguugcuuggaacucuuguagacucuagguuucugguuccuugguucccaccuaccuggcagcccucucuggaccucccuuucuuccuaacccaagauucauccuguguugaugaucuaaauuacucucuuaugaacccucacaccccucacuucuucugcuuccuuagcaaauccccaucagugcugcaucugcguuuuuggcuucuacuucaggguagcugagcgugcuagagagaaucucacaguucauggucuggugccccuaugcguucacgucuucccucccagcuggcuuuagccagccuggccagccucacucuugcccuuggucaucuuucuuuucccgaaaaugaccuuaaaccuguacucuuaaaccaucccaucaaccccugcccccucacucuuaguagaugaccuuguccuaaugucuauagaaaaucaagucccuccauuggaauauuccuuaauuccccacucuccugcugcauaagcauccacauccauauccuccaguuucagaagaggaugugugcgguuucuguccaagaccaaacucugccuuggagauaucuccuuuuugccuuuucuuggacuugauucauacaugaucccaccgcccccaucaccccauuucaaaauuucuuacugugucuuucugucaacaaaacaugcuaaaauuucucccauucuagaauaggcuuccucugacccuuuuuaccugcuuagauacugccccaaccuucuuccccucuuaaacuucuaaaaggucaguccagauucccuuacugaucuucuucacaucccagucaccuucuugcuguguccagaagcuaagguccccaggagccugcuggugauuacaguggacuucugaguccuuagcugccuggaacucaguguugcuggacucauagaugcagugucugcugggccuuccugcuagaugccccaccagcaccgcaaacuucuugcuauaaugccuggccuucuugcauucccaaucacauuugggggcaucaccagcaauguggcuccccaaucuggaaaccugggaguacucuuuaagaacuguccuguucugacccccuuuucccuuuuaacugcuaaguccaguugauuauuccuccuaaauauuccucuaaucaagugguuuucaaacuuugguaugcaucagaaucauccagagggccugugaaacacccauuguuauggcucacccgcugaguuucugauucaggucuggggugcagucugugcauuuuuaacacacuccuagguaaugcuuaugcugaugcugcuaucugggaccaugcucuuuuuuuuuuuuuaaccaacuuuauugagguaaaauuuauacaucaaaaauuuuacccauuuuagguguacauuaaauaauuuuuauaaauuuaccaaccaucauuuuuaaggugcaaccuucaccauuuuuaaugcaguuuuauaacauuuccaucacccuaauaagaucccuaccucaaguaccaggcagccacugaucuacuuuuugucuccagauuugucuuuucuggacauuucaucuaaauggaaucauacaauagguggucguuugugucugguuuucacuuagcauauguuuucuagguuuuuccguguugcacuauguacccguauaccauuucuuuuuguugcuaaagaguauuccauuguguggauacagggcucaguuugacaaugacugcuuugguucagcugucuucuccgguucagcugucuucuccuccucagucacugcugcccucacucaggcccucaccaucucucuccuggauaacugguuuuccuaccucuugcuugaauuguccccuuauauuucccccauacagcucucauccagccagcagcagucucucuaaacacaaaucugaucauaucacuucccuagcuagugccugacauaacucauuguccuguaagaugagguucuuaauucuuaccuuggcaaaccuuauuuucuagccuaccucugcagcuucauggcucccuaccuugaacuuugugcuucaggagcacucaccugucuuuaaauccucuccaucuccaagcaucuugcugcuuuucuccucuuccucucccuucauucuggggcacauugcucaagcuguuccuuuugccuggaauguccuuuugccuuccccuuucuuuuugccucacuaauauuugccugucauuugagauuccccaaagguauugccugcuccuaaaguacuucccugaauuccaagcuccuacucuaauucccuuauccccuguucccuucuuaauaugaugaccuguauuaaaauuaucuguuuauuuucuugacuugcccaccaggcugugagguaugccuuauuugcaguuggaugcucagccaccagcccagugucuugcacaaaguaggaacuuauuaaauguuuguugaauaaacauaggcauggaugauugauggauguccccaagcacaucuucugcccccauuuggacagccauauugucaacugauacucuuaagcuguuaccguguccaggccuuuuaugguaaucacugaauuuccacaugggcaaaauacaaaauagugcuguauaaaaguaccaauccaaucuuucucucucuuuuuuuuuuuuuugacugcauuauuugcugcuuugcacugagaacuauuuuuggccuuaaagguaguucugaggacaaagcagguucuagguaaauuauugcccauaaacuaccugacuacucgaggucaccaacagcugauuccccuaaugggccuguagggcacaggagaacccacugggcagagcugguuacuuccaugguagcaacugcagcugauucuggauaauuagcaccucuaaccaagugucacuagcaaguauguccagagugccuguucacuaagaacaaaguaugaaugcuggcuccaguauaccugugugacuuggggagcaggcacacaguuggguucaaguaguuugcuuucugccggaggaucccucucccacacucuccuagcagaucaaagauaacgugccuggaaauaauuucccuuuugauucugagaguuuuguggcuauaaacaaaauuauuuauuuacaaagaaagaagugacaggugagaaagacaucugagaggacaggaggaaaaggggaaaaaaagcauguuuuaauuuaaacucagauccuguaaagaaggcauuucauguauaucuaauaucuaguaagagucuaaaucuuguaaagauuuccucuguagaaagagaguguucuuuccugucuuucagggcuaaguuuaauacuucauguuacuaucuaaaaaccauauaugauugugcagaauauguuucucugcauauuacucugauugcuugccauggcuaagagcagacagaauuucaaguuuugcaugucuacucucugcaagaacauuaucaucuuuauuagcacucacugagcaccuacuuuuugcuuuauauauauaauuucccuuuacucaacuaguuuguaagauauguauuauuauacccauuuuacagaugagaaaauuguuaccagguuaaguaacuugccuguggucaaauagcuaauauguuuuacugugcuuguuaaagcuguagaguugcuaaguaauaacauuaaauacauuguuugauuuuauuuuauuuuuugaagaaaggauuaaagcaccagucauacauauacuacgguacauggcauuuuccccccucuaaaaucaccucccauuucuaucuuucuaugacugcuaauugcaacuaacauuucucugccuuccaaccucugaagagucaagcuaccaacaaauauucuauuaaauuauuuuauuugcauagaccuuaucuugagcuuuuuaucucauuggguuaguguuucugauaugucccaauuccugcuauuucuuaaucuuuaggauuuuuuuuuuuuugucuagaaucagcacccauuuuauuccuuucucauagcuaccacaugaauucuuuuaucucauuucuucauuuauaaguggagauaguaauagaaaauccuccacuagcaucgguaagauaugacuaguaauaguauagaccuccgcggauuguuauggugaugaaggagacaagacagugagagugagccugaggugcuuacuauagaaccugacaaauauccccuaguaagggaaccagaagucucagggcuuuucugcccaguguguagccuuuggcagcacguggcuauugagcaugcaacgugugucuagccugaauuggaaugugcuugcucuagguguaaaauauaugcuggauuuugaagauuuguagaaaacaaaguaaaauaucucaauuuuuaauauuuauuacauguuggaaugauaauauuuuggcuauauuggguuaaagaaaauccauuauuaaaauuaauuucacauguuucacuuuaauguuuuaauguggucacuagaaaauuuaaaauaagauacaguuaugcaucccauagcgacagggacacguucugagaaaugcauuguuaggcguuuuccucauugugugaacaucauaggguacuuaugcaaaccuaguugguauagccuacugcacaucuaggcuauaugggauagccuauugcuccuagguuccaaaucuguacagcauguuacuguacugaauacuauaggcggcuguaacacaugguguuguguaucuaaacauagaaaagguaugguaaaaauaugguauaaaaugguauaccuguguagggcacuuaccaugacuggagcuugcaggacugggaggugcuuugggugagucagugagugaguggugagugaaugugaaggccugggacauucuuguacacuaccauagacuuuguaaacacugugcacuuaggcuacacuaaauuuauuuuuaagauuuuucuuucuucaauaauaaauuaacauuagcuaacuguaacauuuuuacuuuauaaacuuuuaauuuaaaaaagcuuuugguugggcacaguggcucaugccuguaaucccagcacuuuaggcggccaaggcaggcggaucacgaggucaggaguuagagaccagccugaccaacauggugaaaccccuucgcuacuaaaaauacaaaaauuagccaggcuugguggugcacaccuguaaucccagcuacucaggaggcugaggcaggagaaucgcuugaaccugggagacggagguugcagugagccgagaucgcgccacugcacuccagccugggcgacagagcgagacugcgucucaaaacaaaaaacaaacaaacaaaaaaaccuuugaacuuauuuguaauaacauagcuuaaaacacaaacacauuguacagcuguacaaaaguauuuucuuuauauuguuauaagcuuuuuuucuauuuuuaaaaaguguuuuuuuagcuuuuuaaacuuuuuuuuuuuuguuaaaaacuaagacacagacacacucauuagccuuggccuacacagggucaggaccaucacuauguuccaccuccacaucuuguuccucugggaagucuucaggggcaguaaaacacauggagcugucaucuccugugauaauaauuccucuuuggggaauaccuccugaagggccugcauaaggcuguuuuacaguuaacuuuuuuuuuuuccuaguaagaaggaguaacacucuaaaguaaagaugaaaaguauaguauaguaaauacauaaaccaguaacauggucauuuauuaucauuaucaaguauuauguacuguacaugauugugugugcuagacuuuuauauuacuggcagugcaguaggcuuguuuauuauaccagcaucaccacaaacacacaaguaauucauugcacucggaccuuaggauaaccacaacaucacuaggcaauagcaauuuuucagcuccauuauaaucuuaugggaucaccuacauauauguuguccgucguugacugagacacccaugauugaaugugguucauauuaucuuucucucaaacaguggaugugguuugggguuuucuuuuuuuuuuuuuuuuuuuuuuuuuuuuuugagauggagucuugcucugucacgcaggcuggagugcagugacgcaaucugggcuuacugcaagcuccgccacucggguucacgccauucuccugccucagccucccaaguagcugggacuacaggcacccaccaccacgcccggcuaauuuuugguguuuuuaguagagacgggguuucacuguguuagccaggauggucucgaucuccugaccucaugauccgcccaccuuggccucccaaagugcugggauuacaggcaugagccaccgugcccagccgcgugugguuuucaauuguuaccagcaaucaugaccuuucauggacuccacagcauuagaagaacaacguuuauggccuucaagaacuuucagggugaagcuauuucucuaggaucagcuuuucauguggcaguagccuugggccugucacagcccuguaucucaucuucucaccaacccugguuuaguuuucaacagacagaaauuugagccagaagaaauggaugucacuacacaguucaccccugacaucugugauaguguauguuaucacugacauguucucauuuaaacuauguuauaagagcaaggagaaagaaguaagaaaaauuugcuaucauguagaaaauucuggggaaccucaaauaacucacuuuauauuuagcaggaguuuaugcuucagagaucaucugucccugcaauagacauuuuaucaugguaaggguguggucagcaauagaaaacuaugaucucagcagaagucccucuaccaccccauagcuuaguaauuuucuuaccaacagcuagcugagguagugugcaucccagacgcuccgcaauuggggaaaggucuuuuagcuuguuuugcuguuuucucccuucuucacuuacaauucuuucuuucaaccacugguagcacuggggaaaagcauaacauugaaauguuaaugucugguaaagaucugaugucaaagaaugguaauucaauaaaauaugugaaccucauaaugauuuucugaauuuuuugacccuuauguuucacacugacagggaugauuucaugcaaagaaauguuccucacgaucuugcuccuuguuuauugguucaaaacagauugauuuugacuaauauucaccauucaaauugaucagccugcacagaaguuguuauaacccugaccgugacauacaagcacuuaaauccuagccuguccaauagaagaaguaacguuuuuuauugggauagcccaacuuuagaauguagcaaaaaaaaaaguacauuuacaacuuaccaagaucuauuaugucuccuuuuuauuaagaaagcugggugccaagcuuucugcucaaagaaaaccacuauuuuacauuuuuguuuaacuauuuuucucccccgugcuuucaauucacugcuaaucucuuauucuuuuuauaauggggcuuuguuguuagcuucugcagcuucuuccuagaagcagacauggcauaacugauagguacugaguugguuuuuaaaauuuuaaaguagauaaagacuuugcaaauguuauuaccuauuguauaacuauugaaacuuaaaaaaguaaagaaacucaaaacaggaaacuauucuuuaaagccaaugagaagaaacugacccugaucuauagacuacaaaaugaaccuaauuuccuaaauauaaagauaaaaaucuuuuagaacuucucaaugccuuaguuuccagaaggcucugcucuuacuaugagaaagggaacaauagacucuucuacauaaagcgagcacuuaagcagcaacacccaggggaaaagaguauuuguaagaguguuagucuguuuuagggaaaacaauuaaaaaucaucacacugugugguaauguggacuuucucucuugcguguaauugugacauaauacauaauagccaucgcagaucuuuaucuucccagagaccgcagaaugcucugcaacaggcagugggccauggacacugcacccacaugauuucaauaggcugcuggcuuuuguuuuuugagcauuuuuucauuauucuaagacaauauuuccaaagaaaaggguaaccacauuauguuuuauugugauuuuuuugaguuauuuugccgaugagaaaaggagaagggcaagccgccccaguuuugucuccuaaaucucaaaggcuuaugggcuggcuccuaaccugguagccugcuugaggagauggcuaaaguuuucccagccuuagcucugagaagccucagcuucuucaaaaagaagaguggccuggagcaucucuccagagaugacauuuggugccaguggugaugaggugggcauugugaacaauggacacugccuuggggccggggcagacuuccugggccagagugcugucuaugucagagagucccugaacuuacuuuugguguccucagugggaaaaacaucaccaauccucacuaaaguuucauaacaucuuucagaggaccaauaucucugaauguuauucaaaccgacuaacaaagauugaaaacuaauagccaacugcuuuuugaacaauugcuucuuauuaguauuagaauuucugaguuucaguauauaccaugcauguaaagagugguugguuuaucaaucaaucuuuuguaacuuuuccguuuuugaaaucuuguaugcagugcauucucuuucuuaggauuggguuacaaguucuauuuauguguguguguauauguguaugugugugacacacacauacacaccauuuucagagacagacuuccaaaaguaaaaaaaaaauuaaaaagaaaaaagcaauuauuuauugagucccaauccauguucaacaccauaaaucucauuguugcuuuaaccuauggaaauacaagcagauuaggguuuuuaaaaaguagaugcauaguuuuuauacugcuuuccucauaccaaaggaaacaaaaguguguuggaaauaaacagcuuuaacugcuuuacaaaugagaaaauguuagcagagauaggagaugaggcuuaauuaaaauguuaauuaaauauggaagcaaacaaguguguuuuguaggaagguuggaggugggugugguuguggcaguaauaaacccugcuugcugacuggacaguaaucuaugaaucaaaaggugaaaucuccucauccaacccuauucuaucaccccacugcacugcaaugauuugauuacauguugguuuuucuaaaccuagcagauagaagccagggauggcuuguuguucaugucagcaucuccaguucugacacuuauggcuggcaaggaggaggggcucaaccaauaugguggucagggaggaggcagagaaaccagaguuccguggagucaaaauaaaucucuucccguuuuucagauugaucaugacaccuccuccccaaugcagugugacucugccagcaguccugugggacuccacagggcuuguggcuuccauauuauuucauaauucaccccuucauaugucugucccuauuacaagucccggagcuacuccuugaggguugagacugucccauucaucccuguguccucagcacccagcacaaagucuggguauacucauuaaauauuugucaaagggacaauugaaugagcuuugcucuacagauuaguuggcuauuaguuuuauguauguuacaaaacucuaaauuuuccuaaagccuauuucuuugcccucucccaaugcuaugaugauuuuauaugucccuauuucauagguauugauauugggguaagaauagucugugagacuugccccagaucccuaauuaguuguuaguuaaucuuggauugaacucaggcugaaacuggagccauggacagaaucagucacauuucaguucugaacacugucuagaauaauuuaacaaccaagaucguugacuauuuuacuuaaacuucaaagucuuugacucaaaacaaaaacaaagucacuaaugagguugagaucucuagguaaaaugcuagagccgaaaacuugccuucugaaauuuuaccauaauguacaauaugcuuaguuucuuaauaugaacacuugauguacuuggaccaccccucucucccaacuuugauucaucgaggugugcaugcuucuuauuuuucuuugacagagggguacauaauuuuguaauauuuuuucgagacagggucucauuguauugcucaggcuggagggaaguggcaugaccucagcucacugcagccuugaccucccaggcucaggugauccucccaccucagccuccugaguauuugggacuacaggugagcaugauaccuggcuaauuuuuuguauuuuuguagagaugggguuucgucauuuugcccaggcuggucucaaacuccugggcucaagcgaucugcccaccuccaccucccaaagugcuaggauuacagauaugagccaccacaccuggccuauaauuuuucuagaaagcauuuugccaucaacagggaggagcugccaauaaauuuuauugcacuauuuauuucuauuuagaagcuauacaccuggucucuugaucagacuuuauugauuuuguuauggcucaucaaauuaauuuaacaaagacuuauguaccucuuacguacucaucaggcucugugaugagucagaugagcagguuucaguuuguguccuagauguauucacaaaucauuaccuaguaacaugggaaguguuuuuuuguugggguuccacuccugucaaugauuuccuuacaagcuaugucuuuacugccuucuaauggaaaaugccaugacaagauggugcacaaccugagcugaucacaguaccuuacccuuuuggccacugucauuggucucacaggguggcacaugaccuaagcuuguccagucaucucuggacugaaguugguaaagaaaagauugcuuuuaucuuagguuacaugccuuuagaaaugcaagccugcaaccaccaguuuuccugcuccuggccucauuuauaguagaagaaaaugacacccacauguagagagaaauagagaagauggaaagucaugacaauguacaaguccauggaugcagucauugcugaggccacuccguacuucucaaggauugucuuugugaaccaauagaguccccauucucugaucagauuuuguuacucgcaaccagagaauuagaagacccuguaagaaguguucguggaauaauagagaagguacaaauagcucaguuuuguaaaguuaugacagucuucauagagaggaagacaaccaagcuuugucuuuagcaauaagaagggauuccacaggagaaugaaaagaaggacauuucugggaggcaaaggagaguacagugcauuugcauggaaaaugaaguaguaugauaugggagacacaaaugaaaaaaaauaggcucaacuuagaucccaagggaauuuccuugaaugcuuuaugacaaaguuauggcuuuguccuauaagcaaugauugggaaaucauuagaggauuuuaagcaggguuaugauauggucagauuaauauuuuaaaaagauuaaguagucacaaugguggguuguugagaaaaggggaggaaaucagaguccagaugggaggcuacuacaguaaaucuuguaagaaauggugaagauccaaacaagggcugugcacaagauggaucuuagagucaagauagagucuggaggauuuggugccuuguugaacaggaauaaggaaggaaaggaggcagucugagguaaugcuuuggcuucugacugagacaaccagauggauggguggaggcacuguuaagcaagaaggaauggcagguucugggggugaggauagauuccauuaggcaugacugaugcccaugggacuucuacuuggagaugucuaauagacacaaagaaggagugcugugcaguucagcagugaagucagagcugauaacacaaauuuagaaaucauuguuagaguaguggggccagaggagggggcccagaaaauccagaaaaagaguguuacuuucuaaaagagcccuagauagguauuuuuuaugcugaguuaauuuauccuucaauugcaguucaguacuacaacagaugcaaaauauuaacaucuuaaucuuaucaguauaacaauagccaaugugaaacacaaacuauuuacuuauucucuuuuagggugggaugaacguuaccaauuuauuuaucuacuugcccagauaucuaucuuuuaauuuaauuaaccuuccuuccuuccuucuuucuuuucuuuucuuuucuuucucuuucucuuucauggcauccucauucacuccaaagguugcucugauacuugccuccuuuacuuuuuauuuuuuugcucugguaacgauacucaaguggcuuucauaagugcacauauauuacuccgaaaacacucagauugauaauguagagccuugagagucugcagagcucuaaagaagcauacuuugugaucagccaccuuucaucuguugagagcucuuaauguuuauuguuaaggauguuccaguagauacagaguugacuuuauaaaagucaccaauagaaauauuucccaagcugcuuuugggcuuagccaccuucaaacauucauuacucuuucuuuuuuucuuuuuccuuucacuagugaauuugugaaagauuuuucagcuguuugcaagcuuuucucaaacagugauggagguuagacaaucaugcacuccaaauacaucauagcuacuucuuccuccuuuaaaaaccuggguuuaaagagaaauaaagaugucuuugagggaggcaauuaacuugagagccaggagaccuggguucuaauaucagccuuuucuguuacgaguuuauggucuuggauuguuauuuaaggucuucguguuuuaguuccugcaucugaaaauggucugccucucagcagguuauugugagaacaaacacucugcauauauagaaaugcuuugaauuuuucagcaagccucugaaagaacauaugacaacaugcuuagcucaacugacuaaaagucaccuguauccauucuguuugugagaauaaaaguugaugaaugaaaacacuuagcucagugcuuggcacauaguagguacuuaguaaaauuguaauucucagugcuucccuucuuccuuuccuuccuucuucacucccuucuugccuuccucuuuuuauaccuucuuuccuaagaugcuuuuagucugucuuugcugacuuguuuagacuuguuucagaacaaucuuuaauuuucagaagcaagaccuuauuuaauauucuaggaaaauuguuuuuuguaauaauacaaaacuagaaauaggaccaugucaucaggcuuuaggacguauucauguuguauuauuuuagagaacaaacaagcaaaagcucaacuguuacacagagaaaggaaagucaaaggccuagagccuugaaaauguucugauuagggaagcucacaguggccacagccacaaugauuaaaggauuggugguucagacuugacuugagcuguuuucccaauaauuuagugcugauggaggcaagaaguugugucaggcuuauacuuccucuuagaaggacuccgguuuaucugauuuuuuaaaugccuguauucucucucccuugacaauagagaguaauuugugauucuaauguuauuacacauucucucaaguuuuuaaaaacaggcauguuguuauuaauaaggagagauuuuugaguacucuccaauaaauuagucaucaagauguccugaauggagguaauuuugugucaaugaucuugaauaucuuuuugcuucagagcagaauuuaagcugcuuuaagugauagaagcuuugcuauguaucugucuccugaagucuucccuucuaacccacugcccccaacacacaauaaaaagugucaaccauacucagcuacaacuuuuggccucauauggauuaagccuuuauggcuuacacuuuguuugucaagaaaaggaaauaauguaagaauccucuuauauagaaaagagauuuugcauuuuaucaguuucaaaugauggaauguuuucuuuaauauaagaauaaaaaacaauguaggaauuugagcccugcaaguccaaucaggucacugggcacuuuuuuccuaguccccagaagaagagaauauucaacgcagucagauuaugaaggacugacugauaccuggccaggagccaagaccuccagaaggcuuaggggaaccugccagaggccacuggccuggacaacacagucagccugagcugggaagcccuaggcugcugcagagcuguucuuaccaaccuucuucccuccuuccuacucccaggcuuuuuucuagacauugagaaaaauaccuucagugaagcccuggaacuuucaggcaccccguuuccguauuuuccugagaugauuccacaggcaaguggagaccaugucauugcgccaacaccuacagaagaaaaaacuuagaaaguugcuugugcaaauugggaucaaaagguggguggcggugggggcaguaguguuuaaacagaauuugguagguuauagggaaaagcuggccagauaaaugaguuaauaucagcaugcauuuuuuuccauuacaauuuaggagcuuacaaauuguguuucauucuuuaaucagccaauuaaacauggacugucaguucuugggagugcauaucagaaagccugaaaaauguggcucauccacgaaguuuuguuguccuuguccauuuaguaccuaacauagugccugguacacagcaggagcacacaccugguacauaguaaacacucaauaagugagagcaauaauaacaauuauuacgguuguuauugaaguuuuaucuuuuucuccuuuucccagaauuuuccugcucauaugaacuucuguuucuuaggaagaaaguuauuucuggaaacuuuugauaaauaagccugaaaauguggcuuguucaucuuuuccuaaugucuaaauuucuuggguauauuauauauagauauauuuccccugucucugaaggcauuaguucuaucugcacaaauguauaguacccgacuuaauaguuguugaauuucccauuucuaacucagugccagggccaggguaguggauacagauguauauauccaugauuuuuuuugaaagguagucauuguuuacucgagcaagcaccaaugaaaaaugaacuuauucauugguuguuccuuuuauucaguaugcauuuuuuuuuugaacaccugcugaguacagcugaaauaccagucacaauuuacaacucugcuuggcuuucaucagugauacccuguagacuaaaugcagauucugcuacauuuugauucugcuacaaucucuggaaugcaugguucuuacaaugucuauguuaauuagggacauuuaggaaagcauuucaauaacacuguuuuuauuuuuuccccgaaucagugaucuuucucuuguuaaaaauacucaguagcuuuuauuuugaagauuaccuauuuugugguagagcucuggcagcuggaccuccacuuucucucucuggaaaagaugguacucagcuuguucacagaccggugggaucauauugaacugucuugcuacagaauaggcuuccuagggaggaaugagauuacaaccaaauuuauacugaugagaaauaaggcuucgcuguaauuuguaugcaugagaaauguuuacuuuggugaaaucaguacaaaccaagaaacauguaggaugccaaauaauaagcaaauuugucaccaccgauuucacuaagagcaauaugaaagguaggaaacccuuauuaauucuuugggaggguuuggauugaguuaaguccagagcaaauuagucaaggugugaauuguacacuacgauaaagaaaauguaguuuaacuauuuuuaaguuccuaaagaaauaagacuuagacuaacauauaaaaguaucuguaauuagcuugguauaaacaguauaguuaauacaguuuuuuauaagaaaacuagaauacucuguuaauauaucucauuagcugugaaauucacuuuacccucuugccaccaaagaacacuguauucucuguuguauucugaacggaugagcuccggcuccaauauccaucucuguaaugauggaauugauucuagaauuccagugccauagugauugugagaaaaguuugcaaaagaucuugcaauuuaugcauggcaucugaaaagcaauaauaagguacucaauagccauuuaaaaauagaaguuaaauuaccaugaucuccauagcacuccaucucgaggugccccaguacaucgccaugccuugguuuaucacaugugucauggcucggacaauuucuguggaaggucaaacagacagcauuucaugaauuugucuacuuuucaaaguuaugcgauuuuuacuccucuagccaaagcuuagaagcuuaaugcaauuguuuguuugauuaauaaaauuagccuaauauuggugacaacauuauagucugacaggaaauauugaugguuugaaggcugaugguaccuuugggcaaacugacauuccauuuuccauuugcagcaacaacacuaaaugauauugaaaauauaaugaccauuuuaaguucuuccuuuacuuuuauugcuugaugauuccuggccuaauaaagaauacaugauuuaccuuuuuaagagccugaguaccuucccgacuaaagugagaaguaagagaaggcauuuguuucaacuuuguagaauguaaggucauugaaggugaaaggcuugucuuuguauauuggacuugcagagcuggaccucacacagaaugggucucuaagagaggugacucaacaacaauguguuuagcagaaagauaaacauauuaaaugcugaacaaacagccgaagucaccguggcucacagcuugcaaugacacacccuguccuugaucacuuugaaccaaauuuuguccuaagacacccacauaauugauuucacuggggccuguuuguggucccacccagcgugcucaucagccucauggagcucgacaucacauuuccuaaacaggaaaaugaaucccuuccccagaggauggagcugagcaaauccucuuggcaccagccagaugugcugcagaacaagagagcauggagacccucaaguuuaacuuaguuaaaauucacagacaggguuggauuucuucuacaaagcaggucaguguuuaacaggaugccaggucacucgacaguuucaaagggucacaggccuugggauuuuuuauuucucaguaauaccagucaguuaaaugcccuucagaagaaccaaauccuugucucaaaguagaguugcaguagauguauuuuuuuauuauuauuauuauuucucaugagcaggcacugucuagauugauacggaacaggauuuggaaugaaauggccagagucagggucuuagcuucuuugcuuguuuggcugguguaaacuuuuuuguuguuguuguuuuuuuuuugagauggagucuugcccuuuggcccaggcuggagugcaguggcaagaucucggcucccugcaggcuccgccucccggguucaugccauucuccugccucagccucccgaguagcugggacuacaggugcccgccaccacacccggcuaacuuuuuguauuuuugguagagacaggguuucaccguguuagccaggauggucucgaucuccugaccucgugauccucccaccucggccucccaaaguacugggauuacaggcgugagccacugcucccguccuucuguaaacuauuuuuaauugcccuugauuucuuuuuuggaagauggaaaugcuuucauucaccauuguguguccaacagagguaaaagcuggcuuauaagcaaaauaguuuucuuuuucuuggagaaagacucuagaauaucaaauuauugccuagcaacuaaaacuaugaaguucauucuccauuuauaaaacauaugauuaaaaaaguguaaggaaccgcuuuucuucucuuucauuauacaaauggagaugcgugccuaugauaaacaguuccagaaguugaaaacaaugauaugaaucucugccccagauagauucugucuuuagaugucuccaucacugcaccagcucccuuucccuucacauccugugucauucagagcugggaguucagccaaucaacaguaucuacuaggugucugcuguucugggugcuggagauacuguggugaaucaaacaugcugauaaacacagaagagguuaacagagaauaaacuggaccuggccucucccuuaacucugucucugccaucaaguaagacaggcacagaaugcugacagguggcuugggcacgugggaguccuugacaaaagcagugaagauggaguggaaguugugacucuuccugcacaugcauuuaauuauacaacacacaaguauuaaaagcuuaauguuugccagucacugugcugguugcuggauucuucugugaguaaaacagacacaaauuuccuggacucagggaguuucaaguugagugagagauggagggguaaacaaguaagucauuauaaaauguaaaguguuauaaagaaaauaacacaggggacugggacaggaaaugaaagagaagacauauuuagugcaguaaggaaggucucacugaagagcaaucauguuuaggcauaaaaaagaaaaaaggaaccauccuugugaagaacaguggaagagcauucgaggcagaugauguaguaugcgccuaggcccugaggaaggacagagcuuagugagucccagcaaugggagggaaggaggacagggguaugagaugaaguuggcagagggcaaaccaugucauuuguauguuauucaagguuuaaucaaggcauuaacauuuuaucagguaaggggaugguagaauauaguuugcauuucagaacagucucugugcuguggagaaucauuaguaacagggaggacuggaggaaguagaaagagcuugaggaagguauuguuguauucuaggcaggagaugagggugauuuguaauagggugaugauggcaaacagagagagugguggauggauucaaaauagauguugaaggcagaauccacaauacuuacagauggacugaguguggucagggaaagggaggaauuaaagcuguuucccagauaucuggcuguuuacagagauaagggagacugaaggaagaacagguuugggagaaaaaucgaggguucuucuuuggacaugugaaaaauggagaugcaugugagauacuaaaagggagaugacgggcggggcacgguggcucacaccuguaaucccagcacuuugggaggccgaggcggguggaucacgaggucaggagaucgagaccauccuggcuaacacggugaaaccccgucucuacuaaaaauacagaaaauuagccgggcgugguggcgggugccuguagucccagcuacucgggaggcugaggcaagagaauggcaugaaccugggagguggagcucgcaguaagccgagaucacgccacugcacuccagcaugggggacagagcaagacuccgucucaaaaaaaauaaaaaauaaaaaauaaaggggagaugucaaguggauauuuaauaguuggauaaauacgacagugagcaaucugggccagagguguauauacauuuauuaguuaccagucuauugauuauauuuaaauucaugaaaauggaugagccuuguaaggaaagucuauagacagaaaagagaagaguuucugauggccagcccagggguuagagagaggacccaugcaggaugcuggguagccggcagccaaaggggcaggagggaagccggcacacagggaugugucagaccaagagcagagggcacuucaagagggagccaugcccacaggguggaacgccauggacauuugugucagaacagccccaaacaguguccacuggauuuggccauauguagggagaccacugcagaccaugagaaaagcagcuucagugucagugaugugaugggaucaagcaagguuggagccauuggaagccacucaauggaagaaugaguggaagaaggagaggccuuaaacacaaugcauucaauaaguuuggaagagaaauaggacaggagcugaagggauauucagggucacgggacauuaagaguaagccugugugccauuuggagugaccuaggaagagggaguuauugaugaaauggccucggggcugggaaggaagagggagagagacuugauaaagggagagggaggagggacagagccccuagagguaagaaggacacuuuugucaagaugaugggacccagggagguuuguagaaccaucaugggaagacauggcagcaccuguuugaugaauucuagucucaauaaacugugaaccaaguguaaaaggaggcaugagauguguagcagaaaugagaaaaaggugaggagagccucugcgaggcacuccaaugccucaggucuuuuuguugcugguaguuuuuuccucauuguuuaguuuugacucugaagagaaaagcuugguggaauugggaaaagggaacucugugaguucuuguccuggaaggaggcugcaacaucaaaagcagggagaaauugcaggagaaccaagaggcugcaguuuuggagauucauguugccaugaauuaaaauuuaauucuauuucagagaaaaauucguuuagcuuacuaauaggaaacaaccauacugauggccaagguggguuuuuacaugauuugaauaauuaagaacacuagagggcagcauugcugaaaggaaaaaucaacugucuucuagauacuguuaagugcauaacauggagaugccuuuuaaaagccuccuaggcagaauaacaauucugagugaggaaaggauguuagaaagauaguuuagugcacugcaucaccugccucugggaaaggagacucagacaaaugugauuaaaccugauaacccaguacugaaugugacucuccuggucugggcuccuucccuaguuuuccagaagccuuaaucccagugguucucaacuccgacuacauauuagaaacaccuggagugggggcuuuacaaacuauccaggcccaggcuccacugaaauucuauuauauuagaaucucuugggggugaggccccagcaucgauaauaauuuaaaaacucaucccagaugaugauucuagugugcagccaggauuuagaaccaacgugcuugucuacaccaauggucucaggguguagcuccuggaccagcagcagcagcagcagcagcagcagcagcaccuggaaacuuguuacaaaugcaaaucccagggccucaccccagacuuaguaaauuacaaagucugcauauguguuuuaagcagccuuucaaguaaugcugacacacacugcuuuauacuauucccaaguaagccauuucaauggauacaaacgucuuccuauauuuccucuuuugcuuuuuuaucuaacccaagugcuucaugcuauaaucuuuaguuauuugccuuaguacauaagcaaacagauagcuaguaugauaucuacucucucucucucuuccucucccucuuuccccuccgccccacuccaccaccaugaaucagaaucgccugggaaauuuggcaaaaaugcugagguccagguccuagccuccuucagugagccagggccuuuguauuaguuucauuagcucucaaucacaaacuuuuagaaaaacugacuaaacuauugaaagacuuuguuaaguccucccucugcgcuccuuuccagguugaaauaaucauuauucuuuaaccuaaugaugccuccccagcgcucacccgccacaggcagcucucguacauacucccuguaucccuagcacacagguggcucccuauaaaugcugcagguccacuuuguuucccugaguacucaauuuccuucuguaaagugagaaaugauauggauguugugaaauucuuucaaagcuugacgugggauaauggguguagaauaacuugugaauuugaaacaguaacacaaacugaaaauggcccagguuucuucucaaauaggcccagauucuaacauuuuggggacaguuguuucaguaauguaggccaucaauguuuuaaaaaauaugcauuuuaugucaaagaaauuaauacaacuauuuguucugagugaaaacaauuuugguugaucaauauuuuaauuuucuaaauuggaucacaugccaaaagugguagcucacauuaaacuuuuuuuccugcaaaauguucccuagaacuuugaaaguuguaagcaaauaguuguacugcaugaacaauaagccauagggguaaagauaaaaauaugcuuauuagaaauuaauguuuugaucagauaaaauguacucaaauuaaucuggccacagagauaaaagcaaaagauaaaaaagauaaaagcaaaagaagccuuagagguaauccagugcaguuccuucuuauucuagaugaggaaacagguuaggagugaaguuuuuaggcauaauuaaaagcuugaauauuauuaacaauuauaaauauuuuaaauaugcuugcaaaauacugagaaaaaacaugcaaaauaauuguauuauuuaguggaauuacaugcaauuuuguucuuaauuuuucacauuuccaguaaauauguuauacuuuuauguaaaaaagaagaaugauuaucuaacaagcaaaggcaccacuuuagacacuaacauauuauauauuuaaccaaauaaaauugcuauuuuuagagccccauaauaguuuaauauugacaguauccuaugguucaacccagcugauaucagauuuuuuuuuuuaagaggcaaggaucaagauggaggcuacaacacugguauaaugcaagaauuugguuucaucagaggaguugcuguuaacacuaauaaaaaauaggccuagaccuaggcacaauuuuuacuucaggucagcuguuugugauuuaucuaccuuaaguuguuuauuuauuuaacuucagaagcuuguggugguggugguuuauaacuguacugcuuugaagcuuagaggaaucaucuugaaucuugaucaguccuucauauucugagcugcagagaauccucucagcuugaugccuggagauagaggacuaucauucuucagaggacuggaaacuuauaaucauaaaugaaaugaugucauccuuaguauggaucaugagucacauaucuuaaagguuugcugaaugucugaggacagccugguuccauuugccuuacagagcauguauuaggaugcaggagacauuguuuuuuuuuggucccaucacagucacuaaccuuugacaucucuuguccuugcugagaucucaguuucuucaaugcaaaugagcagauugauauuaauuaagcauauacuuaaucuugacaguaacuguuuaggugggaauauuugaaucccauuuuguugaggaagaaccugagacucagaaagauaaaaucacuugggccaggucucagcagauagucuauagaccccaucuagcuuugaaguucugugaucugucaucgugagagguucuuugcauaaugcauugauggagaagaugguuuggggagagaaaacuaacagagcauuuacuuaauucaccucauuguguguuugugaacaugugaugccuugugugguuauauccauccaucccuuugcauuuaauacacagauggcuauaguucaugaugaguauaaaugacuugggaaauaugagcuuucuuuuuguuuuuuuucgaagaaaaacuaaaaucugaugacucuuugaaaagagaggcaaaaaaagggcuggugucugcaucugaucugucaaagcuuaaagaaagaguggucuucacagggcaguuuauagggaauaugcuuucuggaucagggcacuggccaaacugauucugaaucagaacagaacagauucaagagacuagaaaggaauucaugcacugagccaagucaauaaaaccucuucuaucuggagaaauugaaccuucuucaaaacuccgacccaagaauggagcuuuaugucucugaaggcaaugcauuuuccuccacccuguagcuacccugagagaacccucccuaaagagcacaugguccucaaccucuccucucugccacacacugguuuucccugacucuagacaguuugaagugagccuuugauauugcccaaauaugauuucagaaccuuauucuaaaaugugaaauagguuauugaaaugggacacuuuuagucucacuuuuagcucaaguccaaaggcucugaacagcaacuguuguuuuuaaguaccccugaguuccaaagugaagcacuagaccaccuaugcaggagaccauggugaaaaauguuuggucaucuuuagcccagccuucaccuugaaaaaauaaaugaguuaaaaagagaagcccuuuuagaacugaucaauaaauucauuaagguugcaggacacaaaaucaacauacgagaaucaguaccauuucuauacgauaacaacaaacuagcugaaaaauaaaucaugaaagcaauaucauuuacaauagccacaaaaaauuaaauaccaagugauaugguuuggauguuuguccucuccaaaucucauguagaaaugugauucacaauguuggagguggguccaggugggaagugauuggaucaucaaguggaucccucaugaaugguuuggcaucaucuccuuggugauaagaguucucacucacucaguucacaugagagcugguuguuuaaaagagucugggaucucccuuuucucucucucuuacucccucuagccuuguaauacacucccucucccccucuuagccuuccaccaugauuauaagcucccugaggcccucaccagaagcagaugccagcaccaugcuuucgguacaaccugcagcuccaugagccaauuaaaccucuuuucuuuauaaauuaccuagccucagguauuucuuuauagcaaugcaaaaauggcauaauacaccuauaaauaaauuuaagaagguaaaaaaucucuacaauuaaaauuaugaaacugaugaaagaaauugaagagaacacacaaaaaauaggaagacaucucauguucacaaauuggaagaguuaauacuguuaaaacgacuauacuacccaaggcaaucuauacauucaauguaaucccuaucaaaauuccaauuacauucuuugcagaaauagagaaaacaauccuaaaauuuacauggaaccacaaaagacccagaauagccaaagcaaucuugagcaaaaagaacaaagcuggagauaucauacuacuugaccugaaaauauacuacaaagauauaguaacuaaaauagugugauacuggcauaaaaacagacacauagaucaauggaauagacuagaaauaaauucacauauuuacagccaacagauuuuugacaaagguuccaggaacauucacugggggaaagggaauucucuucaauaaauaguucugggaaaacuggauauccaugugcagaaaaaugaaacuauauuccuauuucucaucauguacaaaaaucaacccaaaauggauuaaagaccuaaauguaagaccugaccugaagcuaugacacuacuagaagaaaacaggggaaaugcuucaggaaauuggucuggacaaagauuuuaugggaaagaccucaaaagcacaagcaacaaaaacaaaaacagacaaauggaauuauauuaaacuaaaagcuucugcacagcaaaggagcuaaucaacaguguaaagagacaaccuagagaaugggagaaaauauuugugaauuauucaucuaacaaggaauuaauuuucagaauauacaaggaauucaaacaacucagcagcaaaaaaaaaaaaacaaaaaaaacaaaaacaaaacaaguaauccaauuuaaaaaugggcaaaugaucugaauaaauauuccucuaaagaagacauacaacgggccaacaggaagccccugucucuaaaaaaacaaaaacaaggcauaagauaccaucuuacccauuagacuggcuaccaucaaaaagacaaaaaaaaaugcuggcaagaauguggagaaaaggaaaaucauaugcuguugguaggaauguauauuaguacagcuauuaugcagaauaguauggaaguuucucaaaaaacuagaauuagaacuaccauaugauccaucaguuucacuacugauuauauauccaaaggaaaggaaaucauauguugaagagauaccugcacucucauguuuauuucggcacaauucacacuagccaagauauggaaucaaccuaaguguucaucaacagaugaauugauaaagaaaauguguuauagauacucaauggaauauuauucagcccuaaaaaagaauuaaauacugucauuuguggcaacauggauaagccugguggacauuauauuaugugaaauaagccaggugcagaaagauaaauacucauauuuaucucacucauauguggaagcuaaaucaguugaucucauagaagcagagaaaagaauagugguaacuagaggcugggaugagugggagggaaaggaggauacggagaguuugguuaauaaacacaauauuacugccagauaggaggaauaaguucuaguguucuguagcuuuguagggagacuauaguuaacaauuguuuguucuauauuuucaaauagcuagaauagaguauuuugaauguuuccaacacaaagaaaugauaaauguuugaggugauggauauguuaaugacuuugauuugaucacaacacauuguauacagguagcaaaauaucacacugugcuccauaaauauguacaauuuuuaugugucaacuaaaaauaauaauaagagaauaaauaaauggagguugagagauuauuuggucuuguuugagcuuuguggcauugccccugugaucuuucccuccaccuuuaucuuucaccucaucucuaagaaaauaaaacuuuagaaccuaaaauucccauuuguagaacuugcaaguaagaacaguucccugaauugagagcuugaccuugcugugauuucucccaaacagacagacacaggcuguccugggaacucugcucacuccuuguacaacucucccuacaaggggaggcuaugggaugcuauauccucuuaauauuauuucuugcuccaccagacauguacucuuuaauccuagcaagacagcaguuguucaucuuacauuuagauaagaauggcgaagugacuugcccaaagcaauaagagagcuuucuacucuauccucauuauuucccuguaauucuuuuaucaccacccccaguuuuuccagcuucucaccuagacuuaccacugccugcugacaugcuccaagaaauaauuauguagaauaugguucacaaaauugcaccuuuucuuucaacauaaucuaaauauagccccaccguuuucuacuaaaaccuggugauuccaaguaaucaguuugcuguguuugguuaaugcuaaaugguaguaauuaaagagguuauucuauccugauaaaagugagguggcauccacaaugaguauagaguacaaugcuauuauugcauaugucaaauucuauaggauuugugaauagugcaaugaauucuaauucauuuaaaaacacucaaaaugaaaguaaacccaucaguuuaaauuuuaucuggagcaaggcaaugaacaaauuuaaacaaacaaacaaaccuaagugaacugaaauuacaggacugugcaacuuuccuagauaccugacuuauaucuucauuugugaagcuaaaaguuuuaucauuacuagguuguaggacacugauccucuuagcauccuggggguuccuuuggcaauguuacugaacuaacucagucuguaaaaaagcaacuuuuauaguuugaacaugggucuuacccugaugugggauauuucccugacacaaaugaaaauguuaaaauuugaaaaagaauuauuuguccuucuaaaauuuguaaaguuuuguucuugucaccuaaguuucugauucaucuugaauuugugugugugugugugugugugugugugugugugugugugugguuguaagguagggaucugguuucauuuuuuuuucauauuauagaaaauagaaugccacuuuuuccauguccauuuauugaauagucccuucuuuucccacugauguucuagaguacuuuugucaaauaucaauguuuuauaaaugcuagugucuguuucuggagucucuauuauagggacuaauauuauauuacaucaauuuaucccauagccaguaccuuccuuaauuacugagguuucauaaugagugcugguacugugauagggcauguccuucccuuccacuuuacccauuuucaggagucauuuggcucuucuuggcccauuacccuuucuuauauauuuuauaauuagcuuaucaaauuauuuuaaaagcuuggaaggauuuugguuggaauagggcacauuuagcagaauuggcaucugauaugguuuggcuguguccccacccaaaucuccacuugaauuguaucucccagaauucccacauguugcgggagggacccagagggagguaauugaaucaugggggcuggucuuucccgugcuauucucaugauaguuaauaagucucacaagauaugguagguuuaucagggguuucugcuuuugcuucuuccucguuuucucuuccugccaccauguaagaagugccauucaccucccaccaugauucugagaccuccccagccauguggaacuguaagucccauuaaacaucuuuuucuucccagucucggauaugucuuuaucagcagcaugaaaauggacuaauacagcaucuuuaagguacuaagucaggccgggcgcaguggcucacgccuguaaucccugcacuuugggaggcugagggggguggaucaccugaggccgggaguucaagaccagccugggcaacauggugaaaccccgucucuacuaaaaauacaguaauuagccaggcaugguggcacaugccuguaaucccagauccucaggaggcucaggcacgagaaucccuugaaccucgcaggcagagguugcagugagccaagaccacaucauugcgauuuccagccugggcaacagagcgagacuccucucaaaaaaaaaaaaaaaaaaaaaaaaaagguacuaagucuuccuguccauggacuuaggauauaucugcauuuauucaaucuccuauaaugucuuucaguaaaguuuuauaaauuuauucauauaccauauacuccuugcacaucuuuuaaaaucuuuuuauuccuacuuacuuaauauucuaaaaaauauucuaaaugguuucuucuugccugugcaggcuuuuuggacucucauuuucccuuccuuuuguuucuauggagguaaauagcaguuccccgaggaggagaauggaagcugacuauggaaucucaugcauuauuaauguuuuccccuugucauacugguguucuguauugaggguaauuauauuuuagaaaucaaaggagcagaugacaaugacagcggccucuaguagagacggaaaggccuacuucaggacauuugccugguuagaaggcuaucuuaucccuguaugagacucaacugcugcagucuaugcuaguauauugauauguagucagugaagccccucaaauucuaucauagaacguggucaagauaguuuugaccuagaaaauuuucaaagcagguguuaccaguuacucaucacugccauugaugaugauacuuccacaaacaucugauuuucaauaaccugauuuuuccagugaauguaccagaaugaaugaucuacaaaacguauacagaaauaaauaaggaaauuaaccuacucuguagguuuauuugauagauccaauuuauucuaacuuagaauagcuaaacgagacuuuuuuauauaucagaaacaauuaauaaaccuaaucagcaacauguggaaagauauaaguuguuguuacccuucauuuaacuauaauauauaaaaaugucuaaagauaauaucuuuaagaauuguuaguuuuuuuauuuugcaauucucuugagcuuuggguugcaguauuucuuacugagaaauaaagaugucucuaacuucuugauguauuaauuagguuuuuuuucuuuuuaaauggaguaaguuauugaaaacucaauuggaagucuuaaauuguaaaagauuuaucugcucaugucacuggaaaugcagucacauggugcuucaggaaugauuguucccacaaaucacugaggaccaaucuuuugucuaacccuccacucugcuauccccaggcugguuucccuuguggcacugguguggcugucaguaacgugugaggucaugugcuuccuugcaccuaauucagcugggcccucugcuucaucauuccaagaaagacuucugagauuuacucuaggcuguuccugucacauaaaccaaugacucuggccaaaggggaaaaacaaaaggaucauuuagcuuacaacccagagccuaccuugcaaccaaggaguggcaaggagagaguaaugcagucuuccucugggucaacuggcaaucuuggaaaagagucacccccauaugaaaauuugggcaccugagaaagcaggguggcugcuggguagacaagcaacaauuucuacucugcuuagauugggucuugugggucacaccagggagcuggguuccuaggccacauggcaacagagggacagagagggcauggacucuacugagugccuaccuugugcuuggcucugggcugggaauuuuuccauuacugcauuuauguuuugccacagccguaugaggugguauuauuacauucccacuuuauguuugaaaaaaucagguucaggaggaugaaaauuugaugaagccaguuuuaaauuucucucuaaaaccagcccuacccacuagcccccaagcucaaacagaaugaagcaaaauaucuuuaucccuuuuucuucauccacauuuguauuucaugcaaacucuuuugauuaugugauuugaugcacauagaggguuaacaauaugaagggaccucaaaaauuucauggaaagaugaaauuaaaagaugacaauacaaaguauaaacuuuauuucucaacuuaagccccaucaaguucaaggcacuuuuguaagcagugguaccagccauuuaguucaccccuaaaaaacugaggguccuagaaauuuaacuauaucaauagucuuuucacauuauuaacuaaagaaaaauggguccccuuugaagauuauuuuuaagauuaagaaacaaaaaaagaaggcagaaggagccaaaucaggacugcaagauggaucccucaugauuucccaucaaaacucuugcaaaauugccuuuguuugagcaggaacauugucaugauggagaaggacucucugauaaagcguucccagauguuuuuccucuaaagccuuaacuaacuuucucaaaaacacucucauaauaagcaaacauuaucauucuuugguccaccaaaaugucaacaagcaaaaugccuugagcaucccaaaaagcuguugccaugaccuuugcucuugaccagucugcuuuuucuuugacuggaccacuugcaucucuugguagccauugcuuugauuuugcuuugucuucaggaucauacuggaaaagccaugcuuauccccuguuacaauucuucaaagaaaugcuucagcaucuugauuccacuuguuuaaaguuuccagugaaagcucugcucuugucugcagcagcauugugugcaaugguuuugguacccauggaaagaaaacuuugcucaacuucaauauuucagucagaauuguguaaacugaaccaacugagauaucuacgguguuggauauucuuuccacuguuaaucauuggucuucuuuaauuaggucauguauuaguccaucuucaugcugcugauaaagacauaacugagacugggcaauuuacaaaagaaagagguuuacuggauuuaacaguuccauauggcuggggaggaagacauggaggagcaagucacgucuuacauggauggcaacaggcaaagaaaagagagguugugcagggaaacuccuguauuuaaaaccauuagcucucaugagacucauuuaccaucaugagaaccgcacaggaaagaccugccucauauuaagucaccucccaccagguuccucccacaacacgugggaauugugggaguuacaauucaauaugagauuuggguggggacgcagcugaaccauauccaggcauaagcaagaugaauuuuucuucuugcaaauugauguggaugguuugcugcugugggcaucaucuucaacauugucuuguccauucuuaaaaugauuuauccguuuuuaaacugcugguuucuuugggggcacugucaccaugaacuuuucauaaagcaucaauaauuucaccauucuuucacccaagcuucacuauaaaucugauguuugacuugcuucaauuuuagcagaaaucauguugcuuugacaggggcucuuuucaaacugacaucuuauccuucuuagugccucaaacuagaucuuguuuagacaugcuauaccaaguuagugugaguuuauuuuggcacaaaauaaauaugcaguccaugcacaguuuuuucauaauacacauuuuuccacaaacuuuucgaagacccuauguaucuauaucauuugaagaaacaagccuuugggccuaucagaaugugauguauuaggcaacauacucacuaagaauaguuuuccuaauguucauugaguugcuaaaaaauaaauuuaaccaaaccccaccaguucuacauggcaucuaauauuucuauauucauuaguggaacaguuauuuuuauacuuggaagcaucugucauugcauugcagauaucugacucaagucuuaaauuucugaucuuuuaaauuguguaaaugucauccuuauuggucagacagacggauguggaaucuugacacauaacuucuuauucuauuauccugucuagagauuuuuauuuauacagcugucuguguaucagcuucuugggacaggcuuuuaacuauuuuaaaaggaauucugucuuguagaugaaggaauaaagcaagaaucuuagcagaggauugauaagaguaaaaaaauauuuacccuaaugagauuuucugcugguaaauccaguuucaugcuauaacaggaagcaaucuucauugcuccuuuaauaguguagagcuggccuuccuuccugguugugccauggcacaugucuggaaggagaugcuuucuuaauguuagugauauuaaaaccuccacuuaacucaugcagcucagcucacuggcagucucaaaugcauuuuagcucuguggcacuuauuuauauugucagauaucuguuaacuaaccaaaagguaaguuuaaaacuugguauguuagaauagacugcuuuucuuaguuuuucaacagugaauuacccagcaaggaggaguuuaauauuuuaaauauuaauguuaauauuuuaaaauagagcaucugucacucuauauguuaaaaugugaggcugacccaguaguggcugggcaacugucacugcaagggccauuacagaagaggcuguccugucuccaugggucuucccuaggaugccccauuuuauuuccuuguaccuauuucacuauuccacacauugccugguuguaucuggggcccuuaaucucuuucuuugggacuuuccuugcuguuucugaggcucuuccccauuccccauacaauguuggcuguuuucccuuauuuucuccauuagaaucuucugcuaaggaaugauucaucaagguuuaucaugguaagacauugcuucuacuacaugacccacuaaaguggcuacaaaaacaaguaguauuagauaguuuuggguuuaucauaaaaauguaugcaaacguucuauaccauauguauuagucuauuuucauacuucuaugaagaaauacuugagacuggguaauuuauaaagaaaaggagguuuaauggacucacaguuccacauggcuggagaagccucacucuuacgguggaaggcaaaggaggagcgaaggcacgucuuacaugguggcaggcaaaagagcaugugcagggaaacugccuuuuauaaaaccaucagaucucaugagacuuauucaccaucaugagaacagcacagaaacaccugucccugugauucaaucaccucccaccaggucucucccaagacacguggggauuaugggagcuacaauucaagaugagauuuggguggggacacagccaaaccguaucaccauaagaaagaaauugauuuaaaacaauaauaauauuuuucuuuauaaaucuuuacaaauauugugccuuuacaaaacugacauggagaaaaaugucacauauuuacucuguggcuccuucaacucacucccugccucccaaacccaccucuuacacacacaaacacauuuccuugugcuucaggggaaacaccugccugguugugaggcaaagggcaguaggaaggagucagugauagaaaauguguaauguauuguccuucucagggacuacacauucaucaggcacagacuccagacuccuaguucacccuaacucuuuauggucugaacuuuuguguuaucuucaugagacauuuugagaugcucccuuacauuaauauuaagggucuuuuaccuuccgggguauuaaaaaugacaguuaacacauaugguaccuguaaggugccuagcaauguucuaaacacuuuacauguuaacuacuuuauuccucacagcaauaugauagaauaggguuauuacuguuauucuuauuucgcacaugaggaaacugaggcacaacaaagguggguaaauuguucaagguuacccagcuaguaagugauggagcugggauuugauagcaggcagucuggcucuagucugcuguuguucacagagaacacuucagcaaguuagaaaucagcaaacuuaguauuccauuguguguauguaucacauuuucuuuaucaagucuaucacugguggguauuuagguugauucaacaucuuugcuuuugugaauagugcugcagugaacauacaugugcauguaucuuuauaauagaaugauuuauauuccuuuggauacauacccaguaaugggauugcuggguugaaugguauuucuccuucugugucuuugagaaauugccaugcugucuuccacaauggcugaacuaauuuacacuuccaccaauaguguaaaaguauuccuuuuucuucacaaccucacauaccauggaauacuauacagccacaaaaaggaaugagaucauguucuuugcagggacauggauggagcuggaggccauuaucucuagcaaacuaaugcagaaacagaaaaccaaauaccauguguucuuauuuauaagugggagccgaaugaugagaacacauggacacacugcagggcacacacacuggggccuguugaggaguugaggguaggaggagggagaguaucaggaagaauagcuaagggaugcuggccuuaauaccugggucaugcgaugaucugugcagcaaaccaccauggcacauguuuaccuauguaacaaaccuguacauccuacacauguauuccugaacuuaaaaguuggaaaaaaaagaaaaaaauuggcaaacuugcuuguaaccagcaagauagaucaagaggcuuugacagaacauaacagguuacauugaaggaaugaaauguuaacucuugaacuucuuugggaacccacaggaaccauauucugcuuccugaggucacuuacuucauacagauggcugcucagugugugugacuacaaggcacuccucugugacacagcaaugugaagucucuuuucccuacuuggccuucauugccuugaaacuuucacacgugaaucucuuucaacauaggaauuugacaggacagauacagaacaguggagaaacaggucauuaguucccaagcuguccuucacucauaagcuauugucuacaauaaagcaggaaaagauaagugcugaguagagaaggaggcaccaugcagaauaggugagaaaggaggguguuuaaauuuaacuaagggcauuaggauggcuucccagggaaaagucuagggaaacacuggcagcccuaagagccaugcucuuccaaauuuuuuauuaugcuucccaaucagucaaacaaaaggacauaaauaacaaaauaaugcuaguaaugaauuauaagucauagaacaaaaucagaaucuaugaguucauauugauauaaauaaacaaauaaauggggaagaagagagaguucuuuuuuacagcagaaugccaaucugcccccuuccccugcaaacguugaaagugugauggaaauagaaaaccaccuuggcaagcacaacagugcugguuucaggcaagaaucacugaugaacgcuaaaauuacgcaucauccugaugagaaacaggauauuugcauaguuucaauguaucucccccaaagagacuuauuaauuacuaaagguaacuuuacaguggagaagccugguagguaccaccauaaaaccaagugaucaaaguuaacaucuucaguaaugggaaaacuagacauucugcacccucuagcaugauguauugggaaggauacaacauuauaucugugguccuccugccaaaagugcuuaaucugaauuuaaucacuaggaaaugccugaaaaacuccaacugaagaacauucuacaaaguagucgauagucuuguaaaaugucaaaauuauaaagacaaagccugaagagcugauccagcuuacaggagaugaaagacacaugaugaguagcuacaacgugugaucuuggccagaaaaggauauuagugggcagcuggagaaacaugaauaagacucagauuauauaauauuauuguguuaauguuaaucuccagguuuugauaauucuaaaugguuacagaagauguuaacauuugggggaaucugggugaggggcauauagaaaucuuugguacuauuuuccuuacuuuuuaugucugaaauuauaucaguggaaaguuuaaaaauagacaaaaguacauacaacaaauagaaacuccaaaaaggauaauauaauuucagugaaggauucauuuuuuaaaaaaagaaaaaggaugcuguaaaauagaaauaguaauauuuucuuaguauccugcaauggauuaucuggcacagcccacuuuggugguuacugaggaagaagucaggcucccuacagcuuguuuaggaagagguggguggggcucuggugugggcauauuucuggagggaucuggugagagacggguuggcaucugaucaaggaaucugggcuggaaaaacuaaaauugguuguguguuucuaaacccuaaggacugugucuagacuuugacagacacagccauauuuaauacugaccacucaaaaccacugguauuuuuaucccauuugugugguuauuguuuuacucuuuagcuuugucaaaguaauacaugcacaguauuuaaagagucaaugcucaaaggcuuguaacaaaaagcagcagucccuugaacucuuuccaugcacugcagaaggaacuacuuccaacuuacguagcugugcacucugguauuaagcucuguauuucucaauaauauuuacguauugcucucuugguucagccuuuugagacauuaucuguugaccucuccuggagaugaagccuuuagcuuccucucauauauccuucaacacccacuaucuuauuaauauauucauaucucaacuuuggguuaaguucauauuuuguguuuucauuuuuuuaguggcuuaaacauuuuauuucucacagcuuugggguuguuggacucagcuggguguugcuugugacuccuccugcaguuguagucauacagaagcugagguaggaguaucugaauuucuucccuaacaucucuggugccugggcugggauggcuggaacaacugaggauuggcuggguacuucucuguauauauggugucuccauauggcaguucagggcuuggagagugagugcuaaaaaaaaguggaaugaaagcugccagcuucuuaggccugggcccccaaacuaauauaacaucacuugugucuuauuguuuugguuaaagcugucacagagcauguccagauucaaggggaggggcuugcacuucagaaugagcaauuaaaagaaguaaccaauauguuaaggcuuuuaucuucuuuuuuauucuuuauagcacuuaauaugguccugcguuuauuguagguaagaaagaaacgcucaauucacuuuuauuuuuugaaauggaauguaccuaucaccaaccaaauuagaggugacauaguuaguaucuauuaauauacauuuuuauaggagcacuagggcuaggagucagaauucuggauaauuggauucuaguucuaguuccuccaauaauuagcuaugagaccugaaacaaaagacuuacauucuugucugugucuugauguuuuaaaagaggaugguguaauuaaauuuagccaaauuacauuccagaaucgaauaauuucucugauacuaugcagugcuaaucaggacacuuagaguucucuaucugguucuguucuuuuuauuguuuccuaauuuuaucaccuccuauuuuuucaucaaggaauaauauuagauagcuagcguguauuaaauauucauuauuuauagaguccuguggcccuauaagaggaguaaaaagaccuccaaagccaaauaaaggcaauauaagaaaauaaauuacaggcuaauuuuuuuuaugaauauaggcauaaaaguccuaaauuaaauauuagcuuaccagauauaguaugauauuuaaaaugauaaaauaauacaucauaagcaaguuaaguuuaucucacaaauguaaguauaauucacuguguuuucauuuuuaugacuaaguauuuaauauccauggcugagcaaagucaucuauaaugauuguauuuccuuucucccauauauuuucauguuaccuuucauuaaacaauugcuuuauuaauuuaguuugauuuggagcuacagccgagcuccaaauaucucucaguacaguuuuccacauggucaagcugauaagaaacucaguuccuuuuuguuuuccuggcaacauuucuucuagagcccuccaucguccugcugcagucucugcuggucacuuucugugccugcugcauggcuguccucuuggcguuuuccuucccauuaucuggaaaauucuucuccucccuuuaaugaauuggaucccauggcuuccacuuuguggcuuuaucuuuauguguugguggaacauauuuuccagcagcuuguggagaaauuguguuugagagacaggaaagucaaaaugacauuacuucuucacccuugguuuguaguuugcccaucaucuuuuugcuuagaauuuugaaggccugcuucaugguguuuugguuccccauguugcuguugagaauccagcaaucuuuuuucuggauccuucauguguguauucaauuaaaucucugaaauguauuaggaugcuuuucuuucucuuuucaguugugaaaucucaugauaauguuucuuugcgucaaucucuauucacuguauuggguacugagugggcacuuuccaucuggagacuuguguucuuccgaucuggaaauuuucuuguauugcuuugcgauaacucccccuccuccauuuuaucuguucucucucaagauauccuucaguugaaaagauguuggacucguggacagaaccuuauuuucuuaucuuuucucuccuauuguccauuccuuuuucucuuuuacuuucuggaauauuuucucaacuuuaauguccagcauucuaauugacuuuaaaaaauuagccauuguauuuuaaauauguaaaaucuuuuucuaguucuauguuguucuugcucuuuuccaucucguuucuguucuauugauguaguaccuucucuuauaucaccaaguauauuauaguuucuuugaacauuucuguaucucucugcauuacucuguuuucuuuuuucuauuuauuugagcuucuuuuccuguuagagacuuucuuugaaugucagaugauccuuggguuucaguucacauuuaagaauaaagcacuaaaauugugcuugaacgguguuuguccacuagugccauucaugcuguaauuuucaauaggguuuucuuccacaacaaugucaauaucuguuagaauuuuuccugggacaguuaauugucuccuaggagauacucugucuucugcauggggagggugugaccuggcugcuggugaccuggacaugggugagagaaggggucuggggucucaagucucauagucuuuuuauuugcagccuggcuccaccuugcucugugccugauaucucucagcuuagagccugucaacucaaugucuccaguuaauaaaacuccucuuccuucauuggaggagaaaggcaggacacugacugcagaccuggggacaugagcuuuaguagcucuguauccucuuuuaaagaacuaccuuguuccuggucccugccucacccccaucuuccgugacauuggauucucuaauagaugaaccauccugagguugugugguacauguuaaguuguuacucaucugcaggcacuuaaaaaaaaucuuuccucaguucugcuaagucauuuauaauccucaucccuuuuccauuuucauacauauuggucuagguuuucaguucacugacacuuucaugagaaaugaaguuucuauuucuguuucuuugucucuguguuguguauuggguagcuuuuuauuuuuuaaaaggaaaggguagaagcauuuuuacuuuguccugcuaauuccagauguuuccuuacuuuuuuccaaauuaggaaacugugagucagaggcuaaguggcuuuuacucacccacucccuucuuacuucaccagaacucucuugucaauguuguuaaagauuuccacauuguuaacaccaauagacaauguucagucuucaucuuacuugaccuaucaguaacauuugauauagcugaucccgucuucaucuuacuugaccuaucgguaacauuugauauaguugaucccuucuuccucuuugaugugauuucuuuauuucuuucuugaacauuacacgcuucuccccauccucucaaccuccuaacacuggagagucccagagcucaguccucaguccuuucuuucuauaucuucuuuuuuuucugcuuuuacuacuugugugauuucaucaauucucaaggguugaaauaccauucgcaugcagacagcucccaaauuuaugccuucaucccaagauggaguuucagcuuuggugucuaacucccuacucagcaucuucacuuggccaccuaauaaacauuucaaacucaagaugacuaaacucaaaccccugagcuuccccacagcugguuccauaucagcuaugaaucccauaucaacugauggcaacuccauccuuuuggugacucaggccuaaaaccuuggagucauucuucacucuuuucuuucagucacgcucauaucuaauucaccaggaacuuccguugccucuaacuucauuauuuauccaaacugaaccacauuacaguccacggcuagugcccucaucugcacccuauucucucaucuagauugcuauaaccauuuuuuaacauaucucccugcuccuacauuugccccuauaauguauucucaauccaaggagggaaugcuuaggacucuggaguuggcuauugagaaggcugccccuauaacguauucucaauccaaggaggagguauccuuuugaaauguaagucaagucacgucacuuuuuugucaaaaauucagagagcccaaagaucuggccucacuuauuucucuaaacucgucuccuucuaccuucccccuuccuuacucugcugcagccacaucuauguccuugacguuccucaaacaugacagaaggcucccaucucagggccuuugcacuguuucuacagccagaaguagucuccuuaucucucuuauggcuauucaccugacuucuucaaguccuugcucaaacccuaccuucucaauggccaacuccaacuuccuaagcauucccauucuaauuucccugcuuuaguuuuucuuuuuuuuuuuuuuauagcacccaucaacaucuaauauucuauacaauuuaacuuuuuguuauauuauuguuucuuaucucuccugccagaaagaaugugcccaacaggggcugggaucuuugucuauguuguucucuaauaaauccuauguaugcugugguauacaguagacacucaauaaauauuaguuggauaugaauaaaugcacaaggccagguuuugcaccugaguguuuauacuaugucauguucuucugugggucaucugaguacuauauggugacauuuaaaaugcauuacguaggguuuuugagacagggucuugcaacauuugaucucugcucaggaagagaguagggaugagagaaacaaaauuucauucuuuccucuuacccauuuuuuauuuuuuuuuuaucucccuuuuuuggcuuuuuguuaaguuuuaugugaauucucuugucagauggguuuaucuccuaucucauuagauaaaaacauucauuuuaaagugguuauuggguuuguuuaauuaccaaacuugcuucuaguuucaaaggcgaugauacaaugcuuuccuuuuugcccuuaauacagaagaauauugguuaacacuaagcuuucuuucccuuccuacugcuucccuguacaaacuguuccauccacuggcccuuaaaaacaaacaaaaugguuuucuugaauaagcaaauucugagcugacuauauuuggauugucaaaauuuuaagucuaaaaguaucuuauuuaauuaucagcaauuuuguaugauuggcuucacuggagcuagacacaacacacgcuuucccuuuugaauuuaaaacaaauacauaaaacuuaacauggggauacauuuagaaaugauggguaaauuccaaacugcagagguugaggcuuuuguggcauauaauauuuuccacuauuugaacauuaacaaauaauuacuucccaaaguugaagugacaccucaaaaguuuucagauucccaaggaggguauguggggugaaguagugcuggaguaugagggaugucuuuguauaauguaugaauuuuauacagggggccaagugcuuuauucuguaauuuauggagacucgaaucuuaagcacauaagguuuuccuaaacuuccaguuauauuggacuuaaugguauuuucauauaaaguaaacaaauuuguuucugaaacuaagaguuaaauuuuuuuggcaugugcauguaauuuaagucagauuuaaacuuagguauuuaaacguguaacaagcauaacuaaugauaauguaauccuucagcuuaauuuuuuuaaaucuccuacugguccuuaacauucaguagagcaaguauccuuuggccuugaugaaaacucagacuggucccacaucuuuucugcucauucuaugguaauacagagaccuaaagucauuuuaagucauaagcacauccuccaacaaucucaaucaaacuucaaacucaaacucuuuuccucugcccaagcugggaccuguuuaggcuagaagacuacaagagugucagguauguuugguuucucuguuucucuauuuucucccucaaaucccuguccuccagccuucauccuccaggaggcccugaagggcaggacucaagaagaccccacacaggagacauuuguaacuaccuucccuaccagucccaggaggucagcacucccccaguggugccaccaagacagauagucagcccaccucuuuaccccuggauuuuccaggcaugcaucagcuccuaggccacuaugcuccccagucauggggguaauguuuuaaaccaucugaauggccuucaaacccccaucccaaccaggguggcaaugaagaggcagccuucucccaugcugggguggauggagcucacagcacaguuuucuucauacgugcccuucucacuagacccccuuuacuccccucucucaacuuuuauacuuuugaagccagugaggagcuccagagucacugaacagagaguaggguaagagcagaagggaaagcuucucuuuguagaagaaaaccaacuccuaaagaaagaggagcugauggaaucaggaaagcaccgucucacagcccuccuuauaaaagcggacacaggcagggauccuuggugggugcuaaaacaagguugugggggacaggcuauucacauagucucaaauaaucacauucuagguuauuuauuaguuauaaaguuaaagagguacugucacaggggagaaaccuggcagacaucacuugaaucgagugaucaaccugaacaggaccagcaaugggaugcagcaacccuccugggcccucggaaaacaguguggaaaauacuauggaauaguaugcagacagaaaaaagaaugaaaucauguccuuugcagcaacaugggcggagcuggaggcuauuauucuaagugaaauagaaucagaaaaucaaauacgucauguucucacuuguaagggggaacuaaacaagggcuacacaaggacaugaagauggaaauacuagacaauggggacuccaaaagaggggaggguggcaggguggugagucuuaagaaacucccuauuggguacaauguucacuauuugggugaucaguucacuagaagcccaaagcucagcauuauguaauauacccauguaacaaaccugcacauguacccccgaaucuaaaauagaauaaaauaaaaaaauuuaacagucaugacaauuaaauguacugcaggauucaugccccccccaaaaaagcaaaacaaauaaauccuauaaaggacauuuuagaaaauuugaauauggcuugaauauucuugaguaugaugauuguguuauggucauauagaagaaugccuuauucucaggagauacuggagaaaauauuuaugaaugaaaugucacaauggcaaagaacaagagagggaaaaacaaaggcaaaauguggcacaauuugguaaauguaggugaagaguauuggguguuuauucuuucaccauuucuauaaguuuuuaauuucucaaaauaaaaaguugggggaagaaagagcuauggaacaagcucuugcacacuucauuugaaaguacaaauggagaacuggcaucucacucuaaaaugucauuucaauuguuucuuggugucuggcugaaacuuugauuauuacaucuuccaagguuuauauauuccuaaaaguguaaacauauguaacaacaacaaccucaaaauauuugugcaggacaauuacaauuuauaacauguuuccacuuaucucauuuugucuucacaacaaucuuggaaauagcuagaauauuuuuauucuucccauuuuacaaaugaaaaacugagaagcugaaggucugagcaacucagccaaguuuauauaccuaagacuaacgcccucaccuucugauugcagaccucauauuuuuuuaggacacauauuaaauauucaggagggggguuaacaaaaccacuuacucucauuauuaauacuuccuuuuguacagaaaguaagagagagacucgaggguauuuguuuauccccggcugucugagaauuuucgauuacccugacacagguggcucugcucacugcauucaaucagcaugccaguaaacccucagaguguguugcugcuaagucauguuagucuccaaguccucugcaugucacugcagaucugcugcagcagaucgaggaacuuacagaaaugaauucuccugagauccagucaacauccccucagaauauggaguuaaauuuugucacaacuccaaauaucucucagagaaaugacaacucacagaaggaagugcacaugagucauaaacccacagccccagaauacuaagcagcucuguuuuucaccugacagcuggggugagcagaagcacucucuguucucccucucucucucucuuuuuucuuaacuaaaaacaacuuaagggaaaaagaagaagaagaaaaaagcauccuuuuggagcuuggugaaguccacagacuuguugugagaagguacaauagucucccaaacauuuggcccaccuuguuuuuccuuuuuuaacuuacugaaugauacagauugaaucucuucugccuucgcuguugaguaaagaugucaugaaagaaaaaaaaggugggggagggaggagagaaaauagaggaaguaaacugcauagcauauaagcauauccuucuuuagaaucuucccuucaaaccaggacuuuauggaauaagguugggaaucacugauuuccaaagaaagcggaaaauacaacaccagaugaguacaauuguuuuucuggaguauaguuuucuuuaaagccagcucuucacauauuuucugcagccuuggcaauuguuaacuucucaguaguucuaguaaagguaauuucucuaaagcucuuguucuuucuauggaacccaguuggaaaagaucauuuguuaaccaggggcucuguucuuauagaugcauaucagaaugauccacagucagaacuuugugggccucuuguuaaugcuggaaauuuuucaacaggccuggaagauuugccggaccugaggcaacaugucaacaacugagaguggugaacucuguaaugugccuuugcuguaugacuuaagauuauucaguucugcucaagaaagaaagugaaacaaagaaagaggauaaaugaaacuggguggagaugcaaguagcuugugagacauaggcagaauuuauaugaugagcaugguaaaacuaaguggauuaguaaccccugagucauaguggccaucaacaaaguagagaaugugcaugcugaacacagauaggagggaggaauggaaagaggugauauugacaacauauccauaugcauacgacaucaaacauuugaaauauacuaaauauaaauacauaaaauaugagaacuuaagucuucagucagccacccauuggugacccccauucuagccacagaaauccucugugcaaggaaugcaaauaguccuuagcuguucaucaggccaaaugaugagcuacaggucauggccaggugggcuugucccugugucuuuccaaguauacuacugacccgggcaucuuuuccuugcugagccccuugcugaaaccucagauuugaccuauauaaucacaccacggagaaggucaaugugguagauagagagaacaggucacaugagcacugugugucccaagauuuaaguagcuggguucuuucuccugcgugaauucuaguguaauuauuuuaacugucccuaucucuuccccucuuucuucucauaauguguuuuaauugauuugauaaaccaugugacucaugcaucuuaauuuguuguguuagccuucuucuuugagaccucuaggauaaccugguaguagaccuggagacuacaauugcaucaagguaauuuccugcauaaaaaaauuacagcaguacuauacaaacaguaauaauaacaaaaaugguagcucuaaauuucgaguaguuacuaggcaacauccuaagcauuuuguguauauuaucucaaauaauccucacaauaacccuauagagcagauauuauuaccuacguucuacagauaagaaaaccagggacaagagaaguucaauaacuugccuaagaucaauuggcucguaacagaaagaggauuugaauugaggucugacucuuaaugccauaccuuugcuauuuuggaggaguccaagcuauuuuccaaacccccuccccacugcccaccauuuccuccuauuaggucauccuaacuaaaaucuacccccauaacuuccuagcccccucccaugauuaguuuguuucuccauucuauuaucaccaucuaauguaacuuucuuacuaacuuuuugucugucuccccaacaagaaugugauuuuucuaaggauaggauuuuuguuuauuaacuucugcuucuccaagugcccaaaacagugcuuaaauaguaaguauucagugaauaucaacugaaugaaugaguuaauccuauuauugaguuguuuuuuuuuucuagagacaucuuugaaaauaaagucacaggcacaagaucaccuuucaggcugaauagauuaacccuggaaaauuuaugauuaaaucagcuuaaagggcauaaagaguuucagagcaaaauuuuaggaggaaaaaaagggcuauaagaaaauuacacugccaacuccauggcuugaaucuuacaugacuucaucacagauccugugcagcccugcagcuuggcuaucuccauuagauuuucaucauauuauaauuucagggccuuggacuucucccaugauuaccucugagaagagauccagagaaaggagaguuuuacaugccuuaccuagggcauucuagaaauggagcuuacguuuguuugccccagcugugagugaggugcuguaaccacauuguuaacucauucagauggugcuuuauguuuccucuguuuucaggugaggaaagugagccucugugaggauaguagcuuuucccaaguguacagucugauagguagcaaagccagaauuugaaguugugucugucuaaugcccuaguccacucugcagaaauauuguuccaaugaggagguccacuaugaacagaaacaugagauuuucuaaacagacgaacuugagauggaaagaaccugaagugaacccuacugucccccauugucauuucuuaggacggaugaaauaaauuugucuuuuuaugacacaauuuuuuuggucuguacaggacaaaacaucagcuaaauaggccuaaaguaucaggaaaauuuuuggugaauuugcaguuaaaauggaaacaaaacugcuuuuuaaaauugaaacacuuuuuuuuuuuuuuuuuugcaacaagcuuggcuggguuuggcucaucuucuuggauaugaaaaucauuuucuccaaauuaauuucuugaaaacucaacugucccgggcuuucaaaccaggggguuaaauugaucugauguacaccagaggccuugggaacguccuggccaggguaauaaaugaaaugcauuaaauaaucuuaauugauacaguaauacucagggggcagcuguauugccaaauugucccuuuauucauuucugcucauuuagauaucaaucagauuucuaaagagagaugcagugcaucuggaugcuacugugauuguagaugagaaacagcauguaaguguccuggggcuguuuggcagcaaccugucaacaucuccuugaaauauguugaaccagguacuagaauguuuauagagguuaggaaaccaagauggguuuucaaguagaggaaaaugaaguuggagcuauuuaacuuuggagcuuuauucauucaaucacucaaacacuugcucagucauucauccagcuagucaauaaauauuuauugagcaccuacuaugugucugcggcucugucagacugggaauaugguuuauaagccugcguggucaaguacaguagcuacuagccacauguggcuauugagcacuugaaauguggcugauccuaauuaaaauugucuacugagcagcugaaauguguugcuccaaauuaggguguacacaacugauuucaaagacuuaguagggaaaaaaaagaauguaauauaugccauuaguaacuuuuggauacuaauggaucaugcugaagugguaaguuuugauauaucacauuaaauaaaauauaauaacuaaccucaccuguuucuuuuuacuuuuuuuuuuuuacuuuaaguucagaaauacaugugcaggacgugcaaguuuguuacauagguauacaugugccauggugguuggcugcacccaucaacccgucaucuaggcuuuauacccugcaugaauuagguauuuauccuaaugcucucucuccccuugccccccaccccacaacgggccccgauauguguuguuccucucucuuuuuacuuuuuuaaugauguagcuaauagaaaauuuaaauuauauauauguggcuugcauuauauuucuauuggacagcucccugauaauauuugcagaagauuucuuccuucuauaucauguuuuuucgaauggcuugaagguaacuuucagggaagauaauaaaagauagaggcagaaggccugaucuacugugguuaaaugauguuucuagguuuuaggugguuaauuuugguuuugaaaacuuuuuacuuuggaaguuaaauaucuagguccaguauuuuggaacugucaaaauguagaaaauuu

SEQ ID NO: 13640 - RNA, 12750 nt, Homo sapiens
ucaauaggguaccucauuucagaaauaguacuuaaaucugacucaaaauuaccuuaugacaccauucaaaagcaaaucagguuuuuugguuuagugcuaaaauauaacauuuaaugucacauuguugggcgacucccauuuacuuuuuccauauauacagugaagacuuacaauagcucacaaugcaguuaagaauugcauuuuaauaaucucaaacuaccaucuaauggaggaaagaauaaguuugucagaaaaccaguacagccauuuugcuauuaaaauuuuccuuuuuaauaauuuauuuaaauaagguauuugaagcaguuuagaaaaaacaagauuuguauuuuauuuccuuguaaaaaucuuuacacaugcagacaaaccaguguuaagaaaguauucaccaucauuuaaacaaauaaccacuuaaauagaacagugucugcaauuuuaucuguauaaaaauaagauacauuuuuacagaauucacgcuccaguucuuauagcaauaaacaauacacaacuauaauaaaguacaauugaaccugaccaugguuuuuaauuagauacugcuagggcauuuuaaugugcaaaaaaauuaacauaguucuuuucaaaagaaacuguccucaguguucuagagaccuagaggguuucaagaaaucaaauccuaaucaguuugcguuuaauguuuuugauugaguccauacaucacacuguagauaggcaaaaccaagaacugaugcaggcucaaaggaagagaaagucagcgccugugccugccauguccugagcgacugccaccauggugcuugcuuuuaugggaccucucaaaggagcgagaucguucacgccugucccuaugauguccccuuucaugccuguguuucuuggcugcaucugagugaucccgagacuugcucugagaucgagaacgagauuuuuuccuuuuaugaccaugucuguuugaacuuuuuaaaucaucucugguaugcuuggccuuaaggugaggagaaccaugauuaugaugucuucgagggcuuucacugugacugcgggaccugcuucuugaucucgagcuguauguuccagaucgacuccgccuauuauuauagcuuagauaauaaaaauuugaaguuuagguucaguuucuauggggaacagauuauuccggugguugcucauaacagguucaaaacaaaacuaccagcuacauaaaugacaaaccagaacuuuucaaaaucuccccaccccucacugcuguaugcccaagccuauauauaacauauuaaaucuuaagcaaauguucuuaugucuuuauuccaaggggaguaauuagcaauuuuuauaguguccuagagcuaugcuuuuuauuaaguaucucccacauguucaaaagacauugaagagccacgaagagcuaacaaucuaauuacaggccuaacuaaagaagauucauugacugguuaauuugauuauugguuauuaauaagggguuaaugaaacacauuuucuaacugaaauuaaaaaaaaaaaaagaaguuuucacauuaugaacaauacuauggcccucaagcacuuuguggguagcuccuacacuucuccaaaaaacaugggagaaaauauaacagaaugccauuaagauacuguauguccagaacaucuccaaacucauuucucauaauuugccucauacuaaaagccuaauucuaaccuaacuuugaaaauaaucuauguucaauuuuuaaagaaaaagcaauaaccuuuaaaaacuccaaauaagacugcuucccuaagaaaacauuuacuuacugucuucuuggaguaugugaucuagaacgugaucguguucuugaccucgaucgacuugcacuucugcuauuucuacuucucuugcugucuuuucuuacacuucaaaaaaucaugacauauuaguuacaaacuuaguguguuaaaaaguaaacacauaaaagauuccucaagccaguuuuccagcccaaguauacucacccauuguaagggcuuuuggaagccuguugucuauccucagguucuuuuuugacugucuucacauuaauggagauuggugauuucucuucagcuuuuacuucucuuggugaugcuuuuaaaagauauaauaacaacauguuaacuacuggauuuaacagagggccaaaaguuguuucuaaauguaacucaaaguaccaugcuuccgcuuccauguugguugacugccaugagagaacauagcagcaguuuccuaacaucauuuuucucuaugcaacuuucaaauguaaaagcucucuaauaaagacacacuuucagugcccccaagucauuuuaauucuaaauacaucuuacauggcuuggaggcuggagaaaauccacccaggguugaaagggcuggaguuccauccggauucaaucccuuugcuuuuaauuuggcuucuuguaaggcuacuuuucuuuuuucuacuucuuuuuccaguaauucauaguuuggcuguuggaggaaaaaaaaguuaguauuucuuccuuagaguagcuuggacucuuagcauguuggcacaaacgaguaaauagagaauaccuuuuuucugguauaaagccuaaguguuucuaugcagauuuccuggauuuccucuucuguaguaccaaaaagaagaaaccaauggggacgaguuggcaacggaaucuaaaccauaagaacagaauguuuuaaauuaaauuuuugcuaaaucuguauuggaaccaccgaaaauuugugugauuuauccuacagaacaaaaugggaaauauacaccuaccugaagugcucuagcugcaagguagaugcaagcacaugcuauagucucugguugaaaucgaacaaacacauugguucgaagacugucauucauguaauuccugaaaaauauuucaacuauaagcuugcauguaaacaaaccaguucuucugaagcuuacauaaaauuggagacucaaucuacuuuauucuuuuuucuucucuuauuuauauucacauccucauauucuagcauauaacaacucuuaacucaaaaaaaucaguaagcaauaagaauuuaauacuaggaccauaugcgauuuuccuauauaugagcgaagcccuuuuaaauuauuucauauuacaauccaaacuagaaauuacuccuaaaaaguuaauauauuucuguaaaaagcaaugcuuuucaaagucaauucugacacgauuaguuucagaaaugauaaaccacuccaauaauacuucaagccauuaauuacugaccaucucuccuuuauccacaauaaaagcagugucaaccaaguucuuuucaaaagcucaaaauaccguuaacagggguaaaaaggcauuuucaguaaguaccaaguuaaacuuauauuaagaaagcuaagauacuuagaaaaucuagauagggaaauaaagagcaauaaacacauauaauggccuuguuuacauaccuuuuuugugacuagguaaaagagauaaacuauuucaguuaaaaaauugcugaacuuuuauuaaugaacccuccccacaacauuccuaaacuaucaaagaaauuuuacagaucauuuaaaagguuaagcugaaauuaaauggacuauuucuuaaaaauccuaaaccaugagaacugcuauaauccauuuuaugcaacacauacuuaaaaugucaugcauuuuauaaaaauaaugagacuuuucuaacauuacaaauauuuacugaguccaaaagaagcauggcagucauaaaaaggacaucuugcugggaagcccagaauauaaaaauuacuucacuaaguccuucacaucaauagucuuaggaaacaguaguuguggcugaaccacaaacuccuuggcuugaccuuuaaauaagccagcacuccaaaucacacaucugcaucucaagaaguccaagugcuaaagcauuuaagcaauauuauaguaacaucucuuuuaaaaaugaagugcuucuugcuucuaauauuauuacccgcaauacagccaagcaguuauauaaauuaagccagugugggaacuggugcccauuuuaagcugcaaguuugucgucuccuuugguaguauucaugcuauacacacuaaaaauaaaaauuuagucaaacuccuaauaaaccauuuaauucauaauggcugcacaacaaaucuaucaaaaaugaacuauucauuuugauaguuacaaguauacauuaaauacauaggcaugucaaauaguuacuucuagaagcaaauauacaaauccuuuugacaccccgacagaacuagaagaugcugccagauggauauggaccacuucagugaaucucggaugagagcuugcacuggauuggcuggagagcaggguagccaaucaggccauccugaggucaugggcugaagugcagagggcagaguucuaugacuuaccaucauggacuacccuuuaauuaaagaguagaaaaaagaacaaaguuaaauugaguucuccauuaaaaguaauuagucaagccaagaaaacaggaagcagaaauaagcauuauuuaccuuuugguuaaaaaaacaaaacaaaaaaacaacgaaaagccccaaacaaacuuaucucauuauuuuggaaagggaaaacgaaacuuacuuuauuucugcuucuguuuuccuggcuaggaaagaaaucuaaaaaagugacuuaccaggcaguuugaaccaggguuugauuacguucacauucuaagacuuguaaauacauaacaaugaucugaaggacaagggaaaaaaacucaauucaguauacugguaguucuuucggaguagaguucaaugaaaaaaguaauugaaaauguuagacucaaguucuaauugugcaucgauaauacagaccaauuuaaauguacauaagauucuaaugugaacugcuacaugacuagauuuuauauaaauuauguuuagaagcauauuucaaaauuguacaggaaaaaaggcaauuaaaagaauauuuuucauuggcacuuuacuaugugaugggcaccgugcuagauuauuucaccuaauuucccaagguacauuucuaacccagguaguccugacccggguaacucacucuauggcuuauauugauaaugaaagcuaagagauguugggagaaacaaauuuccaauaaugguaacagugagcagccaacacacuuagaacauucuacuaugaugauaagugugccagauacuuuuguagcuacacauuuauuccuuggaaugaggaacuuuacaucucuguuuucuagguggaaaaacugggacuuuaaccacagaaacaaaaauaacuucucuaugagcacacaauuaagauuuaagauuugaaccuacauuuuugacugucauuuuacugauaaaucucaacauccaaaagaauguuuuucgaugaagccugaaccuuuaaaagaaugcuuuuuaaaaccaagguuaacacucagauagaaacauaaauucauauaaaauaaaauuuuuagaaaaguccuaauacuuacgaacccaauuucuguacucuacaacucaccuuaugaggaugcuugacaugaacacaaaaucccaacuccuuuagcacccuccucucugcuuugauaacuugauuuuugguguuaauguaguucugaucaaggaucagggggcuuggaguccuauaguuuguaagaaauaaaaucaaaacuguuuugcacauccaaaaaauuuuauuuguggcaucuccauuuucccuuccaaccaacuauuggcaacagaaaccagcuuuuuaaacuccugcaaacaaguuaaagcauuaaucuugugcuguccaaguuaugcuaauuaaauauauacaucuacgagacuaaguuccuaaaggaacuaacaauucuguaaugaaaaaaauucacucuaauguucuugaauucaucccugccaacuuuuccauucugcuuauauucuagguguguauauauauguauuuaacuuuaacgauagcaugauuugucaucacaaaccucaaagucucuccaagagacuuuccacuggccaaaguaaugugcuccaggcugguccgaugguaguggguuaucagaacuuacuaauaucagugucacuaaaguugguauacaaucucccacugcuauuugacugguaaaacaaacaaacaaacaaaacaacuaaagugcuccuaagauuuacaguacuauaaaguccucauaagaucauacugauuuuucaugcauucuauauggccaaaauuuuucaaaaguuggggggggugggaacaguggguaguuaauccagauuccccuccaaugggguauuauguuuuuaauaauuuguucuaagagccuaucuguuuaaaaaaguaaucugaaaacuaaagauucagcucaauuacccaaguaaauuaaaaaucguauuuaaaacuccacgugacccaugagauccaggcccaaauuuggucaggguuguaguuauuaggcaacaugcuuuacuauuaacacagaagggaaugaagggccauaaugagggaaccacaacauauucaagggcucuguaccagacuaaauuuugguaacucagaaguuucuauaauacagaaggcuuaugucagugguuuaaugcuuuaaaaguagcacauucaacugauguuauccccaaauguuuuauuacauaguuuaaaaacuuauaauaaaagacaaucuuauuuaugucauacaauucaaaacugguuucuuccugagaaguuucagucaggaaagguuaaggaauugggcuuuuguuuuuuguuguuggucaugucugaaauuuacccaaguccaacacauucuuagauucaaccaacaaaaacuacuauuuuaucaagacacugauuauacgguaaguuuacaaguagaauacuucaauauuuuuguccauacucaguucauuuucagccaaaagacuuaagagucuuugcucuaggcagaauacacgaucuauuuuuaagacagucauccucucuaccccaaugcacaccagauccagaaaaauguaaucucauauuuuuaaaacaaaaaucuauuucaauacaugcaccgaagguuagaaaacaaucugcgaugaacuucauuaccccuaugguaacaucagaguaaaaagucaguuaucauacauuuuccuuacuuucuuccauuuaaaauuauuacagaaacuggaaugcuuacuaaacaaaaacuggcagcgcugacaagauaaaagacagcuguuacuuaaaauggccuucccucgguuucauuccucacaccuaugaggaaugaggccaccagcuggccucauugagcugcuuucuaauauuaacguguaaugaugaauccauuuuaucaggacaguaggcuacaaauugcucuuuggaaaauaagucaaacuuaauucucaugaaaacaaccuaucucucucuccauauauauacauacauacauacauacauacauacauacauacauauaaacauauuccaaagaucuuaaggucuaugaucagguuuuaucaucacaggaaauuuggaaaaaaguaaaaccaacuucagacucuuuuuaacuuauggcuguguuaucuaauggcucuccuuaacugucauuaagagauaaaauagcuccaguguuacagcugcacacaccauuuuaacucuuaaccccuugcaauccagacagaagacgguaucaucaaaaucccuaguaaaauguaauuuuaugaaaacauaguugucucauuuuucuccauuuguuaauaaaaauuaucuauaccucuuaagauaaccugcuuuaagaacugccuucaaauggugauauaauucauuuguucuugcaauuacacuaaagaagcuaaauauguuugaauuauagcuacuauuuagucccaaaucagacuuaaugaugccauuuucuuuguuuuugugucaaaaugccaaugacaucaaaauagauuuaagaaaaccaaacccauuauuuacuauaauucaauauauacuuaacuucuugcuuaauccugcuauuuauuaccugcaauuuucaaaguuaacuuuguggguauauaaccuaaaaccagauaccuuuauuuuguucagaauugguucuaccucacaaaucaacggugcacacguaauuuacaacuaccugguagagauuacuuuguaucauaaauuuaaaaaauauaucuccaucaaucagcaguaaacaaagucucaaaguauacauuaguaccuucuguugcaacaagcacauuaaauuaaggccugcuagaauuucuuccuccccaaucagguaaacuuucuuugccaauaaaguuugaggagguggcauuugaaaaucucuuuaaaaaagaagucuucaucuauucagagaaaacucaaaaauaauuuucauuaucaacacacaaacuaacucaaucucugcuuuaaguuucuauuguccaauuuuucugauuuauacgagaauuauuuucagcuuuagaaaauccuggucuuuggucauuagaaguuuauuauuaugguuuguuagaggagcuauuuuccuuuagcaugauuauguaauugacauauaacucaacaacaacaaaaauuacaaaguccaaacaugguuaguuucauuuauguguuacaaagacugagaaauauuggaaccaagucuucaagagacuauaacagauugguaguuuacaaagaggcauacugccaagcaauauacaaaaauuuguaaugccuacuuaaaaguagaaacauccuuuauagguauuuaaacaaacugaaggccaccuuguagagccacagaauuauacuguagaaaggugguagacuaaaugacaucacuuaacacccuuccaauucuuaccuauccaacuuuuauuaucuauggauacacugaaaauacauuguauuuacuaaugagaaugguuaaaccagucuuugaaaauuuuaauacgcugcaucucaaaaguaaauauuuggaaacuagaacaaugaaaaagcaauccccccucuaaauuuagcuguuuauugucaacuuaaaagauaauuaucgaaccacaaaaaacugaaggaggaauaggccaaacaauccagguuggggacuaagcacugguacuuuuuaaaaagcuccucugcuaauucucaauguguagccaggcugaagagaccaaugaccuacaagcaacaugaauaauguaucuccacuguaauugucaaagucacacuacaauuuaaaguuaugaauaaacuagauuaaaacaaauagcaucauuaagacaagugauaugcuuuaccuaaccaauguauaauacugauaguacuuucuaaugacauuaaccuaugcaaaaauaaauacaaagcuauaguucuaauaacuuggacagcaaagacaaaagcuuauaacaagaaacaggaguuuuucuaaaugguucaccaguggccaaccuguuaguccccgauuccagugaccuauucucagagcacuggcuucuccuuggggauuuucgauacuucacucacuguugccaugacgacagcuucaucucuauguaccacuccacaucacccaggcuuugguaaauguagcuggucgcuguauagucgguugcaagggaaaaaagaguugaaguuaauaacauauacaaguuacgugcuugaguaaacuuguaauaugcauagaaacacuuuuacauccugcuuuaaaaaaaggcuuccaugcaauuaacaacuccuuuuaaauuuugcuauaaucagacuucuaagauugaaacaaaaucaguuucucuguaauaaugacccaaaaaacaaaguuacaucagacacaacaaucaggugagauuauauuauuuuaaauuccaugguuuuuacaguuaagaccuauucuaacaucaacgaaguaaacuagucucacaggaaaauuccacagaagauaaucaugugauuacauaauaguuggcucaaugguucaaagaauacuagaaaaccauuuccuuuaagcaaagagaaaccuuugacuaaagauagagccuuguauuagugucauuacuuuaaacauccugaagaaucagccagguaucuaaauacagauuuaaccucagaccauaccaaagaccaauuugaaaucuucccaauucccagggacucaucaacaaacuaaaagauauuuuagaauuuaaaaaguacucuaucccuggacacaguuaaggugaaugagaaaagaugggggagaaaaaguauguaggaaaacuguugcagacuuuuugacuaggauacucuuuuuuuaaaaaagaacugucuguagacucacagaauagacuagucaucuuaaaguugcuuuaauauuugcuugucugaauaguuccauuacugccaacuuacagauucagccaauaaggacuacucauauagaauacuaacagcacuaaccaacauacccaacccccagaacaacuuauaauccuuuuaauaacuuccuuucaaacucaguacaauuugucuaacaucacuacaauuccuuaaagagugaaugcaaaaacuauucuacaccaaauauaucauucugcagcauguacuggaagucaccuguagaugcaggaaguccugcaacaaacuuuuugguacugccucacaggaacacauagguccacauaaaauuauguuaccacaacaccuaggagauacuauuucagucucuguauuuucuuacaacaucaaauaaauggcccuaucuaaaugcaacccaaucaaucuuacuuguuaauuuucuaacccacucacugagacuguaucuaaccaaaacaaaauaccuguuuaaucccuuugacuucaaacuucaaacuuuaucauccugcaguccuuucagauccgguauuauucgauuuaucguaguucaauguugagaaguacucuaacaaaagccaaccucaauugauaaagaauuaacugggacuucgaguagaaaaacauaaucuacacagaacuuugccacaauauuaacuuaaacuacaguguuuaaacuuccagccuucagucuuccagagaggggagaggaaaaauaacuuacagaauacacucacacuugagccaaauguacucccuuucuuguuuaaucuuaagccacaggccuggcuucacagcacuguuaggauuguccauaaaugcaacugccucuacaaacuuuagauaaccgguuaauuauguuucuuuuuucaaauuauuuuaaguaucaguguuccuauaugaacuuuaacaccuaaauuaaaguccguuuucuuuugcauccguauucacuugaaaggaaagauguuuugauuugaugacuggugcacgguacagcaguagcaagagauacuauguucaauaaugccaaucuuaccuuuuuccucuuaacuggcggaggugguggaauacauuaaucacaucucuuauucuucuaggugcuucuucgauuuuugaugcaagauuaauacaagccauagcaacaaucugaaagaacccaugagccacaaaagccauuguuagauuaaacucacuuugaagaauaaaauuuagaacacaauugggacaaccuuuaguaaaauuagagaagacaucucuaugccguaagucuaccagcuaugcuaguacuauacuuuuuguuguuuaacucaucuuaauuuugguuccagagucaaacucaaucuuacaggaguucugcauuugguugaaaacuguacuuuucguuaagagggcacuuaggcucgugaucgauuuugaaccacauucuaaagguuuccacuuccuggcgagugagaaguagguacaaaggccuaaacuaaaccacucccuuucuggaaaagcuggcugcugacacuaccccuacucugcccauuuccggaugaagaaaucccuuuuacccgccuccgcugugcuuaccucgaaacuguguuugacgaaagauuuggaguagaaaaaacgaugaaacaacaccugccccguugccaucgccaccugcagacaagagaggagaacggaagcgcaggggucaggcgggcccgcuccaggcgccgccgccauuuugugccgccgaucgcuucccuuuccccucccgccgccgccgccgcugcgaacagcccgcugccaaguccucccuccgccuccgcagccccccgccccggcacgccccggccgcggcugggccccgaacgggaaagccugaaggaaccguccccacccucccggggcacggugauacugagaugcggcguaggggacggaggagaggagaggagcgcccggccggcccggggccggagcacugaccugcggcagccggaggagaaugccggcggccuggaugagcucgcagcccaggaugcguaaguccgucucacugggcaggucgagcccauccugcauggauggggugggcgagagccucuccuccggaaucagagaguggucgaugguaagugaaacuuccgaguacaggcgaucgccgaucaggaucccucccgucguggucgucgucguggucgucgucccggagcuggagccgcccgcgcuuggggcggccgaugaggcggcugcggcagcaguagcugucgaaugaggcccggacgccauagucuuagcgagccgcacgcaagcccaacgcagccggaacccgaaacaagacuaaccagcguucucggcgcgacggauauucccgugaccgccggguucugggccgcuucacgccgcgugcgcuucc

SEQ ID NO: 13641 - RNA, 6238 nt, Homo sapiens
acagcagcuuccggagucggaaggagcugaggaagaagacugacugaaggagcuugcgacuuuuccgccucggcaaccggacccagcagcaagcaggacgggcggcgcucugcuacuggucccguuaagccagaguagcccaagcccugaagucacugcucauccggaauggaaaucccgccgaccaacuacccagccuccagggcggccuugguggcacagaacuacaucaacuaccagcaggggaccccgcacaggguguuugaggugcagaaggucaaacaagccagcauggaggugaguuuagcagggggugguggacagcagaggcuucaggauugcgcucccuccacucacccgcggucucagccuuugggugcagacacuccgugccacccccuacccaccuucuguuuuaggacacacugcugguaucuggucuugagauauuaagguuucugggggaaugucuauacuccagucucuggagacagcccgggacuguuuucaccuuaaggcagagacaaaguuuuuacgcacacaguuacaagaaaacgggaacacgcucuagguaaggggcagcacuuuccuuaaguguaaacuguagaaaccauucaaaagacuacuaaggcugccacguuucucaucugcuacucugaucuggaccaacaaaagcucccaucuuccaagacucuauugccuacauuuuaagacaaauccuuaucagacccuuugaccaaaaugaagggggaaacaaacagcaagagaaacugacaaucaaagucaaagaauaaaagcacugugggcugacgcuggccuuuagccacccaaacaccgcuaccacaugacugccuuaaaugaugugcacccucugcuaaaggcuugaauuaaauguuuaaggccucagcaaucacuaacgagguuuguuuucauuuuacgaaaaucuacuggauuugagauuaucccuuauuuaucugacagaauuuuaacugcuaacagucuuuuagaggugacacaguagaucuuauuuugaaacuguaccagauaacagaauuagguauaaauuuucaaucuguaucuugauuuaaaagugaaauaccauuucuuagucuuauauaauuuguuaaucauuuugcaguuucacuaauguauaaguaaaaacaauacuuaauuguauuaagucuccaauugcuuugcaguaaucugccucaaaaugaaauucacauucauugaacauuauuuggaggguacacugagcuuuaugaaaaaaucuuuucaaaggugauauugucaucuuuagaauuaaacgcuguuucaaacuuucuuauguagagacuuuaagaucacagauccagggguuaaauaaagucuuuugaugauugaaagugaauugugcccaauuuguaugcuuuuauccuacucuuuuguuuucauccaaaauaaacuugauaggggacuugcuaaauuagauguuacauucauggugacaugccuuuuucaagaccuaaggcuuucaccauuccccuucagccagccccuccaaccaaaugagaugcauacuucuaacaaugcaaguauaauguuguuauaauauuuucuugucuccacuacauuuucuuaauuuuaggauauuccaggaagaggacauaaguaucaccuuaaauuugcuguugaagaaauuauacaaaaaguaaguuaaauuucuuuuuucuuugagacagggucucacucuaucacccaggcugaagugcaguggcagaacauggcucacugcagccucaacuucccgggcucaggccaucuucccaccucagccuccccaaauagcugggaccacaggugcaugccacuacaccuggcuaauuuuugugauccuccugccucugccucccaaagugcuaggauuacaagcaugagcuaccaagcccagccaaaauguucuuauuaaacaaauuuaauucuaaauauuccagaucaucuuugcugaucaaaucuguaagauugauuaguuuuaccucuuuuuaaaaaguuguugugaaauaccugccucugaaaaacacugaccauaugggcaaaguuuacaaggaucaguucuuuacuaucuuuggguauuccuagguauaugaauuauuucuaccaaacuacacaaaaaaagacuauacacuucaguucaaaugaauuucuuaagaaguuacauacucuuagggcagucugaacuuaugccuaauauaaaugagugaaguaauuuauuccccaaucaaucaucuucuuaacgucugcuuuucucauucuauuuuucacuggguuuuuagagaaagaacgugcucuuagauauucagaagcaauagaaugccagcugauaccaccauucagaugaagaucuuucaguaauggggaagggaaauuuuaaagauuauacacaacugucaaauuauuaaugagacaaacuuaaaagaaaggaacugcaaucuguaccacagccaucuugaaauuuuaaaaagcuugccuuucuguugagcauaauucauaaagagauucauuaaaaggcaucugagcugcuagacagccaucuuuacaaagcauaacccaaugccauaaucuucuaauuuuauauccagacacagacugcugcaucugcauuucaaaaacuuuguuauuucaggagcaaagaguaagaguaauggaaaaacuuuaaaaguaaccagucuugaguugguauauaaagucagauuaaaaucuggccuugcaaauggacaccccauuaauacugaaauauacugaaaguuuuaagacuagaauucauaagauuaugacaccauaucauuuauaaaguaaguuaucuauuuuaggguauucacaugauaagucuagaauuuaauaggccaggcccaauuagauaccucugaaaacaagcacuuugaagucuagucuaaaacaacaccauuaggagccuaugcuuuaaaucauaucucaaagaugauaauuaauaaugaauagccuucuguauauaaggauauuuugcuaaauuucaaacagcaaguuaaggugaacugcacagcugaaguacuuuacccuucaacgggacaagaaacugcaccagaagucaacuucacauuugaaggagaaacuggaaagaauccagaugaagaagacaacacauuuuaucaaagacuuaaguccaugaaggaaccgcuagaagcacaaaauauuccagguauauaaauauggcaugaaaaccauuuguuugauucaaacuuaaaaucaaucucaauuaucugugcuuaaaauuguuaguugcuaaguauguuagaaacuuacaggcuuuugcaaaaauacucauuucuaauccaauccaacaaaaaagaggccucagaaauuuuauagauccauagcuuaauuaaauuauuuuuugcacaacauucgaaggaaacuaagacaugauuuagaauuuagauuuuguuuuaaaagguuaauacuauauauaugauuaucauauaaaugugucuccuaccagacaauuuuggaaauguaucuccagaaaugacgcucguucuacauuuagccuggguugccugugguuauauaauauggcaaaauucuacugaagacacaugguauaaaaugguaaaaauucaaacugucaagcaagugguaaguaguuucuauaaaauacacuauuaaugggguuaauauuuaucgaaaguauuguaauucauaauuggauuaacaguauuccuauagucauuuuguauuuaauagcaaaccugggauuucaaaggggaggucagguacaaucaagauuagagaaggugaagaauuguaggaagaguccaaagcaacaguaacuggucuaaaaaguuguuugauuuggcugagagaugcaaaccacaggccuccuuugccucaaacuugccuaauaacugugcuuuguuaguugcaugcucugggaacauagagacuaggaagcauaacaaaagcaaggcaaagccaaggauuucagugaaacacuuccuguuaauacacaguaucuagacugcacuuucaaaaagcaucacgguaaucauagcucuuaaucuuucggguuagucaagucagauuuaacuaugauacuuuccucaaacccucuucuagaacaaaaagguugagagaguuuuauuaguagcagcaagacagaaucccagguguacaauauacagucaggccucuccauggguucugcaucuauggauacaaacaaccgagaaucaaaaauauuugggggaaaaaaauggaugguagcaucuguacugaacaugcacagauuuuuuucucgucaugauucccuaaguaauauaacaacuauuuauauaacauuuagauuguauuugguauuauaaguaaucuagagaugauuuaaaguauaugagaagguaugcauagguuauacgcaaauacuacacuguuuuaugucagagacuugggcauccgugcauuuugguaucugaggggaaucuuggaaccaauccuccauggauacuaagggacaauuguaaugacucuccucaccuuuaaucugcucuauagagauccucagggccacuuuuuauggcagucacaagcaaagcugugcuuucagaagagugaagucuugaguuauaauccaacauuuagcuuuugugcucagcuuaauacagauuauuucccuuagcaaucuaaguuuuguguucaaauuacuauagucaugccauacugaaacuaucuguuuuuucccucuacuguacaguacagaaaaaagcuuuaauuacacaaucacacaacuacacucacuacauuuuacuauucucagguguucugguuuuuuuguuuguuugccuguuuuugagacaggguuucacucuguugcccaggcuggagugcauuagugugaucauggcucgcugcagccucaaucucccaggcucaggcgguccucccaccucagccucccagguggcugggaguacaggcacacacaggcaugccuggcuaauuuuuuguuuauucucauagagacaugguuucacuguguugcccagacuggucuugaacuccuaggcucaggcaaguugccuaccucagccccgcaaagugcucggauuauaggugugagccacugugcucggccuuauuuucaguuuucaaaaagagaauuucuguuauaaaauuggauucuuucaauguaaacacccauugcuauagcuuaucccauaaauuaugcuuuucuguacaauggaaacacagagcauucuuaaauaacaagcuacacuugcuaauucucuuaaguagccaccacaacuuggaaacuaaaaacagguaaacauuucuuggggaacaaauauaagaucaugauuuuaaaaugcaucuugaaagaacacuuuauuuaguguaagagaauagauuuugucacauuaaauugaaauuaugacauucaauuuuuauuuuuaccuaaauggaaauauuauauucaucuaaucaaagaugauuuucaaaauuaaauguaauuuuugccaaagauauuaaguuuuaaacaacacguuuuuauuuuuugucauagcaaagaaaugaugacuuuauugaauuagacuacaccauucuacuucauaauauagcaucucagguaaaguauaauuuaccuuuauuugaugccauucugaaaacugagacuccuuguauagccacaguaugcuuuauuaauuuugacucuaaaucagaauucauguaaauccagauaggcaccagauuuaaguauauuauaauugcagcaauuuaacaaaaguacuauucuuugugaagacuguuuuaucucuaacaaaacauaaacccaacuacguuuuccuaaauguuuucugaauuuuaucauggcauuaauuuucuucacuugcaggagauuauucccuggcaaaugcaaguucucuggcauccacaauacggcacuaaaguaaaacauaauagccgucugccaaaggaaguacaacuggaauaaacaaaaacccuaacacuggaaguguaaacaugucuauugauguguaugccaauuucacuggcaucuagcuuaugaggccaaauaaucccaaagugucacuuuauauaaaugucuugauuacaguauagaacuuuauagaguccauaauacaaaguaucacuacauaaaaaugucuuuaaaacaguaauagugguauguauauccaaaauaaaaagcuucaauuucagccucauaaug

SEQ ID NO: 13642 - RNA, 501 nt, Homo sapiens
uuuuuuuuuccacuagaaaaaaaacacagagcucuauuauucucaacaccaauggcagcggucuucauaggccagcggagugaguucugucgacagauagguggccccuacuugcuggcgaugaguggguuccgcaggaccacgaugaccaaguccccgugcaggaacauccuggagauauagcagucuuuguugacuggcuuggacuucuugcccuugccgcucuuggguaccucaguccacgucuccuucacguucuccagcaccauguugcagugccuguggaaggccuucacguggcccaggaguuucguguuguggcgacaguugaugagcacuugcguguuguucuugacugacugugugagcacagaaaguggacccguguuaaauuccuccuccucucgcuucugcagcuccucuggggucaucucacucuuggacuuguuaaggaggcucaugauggucacuacgcucucgguucauucccguuuccuccgc

SEQ ID NO: 13643 - RNA, 775 nt, Homo sapiens
uuuugccccagguuaaggggcauugucuuaaaucuccucauuuucuguuuaucccauuauuucauuaucagcccuagcagaggacucuccuuuauaaaauucacuuuacaagaguucuuauguaaacauuaaugaguagagacuaauaaaacaaaguagggauguggaugccguagcauggauggggucauugcugagaugagugacugucuucugcauuguagacaagggcaagucaaauuuguauccagcaaaaucacugucaggggccuucaguucacuauaauaguugaaacucugagcacuaaaucugcgaauaucuaaccaagucuaucaucuuuuauaccuuuaaaccuaguagaaaacucuuagaggucugugauucuauuugaagaucaccuuacuggguccaguggauacuaaaaaugacgaugacaaggacaugcuugucuggaggguugguuucacagugcuuugagcuuucucuauagcaccugaggguaaguaaaaagucuaaggggagaauuucuaauggaguucucucucucugacuguuuuaucugcagacugcagcugaauauguaaaaucucgacucccagaggcccuuaaacagcaucuucaggacuacgagaaagacaaagaaaauaguguauuaucuuaccagaccauccuugaacagcagauuuugucaauugaccgagaaaugcuagaaaaauugacuguauccuaugaugaagcagguauguuuguuuuuaaaacacacauuuuuuuucc

SEQ ID NO: 13644 - RNA, 1524 nt, Homo sapiens
aaguagauuuuggaauaagagguucuaagcuaucauucauggauccucauuaagauaguuuagaccuuuuauuguauuagcauguauuaauacuaagcaaaauccagaguaacaaguaaggugugguuuauauuugaucuauuaauguuuuuauuuaauugaaguacaaguuuucguacacuucaguagauuggguuuaacacagagaaguuuucaaggaaagcaauggcauaauuugagaugaagagaucaaaauagcauuuuacacuguccaaagcaucaucaaccuaaauauuuauuaugugucauagugggcaaaagucaaaggguuaaaauaccaagagagggaaucuuuccucauauuuauuuuuaugcuggaguauuauuuauguuucuguagcuaaucucaaauucuguuuuuaauuauuuuugaguuugggcaugaauaaauauucccuacauauuccuuuguuaaggauaugguuuguaaugccauguguuugagggaauuaugaggagaguaggcccauuuauuugagagugauauuuucugucacaggcucaagaacccuaagccaugggagcggaagucuggaaacaggagugaagagcugcauauuuuucccuuugggaaaagcugaguacaccugcaauggguagaaugcucaaugguagcaucuuguugcaggccucaagauaguugccuaagcugcugcuuagaucuccuucucagaguucucagaccagcaagggcuuucuguucuuacaguuuggcuagaaaccuauacagccuuccaaugagcacaugcuucugcaauguggaaaaugcacuuacgcguagaaagugaaccagauggugcacaugagggaagaagagagcucagcuggcuguuucuuguguuccuuuggguaucagaguugggagccugcauauucauuuauaagugucaggcagucacauacagcuuucccagaggaggugagaaaggaggagcagcauuaauuucucagcuuuugcuuuaugauucccugauguagcucuaccugcaggugaaagcuaccuguggugaagacacaccaagcacuauaauuuuuggaaaaauagcuuuuuaaaagcguggaggaaugugcucuaagcagcuuaggaaguagcuggaggguuaccuccuauugagcugauuuuauucuucuuaaaauagauggugccugaaaguuacaucuacauuuuaauugggacauuagugucauaguaaucaguaaucucaaaagaaaggccauuuacugucaugggggaaaaaauugaacauacauccagcaaccaaacccaggaaagaguguguugaauuauuuagggacuuuccagguuuucuaagaacauaaaaaaucuaguaaaaggcauuugcaggaaguucuucacuccaacaaauagagugaauuucucaguauauuucucaaacagcuccuaagggaagaggugacacuaagguuuccuuacuuuauaucuucaaucaggaccccauuucu

SEQ ID NO: 13645 - RNA, 629 nt, Homo sapiens
uuuauuugcccuuccgggccuugauuuuccuaagauagaacuccaacucuuugcccucuagcacauacccaucugcucagccacacuguccuggccuugaagcaaugcaugcaagaagcuugcccugcuggaacugcucccccaggagacugcugauuuuggcauucuuuuuccuuucaugauauuucuucugaauuuuuuuagaucgcuuuuuguucaaaaucucuucuuccucaggagucagcuuggcucccuucuugcagcccaggggcggcgcauagugggacucguaccacugucgguacagugugcugucaaugagcacaaugcaauucuucaccagggucuugggacgaaccagcucguuauuagaugcauuguagacaacaucgaugaucguuguuuuaugagcacaacauucugagccccaggagaaauuccucacguccagccucagggcacaguauuucuuguuaccuccccacacacggacuguguggaugcggcgggggccagucuugguguuggcagcugggugccccaacucauacuuccgcuucuugugguagggcuuucucuugucccugguuuuguggcacuugugccaguugucccaagagauguccauc

SEQ ID NO: 13646 - RNA, 51697 nt, Homo sapiens
ugcacgacuccggcugggcaggauuccggacaacgccugguuccucuuggguccuuccggcgucgccggagugaauugauccgggaguugaagagggcugcaaggugggaagugaagucagugccucaguugcugguaagguguagcuguucugucccaguccccguagcucugcaccgagcagaagaggucuagggucacgcaggggccauggcugaggcacuugggcuugguucuggcaggcggagcggacggggcugagagcggggcccuacgggcguaagcgagguuacccuacgcgaguggcguaaagcggguuuguaaaugccgccugccggcuugggcccgaacgccuccaggaagucuccucuaggugggggcgggaggggaagggcgagguuggccccuggugccccgggagaggggacagggcggaugugccuggggugggguccuuugaagguguggcuucggaccgagaggugaggcugcuguuuucccccugcuuuguaaguaagagaaaagggaggaggaaggaaagggugcuugggagucggcucuugggggugacucggguuaugcccuuugagggaagaggagcacuggaagaaggaagagacaaauguuggggucuacggauucaguuccaguuuaaugauguggcccucuaaggagauaauuuugccuuaaacagaaagacuugacccucuuaggugucauaccuaagguauguuuuuacuccuuuacugcuuucagagcgcuuucauuuugggaugcugaugaggaaaccgagggauuauaugacgugcccaaggucacacacguagggacagacuuucugaaucuaguucgguucgaguccagcuuuagaguagggacguugguugugcuuuuugaaaaggguggaggaaguuacaaaguaaauguauuuuauauaguauaucuaagaagccauugugagauaaaaaguuguuucuugaaccggagugaaauuccucaauaaaggaaagauccuuuuggaaaaaauaaaaauggccaguuucaacuuuuacagauuuuuccccuuuuuuuagggguguauuaaaugauagacucuacucucacaguucauuuuuacggguagguaauaggaugggagaacaacaguuaaacaauauaucccauccuuagaagaauauucuuuucuuuuucuaccuuaggacuguuuuuacucucauuuuguaaaacugauaauagugggauuggaauucuuucacaaaacuacacuuuuuucaaauaauguagcguuaggagaguuuagugugcccauuacuagaaaagaagguauuuugcauuucuuggagguaacaucgucuuuuuugagacuuuacuuuucccccauuuucuugacucugggcuguauuugugugugugucugcaaauaauaaaauugggcucuugcauauuuuuauuuuucuuagcaucaacugugacuuucaauucauucuuacuuuacauugaagaaugaaaaaacaguacacguauaguucauaucuugcagaaaguagugccuuuaugcaagucuuauccucuauaaugauuaugaccaguuauagcucaugacuauuauuauuggauaaguuuuuaauagaauuguuagaguauguucauugauggcagaauuuauuugugauaacuuuauauccauacagguuagcauguaauaaaucauggcuuacucuuaacauguaauaaaucauagcuuacuguuuuauauauaaguugaucaucagacuaugcugaauuuugaauguacucugcaguuacuauauuaucaacaaugugcuucacuuuuuaauggaaaaacauuuuuucggaacagagguauuaucuucccugaugguugaaauuaagauggucuggaaauuaauacgauuuuuaaaauagaaaaaguaugauacuauagaaugaaguaaaaucaggaauaauguaccauaaguaauguaguacacagacaaggaagacccaguuaaacaaauggaaaauuauguggugauaacugacuuugugcuggauuaagaaaggugcagugauguaaguagaccguaaacugaacaugagucagugaugguaaagcaagaauauuaaucuguuuucuagaugacaauguagguauuugccuuuuguugaaggagguaugaaauaaguucuaaccuuuggcauguaacucugucauuauggaaagagcuuuugaacuaugaggaaauuuuggaaauuaguuaauguaaugcauuuguucaguguguuuuagauuuuguucuugguucauuucugccacuacucuuuaucucugaggccaauuauaguuuugauauuucuucuauucggaugguggauuaauguuuguauuguuguuaucaucuuucagucacaugcugcgguacuguugucacuuuagaucucugcacguuggauaauuaggaguucacagaguuauguguacacgugguuugcagcucaccagugucugcauuucuucucauuuugaacuuugcaggagccuuaugucagcuuuuggacauuauuucuuagaggacuugggaugucuuccguauauuauacaucugucuguuucucuuaaggauguaaggucuguaagaauaggggcuguuuauuauuguagucugaguagguaagauaauauuuacaaagagaaugaagaggcucaaguugguuaagugacuuguaacuggugggaguaagacaaaaucgagaucuucugacuacagaucuuuaauauuuuggaguaaagacuuaguucccuuagauuauuuacaugagaagaagacuuaacgugacuuaaauauucaaauacuauuaccuucuuacucuguuuaacacuaaaaauuuaucucuucuccuauccagcucuccguccuuaucuccagccuuucucauuuaccaugccuuucaguuacuacauacauaagcugcuuccugacuugguggccuuuacauauuccgucucacuccuuggacuguuccccucacgccuaccuaaauguggccaccugguagucaguuuucacgucucaauuuaaauaucguucgucaggggagccuugcccgccuucccaaaaucagaauagguuuccgccauguauucaccauacucuguacuccuuuguggcaucaucauaauagaaacuuaauuauuucuguauuuauuugacaaauacugucuccucacuggacuauaagcucccugagcagggcccucucauuugucauguuuuaccccacuacuuacgcaguaccuggcacauuguaaggguucaguaaauauuugcugaaugaaugaaggaguguauucaugcacagugcuuccagcacuucucuggggacagaaauagagaaaugaauaaagcggauaugcuuucuggauugaaguauauaagaacuuucaaaugagccauaaugcuuaggcaauuuagguuauauguaaaggagucauugacagaauuuuaauauaaauuguggaaaaauguuuguucuuuuuggaggucucugaaaucaggauuaauuuucuaaguggaaaugauaaaggaaucacuuucauuugccgcagaauugcuguguaacacagcauuuuagagacuuaucacuguccugcuuuuugcaagcgauauucauuauaacaaaauauagacauggaagaaacuucuaauggacucuucuucccuaauguugucucguuuugcccuaaaaaccuuuauuuccucuagguaguaguauuaauacuguuuuauagcugaagacaucaagaaaauaaguaaauuuacuuauuaaacuaaaaaaaguuuaauuaaauugcuagaguuuccagaacguugguacuggaaccaugguuagaaucuggaucuaucuccguauucuagaauccauaauuuuuucuuuuucuuugcuuuuuuguuuuguuucuugcuuuuuaaccuugcuaucuuccuaugaauuauaccuuuaauaucacuugauuuagacaagguggcuuuguaaaauugaguaguuuuuguuucaaaggaacuuauauuuuggguuuccugaaaauuuuucuaauacuuuucuaaucuuauuugcuuuauagcuggagacuuaagcauaaaaagauuauuuuuaaaacauacaaacugaauuuuagggauaaauuguguuagguuuuggucuuggaaacaaguucugcagucauuuguaguaccacgguauggcauagaguaaggucaacagcccugaguuucuguagccuuguaugccuucauggauuuaccaguuuacucuuccacaagaucuugucaaaaagagauugcugauaauuuggcuuuaaaauuugguaauacuauccauuuuauuauuaaaaacaagucuuugcuaaauccuaaacuuacuuuuuaaaaagucaguguugauguuacuugaaucuuggauaaaauuuucauauuuaccuagcauaaccaguauguggaggauaaaacugaaauacugcuuuuuauauguuguuggauaauuaauaucauuaugauagguguuacuaagaauuuuaagccacuuacaugauaaguaauuuuuuccauaauauaaacuguaaaagugauuuagaaguuaaaugucauuguuaucuauguuauugcauuugaaauauuauaguaagcugcaguguuagaggguuaugcuuuagggacacacacacacacacaaugcaaaaaaugaaagcacauuuauuauagcaauuagaaauaauuuaugugcugaaagauaaacacugugguuugaugguucauuuuugucuguaugaagaugguaauuucaauuuugucauuuaagcuacaaaauuuaaaugugucuuaaguguauuauauuacacuuauuuuucaagcucacccuuacauuuuugguuauguauaaccauuuuuaaaaucacccaaaagugauuuucugcuguucaguuucauucuuauacaguugauagaauccagguugccuauaggguuaaaagaaaaagaaaagaauuuuauuaacaagcuuaugaacuauuggguaacagcaguggaacauguuaagugguagucacuaacauauacuuaggcuggucccuugggaauaaguuuaccagagguuagucuaaauaaugacuuuuugauucauuuacuuauugaaugcauauuacuugugaaauugccuuaaaccuucuuuggaaugaacuggaaccuaauauaauagcuagcauuuauugaguauuaaguaacuaagugccaagucucaugcuaauaagcauuuuacaggaucucuuauaauccuuacgacaacccuucgagguagaggcacuauuaucuccaguuuuuaaaugaggaaacuaaaguacagagagguuaaggaacuugccuacgguugcaggaaaaauugcuuggaauuaggauuugaauccaggcuggcugacucaagagaccauguuuuucaucauuauaguaaaaaugauguuagugauugaacugcauuggagagagaaauuagcauuaagaguuguaguuacagagcaguuaugucuuaaaugcuaaggucaguguggcaggcagaaauuacuuaauauucaaacuuuuuaaaaaaccuauuaggaaauacacguuguagacuaacaacuucaacacagccaguuuuuuucuagcauuggaguagauuucuuuugaguaccaggugaaguguuugacuuguuaugcagagaccauauugaaaaaagaaauauguauauuauaauacaagagucacaaucaguguggcaagcuacucuuugugagagcucacuguggcucucagucugguguggggaguggcagauccacguuucuuaucugucucauucugggacuuuugcauagggaauggaauuaucacauacugcaguaguuauuuuuagugaaguuauuuuuuuguuuguuuucuucaaacaaauguucaccaugucuguugaacuugcauaggguaggaguaucaugugaagcagguacgcucccuggaguguuaaugccaaguggcagugugacaugucacuguauuucuuuacugucucucuucccugccaagacuacauaccuucaaggguaugugcuguuugacuuuucaucaccauaucuccaacuaacacuguugcugacuuagacugacuaugcagaauacuguguuggauacuaggaaauagagaaauggauacaacuucucuuuagggaguuuauacuucaguagauacaaggggaaaggguugaaagaccauuguauggacauuuagucuuucuaauauacuaaguacuuccaugugcaucaguucauuuuacaauuuuagguuagagcugauagaaaaauaaaugauuguuucucuaacugccaucuggucccuggcacugaaaugggucucccugucuuauucagucauucucucuuacuucaagauagacuggaauucaacugagauugaaguuauggaaugacaaaacccuaagauguuacacaccggcugccuccucagacuuauauaagguuacuacaacagaagccaguugggaauguuaaaugagucagaccuggccucuagacagcaacugcacccuauacgaguuuagauuguugcuaggcuuuuuuucauuuaauuccaaagcauuuggaauccuuuuuuuuuuuuuauugagaacugcacaucuuucucuaugucuuuauccauauuaaaaucgguauuuaugcaguacugucaaaauuugagagauuuccaagguucuaccuuauuuuugguaugcucccuuaaaaaauaaaucacacuuuugcgaagugaagguuacaggaggaacaguagaugcaguaaaaacagauacuauccuagcccuaauuucuucuuguaagaaauaguauuuguauuugagaucaauugggagcuaaagguaaaguuaaaugucaucaucaagauagaaccuuggccucauuagcaccuaauguuaaauaaggcagaggcuauuuauugucuggggcuaauaguuucugucaacauuugagugcccuguggcaguguuuuuggugcaaagaaauuguguaaaguaaugaaaguaccuguugcauguuuuagaggaucuuaagccauuaggagucauuaaguuaaauucuagguaucuaagauuauaagugauacaaagcaaguagcucugauccagggugguacagauucuuuuaauuguaccuuuaagcagagaggaccuaacacucugaggaauuaaguuuaguugaauuucuaagggauuuuaaaggaaagcuuuaauuaacaucguauuggagaaacuaagacaaggaauaauacuaauaaaaaggaaaauagacauguaccucaauuaaacaccaaacaacuauucaacuaggcauuauucaugaaccauuagguugagaacuuuaugggcaaaagaugaacauauucaaggggacagauuuguuuccugucuuccaacaaguguuuucauuuaaauuuuacucagaucagaauuuaccaaaaauuuagacauaggaaaaaaaaaugaggauugucacaacuaaagagauguauguuuuucccccugaacaaguugcuuugaaauaucguaggagccaauuguuacuauuuuguuacuguuuccauuucccaucagcuaauucugagguaaugagcucuuuaauuuuguugucaacuuuugauuaucuuguacagauuauaaaccuuuuaugaauuaucucaagggcuuugaucacaucuugauuucagugugcaacccagccugcuacccagccugcuucugggccaugguuuccuuuguuaaguuuaucuauguacauuuagaaaaguaauuuuaacauugguuuggcaaaaaguuuuaaaaugcaccugauggccaaauucuuuuauguaagccaaaacuaaguguauuuaugcauccauuuuggcaaaugggagauaaaagguuuugaaaauaugcuauguagguggccuuuaugacauugugauaucaguguuugacucucauuguguauguuaugcaggggcaggacuagggugaggcaagagauaugccuaggguacaaacuuugaagaagcacuaacucucucagucaugcaaaucagagcaaaauuuuguguucuaggcaucugguuugccucacccuaguugcaaucgauuccaugucagguuccuagaauuuuggcuaaaauauuaauaacaauaugaauagaaugguuauuauguguuagccacuguaguaacuauuuuauaugcaguuaguacucuuaaucuggggaagugaguacuucaguauuucuguuucucacuaguuuagaaauagagauuuacaaaacugaaaugauagcauccagcugagcaaaaauucaaacugagguuuuuuuccuuccaaacugagcacuaucuccugcuguauacugucuaucuauguguagaaaaaguuacuucuuacccauuuuauaaauuucuguauuaagaaacaguacucuggccaggcacaguggcucacgccuguaaucccagcacuuugggaggcugaggcggguggaucaccugaggucaggaguuugaaaccaaacugaccaacauggugaaacccccaucucuacuaaaaauacaaaauagccaggcgugguggcaggugccuauaaucccaguacucgagaggcugaggaaggggaaucgcuugaaccuggguggagguacgccacugcaccccagccugggugacagagugaaacucugucucaaaaaaaaaaaaaaaaaaaaaaaacaguacucuacaaaauauguaagugcauacacuugacauggugcaguuaacuuuuaagaugagcuggaagucucagcagcaccaaguugaagauccacaagcuugugcugcuaaguacccuagaguugucagacauauuaaagaagaaaccaaaggauagagaggugaaaugacuuguucagagacaaagauaguuuaugaaugacaggaccagaauuugagcccaugcuuugagacuuuaaaugcuuaugcuuuuucccuguaucuuucugcacaaauuguccauuuaauauuuuuaaagcauauauauauauauauauauauauauauauauauauauauauauauauaaacgauacaaugguaaagugcuauauacacuuaccauuaacaagagauugcuucuagaugucccuaaguguaaaauucuguaaguacuaaacugacaguaguguauguucagggagguuagguuccacuuaacuuuauuaagaaaacuggaaauggaagacauugaauuauagaagauguaauuugcaagucaaggagagagauguagguauauccuuaagacaucaagcucauuuuacucuaaguaggaucacugacuuacccuauuccucugccucccuuuuuccuagcuuucuccucuaaaucuuggucucuuguuuggaagugacuaacagcauuuuggcaugagaaagcccuaaaaagguacguaaacugugucagcaaauguuaaccccaccccgcuuuguuaaauggccagacuaccaucuauacagucuuuguaaaaauccauuuucucuaagaguuugaugagugauuuuuuuuuuuuuuuuuuuuuuuuucuuuuuugagacagagucucgcucuguugcccaggcuggagugcaguggcacgaucucgacucacugcaacuuccgccuuccagguccaagcaauucccuugccucagccuccugaguagcugggacuacagaagcccaccaccgcaucuggcuaguuuauguauuuuuaguagagaugggguuucaccauauuagccaggcuggucuugaacuccugaccucaagugauccaccugccuuggccucccaaagugcugggauuacaggcaugagccaccgugcccagcugaugaguaugauucucuguguuauauuauugagagaaagcaaggaauugucaguuaauugaaauccuggguuaaccaacucuuggggaggaccuccuuaauuagaauuuguaaauaauuuuuaaugauuugaugcuuaaagaaaaauuugucuuaaagaaauuccuauuagauuacuuuggaaaguauagcugauaacaauaaugaagucuuauuaucacugaauuuugguuccagugauaauguggcuggguccaggcuuuguuaauagaauuaauuugauuuuuguguuuguuuuuauuuugcuaggcaugcuauuugaaaaguauauuagcaagacugauucaauuuauaaauugcccaucucaacucaugaauuuggucauucagcaaacauuaagugucuguuaugugcccgcuaugcugacuguaaugucucuauugggaagaagaaacacacuuauaaaugggaacauaaacacaggauucugcucacugcuagaaugaacacacuucucuuaacugaauguucaugcacauuuguuggagauccagcauacaucagucagucaaucaaucuuucccuuuuuagagagagaaauuauaggaauuauaagaauuuagggccaagagggcugaguacuggauuuuacuagagagaaaagcaagacaaaaagaccugccugccuacaaacguuuuaaguguagaauuacuuaaaaagcuguuuuucuaacugagaagugccuauaccaguaccaagagcuucuguuguuccucuccuuucauuugauaguaaauagcuuuggcucuagacuuaucucaagucccagauggaguaaaguaaggcaguuucaggaaauacugauucugagcccugagauauacccauguguggcucuuuaaaugagcagacucgaguugguuagggagggcagaaacaccaaagauuuaagaguuuggcagcggaguggcgaauaccuguuuuugggcuucuuacucuaagcaagugauaauuaucuucagcucaggaagauauuuaaagcugauuaucuucuguuaaaaauuagcagugcuauuuugaauauucaagaaaaugagggguaaauuauaagugagaagauugcuuauacucuguguugauaucccaauaucacaauggguguuuuugaagaaaaguguguuuaaaaguaugccuuuugucuagguucuuucaacauuucuuguucuugguuuuuauuuuguggaugccaacaguacacaaagcuuacuuugaacugaagauuucccugcaaagcagcacauuugaaacgugagacguaaaguucuugcuauguuguuaucauaccaacauuacauuuuuauuauguauuuaauuauuagcuagauguugugaccaggagcaagucacuacauccuuuuuguacuucgguuucugcuguagguagugaaaugggugaaauaacuuuuuaaggccauuucagaugugggauuuguagucagugaucuucaguuuucuguaugugcauaaucagcaccuacuccagaaaauaguguaccuuagaggguugaaauuuuguuaaugugcuacccagcugccgggacuuggucacacucauccuaaaaggaaggcaccuugucaaagggggccucagaccucacucagcucagccaacccuugcuguuuccauagcaggcucuuuguugcaugggguaauugcagguugucccuugaacuauuucaaaugaagaagcaugcggaaggaaugacaaaggcauauuuuaacucgaaguugaaauugacaguaauucaauauuuuaaaagccguauuggaauuguugauuucuaaucucauguaaaugcuacugaaacugaguggccccaguuguuaauguguguucuaaaaaguucaguuuuaaauugguucuuuggagcauuuuucauaagaacaguauuaaaagauggcauguaugccauaggccagccacuuauguagcccaugauguugccaaaauacuguucuuuuuguugacaaauaaguacuguaaaguuaguuuuagagaagagacuauuuauuaaacaugaguuuuaaaaauauuaaaugccaguauuuacaaaagguaaaaauuaaguauuugaguagguuuauaggggguagguagguagagaugucagcaguaauucugaaagugacucuggccacuuaccuuaucccuuuaccucuggcagccuguacaucugcaguuauaugcguauguguucaaaagagugaaacacaagaguaauuccauugugcuuacuuuucucauaaguauuucaccuccuuuauaccgagauucuugaaaacuuaccagcucacucucuuagccccugcagggauuucucaccccaguauauaaguacuccgcucuuugaagguuaccgcuuuaaccucaucaagaaaucaaauaauuuuuuaaaaguuacuuuccauacucaguagcacuuaaaacuuuuggcuaccuucuucuugaaacuuguuucgugaugcugguuuucuccaguucuccuguagcgauauagcagccugacuucucccuuuugugcgcaccacaguuguauguuuucugacuuuccuuuuauaaaacacguuuaauggggucagagacugucuugucuuguucacugcucuauauuuaauaccgugccucuuugugaccauugaaauauuuauuaaauaaauaauuuuuuuucugucacacaaugagagcucuucaaggucuguucuugguuuuguuuugccauuucuuacuugauuuuucauugaugauaccaugccuucugcugcugucuauauucugcauucauucuguccuuuucauuuuaacugauaccacugccuuuuagccauccuccuuuuccccagguuuuuuuuauuaugaaguuuucccaauuuauuuugaaguggaaaagcagauuaccaagugacuuaaguagcuaaauaggaacagcagggccacaauugguauuuaucuacuucuuuuugcuuauuauuuuggucuuguuuauuucugacauagguauacugagucuguuaaguuuuccuugucguuauucuuccuccauucucuccaucaugcugugaccaaagccaucuacuuaacuaaguuacauaaucagguaaugguauucuuuuuccccauagaaugaaauucaggaauucgccuuuugcucuuuuuguucugucaagucauggaguagguuucaggugagaaacaggaaaacucuuugauguuuagaacugucagaaaugggacuaaacaguuuccguagguguugaguucccuuucacugguagcgauaugguggaauacuaagcagcuuuccaauggaacagguuauuggagcuuuuugaagcgucacugcaggccuuugauuguaucuuucagucuuguuaggucuuacacauucuggcacagauaaauuuuuaaugauuaggaacugcacuucauaccuagcaguguuaaacauacucugaacauguugagugaauaauaaauucuggguacuuuucuugaguagaugaggugggguucuuuauuuccacuucaaauuugguuuuguuaugugagaguauaagaucuguauucagaguccugggaucaagucuugggucucuaccugugugaucuugggcaaguuauuuauuaucucugagccugcuuuacacuuguaaaauuagaauugcaguuuuuuaaagcaaguuauuauaggacuaaaugcaugugcaaaauguuuuauacuaugaaaaugcuuuacaaguaguagaaauuaaucaaaaaauggcuuuuuguuuaauauauguaugucacuacuguuauucacuucaugauuaggaucauuuuuuuaaaccauaguaaaggaaauauauaguuguauucucuuuaaaaacuaacauauuuccuuaacaccucaaggcaaaauuucuuuuauuguugaauucuugauuuuaauccaaacuaccagccucuggguuuuucuucuuucucacuuuuuaugucagauuuggacaacaauuucuguaguucuucuaaauaccagaagguaucacuggcacaauuaaguagcaaguauuuuaccaaguggaucacauuugguagaauuuuuuucaauuuuauguuugacauauuuggugcuuguuauguuuguguuauuuucaggugacaaaaucaauaaacaaguagcaaaaagguuuuaauaaaaauguuaaaacacccuaguucuuucuucuuuauugauucuucgauuugguuuucugcacacacuuacacaucaugcauuuccugauuauaauuuuauauuauguauaaauauuauaaguaugugucuuauucauauguucucuuagauuguauaugguggcaugacauacaucauuauuccauggugcuucauagagagcucucugaguucagguuaagcagcgucuuaagucacugcuuugugaaguaguaccuaaccaaggacuuuaggaaagggcaguuguugagucuuuggaggaaaagguaaguuucuugccaacuagguuugcuuucacaaguagaauauauuaaaaaauagcuuuucauaaaauaggaacucuguaauuuggaaaggaaaauuauugguauuugucguuucuccuuaauauaguaagucucuguucuuucuuccucuuucaccagaucaguguguuuuuuguguccaauucuuuuaucaccaaaaaagagaagaaauauugcagugaaugaagauuccucugcauuuuagcacugcuuuuucaacuguaguuggcuuuugaaugaggaugacaauggaagagaugaagaaugaagcugagaccacauccaugguuucuaugccccucuaugcagucauguauccuguguuuaaugaggugaguuggguaaacauguucuugcaugaacucugcaauucuuuaauuccugcuuuauuuauucgucugcuuguucuuuuguauaacaaauacuagcaugaaugaacucuuaucggugcguuaggcauuguaucagggcaaaaaauagugaaaacaaagccaagcagauaugccucuucccucuagagauuaugcuauaaugggaaagagacauuuaauaaaagaacacaaauaauuauaugaaugaacaauggugaugaaguacuaugaaguguaaaagcagaguauguuaagaaagaaaauaggugggaccuacucuaggggucaggacaggccucacuuaagaagagacauauauccuaagaccugaaagagaucuaaaagagauaaauagaguuaauugaagaguuggagauaaguccauucuagguagccagaauagcaggcacaaagaucuuaauuauauugucaguggugacaaaacuuuuuaaaccgauauuuggaagauaucauugcuuuguaucuggagaagauguaguugcuuuuuaauuugaagaauugucuuagacuuaauauugauauauuuugggguuuucuuuuaaauuaauauuaacaugcuaagguauguagagaauucuggaacugaaauuuucuuagagauuauuuaauuccuuuucuauaauggggaacuaaggcccugauaugugaaauuauuuuccuaaaauuaccuauaacaaaucaaaucaagaucuccagacuucaaauucaauggcuucagccuuuuaaaauuuuaauauuuuuuugcuauuuuauuaaucuaauuugccuuuaguaccauuaaccuuauuguuacuguuauaguccauaugcucucaccauuuccaaugaauuuucaucucucuuuguaaaauacuuucauuaaaguaagauucugcauuucaaaaccauuuuuuuccacauuauuggauuugauuacaguuuuauucuauaaucuuaagucuuaggggcaguagagagugauccauuuacacucguugccaugaaagccacagauuuaguugccaaugcagucaacauuuuaaauuuucaaacacuaucucucaaguaauguuagguuugacaaccauagaagaauggacaaaaugguggcuuggauaaaaauuuauuucucugucacauaaaagauucugaagguaagugguccagggcuaguauuguuaugacucaguaugagaaacucaaguucuuaucuucugcucugucauccuaguguuuggcuuccauuaucaaucaaggucaccucagcauacaagauagcugcugaagagccacccaucacauccuaaguuguugccuggaaggggaaaaaguggggcagagaguggggucccgcaucuagcugaguuugcuuccuuaaaguagccuuuuugaaaggccuacacaagacuuccacuuaauuuuuuugucaagaacuuaauucuaaugacgaaaccuagccacaaagggguuggagaaauucaggaguguuaucaaggaagaagcaucuuuugaaaaaccuccuguuaaacugccaccaugguagcauuggagacacuuuuuaggucugguuaugucccucuuuggcagcuguagccaacaccaguaauuaauuucaccauuuuuuuucugauacuuacccauucauuucaaggagcuacuguuagaagcaaguggcuucaguucuguuuaguaaauacuuacugaaugccacccauugguuugcugaauacuucuguuagggucuagaggugugaaaaaggcugcaugcauguucuuaagaaucuauucggaaacacagauauuuaagcaaguaaauuuuuaaauuauucuugcccuagaaauuugauaaggagacagauccuauaagcuagugaguaaccuaucuugguaacaauuuaguuugaccuucucaguuacuccaggaaccauuaucacaauuccacccagagacacucuuucuuuucaugucuauauucugaauugauaaguuauugggcaaaguuguuuggaagaauuuucuuuauuuaucugguauuuugagcccuuacuugaauggagggaaauuuacauugcacaucuucaguuuaauccucuagugaaugaagagaaauuagaaaagguuuuuguucuaacaauuucaguggccuuuuucuugcauaauucucaaauugaauuuacugaucaaacauuaacagcauggugucaagcguuuaaaaaaauuauuucugucauguauucaaaggcauguucagaaguauaggguuuuagaaauagggaugguacuuauuaggguuuccucuuugauauggagaugaaauuuagggcuugaauugggaguggaguaaaauaauguuccuucaaauaugagguguuugguuaaaaaagaaugaaauacuaggauuauuauuugguguuuuaguuuguuaacauaacauauaaauaagauaccuaaucaauuaaacauuaguguuuauaguuuaccuaugaaauucucuauauaucuaauagggaaauuauauuuuaguuuggcuuuuucugugcugugcagauuuaaaggugaaagugguugucaaauuaaucugcaaaauuguaccauaguaaggaugaccguuuuacucugaagcuaaaugauucacuaaaucuugucuacaguguauuguaagaguuaaaaugauuauuccuucucaccuuaacguuagauccaugauagcuacaaugguagucuaguaaucaucuuuuaaaggauuucuagcuaguaggacauguuuacaccugaggaaauuuuaguacuguuacuacagcuugcaagccaaaguuauuuauggcauucuggaaguucgauguuugcuagacuuaauaaagcuaugccaggacagcugagaagaaguaggcuucuuguuuaaucagcugcuguggaguucagaguccaaguuuauugcauguguuguaaauguacugugaaauagguccccugauugcauuauggaauaauggauuucuggaaaccuaauuucaugucauaucagguucucacauaacuauuacuuuguagugauucuuuguauaucggggaggagagaauggugauucaguucuugauuccaggaaaaaauaaggcuuguguuuucuuuuccuaagaccauuuagaggaauuguuuucucaagcaauauauauuauguuuugaaaaauaaacaauuuugcaacuaaaugugaauuuuaggucaccaaagguuuauauguuuguuuacuaauaaauuacacaaaaguaugcuucuguguaaguaauuaauauguuuccauucagaagcaucugaaucagcuauuucugcgaauuauuagcagauauggaacucuuaauuuuuccuaguuagcaaaugaaaccuggaauaccucuccaacguuaccuaccuacuuuuuuuuuaagaagauaaaaucuuauuuuuauuauuuuuaaauuuuuuuaaauuuuugugggcacauaguagguguauguauuuauggaguacgugagauacuuugaaacaggcaugcaaugcguaauaaucacaucauggugaauggguuauccauccccucaaguauuuauccuuuauauaacaaaccauccaguuauacucuuuuaguuauuuuaaaauguauaauuuaguguugacuauuguaacccuguugugcuaucaauaguaggucuuauucguuauuccuauguuuuaguaccuauuaaccauccucacuucuucuccacccccacuauccuccucagccuuugguaaccauccaucucucuaucuccaugaguucaauuauuuuauuuucuagcuuccacaaguaaaugagaacuuuugaaguuugucuaucuguagcuggcuuauuucacuugacauaaugaccuugguuccagccauguuguuacagaugacaggaucucauucuuuuuauggccgaauaguucuccauuguguauguguaccacauuuuaucuguucaucuguugauggacacuuagguugcuucaaaaucuuggcuguugugaacaaugcugcagcaaacauggaaguguagaaaucucuucuacauacugauuuuccuucuuuuggcuauauacccagcauugggauugcugguaccagaggaucauaugguaccucuguuuuuaguuuuuugaggaaccuccaaacuguucuccauagugguuguacuaauuuacauuccagccaacacuauaccaggguuuuccuuucuccauauccuuaccagcauuuguuauuccuugucuuuugguuaaaagccauuuuaauugggaugaggugauaccacauuguaguuuugauuuucauuucucugauggucuaugauguugagcaccuuuucauaugcauguuugucauuuguaugucuucuuuugaggaaugucuacucagaucuuuagcccauuuuaaaauugcauuauuagauuuuuuuuuccuguacaguuguuugaguuguuuauagauggugguuauuaaucccuuguuagagugacaguuugcaauuuucucccauucuguggguugucucuucacuuugcugauuguuuccuuugucugcagagcuuuuuaacuugaugugcuauuuguccauguuuccuuugguugccugugcaugugggguauuauguaagaaauuuuuacccacacuauuguucuggagaguuuuguggauguuuuccuguaguaguuucauaguuugaugauugaguuuuaaaucuuugauccauuuugauuugauuuuuauauauggcaagagauagggauccacuuucauucuucuacauaggaauauccgguuuucugugcaccauuuauuaaagggacucuuuucuccaguauauguucuugggaccuuuguuguuauugaguucauuguaggcauaugcauuuguuucaggguucucuauucuguuccauuggucugguuuuuuuuuugccaguagauggcauuuuggcuacuauagcucuauagaauaguuugaagucaggcagugugacucuuccaguuucauucuuuuuggcuauucugggucuuuugugguucuguauaaaucuuaggauuguuuuuucuauuucugugaagaaugucauugguguuuugcuagggauuacauugaaucuguagauugcuuugaguacugugggcauuuuaacaauauugauucuuccaauccauuaacauagaauaucuuucccuuuuuuguguccaauugccuucgucaguguuuuauaguuuucauuguaaaggucuuuuaguuccuugguuaacuuaauuccuugguauuaaauuuuauuuguggcuacuguaaaugggauuacuuuuuuaaauguuuuuuucagauuuuucacugucggcauauagaaaugcugcugauuuuuauauguugauuucauauucugcuacuuuacuuaauuuaucuguucuaauaguuuccuuguggagucuuuagguuucuccaaauauaagaucauaucaucuacaaacaaggauaauuugacuucuucccuuuccaauuuggaugccuuuuauuucuuucucuuguauaguuugcucuagcuaggacuuccaguacuguguugaauaacggugacagugggcauccuugucguuuaccacaucguagaggaaaggcuuuuuugagaguuuuuaucaugaaggauguugaauuguaucauaugcuuuuucagcaucagcugaaaugaucauaugauguuuguccuucauucuguugauaagauguaucacauugauugauuugcauauauugaaccauccuugcguccugggauaaaucuccuugguuauuaugaaugaucuuucuaauguauuguugaauuugguuuguuaguauuuuguugaggauuuauuuaucagagauuggccuguaguuuuccuuuuuugaugugucuuugcccagauuugguaucaggguaauacuggcuuuguaaaaugaguuuggaaguauucccgccuccucuauuuuucggaauaguuugaguaggguugguauugguucuucaaauguuuggcagaauucagcagugaagccauugaauccugggcuuuucuuuacugggugauguuuuuauuacagcuuugauuuuguuacugguuauuggccuguucagguuauggauuucuuccugauucagucuugauaagugguauaugucugggaauuuauccauuuccucuagauuuuucaauuuauugccauacuguggcucauaguagccacuaaugauccuuugaguuucuaugguaucaguuuguaauggcuaccuuuucgucucugauuuuauuuauuugggucuucuuuuuuucuuaguugguuuaaaguugugucaauuuugcuuaucuuuucaaaaaaccaaguuuuuguuucauugauauuuuguauuuucuuuguuucaauuucauuuaucucugaucuuuauuauuucuuuuccucuacuaauuuuggguuugguuugcucuuuucugguuguuuaagauguguguuauuugaauuguuuguucucuuuugauguaggcacuuaaagcuauaaacuuccuuaguacugcuuucacuguaucccauagguuuugguauguuguguuucuguuacuuguuucaagaaauuuuucauuuucuuucuuaaguuuuugauuuauccacgguuaauucagaagccuauuguuuaauuuccuuguguuuguauaguuucaaaaauuucucuuguuacugguuucuaguuuuauuugauuguguuuagagaagauguuugauacuaguugaauguuuuaagacuuguauugugaccuaacauaugaucuguccuugagaaugauccaugugcuggggaaaagaauguguauucuacagcuguucuauggaauauucuguuuagguucauuugucuauagugcagauuuagucugauguuucuuuguugauuuucugucugaaagaucuguccaacacugaaaguuggguggugaagucuccagcuauuauuguauuuugcucagucucucuauuuaguucuaauaauauuugccuuauauuucuggguacaccaggacugggugcauauauauuuacaauuaucauauccucuuacugaauugaccccuuuaucauuauauaaugaccuugucuccuuauaauuuuugucuugaaaucuguuuugucugauacaaauacagcugcuccuacucuuuuuuugguuuccauuugcauggaauaucuuuuuucgucucuuuauuuugaguucagaugucuuuauaggugaaauguguuucucguaggcaacagguuguucuuguuuuuuaauccauuugccacucuuuuucuuuugacuaguuuaguccauucacauucaaugcuauuauugauaaguaaggacuuaccucugccauuuuguuacuuguuuucugguuguuuuguggucuucucuuccuuuuuuccuuccuuucugucuuccuuuuagcaaaggugguuuucucuggugguauguuuuaauuuuuugcuuuuuauuuuugguguauacauuguuuuuuguuucgagguuaucauaaggcuugcaaacacuaucuuauuaccuauuauuucaaacugaugucagcuuaucacugauuacauaaauaagcaaaaagaaaacuaauaaaaucucuauacuucauuacugucauuuuuuagcuuuugaaauaaacaagcaaaaagaaaacuaauaaaaucucuauacuucaucccucucauuuuuuaacuuuuguuguuucucuuuacgucuuauuguacgguuugucuugaaaaguuguuauaguuauuauuuuugauugauucaucauuagucuuucuacuuaagaguagcuugcacaccacaauuacaguauuauaauauucuguguguuucuguguauuuacuauuaccagugaguuuuguacuuucagaagauuuuuuauugcuccugaauguccuuuucuuucagaucaaacucccuuuguuauuucuucuaggacaagucuaguguugaugaaaucuuucagcuuucauuuguuugggaaggucuuuauuucuccuucauguuugaaggauauuuuuguuggauauucuaggauaaaaauuucuuccuucagcauuuuaaauauaucauacuacucucucauggccuguaagguuuccacugaaaagucuucugcuaggcaaauuggagcuccaucauauguuauuuguuucuuuucucuugcugcuuuuaggauccuuuaugcuugaccuuugggggguugauuauuaaaugccucgacacagucuucuuuggauuaaaucuucuugguguucuauaaccuucuuguacuuagauguugauaucuuucucuagguuugggaaguucucuguuguuaucacuuugaauacacuuucuacccuuaucucuuuuucuaccuccucuuuaaugccaguaacucuuagguucaccauuuugagacuauuuucuagaucuuguaggaguguuuaauucuuauuuuuacuuuugucuccucugcauuuucaauagccugucuucaagcucacuaauuauuucuuucacuugaugcauucugcuauuaagagguugaugcauucuucaguaugccaguugcauuuuucaguucuagaauuucugcuugauuuuacaaaauaauuucagucucuuuguuaaauuugucggauaggauucugaauucuuucucuguguuaucuugaauuucauuguguuuccucaacacagucauuuugaauucucugucugagaagucacauaucuguguuucugcaggauuggucccuggugccuuauuuaguuuguuuggugaggucauguuuuucuggauggucuugaugcuucuggauguucguuggugucuggucauugaagaguuagguauuuauuguaguuguugcagucugggcuuguuuuugcccaucuuucuugggaagacuuucuaaguguucugagggacuugggccccaagcucaauaaugcugugguucuuccagucuccuagagauaccaccgccuuggugguguugacuaagaucuggaagaauucucuggauucccaggcagagggucuuguucucuuuccuuacuuucucccaaacaaauguaguuucuuucugucucucugugcugaacuuccugaagcugggggaggggugacaccccuguugccaccaccucuggaauugcacugggucagaccuaaagcuagcacagcacugggugugacccaaggccugcuguaaacacuaccuggcuaaagccuguguucacucaaggcccugugguucuacaaucagcagguagugaagccagccacauuuauguccuucccuucaguaugauaauuuccccaggccccagauggucuggagaugugcucugggggccaagaauuaagagucaaaaaccuuagaaaucuaccuaguguucuuuccuacuguggcuaagcuggcacugaaagcacaagacaaaguucuucccauuuuucucucuccuuucuacaggcagaggagccucucucuguggucacuggcacauggggaguucugcuaggccaugguugauguucacuuaaaacccaagggcucuucagucagccuguggugauugcugccgagccugagcuucacucuucaggacaaugggcuccucucugggccaggacaggucuagaaaugcuguccaaaagccuaggccuggacucggggaccccaagauccaaagugguaccuaagauguaagacaaaaucccucuuauauuuccuuuugcuuuuuucaagcaggagucucucaccauagccaccacagugagcugggaauuugcuggguuucaccugaaaccagcaugucugaaucucaaccaaggccuacaguguacuaccuggguaucgcuguuguuuauucagggcccgaguggucuuuagucagcaggcgaugaauccugccaggauuggauccuucccuucagggcagugagcuccauuuuggcccagggugugucuagaaauguuguccaggagauagggccuggaauggggucucaguacucugccuguugcuuauccuacugugacugagcugguauacaagauaaaagacacacuccuguugccuuuacuuguugccuuccuauccugaagcagaaggaaggagucucuuauucugugagcucugcugccugggacugggggaggagugacacauccauucccuuggucgcccugucuggugggucuuuugguugcaugcuguccuaguccacuggcucuaagcacaacacuaagacguguccaggaauugcaguccuuguguccuagacugccuuucaaguuuaucugagacucuagagcacuuuagcccuugguggcaaggcuuacucaauuuccaaccucuuggaucggugauucuccucugaccgugucacguccaaaugcuaccuuuuguggguggcugcuagcugaacccagcacacuuuugcucuccaccgugauugaucagcacuaaguuuaguacaaagucucccaguugcugugcucucuccacccaagugcacauauucuuuguccaugccacacagcugcuauugcgggauggggggagggguggcaucaguguuucaagauggucuuuuccacucucuuuauugccucuuucagcaauaugaaauuaaaaccagguacuaugauugcucacuugauuuuugguucuuuggcagugcuuuuuuguguguaguugguaaaauugguauuccugcagaggggaccaucaauggaggcuuugauucggccaucuugcuucgccuccccucuuaguuuuuuuuuuucauguuaagauaaaauaaaccagaccucaaacuuugagcauaguaaacauucuucacaaugcagguagggauuuuaucugcaauccuaccaucaggaagugaucauaauuagcauuuuggguuugaauuauugcucuucuucuuaguaagcuauuuaaucuuaucuguuuccuuauuuauaaaauggggauaaacagugguguacuucacuaucucaacaacucugugaaauaaguaaguugauguauuguaaaguguuuaaaauaguacuaguuguauaguaaguguuaguuauuguuaaggaaucuuucgcauauauuucacaguuuuguauacuuggaggcaguguuuuaauggaauauuuuuauaauaggugguucugcuuaccuuuuuugccagacagcuuggcagcccacagaacugauucuuuuagaagcaugcguugaacuucacauggacaaaucuuucucugugacaguucaaaaacuaauaagugacuucuugauuccauuacuucugucuuucuagcaagcuuguuuacuuuuaccuggcucaccucauuuuuauuugaauuucaggagauguauuugaaguuuuuauucuuguaaguuggcccaguuuaguucuuuuuaagaaauaagaucaacaaucuguucacuguggguagggagaggggcgugaacauggaaaaaucaaaucuugccugauuuugaggaagcaaguagauuuguacacaauucaaaaccaguuaaucuaauuauuuugaccuuuaaaacaaacaacaacaacaacaaaacacacagcuuucacaaaagugugaaagcaggagucuuuuaaaacuugaguaaccaaagggcuaaauggcuuuuuuuuuuuuuuaauuaugguuuuaggaaacuugaugcuggaaaaguguagaagaaacugauacuuuuggagagagcaaaacaacaaauguccucuccauggaaucugaauuauauggaagcuuuuaaaauauuuuuauaaguggaccagaguaaauuugccugguuugugguugauaguaaguguaaguguucuuaaaggcuaucaacaauaaguuacagaaggaguucacaaaacaguaggcagaauggggguugagguaagaccuccuguuaggcuuacccagccuauccauugucuccaaaugugcuucaggaggcacuuuuccuucucuuuuaggagagaugaaguauguuacaaaccuuuucucucacucugauucucuuauuuucucuuacucuuuuacugguuacauggacauacuguguaacugaggcccaagcagugcuucucacugucgcaguauccauuaaugcaaggugcagucacaauuuccuccuucaggggacccaaaauacaguguaugcacugucaguuacuacuaagaaguuuauuguguuuaaucuguuuuuuuuguuuuguuuuguuuuguuuuguuuuugagauggagagucucgcucugucgcccaggcuggagugcaguggugugaucucggcucacugcaagcucugccucccagguucacaccauucugccucagccucccgaguagcugggacuacaggcaccugccaccacgcccagcuaauuuuuuuuuguauuuuuaguagagacuggguuucaccuuguuagccaggauggucucgaucuccugacuuugugauccgccugcuuaggccucccagagugcugggauuacagacgugagccaccgugcccagccuuacuguguuuauucuuuaaaguuacccuagccaaagacguuaucccuaaagcucggaaagugcuggacucuaaagagacugaaaacaaaguggaaauuuucuuuccuaaauuuacaugaaaucauuacauuccauguguuaccaacccugaagaaacuucuaagugggagaacuccccaggaggaugauuuuaagaggccggaacacacuuuuuaaagaucaguucaaaucccauguuuauaaagacuucuuucugcuucaacugauggcagucacuccacuuuucauauagcugcuucacguuguacauguaggaacucaaguacaugguaggaacucaagaauaugucaguccuuaaagaaccagguugaagauauucagugacagaguggacuccagucuggaagagugaguacagggagucaggguagcauuaguggcuuguauacaggauucagagucaaacugaguuucuuccuuuguaaaauggagaagaagauaacauauuuugcuaccuaacuaguacaggcugaaauuauaaauagauuuaagaacaguuuagauaaauuuauggauaagagauuaaauucaguucaaacaauggauauaugccugguacuguccuggacaccaugaauauaucaauaccauaugaggaagaaaggcuuuugacuuuauuguaaggccuauggguauaugcagucauguggcacauaacauuucagucauugguagauggauggcauauaugaugguugucccauaagauuauaauugagcagaaaaauuccucucaccaagugauguuaaagccauuguucauuguagcgcaacauuaccucuuuuauguuuacauacacaaauacauaguguuacaguugccuauaguaguucaguaaacaucagguuuguagccuagacacaguaggcuguaucauacagccuaggugugugguaggcuaucccuguagguuuaugucaguacacucugugauguccacauaaugaugaaaucaccuaaugacauuuuucucaaaacauauccauccccaucauuaagcgaugcaugacuacaguguaucuccaagugacucccaacagaauuuuggugaagugcuucucagcucacagauuuuugauuuaguauaugucugaccuuccugugacuuauucuuuuuguaagguucacguaauuaaaaugagucuagaaaucuagagaugcuguuaccuaucucagauaaucuuguuagcucuucaugaacuuucugggcacuuuuacuugucuggauccuuucacauaccauucagggcuauacagagugaacuaauaacgcugauacuugaaggcacacagcugacucagaccuuuuuaaaagaggucagagugugguguaaaccuaaguaaggaaauggguuccuaucaaaacagaaacauucauucuuuauaucugucccugccuuucuugaauaacaagaacuugagaucuaaugagcuauauuguuauuuuaaucuuaguaauagucacuauaauuauauuaauuacuuggaaguaggaaacuuuuuucauuuuuuggaaacauaucuuuguuaauuaugaacuacuuauauaguuauuucuuucuacauuuguuuacugggcuguuuaugccuuuuuuaucuacugaggcaauauuagauuuuacaagauuuguuagaagucauguuaaauauuaagcuaaaugguucauuguuuuuuggcagauaaauuaucuugucagauucuguugcuuuugcuuugugcuuaaaguuagucauuuguagggaguugcaagguucuuggcauuuguaacugucuuguuuagaaaauaaauugauuuaauguguuagagaucccauacaggagauuucugaagcaaaacuuacacuuuuguugccucaagggaagacuuuauugcauaauaugauauauguucauaagguuuguguagaaauauuauacuugguaaaaaucuauauagauuacauuguuuccaauuuaauauugucccaaguaaaaaauauauacaauugaguuuuauugaguuaacuagcucaauccuuaaggacugaaaaaaucagaauuuaacagaagcuagguuuuuuaagccuggcaguuaacucuuuacaaauggaauuauuuuuaugaaauuaugaaauucugugccuuugguucacugaaaacugaauuaacauguguaguaaggauguuaaucuuuugaaauuauaaaccucacauguuugauauaaaaauuaaaagcauauggguugcuuuuaauuuuuuuaauaaaaaauuaaggacauauauuuuuucauugaaaauuuugauagccuaauugaagaauuacggugauguacaauuguuaacaagaauguugauuaaauguuuaauguguucaugugauugcuacagaauggaaucucagaaaugugcuuuuuccaagaaaguugauauucauaauaauuuaaaauuuuuauugcagcuagaacgaguaaaucugucugcagcccagacacugagagccgcuuucaucaaggugaggugcaaauaauuuacuaugauuauuaaaguguauguucuuuguaaauguaaguacaugugaugguugccaguuuauuuucuuuaagggaaagccuuuuuagccaucuuaugccuguuuuacuauauuccauaaagcuuaaaacacuuccaaaagauaaacuagaacaaauguuauuucguuagcauucaucuuuucaucacuuugugcuuuugaaacugaguuuuucagaguguucucuccuuagcuguagauuauauuuuugaggguuuuuuuuuuuuucuauuauuugaccuuuugaaaacuuauauggcugggcguggugacucauaccugucaucccaacacuuugagaggcugaggugggaggaucacuugagaccuggagcucaagaccagccugggccguauagcaagacccuguaucuacagaaaauaaaaauauuagccaggcaugguggugcgugccugucauucuugcuacucaggaggcugaggcaggaggauugcuagagcccaggaguuugagguuacagugggacgugaucaugccgcugugauccagccuggguaacagagcaagacccugucucaaaauaaaguaaaaauuuaaaaguauuuguaaaaguguaacuugaaaagguauucuuucuauuguuuaauuauagaacaugagucuaaaaaacguuuuucagugggaaaguaauaccuucaaauauggugaauuaaauauacuuugaggauauacaguuaaguuacucaaaauaaauguuuuccuugucuuuagacuugagcuguucaguggguuaucacuagccacauguugcuuuugagcauuuaaaaauaagacuaggucagaucaagauauguuccaaguuaaaauacacacagauuuugaagacuucauauaagaaaaagaaaguaaacuagcuuaguaauaaauauuuuauaaugauuacauguugaaauaauauuuuggauguacuauuaaaauaauuuuaccugugucuuuuuacuuuuuuuuaaauguggccgcuuaauauuacauagguagcucauaguuguugcugauauuacauuucuguuguacagcccuacucuagagacuuacuguacauguugaaugcauucuuuaauauaaaacuuuuaucugguccuccaucccaaauauauauuauggugcccaaaacuuuaauuuuuauuuuugcauuccuucccaucaguagcucaaauaaccuguguuuuagguaaaguauuuuaauguuuaaauguggaauacauuuauauuuuaauuggaguugaaacuauaagcccauucugcuugauuucuuccaugucacacaaguuuauugauaacacucuuuucugguagcacaagucaugucacuagguaucucauauuacuuuaauaaucuacauuacguauguuagaauagagcuuuuuugauuuaauauucugugauucaaggugaguacauauauauuuaguagcuucauuaaauugcauccugccaaaucauuggguuaaugaagcaacaccauaaucauuuucuuuuuuuuuauuguuguuuucuucuuugagugucaguuuggcuuuggaauggcauauuuggucauuagggagacaugaugcuaucuuaagcaucuuuguggccaaaagaagaaggaaaaguaaucuguacaguaguauugcuaagagaaaagucaauauuucagcuuuucuaaugccaggaacagagagaagaagacccuguccgaaggaguagauaguaucuucaaugacauucauaaaauaaaauaauaaauuuccugaggguuuuucuuguaacauccuaacauauaagcuaauuaucuaacacuuaaguacaauuaugugaccgugauagaugugguuugauccauggauaaaguuuguugucuauggcauagauuacuuauuuuggaagaaaacaaaguaacuaauuuuacacugauguauuuuuaauuaucacauuuaguuuguuacauuucaagugaaauugaaggaggacauguuaaaaauguaaagaugcuuguauuuuuuaaauuacaacuuuugaaaaagaugaaagaaaccucaccagucauaaaaucuuuuauauucauaauuccaauuauugguccgcaacgacaauaauuuucaucaugguuuuuguuauuuggagggaaaagaggauuaaaauaguuuuucccaagauaauaccauugaauauuuuaauguauauacaguuaaccuuugaacaguguggagguuagaggugcugacccccugcagaguugaagauuugaguauaaguuuugacuuccacaaaucuuaacuacuaaaagccuacuguugaccagaacaucuuacugguagcaaaaacaguugauuaacauauguuuuguguauccuauauauuacauacuguauucuuaaagucacagaaaagaaaguguuauuaagaaaaucauaagagaaaauauauuuauuauucauuaaguugaaguggaucaucauaaggucugcauccuugucguuuucacauugaauacgcugaggaggaggaagaagagaagggguuggucuugcuagcucagggaugucagaaguagagaaggugaauggggaggcaagagaggcaggcacacuuaguguaacuuuacagaaauauguuuaauuucugacuuauuugcuuugucauuucucuaaaaauguuucuguacaguaccaaucuuccaacauuugcuuuaguuucagugcuuguaucagagaaggguccaugucauaaagcagccuugaauaaagagaacucuucugcuggguugucuaauguccauuuguuuucuggcacuccuuugucuucuuccucauuguccauuagcucuuaaauuucucugauauccauaucuugaaaccuuucauccucuacguuuuuuuuaaccauaucuacaaucucuuucaugauuuccguggcucuguuguaaauccuguggagucaugcacaacauguggacacaguuuucuccagcagaaauuuauuguuuuaggcucgauggguuuuucuauaacaacaguagcaucagugguguaauucuuccagacuuucaugguauucuuucuaccaaggauuguugacagccauuuccauagaggccuuaugguuccauguauaaugagcuuuaaagguucuugauccccugauguagaggcugauuuagaggugugguguuuugggacaaguaggccacuuugaugccuuucaguguugaacucaugggguucugggaagcaagggacauuauccaguaucagaagaauuuuuuugaacaacaauaauaauaaaggcuaggugcggaggcccaugccuuguaauccuagcacuuugggaggcugaagugugaggccagaggccagaaguucaagaccagccuaggcaacauaggaagaccuugucucuaauuaaauauacaauacauauauauguguguguauguauauguagauaucucugauaucuauauauauaucugauaucucaauauauaucugauaucuguagaucuagcuauauagagauauauagguaucucuauagauauauauagacaaucagaagaacuucagaagaccaucccuuccugccaagaugcuuucuaaccgcagaaacaacgcauugaugguaccaggcuagaacaaggguucucuuugucuaggucuucuuguacaaccacaagacuggaagcugguguuuuucuucucccuucaaggcuugaggguuuagcagcauuauaaauaaggacaguccugaucauaaaccagacuucauuugcacagaacaguagaguuguccuaucucuuccugccuuaaauucuggugcucacuucucugcuuuacuaauaaauauucuuuguggcuauuuuuuccuucagaauagggcacuuugaucuguauuaaaaaccuuuucaggcagauauuuuuuuccucaaagauuuucuuaaugguguguggggacuuauuugcugccucuuggucaucagaaucugggucuccuguuaucuugacauuuuuuaagcaaaaccucuuucuaaaauuaucaaacuauccuuggcuggcauuaaauucuucagcuuuagacuuuccuuuugcuuuaaguugucauagaaugacuuugcuuuuucuugaaucauauuagggucuauagguaugccuuucuuauagauauccugcaccaacauaaaagcugcauuuucaacaggagacaaaaagguauuucacaaaacaugcaagguuuuuguaccugcugauguagcugcagcaauggcuuuguuucaugaauuuccuuuuuuuuuuuucuuacagugagucuuagacuguauucaagcaauucaguaucaugcaauacaccuucuuguaaugucaugacuuugcuucuugagcacacuuccaacaucacuaguggcacuuugucgggucccaugguauuaucccauguuuaaaguauugcacuaaacacgaugagaaaaauaugugagggcugggagguauuacuuuguacugggaugugcaguuugcuggagagaugaacuguucacauggaguugauuagagucacauggcguuuuaaucauauacuuacuaauacuugaacugacugcaauagcaacaggagguggcuucaaacuuauuacauauacacguguacuacaguuaauuuugugcaguuaugauuuaauauugcaucuguauauuuguuuauauuucuuuuaacugcaaauaacaccauguacagucuguuugcgugugaguuuugauaaauuuuaacuuuuuaauaauuuguaucuauuuuauaguaaauacuaaaauagacuaguggauaacuauauuuuaugcauucauaacauguguuuuuauuauuuuuuucacuacuuauaggcuacucaguuugucuauaaguuuuuucaaauuguugcugaucuccaaaaauuuuuccuauauauuuauugaaaaguaucugcauguaaauggaccugagcaguuaaaaccaguucuucaagggucagcuauauucuacuugauucccucucccccuuauccucuaugagagguuccgauagguuguccgucuuccagacugagaaucacugauccacaagaguguauguugcugcccuucgguuuauuuuuuucuuacagcuggauucuuuacaaagauuagacacccuacaggguucauguuguauucugagggaaaaccuaagaguuguagauugucucccugauuuaagaccauauuuauucauuuugucagucagagccauuugguaaauucaagcuuuugaaauaagaauuagcuuaaccagguuuuuagccaggagguacugagacuacuccuuccaaacuauguacugagguaccugguggcccauagcaaauucagaggggugccacgaaguauuuuaaaauugugaagguguacagugauacucaacaucuguuugacacugcauggacuccuagcuugagauggauugcaauuuagcauauuggauuguccuucacugcuuucauugguguuagaucauugagaagcuggacuuuuuggccagugcuaugaucuaacagaaguaccagaaaaaaauauaucugcaagaggaaaugagaggggcaagguccaaucuaagaccaauguuugagaaauuaugaagugcccaguaggcacacacaucccaguaauaagugacaauaguuauuuaagaacagaguaaaaauuguuuuuuucaauuuauguguauuauuuuuuuaaaggcuagguaguuaggacacuauacuuauuaaguuguuuagaccuaaguauuuaauaaacagcacugugagguguaucuuuuggcacuaaggacacugaaaacugagaaaguuagggaccuuugugagacuuuuguaaugcucuagcuuuagcauuuuggggucccagaccagcuugguauugaaaacuuuauucucagacuuucagcauuuuaaccuuucaguacuuuauuauaacuuaaucagagauaugcuuuucuuuuucuguccccugcaagcacauagagaauguucccccucuccccaagauaauucauuauguaggaagauuuauugcuagauaagauaaaguauuguuacugaaugcuacauuauauguaauuuuguggcaguucaccgcauuaaugcuauaacaacacaucuuaagccauauuuggacaucuuauaaaggaaacuccuuuuuuaaaaaacacaguuuuuuuuguuuuguuuuguuuuuaauacgaggucuuauucuguaucauaggcuggagugcaguggcaugaucauagcucgcugcagccacgaacuccugggcucaagcaguccucccaucucaaccuaccaaguagcugggaccacagccacaccccaccaugccuggcuaaaaaguagauucuuuuuaaaauauauauccauggaaggaaaagucaacauaggcuguaaaagaaacaggauucagucaaacacaguuuauuguuauuaaucaucuaucaaaaugauuuuccugaauaguaucugacagcauuuaaaaugauccgaagauuggaauaaaugcguguauuuucuuuucucauuucaucccacaacccuucaguuuuugauacuugagaucuaaugagaaacaagauguuauaauggaaagagcaauaggaagagaagaaaacuguaucugcagugauaaucaauggaauugaagaggcggagguuaagugugcuugacacauaaggaaacaaaaagauugccaucugauuaagaucguaaauuguguuucuauuuugcuguuuaauauuagggcaaaaaggaaagaaaaucaucagcauaaugauuaaaauuggcaggcauccuacaggaaacaaacaucaagugugauuacagaauuuacugggaaaaacugaaaucugaagauuaacucuggcuuugguaaacucagaacucuaugcccagucuugaaauggcuagaaaauuuuagugucuuggggagucuaaguaacauagaaccaaugcaaacucaaugaaacaagcucaaaagguaguaaaagguuucaugauguucuagaaaccagugaaggaaauauucuugcuacaaaaauaaaauaggaaaugaaaaucauugugugggaaaauaguuaagguauuauuauauagguucaguaaaaccuucaaaauaaauccuuuuuuguuuuuccuggcauucucuuaauauaaauggaaagaauaugcaaaacacuagucagaugaguuauugcuugauccuugaguugcaguauuagcacauuaaaaaaagcuuaaauucucaagauauuuaaaguaaugagaauagcaauugauagauuacuaaaacauauauaauccuuaauucuaucuuuguuauuaguucaauugcaaaagaguauaaagaagaguagaaaauacuaaguucuuucuguucaaauggaaaauggaaccuuagucauaguaaagagucgggugcacaagcucuaacaaagccuuagugaaugcuaucaugacaccugcuuuacaaagauuucugcccuuaaaaguuaucaguguaagacgcucccaacagauucuaaacaauuaaacuuuggcuuuaaaauguugauuccuuaucuguauuucaaaacuaguuuucucuuuauuauaggcugaaaaagaaaauccaggucucacacaagacaucauuaugaaaauuuuagagaaaaaaagcguggaaguuaacuucacggagucccuucuucguauggcagcugaugauguagaagguaacggacagaagaaccuuguuuaaguuauacaauuguuaaauagcacuuccucuaaaucauuauuauuugaccaaaggaucuuccuucccuacuguuuucccucccucccuuucacuuaugaugaugaugguggugguggugauagugauaguggaagcuaauguagauaaaauagaaaaaugguuuuucuugcuuuuuauauuugugagauuuaauuacuugaacuuuguuuaugcugcauacuucaauuuuuccccccuuuauguuuggugaguuucaguuuuacuaaaagauaagcuuauuuggaauguguugacuuuaagcaaacaacaguuugaaaguaaugagguuuuuguuuuguuguuuuuuuaacuuuaguacagcaucuguguuucaagcacagauuuaagagaauaauauaaccauccuuuuuacuuuucuuauuuuuuuuacuugaaauuauuuagacguugguuuuacuuaaguuuaguagcaguuuucccacuaauuuagaaaaauauggacauauaauuucccagaauuauuaaggaagaacacaaagcagguauuuuaacugauuccaugauuuuaagaaagcccuuaucauuauuuagaguugagcauuugcagcccauuaggccauaauauauugaugaauugguagaguuguaaugcuuccaagucugcaaugaaucuagugaagucuccuuuccaaaauugguguucugugaucccagccuguguguuggauuugugcugguguuuuuguuuuuaagugagauuucaaaaauguguagaagauuuuauuagauuauuugggguuuuaauaugaugaagcaauguauauuaaauauagggguuuuaaauuuuuaaucuuuccaguuggcaaguagauauuaccuuugcacuaguuaugacacucauuauuuaauuuaagguuuccuugggaaauguaaugucagaguacgguugaacuuaagccucccuuuuaaaucuguuuuuuuuuuguguguuuuuuuuuuuuaagauuucaugggauguccuuuugucccaaauugaaaauauuuauucuuucuuuuugugauacuuuacuugaagggagcccugcuguuguuacuggacuaagucaaacgcuaaugaauucugcuuugcaaccuugucuuuccuaauuaucuggccuuucaccucccucaccugccuuugaccaacauuggaaauucuuagaugugaugaauuuggcagagagucgcaggauguuuuuuauuauguauuuauuuuaucagaguauaugauugaacgaccagagccagaauuccaagaccuaaacgaaaaggcacgagcacuuaaacaaauucucaguaagaucccagaugagaucaaugacagagugagguuucugcagacaaucaaguaagcaauuauuuguuuuguuucuucuuuucuuaaaaguacuuccgaggaacuacucaucuacauuuuuuaauuuugguaugacuaacuugaaaugcuuauuugaaauaaaaucucaaauuuuuaaauaccacauuuuauuaacuuuauggcguuugguuucagaguacagcauuuuuuagaauguuuaauuuuaaaacaacaaugaaaugugcauaaacuggaauguaguuugaacuacauaaaugaugggaagauauaaaugucagauaaaugaauagagaaacuggauauauccuagagauugguaguaagauauaccaaaauaauuuuuauuucagaaauagcagcagucauuaagguaaguaacguacucuuaggcaugaguaguguuuucuaagacugaccaaauagccucuaaauccuugccuuugggggauauagguuaaauaagaccaagaauacucauggggccagaaggcuggcuggugagcagcagcaagaagggucauccuagagcaguaguucucagaccagggacacucuucuggaguacagugaagggugagaggguaggggauugagugaaaacauaaucccuacauaaguaucuuuaaacuagaaagucugauaauuuucuucagccucaguggauaaaaaacaaagaaagcugggaauacuugcagugucacuaucaaugcaugguuuuggugaaaccauagguagauauugcuggggagaaaagauuuagcgcaggucuuuuucuggaagaggcugugacauaugugguaacuuugaagaaccuaaggagacucacuuggaauaaauaguaacauucaucuuuuggaguuugggcagugggaggaguggcagcagccaggcagcccagcuuugugaaggcccucagcaugccauggcccacaugcaucugauaugcgccuuccccacuuccaggaugcccaagaggacggucagcucagcugaugggacagugagggaagaucccaaaaggagauugaugugguugucagcuaaaccugcucuuucaguaguggaaauugaagccccaaaagguagcaggaaaagauaaaucuucaggcaaaaaagugcaaacaaaagagaaaagaguaggaaagugaaaacaagccaaaguagcuaagaauaaagauuuaccugcagaaaacagaaaaacuaaaacugaagagaguccagccucugaagcaggagagaaagaagcccagucugauuaauaucgcauaccaugucuuaucagugguuccccgucucucuucuuacauaauccaggagaauauuuuuaucaacuauguuguaaaugcauguuuuuuaguagcucuaauguuuuuuaauagcucuagaaacauuuaaggagggaauuccacugcauuccauuuuuuaaguguaaaugcuuuuuuuuuuaaagaggugaaauaauuuaauuugcugguuauuuuuugguacaaugggaaaauaauguuggauauugaauuaugggaagccuugacuguuaugggugucagcuuaacauuccauagaugggugguuaguuuuuauaucccauaauauaaagcauacuaaauggcaaaguggagucgcaguccugcauuucaugucuugaacauuuuuaauuacuucacucugucacccaggcuggacugcaguggcaugaucauaacuuacugcacccucaaccuccugggcucaagcaguccuuccaccucagccuccagaguagcuaggacuacugguguacaacaccacaccaagcuaauuucuuuuuuuuuuuuuuaauuuuuaguagauaaccacaucucccuacauugcccaagcuggucucuaaccucugagcucaagugauccuccugccuuggccucccaaaguguugggauuacaggagugagccaccacaccuggccuuaaauuacuucuacucuucauguuguuuuuuaguggaauuguuuccuugggcaaaccacuccuugagccuggcucuaccuaucagaauugugugcacucuguaacaucuuuggucaugguaguccuguuuuucuaauaacuuuguuaaugugcugugaaagauuaaaguauauaguguauaugcuauuaaauugugaauuggugggacguaugugacagcuuaucaacauuugaagguacugguacuugauagccuuuuaagguaauuuugccucaguuguaagcuggaaagucacuggaauaacuuuagagaauaauaaugauacguggcuuuuuagauuuugcaguacauauguucagaauuauguacaaguugaaaugucuguguacugauccucaacacaacugaugaaaucucaauuaugaaagaaaaagaaaacauucaucuuuugaaaauaguauucuuugucauucacauugagaaaugcuauuuuagcuuguuuggauaccuagcuaguuuggauacucucuuuugagucacauaaagagaggaauaugucccauagaaaauaaugguucgugauagguaugcaacccagcuaucaaggaaugacccuacucuuugacaauaauuaagggccaggaauauaaaaaaggcuuuuaauugaauagccaaaaucugugucacaagggacaaacacuaaggguuuuuuuguuuguuuuguuuguuuguuuuguuuuugagacggagucuugcucugucgcccaggcuggagugcaguggcgccaucucggcucacugcaaacucugccucccggguucaugccacucuccuuccucagccuccagcguagcugggacuacaggcgcccgccaccaugccuggcuaauuuuuuguauuuuuaguagagaugggguuucacuguguuagccaggauggucucgaucucuugaccuugugauccgccugccuuggccucccaaagugcugggauuacaggugugagccaacacgccuggccuaaggguuuuguauuuuaccuuuccuaugggaaagccccagcuuccuuuucuacuuuuaauaugugaaggaggaagauaaucaacuguucauggaguuuuauuuuuaaucugguacaaguugagcaucccuaauuugaauaucaaauucuaaaugcuccaaaauccaaaacuuuuugagcaccgugacaugacaccauaaguggaaaauuccacgucugaccucaugugauggauggguuguagucaaaacacaaucaaaacuuuguuguaugcacaaaauguaugcauauauggaugcacuuuaugaaacauaaaugaauuucauguuuauacuugggccucauccccaggucuaaagacuucuggucucaagcauuuuguuuaagggauacucgcccuguauaguuaaaguaaacauguuuggccuguaaaaggauaaauugucagugaucccaaacuuaguuguuuagacuauuuauuucuaaaguuuugaaauaauuugguaaguuuucauuugcuuugauaaucguguacuuguugaugagccaugacacauuucuaugaagauuugacauuuaaaauaauauuugcagcagauuuugcuucagaucaucgaaguagguuuauauaaucaaugucaucuuaauaacaaucauuuauauaggacuuauuauaugcuaagcacuauuuuaaucacuuuacauuuauuuacuuaucacaacaacccaguaacaagugaggaaauugaagcaggcacagaaaauuagguaaggccacagaacuuaccuauuaagugguagagcuggauuugaacccaggcaaucuaaugccagguguucacugcuguuucccaaucacagacuuccaauguugauguaaucuggagauugaaaaauagaguuucugccauuugaaagaaaugugaaaaaggauauuuuaacauagaaugccaguacgugagagagauaacaguauugugguugaaacuggcauagaaauguaggcccagagcucucauccugucacuuugacauccucuuucccccuacagagucccugagacaucucugcuaaaccgucugugacucuagggagcugcgguuugaaaaccacauuauuagcagcacauuuuagucauaaggaaauugagcuuaagagucuugucuauagucauugacagaggcuuucuuuaggguguuguuuucuuuaugagggaguaauaauacuucaguucuguuuucuagaguguacuaauuuagcacaauugaauuaagaguaaugguggcaaugaaaauuuacuuccuaaccauuugaggagggauaauuugcccuggcaaguuuguugauauguauguuauuucugagacuaaaauucaaccacauaugaauagcauagauaggcuaaaguauaauuauuuguaucacugucauauauugguacauuuucauguauguucuuaccauuauuaauugacaaauuaguggauaaaauugcacuaaaauagaaaaugauuucuucuucaggcguuucuccaauauuuuacuuucuuauaucuaagguaguuauccccuuuauucauuuuagcaacauuuuucaauaagcauaugucauauacauauuacaccaaguacuauaggugaugcuauagauuguaucaaaguacaaguaaaaaagaauccugacagcuaauaaauauucaggcaauuuugaauauauuagcagaccuagauuugaaucuguguuccaacauuuagcuauguaaccuuggauauaaguugcuuaacuucugucauuuuaguuugugccucugaaaaugaggguaaugacuugugagaauugaaagaaaugauguacaugaagugccuagcacagaaccuagcauacauucaacaguacaugcuauaauaacauugugaaaugaggauuuuccucccuuuucucaauggaguugauaaggaaaaaugauccagcaaauauuucaaaaggccuuuugaucaaugaaugugugugccugaguacauuugagcuaugcaaauauguuauaaaauuaauuuguauuuuuuuugaaguccaauacaucucaacuaauggaaaacuaguggagacucgugauuuaacagaccaaaauaaaaaagccaggcauuuauuuacuguuuguaaucugcauuugcauauucuuaggcuaaaauucagcaagguuuauuuguuuuaaguuaggaguuuucaugaaggguucagaauagauuuuuucagaguuuuccagucuaaaccaaacucaacauaaagcacagggauucccuuucauuagugcauuugcauaaaugcguaucaugcaaauuuggguggcaugauuagaaacucuacuuuucuauugcaguuuuuugauaagauguauguuuacguuucaucugaagccuuugccuuucaguguaauguuucgcaaagcugcgcuauuagguuggugcaaauugcuaaguuccuucuccuucuacucauacuaucugccucuuaucacagaauucaucugcaccaagccgcauucauuaguuaugcgauauuuauuuuacccucaaguuuuuucucaguucuuuaucugguuaauugucuauagugguuuuuuuguccugguauuuucucucguaggaaacaaacucucugguaguuacuaauauaauuuagcuucucuaugugcacaccuuggugccauaaaugaaaauacuuuucuguguacauauggauaacauaauauuugacauacauugcugcagauuguuucuagagaacauuuuuucuacaauuugguaggcauuuaacagucuuuugccucguguccaaacagaggcuuaggaauaaauggccuugguugacagagagcucuguuccaauaaggcauuaaaccuuagcuccaaguuuucaaaccugacucaucagcagucaccugaggaguugcgccuccccccacccccuuuuaaaauagagauuuccaguauuuaucagcaggucuuucuuuuuuuguccagcaaaacccucccuucuucuccccuguguuuuugucucccuaggugcaugaggcaacauguuucagacccacucuuuugacuuguagaaucuagccacuguuauuguauaugaaacauacgcucauuuugaugacuagccccggaaacacauuuuauuccucuuuagcagaauauugaaauacacuacaaaguaagacuauauaaacuucugucugaucacuauguaauuugcuccauuauauuccauuuuaaauaacuccauuguggauuuggagaagcuugcauauuuagagauuugacauguuuuauuuguugaaauuguaauuuuucucacagaauaguccuaugacagcauuuuauuaaacaauaguggguuuauguccaucacaccaauauacaaagauucaacuuaagccauaaaugaaaggaauaguuaucuaauuaaaaacugcuguuacuaaaccagaggcaaaaaaaaauuagauaacauuuauguaagacuuacuguccuacuugaauauguaauguuucaauguuucagcccaauaccaguguuugaccugagagagguaauaaguaaaauauuauugaaauaaucaaugaaaauggaauuacuacuucagaguacucuaaaauacuuuuuuaaaaaauaucaaaauucuguaugcuuuuaauucuuaaaauuucuacaagcuuauuuacugaaaaauaugcugggaaacacccacaugcacacagaaaccuggacacugagguuuuuuuccccuugaaauaggaauguugaaauguuuuagauaggaaauaacugaaaucuggcauuuguaauuaguauuaguaauaaaauguuauguuuaggauggugcagauuuccaucuuauucauuucuucacaguugcauugcauuugaaguuuuuguugugacuaacagcuaagagaaugacugugaaaaagaagguuugucgcagagaaugugagacuauuugagaaugcagaauuacaucaaguucaauuuggcggaaaaaaauugcuaugagguuaaaauguggaaaucaaaaggggcuaguuagaaaggcaaaaaaaaguucagaaaaaauggugcauggauaggaagaacagucaacucaaaugagaauuauucauuucuucuuuuuuuucuuuagaaaggggagggaggugaugaugcauauauagucaaaggaugauugcugggaagguuaaagugcaagaauauugugauguugucuccucuaguaauuuaaauauuuuccaaagggaauagugacugauaguaaguguuugaaagaggaggauauuuggcugcuagauagaagcuaaaagugucuguaaaagaguaagggaggaagaauauuuccucaggggagaggaauauuuucugaggaggaaauauuuuauguuaaacaucaaaacuaauagguaucuagcauacagcauuguuaaauacagaauugaguuauauguaaugcagaauauuauaaaauuguuccuuguucaaauaacaaaaguagagaacaugguagcuugaauuuagcuacauuagccagagcaaagaaaaauuuuaaaaugggaaaagacaggcauagguaauguuuaucuuuuuauaaauuugaguaaggaacgcuuaaugaaaugugauugauuugagaaaguuggucuugguuggcaaccuuuggucagcagugcaagagaaucaggauuacagagggguauaggcuaaaauccccacuccaaccagcuagccgaaaaggcuggcuguucuugaagugauugcgcuuaacauaauuaagaguguacugugauuagauuaagaguguacuuaauuucuuucaaauguagcugauguucuuuucucucacaaauuucuuucaaauguagcugauauucuuuauucuuuucccaacagggauauagcuagugcaauaaaagaacuucuugauacagugaauaaugucuucaagaaauaucaauaccagaaccgcaggguacguuuaguagaagccuugcuaguugacacccuagauguugguuuaugccuaguuguuuuauugacuuaaaaauaagauugauuguuggaaauaguuuugugucauuaaccauugaguuuauucuugaauuuaaauaugccuuuuuauuuaaaagugaguacuccacaauugcuuauuaguaauauucauauaaagugcaucccauauccuguguaaucucuuguccuugccuuuggcuuuugugauuauuucucuuauuuaguacuuuauuucuuauuauauuuugugacuguaggcacuugaacaccaaaagaaagaauuuguaaaguacuccaaaaguuucagugauacucugaaaacguauuuuaaagauggcaaguaaguacuguaauuuauccuuuacuuuuaaaauuaaauagauuaugugguuuuauaugauaugaaaaccacauaaauuaagcccuuuuauuuuauuauuaguacuccaggcaacugauaaugaaggcagaccauuaacaauagaaaaugaaugguugcuaaucuagccauaacuccuuucuagaacaggaguuaucagacgcuuucugaaaagagccagguaguaaauauguuagauuuggugggccuguugccguuauccacccaucucugcuguuguaguacagaaacaagccauagacaauguacaaacaagggggugugacuguguuuuaauaaaacuuuauacaaaauucaaauuucaguaucuugaaauaauuuuuaccugucauauaauauucuucuuuuguuuuuuaaccauuuaaaaauguaaaagcaauuuuaguucauuggccuacuuuauacacuccugaaacagugguucucaaacuuuaguggcaucagagucaucuggaggacuuguuacagucaaauugcaaauugcucgagggucccacuucuagaauuucugauuucguaggucuaggauggagccuaagaauuugcauuucuuagaaauuuucaggugauacauuacaggucuauugagaacuacugcacuaaaguuaaagcaauaguugucaauccuuucugugcauuagagucacuugaggacaguuuuuaaaaaauucccacugccuaggccccaccugcagagauucugauucaguuggcugggaguggagucaggguuuagauauuuuguaaaagugccccagauguuuuuaaagugcuguaaggguuuugacccacucuccuggaaagaggcuuucacagcaucauucuauaaaauaggaaauauacuaaaauguaaauuggacauuauuuuuuaauuuauauauaauugguugugaugcacuauagaaaaccaagagauuuuauauauuuuaacauacauacaugcauacguauaauguauaaacugauggaaagucuggccguauagguaguuauuugcacuucaagucaaaugugagaauuuuuugaacaagauuauuuuuuaacagugcuuaaagucagaaaaguaaauagagaccucaaucauuccauccugcuauucagguuuuaagaucucuauauucaugucacaucauuacaguauuauuguaguaauauuuaaaaaugauaaaaauacauuagauagaauuauguuaauuuucagagucauuuuuaacaguucaaacagguugaaguauuuacauuuauauuaugaauuagagauaucgagcuaaauuuuauuacuuguuuuguggugguguuccauacacagguuugucuaagggaaaugcuccuugaugacuuaguuuaauaagcuggcauuuguguuuugaaaauaaacuuuuauuugauuuaugcuaagcucaaauaaccaaaaacacauuaaaauaauaauuuacaugaugggauuauuauuucugauuuuaaauuacuauuauggaauaagcacaaugaaagguagacauuaauuuagagacuaauuuucauuaauuaauugaaauuauuuacucugcauauggauucagugucguugcuacuacuuucucuccauucagcagcuuuuuaaaauuccaguucuuuguguaucaauaaugugcuugaguuuuauaccuguuuccucaaaacagaaaauuauugauagaaccugaucuuuaggccaucuuucaguagggggauggauuugcauugauucagcuauuucuuccuggcccuucucuuuuuuuuuuuuuuuuuuuuuuuuggagacagagucuugcuauguugcccaggcuggaucugggcucacugcgaccuccagcuccuggguucaagcaauucuccugccucagccucccgagcugggauuauagacacaugccaccaugcccggcuaauuuuuguauuuuuaguagagacaagguuucaccauguuggccaggcuggucucacacuccaagagaccucaugauccgcccaccuuggccucccaaagugcugggauuacaggugcgagccaccagguccagucccugggccuucucuuuugagaaaugucuaggaugcgggugcaugcuagauaugauacuaggaaacuguugaggccacacagugggacuagggcaucaucucugaaucccagcugcaugaagaugagccauuaggagaaugugguggggcucaaagccaguuuuaaagaauauauuuuuauauguugucagcucccagauuuugaaacugcaugauuauuuuguuuuaaaaguauguuuauaguaaaaguaguuuguaguaguuuguagcuuagaauuucuaccuuuuuuuaaggagauaaagagauugggaugaaucagauuggaaguaauuagauuuuucuugaguauuaugcccauuaauuacaaauuuugagauuaugauacuuugcuggauuuuacuuguuaacuucuaugaaaccacagcuggagaccacaucugaauccuccuuuuggccaguuaacuuguuccaccuauaaaugaacuggguuguugaggcacuaucauuagcaguccuccaacauuuuauuaccagucagaaccaccagggggcaguaauuacuagauaguuuaaaaugaugcaagacuauuauauccuaaauuggaauaaaaguuuuaauaauacuaacuugucuuuuuuuuuuuucuaaaauugauuccauugcuacuguuaauaguauaaaucuuaaaagggugaauuuuuuggaugaaauuaaugcuuauucuuuucuuuuuaaacagggcaauaaauguguucguaagugccaaccgacuaauucaucaaaccaacuuaauacuucagaccuucaaaacuguggccugaaaguuguauauguuaagagauguacuucucaguggcaguauugaacugccuuuaucuguaaauuuuaaaguuugacuguauaaauuaucagucccuccugaagggaucuaauccaggauguugaaugggauuauugccaucuuacaccauauuuuuguaaaauguagcuuaaucauaaucucacacugaagauuuugcaucacuuuugcuauuaucauucuuuuaagaauuauaagccaaaagaauuuacgccuuaaugugucauuauauaacauuccuuaaaagaauuguaaauauugguguuuguuucugacauuuuaacuugaaagcgauaugcugcaagauaauguauuuaacaauauuugguggcaaauauucaauaaauaguuuacaucuguuaaacauuucuuuacuugaaaaaaugcauauauauauguguguauauauauauauauauauauauauaugaacagaagaccaagacaacuugguguaaugucuaaaaaacuucuaaugggagcuuaucagcaguuuaucaaauaauaaagcaagaauuucuauuuuuguccuuaaucacuuuggacacagaguagucaauggaaauauuuuuguuaauuacuuauaagguacugaguauuuuuauaugauuuccaaccuguuuuaaacgacuuaugaguaagagauagcauuuucuaguguuuuugcacuauaaugccacuuuuugaacucuugugacaaauguagauuugacucuuaaaaauuaagccuuucguauacugggcccucauaagcuuugcacaauuuuuucccaaaaaauagccacaauuaauaguaauuugaagcuauaucaacgguuggauugaaauugucaugaguguuaauauuauauacacucuucaacuagguacaguuuuauuucaccauagagaaguuuuaaggaaauuauguaucaaguguucauguuaagugguuucauuuuucaauuauaaaauaaagggaaaaaaucagaauuugcuuaucuuuuauaaagauuuuagacguuaaacuaaguuucuguugacagu
